United States Patent 8,541,208 (PROCESS FOR THE PRODUCTION OF FINE CHEMICALS) - sequence listing, part 2

SEQ ID NO: 1632 - protein, 363 aa, Caenorhabditis elegans
MRRFYIFLLLIPYINGTINDDSLPMVITTWGSDGFKKATKNAVDATLLGGRMFGLVEGLSTCEALQCDTTVGYGGSPDENGETCLDSLVIDADGMRVGAVANLHRIRDAARVAWGVMNFTKHTLLVGESATQFAKTLGFKEEDLSTEETKSWISKWKTEKCQPNFWKNVSPDPSSSCGPYKTNPLTKSMRYYSLVNQSDEAGYLVEKTNHDTIGMVVRDTENIFSAGTSSNGARFKIPGRVGDSPIPGAGAYANKFGGAAATGDGDVMMRFLPSFFAVTQMELGTKPSKAAYKAITRILKVFPKFSGAVVAMNVKGRIGASCANINKFGYNVAFQNGTVVTYSISCLKEVNSLKYLKEGIEFA

SEQ ID NO: 1633 - DNA, 957 bp, Vibrio vulnificus (strain YJ016)
  CDS (1)..(957)
atgagtagagccacgatgaacaagcctttttccattgccattcacggtggtgccggcaccattttacgcagccagatgagcgatgagctcaaagaggccattttgtccgatttacaacacgcggtcagagcggggtatcaattacttgagcaaggagccgatgcattggatgcggtggtggctgcggtcaaagtgttagaagactcgccgaatttcaatgcaggaaaaggttcggtgctgactcacaatgaaatggtggagatggatgcctctgtgatgcacggacgagagctcaaagcgggggccgttgctggggttcgccatatcaaaaaccccatagaactggcgcgtgatgtgatgcaaaacagtgctcatgtcctgctcatcggggaaggggcggagaaatttgcttttgagcaaggtcaccagtacaccgaacaggattatttctttactgaccgacgctatgagcaactgctctcgatgcgtgaaaaaggcctgtttgcgttgtcggaagccaaatatcccgacgacaaaaaacatggcacggtgggtgcggtggcgctggatcagcaaggcaatcttgcggccgctaccagtacgggcggtgtcaccaataaaaaatatggccgcgttggcgattctgcgctgattggctgtggcaccgtggcggaaaatggcgtggtggcggtgtcgaccactggcgtgggcgagttctttattcgtaagcgtgtggccgaagatgttgcggcgcgaatgcgctatctcaacgaagatgtgcatacggcgtgtgagcagattattcacggagagctaaagagcatgggtggagaaggcggtttaattgcggttgatgcacagggagacattcactttgccatgaacagctccggtatgtatcgagcggccatcaatacccaaggcgagctttgcgtgaaaatctacgctgacgaataa

SEQ ID NO: 1634 - protein, 318 aa, Vibrio vulnificus (strain YJ016)
MSRATMNKPFSIAIHGGAGTILRSQMSDELKEAILSDLQHAVRAGYQLLEQGADALDAVVAAVKVLEDSPNFNAGKGSVLTHNEMVEMDASVMHGRELKAGAVAGVRHIKNPIELARDVMQNSAHVLLIGEGAEKFAFEQGHQYTEQDYFFTDRRYEQLLSMREKGLFALSEAKYPDDKKHGTVGAVALDQQGNLAAATSTGGVTNKKYGRVGDSALIGCGTVAENGVVAVSTTGVGEFFIRKRVAEDVAARMRYLNEDVHTACEQIIHGELKSMGGEGGLIAVDAQGDIHFAMNSSGMYRAAINTQGELCVKIYADE

SEQ ID NO: 1635 - DNA, 864 bp, Gloeobacter violaceus
  CDS (1)..(864)
atgccacggccaggactgattattcatggtggacttggggcgaccgaggcggagcaatcgagccgacaggtgcgccgcgaggcgctgcaggagattctcaaagacgcccatgaggtgctcaaaaacggcggtgcccgccaggcggtggtgcgcgcctgtgaactcctcgaagattgcccgctctttaacgcgggtaccggcgccaccatccagcgcgacggccagattcgcctcagttgcgcgctgatggacggtcgggagcaccgcttcagcggcctggtcaacgcccgttacctcaaaaacccgattcgcctggccgagcagctgcaaaaccgcgtcgaccggcttctcgatccgcagggtgccgagctattggcccgcgccctcggagaagcggtgcacgaaccggccttaccggaggtgatccggcgctgggcggacgagcgcttcgaggggcagtacgcgggcacccacggcacggtgggggcggcggcggtggacggcgaaggcgggcttgccgccgctacttccacgggcggtcgcttcatggccggggtggggcgggtgagcgattcgtgcacaccggcgggcaactacgccaccgaccgctgcgcggtgagctgcaccggccacggcgaggacatcctcgacgaagcgctcgccgcgcgcatcgccatccgggtggacgacgggatgagccttcagcgagctttcgagcgctccttcgccgaggccgaatcgcgcgggcgcgactttgccgccatcgccgtcgacagcgacggccatacatgctggtcggtcaccatgggcatcctggtggcggcgtacttcgatggcaagggagagtttcgggcgacattctga

SEQ ID NO: 1636 - protein, 287 aa, Gloeobacter violaceus
MPRPGLIIHGGLGATEAEQSSRQVRREALQEILKDAHEVLKNGGARQAVVRACELLEDCPLFNAGTGATIQRDGQIRLSCALMDGREHRFSGLVNARYLKNPIRLAEQLQNRVDRLLDPQGAELLARALGEAVHEPALPEVIRRWADERFEGQYAGTHGTVGAAAVDGEGGLAAATSTGGRFMAGVGRVSDSCTPAGNYATDRCAVSCTGHGEDILDEALAARIAIRVDDGMSLQRAFERSFAEAESRGRDFAAIAVDSDGHTCWSVTMGILVAAYFDGKGEFRATF

SEQ ID NO: 1637 - DNA, 936 bp, Chromobacterium violaceum
  CDS (1)..(936)
atgaccatcgccctcgccttgcacggcggcgccggcaccctgcgccgcagcgacatggacgccgaattggagcgcgcctaccgcgccggcctggaacaggcgctggaggccggccacgcggtgctgcgcggcggcggcgcggcgctggatgcggtgtgcgcggcggtctgcgcgctggaggacgatccactgttcaacgccggccgcggctcggtgttcaatctggacggcaaacaggaaatggaagcggcggtgatggacggcatccgccaggacgccggcagcgtagccggcctttccggcgtgcgcaacccggtgctgctggcgcgcgcggtgatggagcgcacaccccacgtgacgctggggtatgcggcggcggaagatttcgcccgccgggcaggattggaaatgcggccgccggaatacttccacaccgacaagcgctggcaggcgctgctggcggaaaaggagaggctggccaacggcggctcggacgaggacatctccgaagaccgcaagcacggcaccgtcggcgcggtggcgctggacgcgcaaggccggctggcggccgccacctccaccggcggccgcaccgccaagtggccaggccgcatcggcgacacgccggtgatcggcgccggcacctgggccgacgcctattgcgcggtgtcggccaccggccacggcgaatacttcgtccgcgccgccgccgggcacgagatctcggcccggatccgccacctggacgaaaccgtggcccaggcttgcgacgccgtggtctacggccagctgctgaccatgggcggcaccggcggcgtcgtcgccgtcgaccgctacggccgggtggcgttgccgttcaactgcgagggcatgtaccgcgcggcgatagacggcgcgggcttacgcaccgtcgccatctaccgcggcgaagactag

SEQ ID NO: 1638 - protein, 311 aa, Chromobacterium violaceum
MTIALALHGGAGTLRRSDMDAELERAYRAGLEQALEAGHAVLRGGGAALDAVCAAVCALEDDPLFNAGRGSVFNLDGKQEMEAAVMDGIRQDAGSVAGLSGVRNPVLLARAVMERTPHVTLGYAAAEDFARRAGLEMRPPEYFHTDKRWQALLAEKERLANGGSDEDISEDRKHGTVGAVALDAQGRLAAATSTGGRTAKWPGRIGDTPVIGAGTWADAYCAVSATGHGEYFVRAAAGHEISARIRHLDETVAQACDAVVYGQLLTMGGTGGVVAVDRYGRVALPFNCEGMYRAAIDGAGLRTVAIYRGED

SEQ ID NO: 1639 - DNA, 1416 bp, Rhodopirellula baltica
  CDS (1)..(1416)
atgaattttaagacaacgatccttgctgcggccgttgcgtttgcgtttgtcgccccccgaacaatccaaagtaaagagcctgccatgaagaccaaatgggccattgtgattcatggtggagccggcagctcaccggctcaacttggcgacgcatcgagtaagcaacgcaccaaaggtctgcaacacgcgttgcaaaccggtcgcgatatgctggcggacggcgcgacggccatggacacggttgaagccgtgattcgaaccttggaagacgatccaatcttcaacgctggacgaggttcagttgtgacgaacgagggacgcgtcgagatggattcatcggtgatggatggcaagacactcgcgtgtggcgcagttgctggggtgacacgggtcaagaacccgatctcactcgcacgccgggtgatgacagagacgaaacacgtgctgctggttggtcccggtgccgacgagttcgcggaaactcagcaagtgcctctcgtcgatccgaaatactttctgtcccaacgcgatggcgatgacgcatccagcattgcttcggcaactcaggatgaagacgaatcgcatcttggaaccgtcggctgcgtcgtgctggattcccacggcaacctcgcggctggaaccagcaccggaggcacagcaaacaaactgccaggtcgagtcggtgattcacccatcgttggggcgggcacctacgcggccaatggattgtgcgccgtttcaggaaccggcgttggcgaagagtacatccgcaacagtgtcgcgtatgacatcgccgcgcaaatgcggtacgcgaatcagtcgctcgagtcagcagtcaccgacatcatgctgaatcgactcgatccgggtgttggcggattgattgctgtctctcagcaaggcgagatcgtgatgcagcacaacacccctggcatgagctgcgcagcagccgacagcaccggacgtttcgaaacgcacttgattctcgacaacggtggagcaccggcggaagcgacaaccaaatcaaacccatccgcatccgacgaatcaaagatcagggaactgattcagcaacaggccagcgattggaatgcgggcaacattgacgctttcatgaaggtctattggaagagcgatcaactcacgttctcctccggtggtgacgtgacacgcggattcgacgcgacattgcagcgatacaaagaacgctaccccacttcggaaaagatgggaaagctcactttcacagacctggaattccttccgctgggtaactccgccatgcaagtcctcggcgtttggaaacttgatcgaatggagccgatggagggcaagttcacgctcgttttccgacgcttccccgaaggttggaagatcgtccacgaccacacctcaaagtcccccgactcgcaatag

SEQ ID NO: 1640 - protein, 471 aa, Rhodopirellula baltica
MNFKTTILAAAVAFAFVAPRTIQSKEPAMKTKWAIVIHGGAGSSPAQLGDASSKQRTKGLQHALQTGRDMLADGATAMDTVEAVIRTLEDDPIFNAGRGSVVTNEGRVEMDSSVMDGKTLACGAVAGVTRVKNPISLARRVMTETKHVLLVGPGADEFAETQQVPLVDPKYFLSQRDGDDASSIASATQDEDESHLGTVGCVVLDSHGNLAAGTSTGGTANKLPGRVGDSPIVGAGTYAANGLCAVSGTGVGEEYIRNSVAYDIAAQMRYANQSLESAVTDIMLNRLDPGVGGLIAVSQQGEIVMQHNTPGMSCAAADSTGRFETHLILDNGGAPAEATTKSNPSASDESKIRELIQQQASDWNAGNIDAFMKVYWKSDQLTFSSGGDVTRGFDATLQRYKERYPTSEKMGKLTFTDLEFLPLGNSAMQVLGVWKLDRMEPMEGKFTLVFRRFPEGWKIVHDHTSKSPDSQ

SEQ ID NO: 1641 - DNA, 981 bp, Bordetella pertussis
  CDS (1)..(981)
atgacgcagcccatcatcgccattcatggcggggccggcgcgatatcgcgcgcggccatgccggccgacaaggaaaaggaatacctggacgccctggcgcgcatcgtcgccgccggccaggcggtgctggccggcggcggcagcgccatcgacgcggtcaccgaggccgtgcgcctgctggaggattgcccgctgttcaacgccggccacggcgcggtgttcacgagcgccggtacccatgagctggacgcggccatcatggacggggccacgctgcgttcgggagccattgctaatgtggattgcgtgcgcaaccccgtgcgggccgcgcgcgcggtcatggagcacagcaagcatgtgttcttcgtcggcgagggggcggtcgccctcgcgcgcgagcacgggctggagctggtcgatcccggctatttctccaccgaggcgcggcgcgagcaactgttgcgggtgcagcgcgaaacgcccggggcggccgtgctggaccacgacggccaggccctggtgacgcaaggccagccggcccccgccgacccgctggatgccgacaggaaattcggcacggtgggcgcggtggcgctggacgcgcagggcaacctggccgcggcgacctccaccggcggcatcaccaacaagcaggtcgggcgcgtgggcgacgcgccgctgatcggcgcgggcacgtatgccagcaaccggacctgtgccgtttccaccacgggaaccggagaaatgttcatccgcatggtcgccgcgtacgacgtggcggcccagatggagtattgcggcgccacgctggcgcaggcggccgaccgggtggtgcacgacaagctgcccaccatcgaaggcaagggcggcctggtcgccgtcgacgcccatggcaacgtggccctgccgttcaataccgagggcatgtaccgcggccatggccgcgtgggcgagccgccggtggtcgccatttaccgatag

SEQ ID NO: 1642 - protein, 326 aa, Bordetella pertussis
MTQPIIAIHGGAGAISRAAMPADKEKEYLDALARIVAAGQAVLAGGGSAIDAVTEAVRLLEDCPLFNAGHGAVFTSAGTHELDAAIMDGATLRSGAIANVDCVRNPVRAARAVMEHSKHVFFVGEGAVALAREHGLELVDPGYFSTEARREQLLRVQRETPGAAVLDHDGQALVTQGQPAPADPLDADRKFGTVGAVALDAQGNLAAATSTGGITNKQVGRVGDAPLIGAGTYASNRTCAVSTTGTGEMFIRMVAAYDVAAQMEYCGATLAQAADRVVHDKLPTIEGKGGLVAVDAHGNVALPFNTEGMYRGHGRVGEPPVVAIYR

SEQ ID NO: 1643 - DNA, 981 bp, Bordetella parapertussis
  CDS (1)..(981)
atgacgcagcccatcatcgccattcatggcggggccggcgcgatatcgcgcgcggccatgccggccgacaaggaaaaggaatacctggacgccctggcgcgcatcgtcgccgccggccaggcggtgctggccggcggcggcagcgccatcgacgcggtcaccgaggccgtgcgcctgctggaagactgcccgctgttcaacgccggccacggcgcggtgttcacgagcgccggtacccatgagctggacgcggccatcatggacggggccacgctgcgttcgggagccattgccaatgtggattgcgtgcgcaaccccgtgcgggccgcgcgcgcggtcatggagcacagcaagcatgtgctcttcgtcggcgagggggcggtcgccttcgcgcgcgagcacgggctggagctggtcgatcccggctatttctccaccgaggcgcggcgcgagcaactgttgcgggtgcagcgcgaaacgcccggggcggctgtgctggaccacgacggccaggccctggtgacgcaaggccagccggcccccgccgacccgctggatgccgacaggaaattcggcacggtgggcgcggtggcgctggacgcgcagggcaacctggccgcggcgacctccaccggcggcatcaccaacaagcaggtcgggcgcgtgggcgacgcgccgctgatcggcgcgggcacgtatgccagcaaccggacctgtgccgtttccaccacgggaaccggagaaatgttcattcgcatggtcgctgcgtacgacgtggcggcccagatggagtattgcggcgccacgctggcgcaggcggccgaccgggtggtgcacgacaagctgcccaccatcgaaggcaagggcggcctggtcgccgtcgacgcccatggcaacgtggccctgccgttcaataccgagggcatgtaccgcggccatggccgcgtgggcgagccgccggtggtcgccatttaccgatag

SEQ ID NO: 1644 - protein, 326 aa, Bordetella parapertussis
MTQPIIAIHGGAGAISRAAMPADKEKEYLDALARIVAAGQAVLAGGGSAIDAVTEAVRLLEDCPLFNAGHGAVFTSAGTHELDAAIMDGATLRSGAIANVDCVRNPVRAARAVMEHSKHVLFVGEGAVAFAREHGLELVDPGYFSTEARREQLLRVQRETPGAAVLDHDGQALVTQGQPAPADPLDADRKFGTVGAVALDAQGNLAAATSTGGITNKQVGRVGDAPLIGAGTYASNRTCAVSTTGTGEMFIRMVAAYDVAAQMEYCGATLAQAADRVVHDKLPTIEGKGGLVAVDAHGNVALPFNTEGMYRGHGRVGEPPVVAIYR

SEQ ID NO: 1645 - DNA, 981 bp, Bordetella bronchiseptica (Alcaligenes bronchisepticus)
  CDS (1)..(981)
atgacgcagcccatcatcgccattcatggcggggccggcgcgatatcgcgcgcggccatgccggccgacaaggaaaaggaatacctggacgccctggcgcgcatcgtcgccgccggccaggcggtgctggccggcggcggcagcgccatcgacgcggtcaccgaggccgtgcgcctgctggaggactgcccgctgttcaacgccggccacggcgcggtgttcacgagcgccggtacccatgagctggacgcggccatcatggacggggccacgctgcgttcgggagccattgccaatgtggattgcgtgcgcaaccccgtgcgggccgcgcgcgcggtcatggagcacagcaagcatgtgttcttcgtcggcgagggggcggtcgccttcgcgcgcgagcacgggctggagctggtcgatcccggctatttctccaccgaggcgcggcgcgagcaactgttgcgggtgcagcgcgaaacgcccggggcggccgtgctggaccacgacggccaggccctggtgacgcaaggccagccggcccccgccgacccgctggatgccgacaggaaattcggcacggtgggcgcggtggcgctggacgcgcagggcaacctggccgcggcgacctccaccggcggcatcaccaacaagcaggtcgggcgcgtgggcgacgcgccgctgatcggcgcgggcacgtatgccagcaaccggacctgtgccgtttccaccacgggaaccggagaaatgttcatccgcatggtcgccgcgtacgacgtggcggcccagatggagtattgcggcgccacgctggcgcaggcggccgaccgggtggtgcacgccaagctgcccaccatcgaaggcaagggcggcctggtcgccgtcgacgcccatggcaacgtggccctgccgttcaataccgagggcatgtaccgcggccatggccgcgtgggcgagccgccggtggtcgccatttaccgataa

SEQ ID NO: 1646 - protein, 326 aa, Bordetella bronchiseptica (Alcaligenes bronchisepticus)
MTQPIIAIHGGAGAISRAAMPADKEKEYLDALARIVAAGQAVLAGGGSAIDAVTEAVRLLEDCPLFNAGHGAVFTSAGTHELDAAIMDGATLRSGAIANVDCVRNPVRAARAVMEHSKHVFFVGEGAVAFAREHGLELVDPGYFSTEARREQLLRVQRETPGAAVLDHDGQALVTQGQPAPADPLDADRKFGTVGAVALDAQGNLAAATSTGGITNKQVGRVGDAPLIGAGTYASNRTCAVSTTGTGEMFIRMVAAYDVAAQMEYCGATLAQAADRVVHAKLPTIEGKGGLVAVDAHGNVALPFNTEGMYRGHGRVGEPPVVAIYR

SEQ ID NO: 1647 - DNA, 1341 bp, Oryza sativa (Rice)
  CDS (1)..(1341)
atggccggcggcgatggcggcggcggcgggggagacgagagcgagtttgtgggggtaggcggcggcggaggaggaggaggagaaggagaagggaaccagagcccccccaaccgtaggttcttcgtggccgtgcacgtcggcgccggcttccacgcgccggcgaacgagaaggcgtaccgccgagccatgaagcgcgcttgcctcgccgccgccgcagtgctccgcgagggaaatggcacaagccttgatgcggttgcagctgccattcaagtattggaggatgatcccatcacaaatgctggacgcggttcaaatttgactgagagtggtcatgtggaatgcgatgcaagtatcatggatggttctactactacctttggagctgttggagctgtgcaaggtgtaaagaatcccatccaaattgctttgcacttggcaagggaacagatggtaggaccttcactgcttggtcggataccccctatctttttggttggtgaaggagcatgccagtgggcaaaatcgaaggggttgaacctacctgaagccacatcagagggaaatagttggttggtgactgagagtgcaaaagcacagtggggaaaatacagatcattgcttgcaagtgccaaggaatcagttaatcatagcactggttctggttcagaatctagttcagtacagttggaagcaccaggagctgaagctgaggatattactggtgtaaagaagatgaagatgatcacacgatcaatcatggaggatgatcaagactgcgtgatggatactgttggtgctgtttgtgttgatgcttatggaaatatagcatcaggagcatccagtggtggcattgcactaaaggtagatggacgggttggtttggctgctatgtatgggtctgggtgctgggcctcatccaaagggccctttggcacaccgtttatagttgggtgttgtgcaactggagccggtgaacacttgattagaggatttgctgcacgtgaatgttgtatctcatcatcattgatacaatctggccctgcttctgcttgtaccaaagttctgcgccaagcggttcaaagcagcagcgagatgtctcatgatacaggcgctgggttgttgctaattcaggctgatgttctaaacgtgagaagggaggtatctgcattgggagccgctgaacttgttgctgcctattcctccccttcatttggtgttggttatctcggaagctatatgaacagtcctaaggttgcaatgcttagatcttcaaaagctgcacccaatacgataaaccattttgctactcgtgtcaactttgacgcacaatctgaccaatga

SEQ ID NO: 1648 - protein, 446 aa, Oryza sativa (Rice)
MAGGDGGGGGGDESEFVGVGGGGGGGGEGEGNQSPPNRRFFVAVHVGAGFHAPANEKAYRRAMKRACLAAAAVLREGNGTSLDAVAAAIQVLEDDPITNAGRGSNLTESGHVECDASIMDGSTTTFGAVGAVQGVKNPIQIALHLAREQMVGPSLLGRIPPIFLVGEGACQWAKSKGLNLPEATSEGNSWLVTESAKAQWGKYRSLLASAKESVNHSTGSGSESSSVQLEAPGAEAEDITGVKKMKMITRSIMEDDQDCVMDTVGAVCVDAYGNIASGASSGGIALKVDGRVGLAAMYGSGCWASSKGPFGTPFIVGCCATGAGEHLIRGFAARECCISSSLIQSGPASACTKVLRQAVQSSSEMSHDTGAGLLLIQADVLNVRREVSALGAAELVAAYSSPSFGVGYLGSYMNSPKVAMLRSSKAAPNTINHFATRVNFDAQSDQ

SEQ ID NO: 1649 - DNA, 924 bp, Enterococcus faecalis (Streptococcus faecalis)
  CDS (1)..(924)
atggcacatgatgggttactaaaagctacagaagaattacaacaaggaggtgctgcaggcacggccgtggaacaattaattaaagaagtagaagactatcctttttataagtcagtgggctacggcggtttacctaatgaggaagggattttagaaatggatgctgcctatatggatggagacacatttgcaattggtgctgtggcgggaattacagatgttaaaaatccgatttcagtggctaaagcattaagtaaagagaagtttaatagttttcgtgttggcgcaggtgcaacgaaatattcaatgttgcacggttttgaaagaaagaatatgttgacagaacgcgctaatcaatggtggcaaaagcgtttaaaagaaattcaggaaaatcagttgaacccctatgatgggcatgatactgtcggcgctattacgttagaccaaacaggatcaatggcagctggcacttccagttcgggactcttcatgaaaaaagcaggacgtgttggcgattcaccactgtcaggttctggtttttatgttgatagcgaaattggtggtgctgcggctacaggcttaggtgaagatttaatgaaaggctgtctttcttatgaaatcgttcgtttaatgggggaagggcgctcgccacaacaagcatgtgatcaagccgtctatgcttttcatgaaaaattgacccaacgttatgggaaagcaggagctttttcactagtggccatgaacaaacagggagactggggcgtagctacgaatgtggaatttacttttacggttggtactgatatgcagcaaccagaaatctatattgcaaatccaggcaagaatcatactacagagattcagccgatttcacaagaatggttagcggcctatgaaaaaagaatcaaagcactaattgaataa

SEQ ID NO: 1650 - protein, 307 aa, Enterococcus faecalis (Streptococcus faecalis)
MAHDGLLKATEELQQGGAAGTAVEQLIKEVEDYPFYKSVGYGGLPNEEGILEMDAAYMDGDTFAIGAVAGITDVKNPISVAKALSKEKFNSFRVGAGATKYSMLHGFERKNMLTERANQWWQKRLKEIQENQLNPYDGHDTVGAITLDQTGSMAAGTSSSGLFMKKAGRVGDSPLSGSGFYVDSEIGGAAATGLGEDLMKGCLSYEIVRLMGEGRSPQQACDQAVYAFHEKLTQRYGKAGAFSLVAMNKQGDWGVATNVEFTFTVGTDMQQPEIYIANPGKNHTTEIQPISQEWLAAYEKRIKALIE

SEQ ID NO: 1651 - DNA, 966 bp, Shigella flexneri
  CDS (1)..(966)
atgggcaaagcagtcattgcaattcatggtggcgcaggtgcaattagccgcgcgcagatgagtctgcaacaggaattacgctacatcgaggcgttgtctgccattgttgaaaccgggcagaaaatgctggaagccggcgaaagtgcgctggatgtggtgacggaagcggtgcgtctgctggaagagtgtccactgtttaacgccggaattggcgctgtctttacgcgtgatgaaacccatgaactggacgcctgtgtgatggatggtaacaccctgaaagccggtgcggtggcgggcgttagtcatctgcgtaatccggttcttgccgcccggctggtgatggagcaaagcccgcatgtgatgatgattggcgaaggggcagaaaattttgcgtttgctcatggcatggagcgcgtctcaccggagattttctccacgcctttgcgttatgaacaactactggcagcgcgcgaggaaggggcaacagtcctcgaccatagcggtgcgccactggatgaaaaacagaaaatgggcaccgtgggggccgtggcgttggatttagacggcaatctggcggcagccacgtccacaggcggaatgaccaataaattacccggacgagttggcgatagtcccttagtgggtgccggatgctacgccaataacgccagtgtggcggtttcttgtaccggcacaggcgaagtcttcatccgcgcgctggcggcatatgacatcgccgcgttaatggattacggcggattaagtctcgcggaagcctgcgagcgggtagtaatggaaaaactccctgcgcttggcggtagcggtggcttaatcgctatcgaccatgaagggaatgtcgcgctaccgtttaacaccgaaggaatgtatcgcgcctggggctacgcaggcgatacgccaaccaccggtatctaccgtgaaaaaggggacaccgttgccacacagtga

SEQ ID NO: 1652 - protein, 321 aa, Shigella flexneri
MGKAVIAIHGGAGAISRAQMSLQQELRYIEALSAIVETGQKMLEAGESALDVVTEAVRLLEECPLFNAGIGAVFTRDETHELDACVMDGNTLKAGAVAGVSHLRNPVLAARLVMEQSPHVMMIGEGAENFAFAHGMERVSPEIFSTPLRYEQLLAAREEGATVLDHSGAPLDEKQKMGTVGAVALDLDGNLAAATSTGGMTNKLPGRVGDSPLVGAGCYANNASVAVSCTGTGEVFIRALAAYDIAALMDYGGLSLAEACERVVMEKLPALGGSGGLIAIDHEGNVALPFNTEGMYRAWGYAGDTPTTGIYREKGDTVATQ

SEQ ID NO: 1653 - DNA, 1010 bp, Glycine max (Soybean)
  CDS (7)..(984)
gtgattatgggcggttgggctatagctgtgcatggtggcgctggtgtcgaccctaatctcccactcgagcgccaagaagaagcgaaacaacttctcacgcgctgtctcaatcttggaatctctgctctaaattctaatcttcccgccatagatgtcgtcgaacttgtggtgagggaattggaaacggatccgctgttcaattcgggccgtggatctgccctgacagaaaaaggaacggtggagatggaggctagcatcatggatggtccaaaacgacgatgcggcgccgtttcgggtcttaccaccgttaagaacccgatctcgcttgctcgtttggttatggacaaatccccgcattcctacctcgccttctccggcgccgaagaatttgctagacaacagggtgtggaggttgtggacaacgagtactttatcacacctgacaacgttggcatgctcaagctggcaaaggaagcgaacacaatcctgtttgattaccgaatcccaacatcggggtacgagacgtgcggatccggtgtggagagtccactgcaaatgaatggactcccaataagcgtgtacgcgcccgaaaccgttgggtgcgtggtggttgaccgggagggccggtgcgcggcagcaacatccacgggagggctgatgaacaaaatgaccgggcgcatcggtgattcgccgctgataggcgccgggacctacgcgtgcgacgtgtgcggcgtatcgtgcacgggtgaaggcgaggccatcatacgttggctggcgcgtgaggtggcagcggtgatggaatacaaaggcttgaagcttcaagaagccgtggattttgtgatcaagcaccgtctcgatgaagggatggctggtctcattgctgtgtccaacgctggggaagtggcttatggtttcaattgcaatggcatgtttaggggctgtgccactgaaaatggcttcatggaggttggaatctgggaataggttcatttatttggttcatggttgtt

SEQ ID NO: 1654 - protein, 325 aa, Glycine max (Soybean)
MGGWAIAVHGGAGVDPNLPLERQEEAKQLLTRCLNLGISALNSNLPAIDVVELVVRELETDPLFNSGRGSALTEKGTVEMEASIMDGPKRRCGAVSGLTTVKNPISLARLVMDKSPHSYLAFSGAEEFARQQGVEVVDNEYFITPDNVGMLKLAKEANTILFDYRIPTSGYETCGSGVESPLQMNGLPISVYAPETVGCVVVDREGRCAAATSTGGLMNKMTGRIGDSPLIGAGTYACDVCGVSCTGEGEAIIRWLAREVAAVMEYKGLKLQEAVDFVIKHRLDEGMAGLIAVSNAGEVAYGFNCNGMFRGCATENGFMEVGIWE

SEQ ID NO: 1655 - DNA, 927 bp, Oryza sativa (japonica cultivar-group)
  CDS (1)..(927)
atggggtgggcggtcgcgctgcacggcggcgccggggacatcccgcgctcgctgccgcccgaccgcagggagccccgcctcgccacgctccgccgctgcctcgacctcgccaccgccgcgctccgttccggccgcgctgccctcgacgtcgtcgagctcgtcgtgagggagctggagaactgcccgcactacaacgccggcgtgggctccgtgctcaccgccgacggcaccgtcgagatggaggccgccgtcatggacggcaacaccttgcgctgcggcgccgtctccggactctccaccgtcgtcaacgccgtctccctcgccaggctcgtcatggagaagacgccgcacatctacctcgccttcgatggcgccgaggccttcgccagggagcagggagtggagactaaagatccaagccactttattacggaggcaaacaaagagaggctcagacaagcaaaagaagccaacagggtgcaggtactgtcacaccgggtcggcacggtgggctgcgtggccatcgactccgccggcaacctcgcgacggcgacgtccaccggcgggctggtgaacaagatggccggcaggatcggcgacacgccggtgatcggcgccgggacgtacgccaacgcgctgtgcgccgtgtcggccacgggcgtgggcgaggccatcatccggcacacggtggcgcgcgacgtcgcggccctgctggagcacgccccgccggccggcctctccctgggggacgccgccgcgcgcgtcgtggccggcgtgccgccgggcaaggtcgggctggtggccgtgtcggccgccggcgaggtggccatggcgtacaacaccaccggcatgttcagggcgtgcgccacggagggcggccgccacgaggtggccatctggcctgacgacgctgatggtgctaattga

SEQ ID NO: 1656 - protein, 308 aa, Oryza sativa (japonica cultivar-group)
MGWAVALHGGAGDIPRSLPPDRREPRLATLRRCLDLATAALRSGRAALDVVELVVRELENCPHYNAGVGSVLTADGTVEMEAAVMDGNTLRCGAVSGLSTVVNAVSLARLVMEKTPHIYLAFDGAEAFAREQGVETKDPSHFITEANKERLRQAKEANRVQVLSHRVGTVGCVAIDSAGNLATATSTGGLVNKMAGRIGDTPVIGAGTYANALCAVSATGVGEAIIRHTVARDVAALLEHAPPAGLSLGDAAARVVAGVPPGKVGLVAVSAAGEVAMAYNTTGMFRACATEGGRHEVAIWPDDADGAN

SEQ ID NO: 1657 - DNA, 942 bp, Vibrio parahaemolyticus
  CDS (1)..(942)
atgacgaaaccgttctcaattgccattcacggcggagcaggcaccattttgcgtgaacaaatgagtgatgaacttcagcaatccatcttggcagacttagaagctgcggtaaaagcaggacaccaaatactcgaacaaggcggagaagcgcttgatgcggtggtcgctgcggtaaaagtactggaagactctcccaactttaatgcgggtaaaggctcggttcttactcacaacgaaatggtagaaatggatgcctctgtgatggatggtcgcaaccttgccgcaggtgctgtcgcgggcgttagacacattaaaaacccgatcgagctggctcgggatgtgatgcttcgcagcaaccatgtgttgttggttggtgaaggtgctgagaagtttgcttttgaacaaggccatcaatacaccgaacaagattacttcttcacagatcgccgttatgaacagctgctctcaatgcgtgagaaaggtttgtttgcgttatctgagtctcgttacccggatgatcgtaaacacggcaccgtaggcgcagtggcgttagaccagcaaggcaacttagctgcggcgaccagtacgggtggggtaaccaataagcaatatggtcgtgttggagattctgcactgataggttgtggcacggtggctgagaatggcgtggtggcagtttcaactacgggtgttggtgagttctttattcgtaaacgtgttgcggaagatgtagcagcacgcatgcgctatttgcaagaggacgtacataccgcgtgtgaagccattattcagggagatctcaaaaccatgggcggagaaggtggcctgattgccattgatgcgaatggggagttgcatttcgctatgaacagtacggggatgtatcgtgcgggtatcaatactcgcggtgagttgagtgtgaaaatctacgctaacgactaa

SEQ ID NO: 1658 - protein, 313 aa, Vibrio parahaemolyticus
MTKPFSIAIHGGAGTILREQMSDELQQSILADLEAAVKAGHQILEQGGEALDAVVAAVKVLEDSPNFNAGKGSVLTHNEMVEMDASVMDGRNLAAGAVAGVRHIKNPIELARDVMLRSNHVLLVGEGAEKFAFEQGHQYTEQDYFFTDRRYEQLLSMREKGLFALSESRYPDDRKHGTVGAVALDQQGNLAAATSTGGVTNKQYGRVGDSALIGCGTVAENGVVAVSTTGVGEFFIRKRVAEDVAARMRYLQEDVHTACEAIIQGDLKTMGGEGGLIAIDANGELHFAMNSTGMYRAGINTRGELSVKIYAND

SEQ ID NO: 1659 - DNA, 981 bp, Mus musculus (Mouse)
  CDS (1)..(981)
atggcgtgcgcccgcggcaccgtggcgccgccagtccgagcctccatcgatgtgagtctcgtggtggtagtccatggtggcggagcaagcaacatctcagccaaccggaaagagctggtgcgcgagggcatcgccagagcggcaaccgagggctacaaaatcctcaaggcgggagggagcgcggtagatgctgtggaaggagccgtgactgtcctggaaaacgacccagagttcaacgcaggttatgggtctgtcctgaatgtaaacggtgatattgagatggatgctagtatcatggatgggaaggacctgtctgcaggtgcagtgtctgccgtgcgctgtatcgcaaatcccgttaaacttgcacggcttgttatggaaaagacacctcattgctttctgactggccatggtgcagagaaatttgcagaagacatggggattccacaggtccctgtagaaaaactgataactgagagaaccaagaagcacctggagaaagagaagcttgagaagggagcacagaatgctgactgccctaaaaactcaggaactgtgggtgctgttgccttggactgcagaggaaacttggcttacgcaacctctactggggggattgtcaataaaatggttggccgagttggagactcgccttgcataggagctggaggttacgcagataataaccttggagccgtttcaaccacaggacatggggaaagtatcctgaaggtgaatctggccagacttgccctcttccatgtagagcaaggaaagaccgtagaggaggctgctcagttggcattggattacatgaagtcaaaactcaaaggtctaggtggcctcatcttggtcaacaaaacaggagactgggtggcaaagtggacctctgcctccatgccctgggcagcggtgaagaatggcaagctgcaggccggcattgacctctgtgagaccaggacaagggacctaccttgctag

SEQ ID NO: 1660 - protein, 326 aa, Mus musculus (Mouse)
MACARGTVAPPVRASIDVSLVVVVHGGGASNISANRKELVREGIARAATEGYKILKAGGSAVDAVEGAVTVLENDPEFNAGYGSVLNVNGDIEMDASIMDGKDLSAGAVSAVRCIANPVKLARLVMEKTPHCFLTGHGAEKFAEDMGIPQVPVEKLITERTKKHLEKEKLEKGAQNADCPKNSGTVGAVALDCRGNLAYATSTGGIVNKMVGRVGDSPCIGAGGYADNNLGAVSTTGHGESILKVNLARLALFHVEQGKTVEEAAQLALDYMKSKLKGLGGLILVNKTGDWVAKWTSASMPWAAVKNGKLQAGIDLCETRTRDLPC

SEQ ID NO: 1661 - DNA, 966 bp, Escherichia coli O6
  CDS (1)..(966)
atgggcaaagcagtcattgcaattcatggtggcgcaggtgcaattagccgcgcgcagatgagtctgcaacaggaattacgctacatcgaggcgttgtctgccattgttgaaaccgggcagaaaatgctggtagcgggcgaaagtgcgctggatgtggtgacggaagcggtgcgtctgctggaagagtgtccactgtttaacgccggaattggcgctgtctttacgcgtgatgaaacccatgaactggacgcctgtgtgatggatggtaacaccctgaaagccggtgcggtggcgggcgttagtcatctgcgtaatccggttcttgccgcccgactggtgatggagcaaagcccgcatgtgatgatgattggcgaaggggcagaaaattttgcgtttgctcatggcatggagtgcgtctcgccggagattttctccacacctttgcgttatgaacaactaatggcagcgcgcgaggaaggggcaacagtcctcgaccatagcggtgcgccactggatgaaaaacaaaaaatgggcaccgtaggggccgtggcgttggatttagacggcaatctggcggcagccacgtccacgggcggaatgaccaataaattacccggacgagttggcgatagtcccttagtgggggccggatgctatgccaataacgccagtgtggcggtttcctgtaccggtacgggcgaagtcttcatccgcgcgctggcggcatatgatatcgccgcgttaatggattacggcggattaagtctcgcggaagcctgcgagcgggtagtaatggaaaaactccctgcgcttggcggtagcggtggcttaatcgctatcgaccatgaagggaatgtcgcgctaccgtttaacaccgaaggaatgtatcgcgcctggggctacgcaggcgatacgccaaccaccggtatctaccgtgaaaaaggggacaccgttgccacacagtga

SEQ ID NO: 1662 - protein, 321 aa, Escherichia coli O6
MGKAVIAIHGGAGAISRAQMSLQQELRYIEALSAIVETGQKMLVAGESALDVVTEAVRLLEECPLFNAGIGAVFTRDETHELDACVMDGNTLKAGAVAGVSHLRNPVLAARLVMEQSPHVMMIGEGAENFAFAHGMECVSPEIFSTPLRYEQLMAAREEGATVLDHSGAPLDEKQKMGTVGAVALDLDGNLAAATSTGGMTNKLPGRVGDSPLVGAGCYANNASVAVSCTGTGEVFIRALAAYDIAALMDYGGLSLAEACERVVMEKLPALGGSGGLIAIDHEGNVALPFNTEGMYRAWGYAGDTPTTGIYREKGDTVATQ

SEQ ID NO: 1663 - DNA, 933 bp, Bifidobacterium longum
  CDS (1)..(933)
atgaccacatcctccgtttcgccggtgaccactgaactggcgggcagcgaaaccggcatcacgcttatcattcacgccggagcgggcagtcgtggcaagcacagcacgcctgaacgcatcgcccaggtcgaacttgatctgcagcgcgccctcgatgccggataccagttgttggaatccggagcaccggcgcatgaggctgtggtcgccgccatccacgtcatggaagacgctcccgaattcaacgccggccgtggtgccgccctgaccagcgatggcatcgcccagatggacgcctgcctgatgaccggcgatggcgaggtcggtgcggtcaccggcgtaagcaccgtgaagaacccgatcgatgcggcgcgtgccgtcaaagagcagaccaagcatgtgctgttcgcggacccgaccgatgcagaaatcgccgattggggcgtcgcgaccgaaagcaacgagtacttcatcaccgaacagcgtcgtcagtccttggccgaggctcagtccggtggcgatgagtgggagaagcatggcaccatcggcgccgtggcgcgcgatgccgaaggcaatatcgccgccggcacgtccactggcggcatcaccaaccagatgcacggtcgtgtaggcgattcgccgctgcccggttgcggcacgttcgccaaccagtccacggtggcggtgtcctgcaccggcatcggcgaggcattcatcaaggtggtcgccgcccatcaggtgtcggatcgtgtgcgtttcgccggcgagaacgtcgaagatgccgcgacggccactttggacgaagtcgccgcgcatcatggcgatggtggcatgatcgttctgccggcggtcggccgtggcgtggtcgcctacaacagcgagatgatgaacttcggataccgtagcgcgcaaggcggtaaggtgcagggctga

SEQ ID NO: 1664 - protein, 310 aa, Bifidobacterium longum
MTTSSVSPVTTELAGSETGITLIIHAGAGSRGKHSTPERIAQVELDLQRALDAGYQLLESGAPAHEAVVAAIHVMEDAPEFNAGRGAALTSDGIAQMDACLMTGDGEVGAVTGVSTVKNPIDAARAVKEQTKHVLFADPTDAEIADWGVATESNEYFITEQRRQSLAEAQSGGDEWEKHGTIGAVARDAEGNIAAGTSTGGITNQMHGRVGDSPLPGCGTFANQSTVAVSCTGIGEAFIKVVAAHQVSDRVRFAGENVEDAATATLDEVAAHHGDGGMIVLPAVGRGVVAYNSEMMNFGYRSAQGGKVQG

SEQ ID NO: 1665 - DNA, 957 bp, Vibrio vulnificus
  CDS (1)..(957)
atgagtagagccacgatgaacaagcctttttccattgccattcacggtggtgccggcaccattttacgcagccagatgagcgatgagctcaaagaggccattttgtccgatttacaacacgcggtcagagcggggtatcaattacttgagcaaggagccgatgcattggatgcggtggtggctgcggccaaagtgttggaagactcgccgaatttcaatgcaggaaaaggttcggtgctgactcacaatgaaatggtggagatggatgcctctgtgatgcatggacgagagctcaaagcgggggccgttgctggggttcgccatatcaaaaaccccatagagctggcgcgtgatgtgatgcaaaacagtgctcatgtcctactcattggggaaggggcggagaaatttgcttttgagcaaggccagcagtacaccgaacaggattatttctttactgaccgacgctatgagcaactgctctcgatgcgtgaaaaaggcttgtttgcgttgtcggaagccaaatatcccgatgataaaaaacatggcacggtgggtgcggtggcgctggatcagcaaggcaatcttgcggccgctaccagtacgggcggtgtcaccaataaaaaatatggccgcgttggcgattctgcgctgattggctgtggcaccgtggcaaaaaatggcgtggtggcggtgtcgacgactggcgtgggcgagttctttattcgtaagcgtgtggccgaagatgttgcggcgcggatgcgctatctcaacgaagatgtgcatacggcgtgtgagcagattattcacggagagctgaagagcatgggtggcgaaggcggtttaattgcggttgatgcgcagggggacattcactttgccatgaacagttccggtatgtatcgagcggccatcaatacccaaggcgagctttgcgtgaaaatctacgctgacgaataa

SEQ ID NO: 1666 - protein, 318 aa, Vibrio vulnificus
MSRATMNKPFSIAIHGGAGTILRSQMSDELKEAILSDLQHAVRAGYQLLEQGADALDAVVAAAKVLEDSPNFNAGKGSVLTHNEMVEMDASVMHGRELKAGAVAGVRHIKNPIELARDVMQNSAHVLLIGEGAEKFAFEQGQQYTEQDYFFTDRRYEQLLSMREKGLFALSEAKYPDDKKHGTVGAVALDQQGNLAAATSTGGVTNKKYGRVGDSALIGCGTVAKNGVVAVSTTGVGEFFIRKRVAEDVAARMRYLNEDVHTACEQIIHGELKSMGGEGGLIAVDAQGDIHFAMNSSGMYRAAINTQGELCVKIYADE

SEQ ID NO: 1667 - DNA, 927 bp, Synechococcus elongatus (Thermosynechococcus elongatus)
  CDS (1)..(927)
atgccccaacccactgttattctccatggcggcgctggcagttcactccaagacaaaggtggtctcattcctgtccgccaatccctccatggcattgttacccaagtggttcaggccctcaaagaaggggcaacggcgattgaggcagtggttttggggtgtcggctcctagaggatgaaccgcgctttaatgccggcacaggctcggtgctgcagtccgatgggcagattcgcatgagcgcctctctaatggatgggcagcggcagtgctttagtggtgtcatcaacgtctcgcgggtaaaaaatcccattgatctggcccactggctacaacagtgccccgatcgcgttctgtcggatgtgggggcagcagagttggcccgtgaattgcagctgcctgtgtatcaacccctaacggatcagcgactctacgagtggctcgaggaacgcaagggcaatttctcaaaatcaatggcgagggtggtggccgaaggggcaagacggggcacggttggtgtggtggttttagatcagcagggacacttggctgtggggacttccactggcggcaaaggttttgagcgtattgggcgggtgagtgactctgcaaccccagcgggaaactatgccaacagcttagcagcggtcagttgtacaggcattggtgaagacattctcgatgaggcgctggccgcgcggattgtggtgcgagtaaccgatggcctgtccctagaggcggcctttgaaaaatccttccgggaagctgcccgtcggcaacgggattttggcgccattggcttggatcgtcagggggcgatcgcctggggtaagacctgtgatgttctccttgcggcctactggaatggcacggccattggcgataccttggagttaccaccggggctacaggtgggcagtcaaaaataa

SEQ ID NO: 1668 - protein, 308 aa, Synechococcus elongatus (Thermosynechococcus elongatus)
MPQPTVILHGGAGSSLQDKGGLIPVRQSLHGIVTQVVQALKEGATAIEAVVLGCRLLEDEPRFNAGTGSVLQSDGQIRMSASLMDGQRQCFSGVINVSRVKNPIDLAHWLQQCPDRVLSDVGAAELARELQLPVYQPLTDQRLYEWLEERKGNFSKSMARVVAEGARRGTVGVVVLDQQGHLAVGTSTGGKGFERIGRVSDSATPAGNYANSLAAVSCTGIGEDILDEALAARIVVRVTDGLSLEAAFEKSFREAARRQRDFGAIGLDRQGAIAWGKTCDVLLAAYWNGTAIGDTLELPPGLQVGSQK

SEQ ID NO: 1669 - DNA, 981 bp, Shewanella oneidensis
  CDS (1)..(981)
atgtcacaaaatacccacgctaatgaaaaaccttttgcgattgcgatccacggtggggcgggcacgatttctaaagcgaatctcacgcctgagctgcgccaagcctataaagacaaactaaaagaagccgttgataaaggctcaaaggtactcgaacagggaggcgatagtttagttgctgtgcaaactgccattaatgtattggaaaatagcccattgtttaatgcaggcgtggggtcggtttatacctatgatggcggccatgaactggatgcttcaatcatggatggtaaaaccatgaacgcgggtgctgttgcgggtgtgcgccatatcgctaaccctatcgatttagccttagccgtgatgaataagtccgagcatgtgatgttatcgggcgcgggcgcagaagagtttgcgctgacccaagggtttaccttagtggcaaacagtcattttgatagcgatgcccgttatcagcagttactcgacgcgagacaaaaactgcaggctgctcaaaagtctgagcaaattgcgggcattgagatgaacgatcttgattataaatttggtaccgttggcgcagttgctttagataaaaacggtaacttagcggcgggaacctccacaggtgggatgacggctaagcgctttggccgaatcggggattcacccgtgattggggcgggaacctacgctgagaacggtgtttgcgccgtctctgctacgggccacggcgagttctttattcgttaccaagtggctggcgatatttgcgctagggtgaaataccaacaaaaatctattcttcaggcagcggatgaggtgattaatcagcgtcttatcactgctggtggttcaggcggagtgattgcggttgaccatcgaggaaatattgcaacgccgtttaataccgaagggatgtaccgcgcaagccgcagcaatggtgaacctgctcaggtgatgatttggcaggatcaataa

SEQ ID NO: 1670 - protein, 326 aa, Shewanella oneidensis
MSQNTHANEKPFAIAIHGGAGTISKANLTPELRQAYKDKLKEAVDKGSKVLEQGGDSLVAVQTAINVLENSPLFNAGVGSVYTYDGGHELDASIMDGKTMNAGAVAGVRHIANPIDLALAVMNKSEHVMLSGAGAEEFALTQGFTLVANSHFDSDARYQQLLDARQKLQAAQKSEQIAGIEMNDLDYKFGTVGAVALDKNGNLAAGTSTGGMTAKRFGRIGDSPVIGAGTYAENGVCAVSATGHGEFFIRYQVAGDICARVKYQQKSILQAADEVINQRLITAGGSGGVIAVDHRGNIATPFNTEGMYRASRSNGEPAQVMIWQDQ

SEQ ID NO: 1671 - DNA, 1258 bp, Glycine max (Soybean)
  CDS (57)..(1037)
cacacaaaaactcagggtagggcagagagagagagagagagagagagagagagagaatgggagggtgggctatcgcggtgcatggtggcgctggtgtcgaccctaatctcccactcgagcaccaagaagaagcgaaacaacttctcacgcgctgtctcaatcttggaatctctgctctaaattctaatcttcccgccatagatgtcgtcgaacttgtggtgagggaattggaaacggatccgctgttcaattcgggccgtggatctgccctgacagaaaaaggaacggtggagatggaggctagcatcatggatggtccaaaacgacgatgcggcgccgtttcgggtcttaccaccgttaagaacccgatctcgcttgctcgtttggttatggacaaatccccgcattcctacctcgccttttccggcgccgaagaatttgctaggcaacagggtgtggaggttgtggacaacgagtactttatcacacctgacaacgttggcatgctcaagctggcaaaggaagcaaacacaatcctgtttgattaccgaatcccaacatcggggtacgaaacgtgcggatccggtgtggagagtccactgcaaatgaatggactcccaataagcgtgtacgcgcccgaacccgttgggggcgtggtggttgaccggaagggccggtgcgcggcagcaacatccacgggagggctgatgaacaaaatgaccgggcgcatcggtgattcgccgctgataggcgccgggacctacgcgtgcgacgtgtgcggcgtatcgtgcacgggtgaaggcgaggccatcatacgtggcacgctggcgcgtgaggtggcagcggtgatggaatacaaaggcttgaagcttcaagaagccgtggattttgtgatcaagcaccgtctcgatgaagggatggctggtctcattgctgtgtccaacgctggggaagtggcttatggtttcaattgcaatggcatgtttaggggctgtgccactgaaaatggcttcatggaggtcggaatctgggaatagcttcattattttccttcatggttgtttcgatgcaacttttggatttctgtaccatgttccactgtagtgtagggtctttctgctggtgcccgatttagataaaaaatggtaaccttgtttctaagaattagaaaaaaatgtgaaataataatatggtaactttgttgtctttctcttaaataaagacttgtggtagaccctcaacaaacccgtgtacttta

SEQ ID NO: 1672 - protein, 326 aa, Glycine max (Soybean)
MGGWAIAVHGGAGVDPNLPLEHQEEAKQLLTRCLNLGISALNSNLPAIDVVELVVRELETDPLFNSGRGSALTEKGTVEMEASIMDGPKRRCGAVSGLTTVKNPISLARLVMDKSPHSYLAFSGAEEFARQQGVEVVDNEYFITPDNVGMLKLAKEANTILFDYRIPTSGYETCGSGVESPLQMNGLPISVYAPEPVGGVVVDRKGRCAAATSTGGLMNKMTGRIGDSPLIGAGTYACDVCGVSCTGEGEAIIRGTLAREVAAVMEYKGLKLQEAVDFVIKHRLDEGMAGLIAVSNAGEVAYGFNCNGMFRGCATENGFMEVGIWE

SEQ ID NO: 1673 - DNA, 1301 bp, Drosophila melanogaster (Fruit fly)
  CDS (42)..(1223)
tgatacaccaagacttctcgtagagaccattacgattaaccatgagaaggcacttgcgggcaagtctttggatcctttgtttggccaccatggcgttttccatccttgcggcagtaaatacttcgcccaaaccaacgctgacttcggcgtttagtggaaaagctggcaccactgccgtgaaggcgaataagacgacgggtgagctgctgcccatggtcattaacacttggaacttcacggctgccaatgtgctcgcctggcgaatcctgaagcaaagcaagggtggactccggcagacgcggaatgcggtagtggagggctgctcgaagtgtgagaaactccagtgtgaccgaacggtgggctatggcggatcgccggacgagttgggcgaaaccacactggatgccatggtcatggacggggccaccatggatgtgggggcagtggctggtctgcgacgcattaaggatgccattaaggtagcccggcatgttctggaacacacgcagcacaccatgctggtgggtgatgcggcgtcagctttcgccaatgctatgggattcgaatcagagtcgctggtcacgccggagtcgaaggacatgtggttacagtggacggctgagaactgccagccaaacttctggaagaacgttcacccggatcccaaggtctcttgcggcccgtataagccgcggccgactccgctgacccgctggaaggaggaccgtgcccgcaatgagtatgagatcggacgcaagaaccacgataccatcggcatgatcgccatcgacgtggaaagcaacatccacgccggcacctccaccaacggggcgcggcacaagattcccggacgggtcggcgactcccccattccgggtgctggcgcttatgcagacaacgaggtgggtgcagccgtggcaaccggagatggagatgtgatgatgcgcttcctgccctccctgctagcggtggagaccatgcgggcgggaaaacctccggctgaggcagctcaagagggccttcgccgcattctcaagcaccacaaggatttcatgggtgctctcatcgccgtagatcggctgggtaattatggcgctgcctgctacggcctggccgaattcccctttatggttagcagtccagccggagcggatgggcctacgcgcttggaaacggtcaaatgcataggtggtcaggacaaagtaaatatcgtggcgttgtgaggtggcgaaaactgtaacgtatttcaataaaatttaaatttcgtggagttctcatctgcaaaaaaaaaaaaaaaaaaa

SEQ ID NO: 1674 - protein, 393 aa, Drosophila melanogaster (Fruit fly)
MRRHLRASLWILCLATMAFSILAAVNTSPKPTLTSAFSGKAGTTAVKANKTTGELLPMVINTWNFTAANVLAWRILKQSKGGLRQTRNAVVEGCSKCEKLQCDRTVGYGGSPDELGETTLDAMVMDGATMDVGAVAGLRRIKDAIKVARHVLEHTQHTMLVGDAASAFANAMGFESESLVTPESKDMWLQWTAENCQPNFWKNVHPDPKVSCGPYKPRPTPLTRWKEDRARNEYEIGRKNHDTIGMIAIDVESNIHAGTSTNGARHKIPGRVGDSPIPGAGAYADNEVGAAVATGDGDVMMRFLPSLLAVETMRAGKPPAEAAQEGLRRILKHHKDFMGALIAVDRLGNYGAACYGLAEFPFMVSSPAGADGPTRLETVKCIGGQDKVNIVAL

SEQ ID NO: 1675 - DNA, 927 bp, Homo sapiens (Human)
  CDS (1)..(927)
atgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtaacctacgcaacctccacaggcggtatcgttaataaaatggtcggccgcgttggggactcaccgtgtctaggagctggaggttatgccgacaatgacatcggagccgtctcaaccacagggcatggggaaagcatcctgaaggtgaacctggctagactcaccctgttccacatagaacaaggaaagacggtagaagaggctgcggacctatcgttgggttatatgaagtcaagggttaaaggtttaggtggcctcatcgtggttagcaaaacaggagactgggtggcaaagtggacctccacctccatgccctgggcagccgccaaggacggcaagctgcactttggaattgatcctgacgatactactatcaccgaccttccctaa

SEQ ID NO: 1676 - protein, 308 aa, Homo sapiens (Human)
MNPIVVVHGGGAGPISKDRKERVHQGMVRAATVGYGILREGGSAVDAVEGAVVALEDDPEFNAGCGSVLNTNGEVEMDASIMDGKDLSAGAVSAVQCIANPIKLARLVMEKTPHCFLTDQGAAQFAAAMGVPEIPGEKLVTERNKKRLEKEKHEKGAQKTDCQKNLGTVGAVALDCKGNVTYATSTGGIVNKMVGRVGDSPCLGAGGYADNDIGAVSTTGHGESILKVNLARLTLFHIEQGKTVEEAADLSLGYMKSRVKGLGGLIVVSKTGDWVAKWTSTSMPWAAAKDGKLHFGIDPDDTTITDLP

SEQ ID NO: 1677 - DNA, 951 bp, Xanthomonas campestris (pv. campestris)
  CDS (1)..(951)
atgccggtcctgcccgctggcgcgccgcgggtgatctccacctgggatttcggcatcgccgccaatcaggcggcctgggacattctgaaagccggcggcaaggcgctggatgcggtggaagcgggcgtgcgcgtgcccgaggccgatgccagcaatcccaccgtgggcctgggtggctatccggatcgcgacgggcgggtgaccctggatgcctgcatcatggatcacctcggcaattgcggggcggtggcttcgctggaagatgtggtgcacgccatctccgtggcgcgcgcggtgatggaaaaaacaccgcacgtgatgctggtgggcgatggtgcgcggcagttcgcgcttgagcaggggttcccaaagaccaagctgctgacgcccagttcggaggcggcgtggaaggagtggttgaagacgtccaagtattcgcccgaagccaatatcgagaaccgcgcctggcgcgatgccaagctgccgggtggcaaggacaaccacgacaccatcggcatgctggcactcgatgcgcacggcaatctgtccggcgcgtgcaccaccagtggcatggcgtggaagatgcacggccgggtcggcgacagcccgatcatcggtgcgggcctgtatgtggacaacgacgtgggcggcgccacctccaccggtgtgggcgaagaagtgatccgcaatgtcggcagctttgcggtggtggaaatgatgcgccagggcaagtcgccggcagatgcctgccgcgaggtggtgatgcggctggtgcggcgcaagcccgagctcacgcgcacgttgcaggtgggctttctggcgatgaacaaacgcggcgaggtcggcgcgttcgcgatccagaagggtttcagctacgcggtctgcgatgcgcagcggcaggacctgctggtgcccggtgagagccactaccgcaacgagcccgccgcatga

SEQ ID NO: 1678 - protein, 316 aa, Xanthomonas campestris (pv. campestris)
MPVLPAGAPRVISTWDFGIAANQAAWDILKAGGKALDAVEAGVRVPEADASNPTVGLGGYPDRDGRVTLDACIMDHLGNCGAVASLEDVVHAISVARAVMEKTPHVMLVGDGARQFALEQGFPKTKLLTPSSEAAWKEWLKTSKYSPEANIENRAWRDAKLPGGKDNHDTIGMLALDAHGNLSGACTTSGMAWKMHGRVGDSPIIGAGLYVDNDVGGATSTGVGEEVIRNVGSFAVVEMMRQGKSPADACREVVMRLVRRKPELTRTLQVGFLAMNKRGEVGAFAIQKGFSYAVCDAQRQDLLVPGESHYRNEPAA

SEQ ID NO: 1679 - DNA, 936 bp, Xanthomonas campestris (pv. campestris)
  CDS (1)..(936)
atgctggtgatccacggcggcgccggtgtggagaaatccagcctgtcgccggaggaacaagcgcaggcacgcgaggcgatgcagcgcgcgctgcgtgctggccatgcggtgttgacgcgcggcggtagcgcggtggatgcggtggccgccaccatcaccgtgctggaggatgcgccgcaattcaacgccgggcgcggtgcggtgttcacccacgatggcaagaacgaactcgatgccgccatcatggatggtgccagcggcaaggccggcgcgatcgctggcgtgcacacggtcaagaacccgatcctgttggcgcgcagtgtcatggaccgctccaagcatgtgatgctggtcggcgacggcgccgagcagttcgcgcgcgagcagggcatcgcgttggtcgatcccagctatttccgtaccgacaagcgttggcagcaactgcaaaaagcgctcaaggccgaggccggtgaccgccaggcccaagccgaactggatctggaaaccgccaagcacttcggtaccgtgggcgcgttggcgctggaccgcgacggccatctggccgccggtacctccaccggcggcatgaccaacaagcgctacggccgcgtgggcgacgcgccgatcatcggcgccggtacctatgccaacacccagtgcgcggtgtccggcaccggctggggcgagttctatatacgtgcggtggccgcctacgacatctgcgcgcgtatgaaatatgccgggcaatcgctgcaacaggcggccgaggcagtcatcgatcagcagattcccaaggccggcggcgacggtggcgcaattgcgctggatgcgcagggcaatgccgcatttccgttcaataccgagggcatgtaccgcggctggatcggtgccgatggcactgcgcatgtggcgatcttcaaggacgaggcgctgtaa

SEQ ID NO: 1680 - protein, 311 aa, Xanthomonas campestris (pv. campestris)
MLVIHGGAGVEKSSLSPEEQAQAREAMQRALRAGHAVLTRGGSAVDAVAATITVLEDAPQFNAGRGAVFTHDGKNELDAAIMDGASGKAGAIAGVHTVKNPILLARSVMDRSKHVMLVGDGAEQFAREQGIALVDPSYFRTDKRWQQLQKALKAEAGDRQAQAELDLETAKHFGTVGALALDRDGHLAAGTSTGGMTNKRYGRVGDAPIIGAGTYANTQCAVSGTGWGEFYIRAVAAYDICARMKYAGQSLQQAAEAVIDQQIPKAGGDGGAIALDAQGNAAFPFNTEGMYRGWIGADGTAHVAIFKDEAL

SEQ ID NO: 1681 - DNA, 957 bp, Xanthomonas axonopodis (pv. citri)
  CDS (1)..(957)
atgcggccgatggcggtgccgcgtggcgcggcgcgggtgatctccacctgggatttcggcgtcgccgccaatcaggaagcctggaagattctcagcagcggcggtattgcgctggatgcggtggaggccggcgtgcgtgtgccggaagcggacccgaacaatcccaccgtcggcctgggcggttatccggaccgcgatggccgggtaacgctggacgcctgcatcatggatcacctgggcaattgtggcgcggtggcatcgctggaagacgtggtgcacgccatttcggtggcacgtgcggtgatggagaaaaccccgcacgtgatgttggtgggcgacggcgcgcgtcaattcgccttcgaacagggttttccgaaaaccaagctgttgactccaagctcggaagcggcctggaaagagtggttgaagagctccaagtattcgcccgaagccaatgtcgaaaatcgcgcctggcgagatgccaagttgcccggcggcaaggacaatcacgacaccatcggcatgctggcgctggatacgcacggcaatctatccggtgcatgcaccaccagcggcatggcgtggaagatgcacggccgcgtgggcgacagcccgatcatcggcgcgggcctgtacgtggacaacgacgtgggcggggcgacctcgacgggtgtgggcgaggaggtgatccgcaacgtcggcagttttgcggtggtggaaatgatgcggcagggcaaatcgcccgccgatgcctgccgcgaggtggtgatgcggctgatccgtcgcaagccggagctgacgcgcacattgcaggtcggctttctggcaatgaacaagcgcggcgaagtgggagcgttcgcgatccagaagggcttcagttacgcggtgtgcgacgcgcagcggcaggatctgctggtgcctggcgagagccattacaccagcgagccggcagcatga

SEQ ID NO: 1682 - protein, 318 aa, Xanthomonas axonopodis (pv. citri)
MRPMAVPRGAARVISTWDFGVAANQEAWKILSSGGIALDAVEAGVRVPEADPNNPTVGLGGYPDRDGRVTLDACIMDHLGNCGAVASLEDVVHAISVARAVMEKTPHVMLVGDGARQFAFEQGFPKTKLLTPSSEAAWKEWLKSSKYSPEANVENRAWRDAKLPGGKDNHDTIGMLALDTHGNLSGACTTSGMAWKMHGRVGDSPIIGAGLYVDNDVGGATSTGVGEEVIRNVGSFAVVEMMRQGKSPADACREVVMRLIRRKPELTRTLQVGFLAMNKRGEVGAFAIQKGFSYAVCDAQRQDLLVPGESHYTSEPAA

SEQ ID NO: 1683 - DNA, 936 bp, Xanthomonas axonopodis (pv. citri)
  CDS (1)..(936)
atgctggtcatccatggtggcgcgggcgtggagaaatccagcctttctaaggacgagcaggcgcaggcgcgcgaggcgatgcaacgcgcactgcgtgccgggcacgcggtgctgcaacgtggcggcagtgcagtggatgcagtggccgccaccatcaccgtgctggaggatgcgccgcagttcaacgctggccgcggtgcggtgtttacccatgacggcaggaacgaactggacgcggccatcatggatggcgccagcggcaaggccggtgcgattaccggcgtgcacacggtcaagaacccgatcctgctggcacgcagcgtgatggaccgctccaagcacgtgatgctggtcggcgacggcgctgaagcgttcgcgcgcgagcagggcatcaccctggtagacccggcctatttccgcaccgacaagcgctggcagcaactgcagaaagcgctcaaggccgaggccggcgaccgccaggcgcaggccgagctggatctggagaccgccaagcatttcggcaccgtcggcgcgctggcgctggaccgcgacggccatctggctgccggtacctccaccggcggcatgaccaacaagcgctatggccgggtcggcgatgcacccatcatcggggccggcacctatgccaacagccaatgcgcggtgtccggcaccggctggggcgagttctacatccgcgccgtggctgcctacgacatctgtgcgcgcatgaaatacgccgggcaatcgctgcagcaggccgccgagaccgtgatcgaccagcagatcccgaaggccggcggggacggcggcgccatcgcgctggatgcacagggcaacctggcgtttccattcaataccgagggcatgtaccgcggctggatcggcgccgacggcaccgcgcatgtggcgattttcaaggacgagacgttgtaa

SEQ ID NO: 1684 - protein, 311 aa, Xanthomonas axonopodis (pv. citri)
MLVIHGGAGVEKSSLSKDEQAQAREAMQRALRAGHAVLQRGGSAVDAVAATITVLEDAPQFNAGRGAVFTHDGRNELDAAIMDGASGKAGAITGVHTVKNPILLARSVMDRSKHVMLVGDGAEAFAREQGITLVDPAYFRTDKRWQQLQKALKAEAGDRQAQAELDLETAKHFGTVGALALDRDGHLAAGTSTGGMTNKRYGRVGDAPIIGAGTYANSQCAVSGTGWGEFYIRAVAAYDICARMKYAGQSLQQAAETVIDQQIPKAGGDGGAIALDAQGNLAFPFNTEGMYRGWIGADGTAHVAIFKDETL

SEQ ID NO: 1685 - DNA, 2168 bp, Rattus norvegicus (Rat)
  CDS (61)..(1062)
ggcacgaggcggttgcggccgcagcggtttgctgcccagtgtcttggccagtttgacatcatggcgaccgcccgcccctcttcgtgcggccgcgactcagtcccggcgacaccccgagcctccatcgatgtgagtctcgtggtggtagtccatggtggtggagcaagcaacatctcacccggccggaaagaactggtgagcgagggcattgccaaagctgcaactgagggctataacatcctcaaggctggagggagcgcagtagatgctgtggaaggagccgtgactatgctggaaaatgacccggagttcaacgcaggttatgggtctgtcctgaatgcagatggtgatattgagatggatgctagtatcatggatgggaaggacctatctgcaggagcagtgtctgccgtgcgctgtatcgcaaatcctgttaaacttgcacggcttgttatggaaaagactcctcattgctttctgacgggccgtggtgcagagaaatttgcagcagacatggggattccacagactcctgccgaaaaactgataacggagagaaccaagaagcacctggagaaagagaagcttgagaagggggcgcagaaagctgactgccctaaaaactcaggaactgtaggtgctgttgccttggactgcaaagggaacttggcttatgcaacctctactggggggattgtcaataaaatggttggccgagttggagactcaccttgcataggagctggaggttacgcagataataaccttggagccgtttcaaccacaggacatggggaaagtattctgaaggtgaatctggccagactcgccctcttccatgtagagcaaggaaagaccgtagatgaggctgctacgttggcactggattatatgaagtcaaagctcaaaggcctaggtggcctcatcttgatcaacaagacgggagactgggtggcaaagtggacctctgcctccatgccctgggcagcggtgaagaacggcaagctgcaggccggcattgacctttgcgaaaccaagacaaggaacctgcccacttgctagcctggatgtgaagtcaagctgcctgcagtggagacctaacttaatcaattagatgtagacatggaaaacttgtgcagtctgtccctccttttgttaccttgatcaataagtcaatgaatgcttggttgagggtcgggttctgaagggatgagaggtgactgcctgtatcaagagcagggaaaatggaagccttaaggaatctttctttcccagtctccgtcatgtaaggccagaaaggagctgttagatatggaccccacagaactgcctctgagctacgagtgtcatctggattgggaagatggcaatttgcagaggctaggctcagggagtgcaggaagaagggctggggaaaaaataaggtgtaagaaagaccaagtccaggtgaagctcaaatgctagagtttattcttagtcacgaggacaccgggcaagatggttgagaaagtgctctttgtctgtggatctttccaaaaagctcagatttctccaacacgtatctgggcacttgcagagtctcccttgctgcccaagctgtagactattggagtttgggggttgtgtttgttgttgttttttttttcttttctttttttttcggagctggggaccaaacccagggccttgcacttgctaggcaagcgctctaccactgagctaaatccccaacccgctggagtttcttaatgtctggaatttttcttggctcccaaaagccagccccacctgaaccagtcctggttgtcctcactgggccttgatagggcacatgacattcctagcctttccaacagtggggtggcagatggctggagaggtaacactgtgtgtcactaagaagtagcttctagtgctttgggacagtcccaagcacgctgaatcaaatgtccagggtggtgagcatgacgcagaagcagtctcctcagtggggagcactctgcacctgtcagcaccctgggaacggtatgtctgctgcggtgtgtctgctcagctttttagtctagcagagattccctgggaagaaactgatctcgtgccgaattcctgcagcccgggggatccactagttctagagcggccgccaccgcggggagctccagctaagg

SEQ ID NO: 1686 - protein, 333 aa, Rattus norvegicus (Rat)
MATARPSSCGRDSVPATPRASIDVSLVVVVHGGGASNISPGRKELVSEGIAKAATEGYNILKAGGSAVDAVEGAVTMLENDPEFNAGYGSVLNADGDIEMDASIMDGKDLSAGAVSAVRCIANPVKLARLVMEKTPHCFLTGRGAEKFAADMGIPQTPAEKLITERTKKHLEKEKLEKGAQKADCPKNSGTVGAVALDCKGNLAYATSTGGIVNKMVGRVGDSPCIGAGGYADNNLGAVSTTGHGESILKVNLARLALFHVEQGKTVDEAATLALDYMKSKLKGLGGLILINKTGDWVAKWTSASMPWAAVKNGKLQAGIDLCETKTRNLPTC

SEQ ID NO: 1687 - DNA, 963 bp, Ralstonia solanacearum (Pseudomonas solanacearum)
  CDS (1)..(963)
atgcccaccccgatcctcgccatccatggcggcgccggcaccattacccgggcggcgatggacgccgacaaggaagccgcctaccggcaggcgctcgacggcatcctgctggccggccagcgcattctggccggcggcggcagcgcgctcgacgccgtgaccgaagccgtgcgcctgctggaagcgtgcccgctgttcaatgccggcaaggggtccgtgctcacgcgcgcgggcacctacgagctggatgcctcgatcatggacggcaccacgctggccgccggcgcggtgacctgcgtcaagcgcctgcgccatcccgtgctggccgcgcgcgccgtgatggagcacagcgagcacgtgctgttcacctccgagggcgccgaggcgttcgccgcgtcgcagggactggagttcgtcgagccggactactactacaccgaggcgcgctacgcccagtggcagcgcgcccgccagcacgccggcatggcgctgctcgaccacgatgcggcatccctgctggcgcaggcgcccgagccgatcgatcccgacagcaagttcggcaccgtgggcgcggtcgcgtgcgatgcgcagggccggctggcggcggccacgtccaccggcggcgtcaccaacaagcaggtcggccgggtgggcgacacgccgctgatcggcgccggctgctacgccaaccgcgccgccgccgtgtcgtgcaccggcaccggggagatgttcatccgcgccgtggccgcctacgacgtggccgcgcagatggaatacgccggcaagccgctggccgaggcctgcgacgacgtggtgatgcgcaagctggtcgccatcggggggcgcggcgggctgatcgcggtggacgcgcacagcaacgtggcgctgccgttcaacaccgagggcatgtaccggggcttcgcgcgcggggatgccgcgcccgaggtctcgatttaccgatag

SEQ ID NO: 1688 - protein, 320 aa, Ralstonia solanacearum (Pseudomonas solanacearum)
MPTPILAIHGGAGTITRAAMDADKEAAYRQALDGILLAGQRILAGGGSALDAVTEAVRLLEACPLFNAGKGSVLTRAGTYELDASIMDGTTLAAGAVTCVKRLRHPVLAARAVMEHSEHVLFTSEGAEAFAASQGLEFVEPDYYYTEARYAQWQRARQHAGMALLDHDAASLLAQAPEPIDPDSKFGTVGAVACDAQGRLAAATSTGGVTNKQVGRVGDTPLIGAGCYANRAAAVSCTGTGEMFIRAVAAYDVAAQMEYAGKPLAEACDDVVMRKLVAIGGRGGLIAVDAHSNVALPFNTEGMYRGFARGDAAPEVSIYR

SEQ ID NO: 1689 - DNA, 900 bp, Pyrobaculum aerophilum
  CDS (1)..(900)
atgattgtcgcggtccacggcggagctggcctgtggagagtagaagagcgcatcaagcaggaggtcaaaaaggcgctggccgccgccattagcgagggccttctcgcggccgagagggggagcgccctagatgcagttgtggcggcggtggagtacatggagaaaagcggcctcttcaacgcgggctacggctctgtctacgccatagacggcagagtatatatggacgctggcgttatggacgggcgctctaaaagagcgggagccgtggcggccgtcgagggtgttaaaagcgccgtgaggctggctaggtacgtgttggaaaacacagaccacgtcattatatcgggagagggcgcccggctcctcgcggctaaaacaggccttttagaagcctcttataaattttacacagaggagaaaaacaagaggtttcaagaggtggtgcaagaggcgaggcggggcaattggcattataagagagtcgcggaatttttcggcgatactgtcggcgccgtggcgttggacagagacggcaatttagcagcggctacctccactgggggcgtttggctcaaatggccggggaggataggcgatagtccaataccgggggctgggttttgggctgaaaacggagtgggggccttcagcgctacaggcgtgggggaggtgattattatgtccgctctgtcgttaagagcccgcgacgagcttataaaaacaggcgatataggcgttgcagtagagaaggcgatagggttcgtgactgagtcgtacggcccaaatacggctgggataatagggattgactccaaggggaggcccgcctacgcctataacacaaaggcaatggcgagggggtggggaaaacgcggggagatttacgtagatctttag

SEQ ID NO: 1690 - protein, 299 aa, Pyrobaculum aerophilum
MIVAVHGGAGLWRVEERIKQEVKKALAAAISEGLLAAERGSALDAVVAAVEYMEKSGLFNAGYGSVYAIDGRVYMDAGVMDGRSKRAGAVAAVEGVKSAVRLARYVLENTDHVIISGEGARLLAAKTGLLEASYKFYTEEKNKRFQEVVQEARRGNWHYKRVAEFFGDTVGAVALDRDGNLAAATSTGGVWLKWPGRIGDSPIPGAGFWAENGVGAFSATGVGEVIIMSALSLRARDELIKTGDIGVAVEKAIGFVTESYGPNTAGIIGIDSKGRPAYAYNTKAMARGWGKRGEIYVDL

SEQ ID NO: 1691 - DNA, 816 bp, Sulfolobus tokodaii
  CDS (1)..(816)
atgaaatacacaaaacccgttttagttgtccatggaggagctggagattggagtaaaagagactatgaaaagggacttacagagatcaaaaaaacgttagaaaggggttatgaagaatttaaaaaaggtagtgctattgaagctgttgttgaggctatcgcatatatggaggactctggagtatttgatgctggtatagggagcgttaagaactctgaaggagaagtggaaatggatgctggaattatgcatggtaatagttggaaagtaggtgctgtggcttcggttaaggctaaaaatcccataaaagaagcactaaaagttatgcttgacggtagacatgtccttttagttggcgaaaggggtgaaaggtcgataaccaattttattggaaataacggtggagatactgtcggtgctgttgccttagacgaacaaggtaatttagtagctgggacaagtactggaggaatttctggcaaattaccaggtagagttggtgactccccaatacctggtgctggatactatgcaactcctagagttgcagtttcttctactggtattggtgaaattattcttaggattttaccggctaaagaagtagatatgttagtttccatgggtttctcaatagaggattctgttagggctgttatcaataagattactgaactatttggcaagagtaatgtaggcttaattgggatagattataaaggatatgctactgcttattataacactgttggaatggcaaggggagtaaaggataagaatatagttagagtctttgtttttgagggagaaatctaa

SEQ ID NO: 1692 - protein, 271 aa, Sulfolobus tokodaii
MKYTKPVLVVHGGAGDWSKRDYEKGLTEIKKTLERGYEEFKKGSAIEAVVEAIAYMEDSGVFDAGIGSVKNSEGEVEMDAGIMHGNSWKVGAVASVKAKNPIKEALKVMLDGRHVLLVGERGERSITNFIGNNGGDTVGAVALDEQGNLVAGTSTGGISGKLPGRVGDSPIPGAGYYATPRVAVSSTGIGEIILRILPAKEVDMLVSMGFSIEDSVRAVINKITELFGKSNVGLIGIDYKGYATAYYNTVGMARGVKDKNIVRVFVFEGEI

SEQ ID NO: 1693 - DNA, 825 bp, Thermoplasma volcanium
  CDS (1)..(825)
atgaggaacgtccttctcatccatggaggagctggatcggatccatcgtacagtggccgccttaactcctatgcgtcctttgcttctgaagagattagtgcgctggacaacgctgtaaaagcagttgtcaagatggaagatgacccagacttcaacgcaggcactggatctgtcccaaggttagatgggagcattcagatggatgccgctgtaatgatacccggccacttcggatcagttataaacatagaacgcgttaagaaccctgtacttgtagctagagatgtcatggcaaagtctccgcacattatgatatctggcgatggagctgtaaagtttgccaggctgatgggatatccagattatgatcctactacagagaaagcgaagaagctcctccagcagtttgaggaagaagccgagaaaaacgaaataccagataaattcaagatatactttaagtacgtgaagccccacgatacagttggggctgttgcccgtgtggaaggtgagttcgctggggcggtttcaacaggaggttcatttccaatggttcggggaagagttggtgattctccaatacctggtgctggaatatacgttggtgaaaaaggcgccgttgttgcgacaggcataggcgaggagatagcaaagaatattttatcgttccgcatatacaacagaattggtgaaaaaaggctttacgacattgtcaaagaagaagtagataagttcagcgtatcagtaggtataatagctgtggatgagaaagactatgcgtattatgctaacaggccgatggcagtaggaataaaggagttttga

SEQ ID NO: 1694 - protein, 274 aa, Thermoplasma volcanium
MRNVLLIHGGAGSDPSYSGRLNSYASFASEEISALDNAVKAVVKMEDDPDFNAGTGSVPRLDGSIQMDAAVMIPGHFGSVINIERVKNPVLVARDVMAKSPHIMISGDGAVKFARLMGYPDYDPTTEKAKKLLQQFEEEAEKNEIPDKFKIYFKYVKPHDTVGAVARVEGEFAGAVSTGGSFPMVRGRVGDSPIPGAGIYVGEKGAVVATGIGEEIAKNILSFRIYNRIGEKRLYDIVKEEVDKFSVSVGIIAVDEKDYAYYANRPMAVGIKEF

SEQ ID NO: 1695 - DNA, 1080 bp, Arabidopsis thaliana (Mouse-ear cress)
  CDS (1)..(1080)
atggcgagaagcgatgttttgatttttgtttctactcttcttctgtttctgtctctgcttacggtagctgatgcggaattggtgaaatctgacaagtttccggtagtggtgagtacttggcctttccttgaagctgttagagctgcttggagagcagttgataatgggagctctgcagtggaagctgttgttgaaggttgttctgcttgtgaagaacttcgttgtgacggtacagttgggcctggaggaagtccggatgagaatggtgagaccatgattgatgctttagtcatggatggggtgactatggaggttggagctgttgctgcaatgcggtatgttaaagacggtataagagctgcacatctagtgatgaaatactctcaacacacgttgcttgccggagaaggagcatcagcatttgcaatctccatgggtctccccggacccatgaacctaagctcccctgaatctgtaaagaagtggtcggactggaaagagaatcagtgtcaacccaatttcaggaagaatgtagtccccgcaaatgactgtggaccttacaagccaaacaatagtgctatgaatgtttttgtagacaaaagcactgaatcttgcgagatgggggcgattgagtataaacctcctcttgttggtcctcacaatcacgatacgatatcgatggctgtcattgacagaatggggcatatagctgttgggacatcgaccaatggagccacatataaaattcctggaagggttggtgatgggcctatcgtcggttcatcagcctacgctgatgatgaagtaggtggatgtggtgcaactggagatggtgacaccatgatgcgcttcctcccttgttaccaagttgtggagagcatgagacaaggaatgaaaccagaagaagctgctaaagatgcaatctcgagaatcgcaaggaagtttccagatttcgtgggagcagttgtggctgttgacaagaacggatctcacgcaggagcttgctatggctggacgtttcagtactcagtccaaaaccctgacatgaacgatgttcaagtctttacagttcttccatga

SEQ ID NO: 1696 - protein, 359 aa, Arabidopsis thaliana (Mouse-ear cress)
MARSDVLIFVSTLLLFLSLLTVADAELVKSDKFPVVVSTWPFLEAVRAAWRAVDNGSSAVEAVVEGCSACEELRCDGTVGPGGSPDENGETMIDALVMDGVTMEVGAVAAMRYVKDGIRAAHLVMKYSQHTLLAGEGASAFAISMGLPGPMNLSSPESVKKWSDWKENQCQPNFRKNVVPANDCGPYKPNNSAMNVFVDKSTESCEMGAIEYKPPLVGPHNHDTISMAVIDRMGHIAVGTSTNGATYKIPGRVGDGPIVGSSAYADDEVGGCGATGDGDTMMRFLPCYQVVESMRQGMKPEEAAKDAISRIARKFPDFVGAVVAVDKNGSHAGACYGWTFQYSVQNPDMNDVQVFTVLP

SEQ ID NO: 1697 - DNA, 1002 bp, Oryza sativa (Rice)
  CDS (1)..(1002)
atggcgaggtgggccattgcgatccacggcggcgccggggtggacccgaacctgccggagcacaggcaggaggaggcgaagcgcgtgctggcgcggtgcctgcaggtgggcgtggacgcgctgcgctccggcgcggcggcgctggacgtcgtggaggccgtggtgcgggagctggagagcgaccccttcttcaactccgggaggggctccgcgctcacccgcctcggcaccgtcgagatggaggccagcatcatggacggccgcggccgccgctgcggcgccgtctccggcgtctccaccgtcaagaaccccgtctccctcgcccgcctcgtcatggacaagtccccccactcctacctcgccttcgacggcgccgagcagttcgcgcgcgaccagggtctagaggtcgtcgacaacagctacttcatcaccgaggacaacgtcggcatgctgaagctcgccaaggaggccaacagcatcttgtttgactaccgtatcccgctgtccgggtcggagacgtgcggcgcacaggccgtgtcgtcggacaacagccacggcaacggcatggtgatgaacggcctccccatcagcatctacgcgccagagacggtggggtgcgcggtggtggactccagcggccacaccgcggcggccacgtccacgggcgggctgatgaataagatgacggggcgcgtcggcgactcgccgctgatcgggtcggggacctacgcgtgcggcgcgtgcgcggtgtcgtgcacgggggaaggcgaggccatcatccgctccacgctcgcgcgcgacgtcgccgccgtgatggagtacaggggcgccgggctgcaggaggccgtcgactactgcgtcaagaagcggctcgacgaagggttcgcggggctcatcgccgtgtccagcacgggcgaggtggcgtacgggttcaactgcaccggcatgttcagagggtgcgccaccgaggacggattcatggaggtcggcatctgggagtga

SEQ ID NO: 1698 - protein, 333 aa, Oryza sativa (Rice)
MARWAIAIHGGAGVDPNLPEHRQEEAKRVLARCLQVGVDALRSGAAALDVVEAVVRELESDPFFNSGRGSALTRLGTVEMEASIMDGRGRRCGAVSGVSTVKNPVSLARLVMDKSPHSYLAFDGAEQFARDQGLEVVDNSYFITEDNVGMLKLAKEANSILFDYRIPLSGSETCGAQAVSSDNSHGNGMVMNGLPISIYAPETVGCAVVDSSGHTAAATSTGGLMNKMTGRVGDSPLIGSGTYACGACAVSCTGEGEAIIRSTLARDVAAVMEYRGAGLQEAVDYCVKKRLDEGFAGLIAVSSTGEVAYGFNCTGMFRGCATEDGFMEVGIWE

SEQ ID NO: 1699 - DNA, 1002 bp, Hordeum vulgare (Barley)
  CDS (1)..(1002)
atggcgcgctgggccattgccatccacggcggcgcgggcgtggacccgaacctgccggagcacaggcaggaggaggccaagcgggtgctggcccggtgcctgcaggtgggcgtcgacctgctgcgcgccggcgccaccgcgctggacgtggtggaggccgtggtgcgggagctggagacggacccctgcttcaactcgggccgcggctccgcgctcacccgcgccggcaccgtcgagatggaggccagcatcatggacggccgcggccgccgctgcggcgccgtctccggcgtctccaccgttaaaaaccccgtctccctcgcccgccgcgtcatggacaggtccccgcactcctacctcgccttcgacggcgccgaggatttcgcccgcgagcagggtcttgaggttgtggacaacagctacttcatcacggaggagaacgtgggcatgctcaagctcgccaaggaggccaacagcatcctcttcgactaccgcatcccgctcgccggggccgacacctgcagcgcgcaggcggcggcgaccgagaaccacaacaacaacggcatggtgatgaacgggctgcccatcagcatctacgcgccggagacggtggggtgcgccgtggtggactgtaacggcttcacggcggcggccacctccacgggcgggctcatgaacaagatgacgggccgcatcggcgactcgccgctcatcggcgctggcacctacgcgtgcgggcactgcgccgtgtcgtgcacgggcgagggcgaggccatcatccgctccacgctggcgcgggacgtggccgccgtgatggaatcaaggggctgccttctgcaggaggccgtggacttctgcgtcaaggaacggctcgacgaagggttcgccgggctcatcgccgtgtccggcaccggcgaggtggcatacgggttcaactgcaccggcatgttcagaggctgcgccaccgaggacggattcatggaggtcggcatctgggagtga

SEQ ID NO: 1700 - protein, 333 aa, Hordeum vulgare (Barley)
MARWAIAIHGGAGVDPNLPEHRQEEAKRVLARCLQVGVDLLRAGATALDVVEAVVRELETDPCFNSGRGSALTRAGTVEMEASIMDGRGRRCGAVSGVSTVKNPVSLARRVMDRSPHSYLAFDGAEDFAREQGLEVVDNSYFITEENVGMLKLAKEANSILFDYRIPLAGADTCSAQAAATENHNNNGMVMNGLPISIYAPETVGCAVVDCNGFTAAATSTGGLMNKMTGRIGDSPLIGAGTYACGHCAVSCTGEGEAIIRSTLARDVAAVMESRGCLLQEAVDFCVKERLDEGFAGLIAVSGTGEVAYGFNCTGMFRGCATEDGFMEVGIWE

SEQ ID NO: 1701 - DNA, 825 bp, Thermoplasma acidophilum
  CDS (1)..(825)
atgaggaacgttcttctgatccacggtggcgtcggatccgatccatctttcaacggcaggctcaacggttatgcagagacggcatcagaggagctgagtgcgctggacaatgccgtcagggcagtcatcaagatggaggatgacccggacttcaacgctggcacaggatcggttccaaggatcgatggcagcatacagatggatgctgcggtaatgatacccgggcactttggatccgtaataaacattgagagggtcaagaatcccatactcgttgccagggacgtcatggcaaagtcaccacacataatgatgaccggcgacggagctgtcaagtttgcccggctcatgggctatcccgattacgaccccatgacggagaaggccaggaacctcctgaagaaattcgaagaagatgtggaaaagaacgaagtgcctgacaagttcaagatatacttcaagtacgtacgcgtgcacgacacggttggggcagttgcgcgcgttgagggtgagtttgccggtgccgtttccacaggtggatcattccccatgatgagaggacgagtcggtgattcgcccatacctggcgctggcatttatgtcggtgagagaggtgctgtggttgccaccggcgttggcgaggagatagccaagaacgtgctatctttccgcatatacagtagaataggtaccggaaagctctacgacataataaaagaggaggttgacaagttctccgttccagttggcatcatcgccatagatgaaaaggattatgcctattacgccaacaagccaatggctgtgggcataaaggagttctga

SEQ ID NO: 1702 - protein, 274 aa, Thermoplasma acidophilum
MRNVLLIHGGVGSDPSFNGRLNGYAETASEELSALDNAVRAVIKMEDDPDFNAGTGSVPRIDGSIQMDAAVMIPGHFGSVINIERVKNPILVARDVMAKSPHIMMTGDGAVKFARLMGYPDYDPMTEKARNLLKKFEEDVEKNEVPDKFKIYFKYVRVHDTVGAVARVEGEFAGAVSTGGSFPMMRGRVGDSPIPGAGIYVGERGAVVATGVGEEIAKNVLSFRIYSRIGTGKLYDIIKEEVDKFSVPVGIIAIDEKDYAYYANKPMAVGIKEF

SEQ ID NO: 1703 - DNA, 1201 bp, Arabidopsis thaliana (Mouse-ear cress)
  CDS (58)..(1035)
atcattctcggtttaactgtgaaacacataaataaaacaaagagaaagagagagaatatgggtgggtgggcaatcgcagtacacggtggtgccggtatcgaccctaatcttccggcggagagacaagaagaggctaaacagcttttaactcgttgtctcaacctcggcataatagctttgcgttccaatgtctccgccattgacgtcgttgagctcgtcattagagaattggagacggatcctctgtttaattcaggccgtggatctgctttgacggaaaaaggaacggttgagatggaagctagcattatggacggtacgaagagacgatgcggtgccgtttcggggataaccaccgtgaaaaatcctatatctcttgctcgtctcgtcatggacaaatctccccactcttaccttgctttctcaggtgcagaggatttcgcccgcaaacagggagttgaaattgtggacaacgagtactttgtcacggacgacaacgtaggaatgctcaagttggccaaggaagctaactccatcttgtttgattaccggattccgccgatgggatgtgccggtgcagctgcgaccgacagtccaatccaaatgaacggtcttccgatcagcatttacgcaccggagacagtcgggtgcgttgtggttgacgggaaaggacattgtgccgccgggacatccacgggtggtttaatgaacaagatgatgggaaggattggtgactcgccgctgataggagccgggacgtatgcgtcggagttttgtggtgtgtcgtgtaccggagaaggagaagccattataagagcaaccctagctcgtgatgtgtcagctgttatggagtataaaggacttaacctccaagaagcggttgattacgtcatcaagcatcgacttgacgaagggttcgctggactcattgctgtctcgaataaaggagaggtggtttgtggttttaactctaatgggatgttcaggggatgtgcaactgaggatggattcatggaggttgctatttgggagtgagaaatattttagattaagaaaatgtcttactagtatttaatcagtcatcgctctattaatttggttattcattatcataaagctggaggagtaaatttagttatgtcgttatcaccagtcctatattgatttgtgtttaatgcggtttcaaatggttagttcgtgt

SEQ ID NO: 1704 - protein, 325 aa, Arabidopsis thaliana (Mouse-ear cress)
MGGWAIAVHGGAGIDPNLPAERQEEAKQLLTRCLNLGIIALRSNVSAIDVVELVIRELETDPLFNSGRGSALTEKGTVEMEASIMDGTKRRCGAVSGITTVKNPISLARLVMDKSPHSYLAFSGAEDFARKQGVEIVDNEYFVTDDNVGMLKLAKEANSILFDYRIPPMGCAGAAATDSPIQMNGLPISIYAPETVGCVVVDGKGHCAAGTSTGGLMNKMMGRIGDSPLIGAGTYASEFCGVSCTGEGEAIIRATLARDVSAVMEYKGLNLQEAVDYVIKHRLDEGFAGLIAVSNKGEVVCGFNSNGMFRGCATEDGFMEVAIWE

SEQ ID NO: 1705 - DNA, 858 bp, Schizosaccharomyces pombe (Fission yeast)
  CDS (1)..(858)
atgtctaatggcttggtaattttacatgctggcgctggcttatacagtggtcaacgggaaatccaagccaaaaaaacctgttctgatgcttgtaaagctgctattcaggctcttaaagttggccaatctgccttatctgctgctattcaggcagcaaaaattatggaggatagtccagtgacaaacgctggtgtaggttctaatttaaacattgatggaaaagttgagtgtgaggctggagtcatggattctgaaagtggtttaactgcaagtgttgcttgttgcaattgctgtaggcatccttcagaagcatgtttatatattttaaacaaaagaaaggtaatgagccaacatggactggtacctcctgcaatgcttgttgggaacggaatagagaaacttctccttcatagtaacataaaacttgttccagaatcacatctcataactgagagatctatgaaaactcaaataaaatggaaagaaatcctttaccaaaatccaatcaatctctcttcgcaagataccattggcgtaatatgcgtggataaaaatggtagaattgccgttgtaagcagcagtggaggattattacttaaaccagcagggaggatcggatcttctccgataccagggcatggtttttggattgaaagctttgataataagtctcattcctctacttgtgctgttgctacctctggaactggtgaacatattagcaacacttgttttgcttgtcgttcttcacaacttttagtttccgaggataatgttgtatcatctttaaataaattaattaatgactttcatggtaagcttattgacttgtgcgttcgtatcccgtacttgttctaa

SEQ ID NO: 1706 - protein, 285 aa, Schizosaccharomyces pombe (Fission yeast)
MSNGLVILHAGAGLYSGQREIQAKKTCSDACKAAIQALKVGQSALSAAIQAAKIMEDSPVTNAGVGSNLNIDGKVECEAGVMDSESGLTASVACCNCCRHPSEACLYILNKRKVMSQHGLVPPAMLVGNGIEKLLLHSNIKLVPESHLITERSMKTQIKWKEILYQNPINLSSQDTIGVICVDKNGRIAVVSSSGGLLLKPAGRIGSSPIPGHGFWIESFDNKSHSSTCAVATSGTGEHISNTCFACRSSQLLVSEDNVVSSLNKLINDFHGKLIDLCVRIPYLF

SEQ ID NO: 1707 - DNA, 1444 bp, Drosophila melanogaster (Fruit fly)
  CDS (216)..(1226)
ttgtgatacaccaagacttctcgtagagaccattacgattaaccatgagaaggcacttgcgggcaagtctttggatcctttgtttggccaccatggcgttttccatccttgcggcagtaaatacttcgcccaaaccaacgctgacttcggcgtttagtggaaaagctggcaccactgccgtgaaggcgaataagacgacgggtgagctgctgcccatggtcattaacacttggaacttcacggctgccaatgtgctcgcctggcgaatcctgaagcaaagcaagggtggactccggcagacgcggaatgcggtagtggagggctgctcgaagtgtgagaaactccagtgtgaccgaacggtgggctatggcggatcgccggacgagttgggcgaaaccacactggatgccatggtcatggacggggccaccatggatgtgggggcagtggctggtctgcgacgcattaaggatgccattaaggtagcccggcatgttctggaacacacgcagcacaccatgctggtgggtgatgcggcgtcagctttcgccaatgctatgggattcgaatcagagtcgctggtcacgccggagtcgaaggacatgtggttacagtggacggctgagaactgccagccaaacttctggaagaacgttcacccggatcccaaggtctcttgcggcccgtataagccgcggccgactccgctgacccgctggaaggaggaccgtgcccgcaatgagtatgagatcggacgcaagaaccacgataccatcggcatgatcgccatcgacgtggaaagcaacatccacgccggcacctccaccaacggggcgcggcacaagattcccggacgggtcggcgactcccccattccgggtgctggcgcttatgcagacaacgaggtgggtgcagccgtggcaaccggagatggagatgtgatgatgcgcttcctgccctccctgctagcggtggagaccatgcgggcgggaaaacctccggctgaggcagctcaagagggccttcgccgcattctcaagcaccacaaggatttcatgggtgctctcatcgccgtagatcggctgggtaattatggcgctgcctgctacggcctggccgaattcccctttatggttagcagtccagccggagcggatgggcctacgcgcttggaaacggtcaaatgcataggtggtcaggacaaagtaaatatcgtggcgttgtgaggtggcgaaaactgtaacgtatttcaataaaatttaaatttcgtggagttctcatctgcaatataaattgcgttatttgtttgtccctatcggcagcaagatagacgggtagttttaccgtaaattagcggtattaagaattatcgatatgtaaggatccttacataaaataaataaataaagtatgagaatagaatagaaaaagacaaaacaaaaac

SEQ ID NO: 1708 - protein, 336 aa, Drosophila melanogaster (Fruit fly)
MVINTWNFTAANVLAWRILKQSKGGLRQTRNAVVEGCSKCEKLQCDRTVGYGGSPDELGETTLDAMVMDGATMDVGAVAGLRRIKDAIKVARHVLEHTQHTMLVGDAASAFANAMGFESESLVTPESKDMWLQWTAENCQPNFWKNVHPDPKVSCGPYKPRPTPLTRWKEDRARNEYEIGRKNHDTIGMIAIDVESNIHAGTSTNGARHKIPGRVGDSPIPGAGAYADNEVGAAVATGDGDVMMRFLPSLLAVETMRAGKPPAEAAQEGLRRILKHHKDFMGALIAVDRLGNYGAACYGLAEFPFMVSSPAGADGPTRLETVKCIGGQDKVNIVAL

SEQ ID NO: 1709 - DNA, 1026 bp, Drosophila melanogaster (Fruit fly)
  CDS (1)..(1026)
atggttatcaacacctggccctttgcggaagccaaaaaggaggcgtggcgactgctcaatgtgaaaaagggcggacttggacagacgagaagcgccgttgtgggcggtatatccatgtgcgaaaagctgcagtgcgccaagactgttggctacggcggcaatcccgacgagcgcggagatacatccctggatgccttgcttatggatggaggcaccatggaggtgggtgctgtgggcgatctgcgacggatcagaagtgccatcaaggtggcgcaacatgtcttggaacacacgcttcacaccctgctagttggcgatggggccgatgagttcgccaatgccatgggattgcagtacgaatcactaaactctgaggacaacatagagtcattgaaaaattggacgaggcacaactgccagccaaacttttggcgaaatgtccacccggatccgaggacctcctgcggtccctaccagcccttggtcacatgggatccgaatgccaagcaatcggatcggatcgaaattggtcccgataaccacgacaccatcaccatggccgccatcgatgaggagggtcacatccatgtgggcacctccaccaacggactacgctacacgctgcccggacgtgttggcgacgcctcgattcccggctccgctgcctatgcggataacgaagtgggcgccgctgttaccactggagatggagacatccttatgcgcttcctgccctctctcctggcggtggaggccatgcgggcgggcaaaacaccggcggaggcagtcgagttggtcatccagcgaatccagaagcacgtaaagtatttcgaagtcgccgttatcgttgcaaaccggcttggaacgtacgcagtcaggtgccatggtactggcatggccagggataatggaaagtttgcctatatggtcagtagtccgggacaaccggtgcgcacggaatcggttgagtgctcagcgaatcctgagaaatctccttccgaagacgatagacaagttatttggtaa

SEQ ID NO: 1710 - protein, 341 aa, Drosophila melanogaster (Fruit fly)
MVINTWPFAEAKKEAWRLLNVKKGGLGQTRSAVVGGISMCEKLQCAKTVGYGGNPDERGDTSLDALLMDGGTMEVGAVGDLRRIRSAIKVAQHVLEHTLHTLLVGDGADEFANAMGLQYESLNSEDNIESLKNWTRHNCQPNFWRNVHPDPRTSCGPYQPLVTWDPNAKQSDRIEIGPDNHDTITMAAIDEEGHIHVGTSTNGLRYTLPGRVGDASIPGSAAYADNEVGAAVTTGDGDILMRFLPSLLAVEAMRAGKTPAEAVELVIQRIQKHVKYFEVAVIVANRLGTYAVRCHGTGMARDNGKFAYMVSSPGQPVRTESVECSANPEKSPSEDDRQVIW

SEQ ID NO: 1711 - DNA, 1486 bp, Drosophila melanogaster (Fruit fly)
  CDS (71)..(1168)
tttacgccgtacagcgcacggattgcagttgggccaacaacaaggcgcgagcataaacagcaataccaacatggccggcttcgtcgcggtgcacacgggggctgggaactgcatcgacgagacgaagtaccagcgggtgattaaggaggcctgcctgcgcgccacggagatccttcgcaacggcggatccgccgtcgatgcctgcgaggcggccattgtgcggctggagaactgcggctacacaaacgccggctatggctccaatctctgcatggacggctctgtgcagtgcgatgcggctataatggatggctcaacgcttaactttggcgcctgcacgaacgttagtcgggtgaagaaccccatacagttggcgagacgcatctgcgatgcccagtccagtccgcagcttctggagcgcattccaccgatgatcctcgccggcactggagcggaacactatgccgacgaggtgggttgctccatggtggagcccggcgtactgatctcatctaaggccaagttccagtttaatcactacaaaagcaagtacgacctcgtggtcaacagcagattgggcaaggcaacgtccgaggaatccgtacaagtgccggaaccaggaaacgaggtggaacttgccgctgctttggacacagtgggagcggtatgtgttgatggggcagggaacacagcagctggatgtagctccggtggcatactgctcaaagttccgggcagagtggggcaggcggctacttatggtgccggctgttgggccaccgatacggacgaactggccatagccacctgcacaaccggaaacggcgagtacctgatgaaaacgctgctggcccgagagatctgccatggggcatttagcagtgattgtgcggtgaccagtcttcacaagacgttcaagcaaaagttcctggactccccgctgctgccccgacagcaggatctgtacgctggagctctgacgctactctattatccgggccagagcagcggcgaggtgatgtggagccacacgacgcagtcgttctgtgtcggctacatggcaaccaaccagagggtgccaaagtttgtgcattcgccgctgcccacgtacagcgtcccgggccgatcgtgcgtcgtcaatggccataatttccatttgcgcatttaaatgtgggctggccaactagccgcagcccccagcaccttcctgcagctcctagtcccgctgctctgcatctgcaattcatttgatttaatgtttaattgccgcgacaatcgctgccaatgacatatgggagcagaaggcgcctgaggagctgggacagcattatgtgtatatgcttcattctctcggcgaaatattaagataattaagcaaatatttttattgtaaaaatctcgtagatcgtaatgtttgcagtactagtagtagcaatgaaataggatttcgaatatattgtatccctcgtcgaaccgggtgcgctag

SEQ ID NO: 1712 - protein, 365 aa, Drosophila melanogaster (Fruit fly)
MAGFVAVHTGAGNCIDETKYQRVIKEACLRATEILRNGGSAVDACEAAIVRLENCGYTNAGYGSNLCMDGSVQCDAAIMDGSTLNFGACTNVSRVKNPIQLARRICDAQSSPQLLERIPPMILAGTGAEHYADEVGCSMVEPGVLISSKAKFQFNHYKSKYDLVVNSRLGKATSEESVQVPEPGNEVELAAALDTVGAVCVDGAGNTAAGCSSGGILLKVPGRVGQAATYGAGCWATDTDELAIATCTTGNGEYLMKTLLAREICHGAFSSDCAVTSLHKTFKQKFLDSPLLPRQQDLYAGALTLLYYPGQSSGEVMWSHTTQSFCVGYMATNQRVPKFVHSPLPTYSVPGRSCVVNGHNFHLRI

SEQ ID NO: 1713 - DNA, 1449 bp, Drosophila melanogaster (Fruit fly)
  CDS (253)..(1251)
gaacttaataaaaataatatagaaaatatgtcaaaagtggatttaaaatcacttcagttgctaatggactccttgagcagggaattgtccccgccaacaaaggagccataaagacaaagagagtatcaaacaataaagaaaaaaaaaagtataaaacaattcccccagcaatccgagcaccagacatcggctgctcgagctgcctgccacatctccataaaatctccgtagctgacagcgaatattatcgaaatgccacgcccagttctgctcattcacggtggagccggtgatatatcggactccaggatagcgggcaagttcgcgggcattaagcaggcactgcgctccgcctgggggctactgagtccggacaatggcagcggcggaggcagtgccctggatgccgtagaggcggcggtgcgcagcatggagctggacgagaacttcaacgccggctacggctcctgcctgaacaccagtggccaggtggagctagaggccagtttaatggagggccgcgacttgcgagccggctgcataaccctgctgcgggatgtgatgcacccgattacagtggcgcgtcgcctgatggagaagcagcgacacacctttcttggcggcgcagcggcccaggagctggcactagccacgggcagcgaacgactgcagccgggagcactggtcaccgagggggctcgcttaacgctgaaggaattcgaggatcaggtggcccagggcaaggatcccttcttcgcgcgcaccgaactgaccgatgacaagccggtgccgaaaacggatcccagtggcgaaacagtcggagcggttgccatggacgcatcgggccaaatagtggtgggcacctccaccggcggcatcaccggcaagtggccgggtcgcattggggacacacccattctcggcagcggcacctatgcggataactgccgtggaggcgtctccaccaccggacatggcgagaccctcatgcgttacaatctggcccagcgcattctgtccgccatggagtaccagggactgtccgcccaggcagccgccgacaaggagtgccgcgagatgaccaaacggctgggtggcactggtggcgccatcgtggttggccactccggtgacctgggcatcagtttcacgtcgcgtcgcatggcgtggggatatgtccaggatggcaccatcttttacggcatcgagggtcaggtggtgcaccaggaaccgttcacactttccacgtaactaaattcggagtacctacctatccaaggatttatcaaaatcccagtagaatagtaaacaaattaaagaatcttctttcatttcaaaaagttacataaataaatttgacttgttttaataagaagcacacgcatttgttttaaatagttagttcatttgatcaagagactatataaataaattaatgttgaccacact

SEQ ID NO: 1714 - protein, 332 aa, Drosophila melanogaster (Fruit fly)
MPRPVLLIHGGAGDISDSRIAGKFAGIKQALRSAWGLLSPDNGSGGGSALDAVEAAVRSMELDENFNAGYGSCLNTSGQVELEASLMEGRDLRAGCITLLRDVMHPITVARRLMEKQRHTFLGGAAAQELALATGSERLQPGALVTEGARLTLKEFEDQVAQGKDPFFARTELTDDKPVPKTDPSGETVGAVAMDASGQIVVGTSTGGITGKWPGRIGDTPILGSGTYADNCRGGVSTTGHGETLMRYNLAQRILSAMEYQGLSAQAAADKECREMTKRLGGTGGAIVVGHSGDLGISFTSRRMAWGYVQDGTIFYGIEGQVVHQEPFTLST

SEQ ID NO: 1715 - DNA, 1194 bp, Drosophila melanogaster (Fruit fly)
  CDS (1)..(1194)
atgttggcgcaaagctgttgccttcgactgctgatcctcctccttctgttcacaacaatcggcagcgtaccgaaaaaatccctcaaatacttcacgaatcgaaaattgcgagagagaaggatcaaattgttcggcaccaagaagacagagattcaatcactcttgataagtacgtggaactatacggatgccaatttgcaggcatggagtgtgttgcaacaaggacctcgaaggactcgtcaggcggtgattcagggatgcatggcctgccagaatcagcgatgtggacgcctgctgaccggaagatcctctccagatacggagggagcactcaccctggaggctgccattatggatggggaaagcttggagtacggtgcagtggccgggatgaatggagttcggaatgccattctagtagccgatgcagttctgaaatacacaaaacattccgtactggtcgggaaaagtgcaacgaaatttgccagatctttgggttacaaagaggagtacctcacggatgcgagaacgagaaatgtcttgaaaaagtggaggtcaaacggctgtcagccgaatttctggcgagatgtacatccttcgccggcggaaaactgtgggccatattcacccctacccgagcacatgcatcagcatccgatgcaccaggaatatgccatcatacagggtcaacacgatcagctggccttcttggccctggatgcggagggtaaattccatgtggccagccaatcgagtggcgcccaattccggattcccggtcgagtgggtgattcggcggtgcctggtgctgggatttatgcggataatgaagtgggcggtgcggtggccagtggcgatggtgatgtcctgatgcgccacctgcccgccttcctggccgtcgaagcaatgcgagcgggaaaggaaccagacaaggcagccgagttggtggtgcaacgcctgctgaggcacaatacggaattcaatggagccgtggtggtggtcaatcgacgtggcatctatgccgccgcctgtgcaggactcgacgagttccattttgtggtcagtgggggcaaggaatacctcagcatggcgcgggtggagcgggtcaagtgcttggagcgggagaatgaagtcatagatggtggccccaaaggactgtttcccaccattcccgaaaaacataaggttccatga

SEQ ID NO: 1716 - protein, 397 aa, Drosophila melanogaster (Fruit fly)
MLAQSCCLRLLILLLLFTTIGSVPKKSLKYFTNRKLRERRIKLFGTKKTEIQSLLISTWNYTDANLQAWSVLQQGPRRTRQAVIQGCMACQNQRCGRLLTGRSSPDTEGALTLEAAIMDGESLEYGAVAGMNGVRNAILVADAVLKYTKHSVLVGKSATKFARSLGYKEEYLTDARTRNVLKKWRSNGCQPNFWRDVHPSPAENCGPYSPLPEHMHQHPMHQEYAIIQGQHDQLAFLALDAEGKFHVASQSSGAQFRIPGRVGDSAVPGAGIYADNEVGGAVASGDGDVLMRHLPAFLAVEAMRAGKEPDKAAELVVQRLLRHNTEFNGAVVVVNRRGIYAAACAGLDEFHFVVSGGKEYLSMARVERVKCLERENEVIDGGPKGLFPTIPEKHKVP

SEQ ID NO: 1717 - DNA, 996 bp, Caenorhabditis elegans
  CDS (1)..(996)
atgagcaactgcgagataatcgcggtgcacggaggtgcgtgtgctaaattcgacgcaagtcttgccgaggactgccgttttgcgtgtggtacaggcactgttgagaatgcgttgacggatcttgaaagaatagaaaagttcaactgtggattcggctcacatttgactatcgatcaagaagttgaatgtgaagcatcatatatgtcatccaaaaatttaagtttcggcgcggtcggcgcgatttccaacgttttccatccgtcccgagtggcacgtcaccttgcacatagcaattggtggaagcagcgacgtcttcttcatccccttattcttgttggtcgtggagcagagaaatatgctgttaaaaatgattttccaacgtgtacacctgaagaactcgtatcaaaagcggcgaaagagagctttgagaagtatttacatcgaatgcttcatccatatgatacacatgacactgtaggagctatttcaattaataccaatacaatgaactcagaatccggtacttcaagcggtggaattgtgctaaaacactcgggacggcttggtcacagctgtgtatatggaagtggaacatggtctgaacgaaggcaatacgaagaaccatttgatcaagtcagtgaacgaaccatctcgatttgttcgacaggacacggtgaatcacttgtgaaagccgatttctgcaggggtatcgccacgagagtgctagacgacgaggagggtatcatgtacagtgagattattcgagaattcatacacgaaaaaatggaacatggatcccgatacggtggcatcgcattgatcgccgacaaattcaaagatcgaatgtcgctggaatttctgattttccataattgtcgatatcttccggctgcagttcgttgtcgagacaatcagattcgtgtttttgaatcacaattcgatccggatcaatgtactactgatcctaaatgtgttatcgagtcattcatcatgtaa

SEQ ID NO: 1718 - protein, 331 aa, Caenorhabditis elegans
MSNCEIIAVHGGACAKFDASLAEDCRFACGTGTVENALTDLERIEKFNCGFGSHLTIDQEVECEASYMSSKNLSFGAVGAISNVFHPSRVARHLAHSNWWKQRRLLHPLILVGRGAEKYAVKNDFPTCTPEELVSKAAKESFEKYLHRMLHPYDTHDTVGAISINTNTMNSESGTSSGGIVLKHSGRLGHSCVYGSGTWSERRQYEEPFDQVSERTISICSTGHGESLVKADFCRGIATRVLDDEEGIMYSEIIREFIHEKMEHGSRYGGIALIADKFKDRMSLEFLIFHNCRYLPAAVRCRDNQIRVFESQFDPDQCTTDPKCVIESFIM

SEQ ID NO: 1719 - DNA, 921 bp, Pyrococcus furiosus
  CDS (1)..(921)
atggtagctattattgtccatggcggagcgggaacaattagaaaagaggagaggattccaaagatcatcgagggagttagggaggcagttttaaccggttggagagaactgaaaaagggttctgcccttgatgctgttgaagaagccgtaaaagttcttgaggacaatcctctctttaatgctggtacaggaagcgttttgaccttagatggaaaagtagagatggacgctgcaataatgagaggaaaaacattggatgctggtgctgttgcagggatatggggagtgaaaaacccaattagtgtggcaagaaaagttatggaaaagactgatcatgtattacttattggagaaggagctgttaaatttgcaaggctaatgggttttcctgaatacgatcccacaacagaagagagaagaaaacagtgggaggagttgaggaaaaaactacttgaaactggagaaatacgccactggaaaaagttaagtgagcttataaaggaatatccagaagtcttaaggagtaccgtaggagctgtagcctttgatggggaggagatagtagctggaacttcaactgggggagtattccttaagatgtttggtagggtaggggatactcctataatcggggctggaacgtatgcaaatgaggttgctggggcttcatgtactggtttgggggaggttgcaattaagctaagcttagcgaaaacagcaactgacttcgtaaggctcggtttggatgctcaagctgcaagtgaagcagcaataagattagctacaaagtactttgggcctgatacaatgggaataatcatggttgactctaatgggaatgttggctttgctaagaatacaaaacacatgagttacgcatttatgaaggaaggcatgaaggaaccggaggcaggggtgtaa

SEQ ID NO: 1720 - protein, 306 aa, Pyrococcus furiosus
MVAIIVHGGAGTIRKEERIPKIIEGVREAVLTGWRELKKGSALDAVEEAVKVLEDNPLFNAGTGSVLTLDGKVEMDAAIMRGKTLDAGAVAGIWGVKNPISVARKVMEKTDHVLLIGEGAVKFARLMGFPEYDPTTEERRKQWEELRKKLLETGEIRHWKKLSELIKEYPEVLRSTVGAVAFDGEEIVAGTSTGGVFLKMFGRVGDTPIIGAGTYANEVAGASCTGLGEVAIKLSLAKTATDFVRLGLDAQAASEAAIRLATKYFGPDTMGIIMVDSNGNVGFAKNTKHMSYAFMKEGMKEPEAGV

SEQ ID NO: 1721 - DNA, 1092 bp, Caenorhabditis elegans; identical to SEQ ID NO: 1631
  CDS (1)..(1092)

SEQ ID NO: 1722 - protein, 363 aa, Caenorhabditis elegans; identical to SEQ ID NO: 1632

SEQ ID NO: 1723 - DNA, 978 bp, Lupinus albus (White lupine)
  CDS (1)..(978)
atgggtggttggagtatagctctgcacggtggcgctggcgacatcccattttcactgccaccggagcggcgaaagcctcgggaagaaggactccgccactgcctccaaatcggtattgaagctctaaaagcccaaaaccctcctttggacgttgtagaacttgttgttcgtgagttagagaatattcaacatttcaatgcgggaataggatctgtgttgaccaatagtggaacagtggaaatggaagcatcaataatggatgggaatactatgaaatgtggagctgtttctggtttgaatacagttatgaatccaatttcactagctagacaagttatggataaaactcctcatatatttcttgctttccaaggagctcaagatttgggtaaacaacaaggtgttgagactgtagattcaagtcattttattactgaagaaaatgttgaaagactaaagctggcaatagaagccaatagggttcaggttgattatagccaatataattatacccaacctgttcaagatgatgctgagaaggaattaccacttgctaatggtgatagtcaaattggaactgttgggtgtgtggctgttgatagtcatggaaatctagcttctgcaacatccactggtggattagtgaacaaaatggttggtcgaatcggtgacacgcccctcataggggcagggacttatgccaatgaactttgtgcagtttctgcaaccggcaaaggagaagcaataatacgtgcgacagtagcaagagatgtggctgcactcatggagttcaaaggcctttctctcaaggaagctgctgattgtgttgtacatgagcgtacaccaaaaggcactgttggattgattgctgtgtctgctgcaggagaaattgcaatgccttttaatacaacaggcatgttcagagcatgtgctactgaagatggctattcagagattgcaatttggcctactgcctga

SEQ ID NO: 1724 - protein, 325 aa, Lupinus albus (White lupine)
MGGWSIALHGGAGDIPFSLPPERRKPREEGLRHCLQIGIEALKAQNPPLDVVELVVRELENIQHFNAGIGSVLTNSGTVEMEASIMDGNTMKCGAVSGLNTVMNPISLARQVMDKTPHIFLAFQGAQDLGKQQGVETVDSSHFITEENVERLKLAIEANRVQVDYSQYNYTQPVQDDAEKELPLANGDSQIGTVGCVAVDSHGNLASATSTGGLVNKMVGRIGDTPLIGAGTYANELCAVSATGKGEAIIRATVARDVAALMEFKGLSLKEAADCVVHERTPKGTVGLIAVSAAGEIAMPFNTTGMFRACATEDGYSEIAIWPTA

SEQ ID NO: 1725 - DNA, 978 bp, Lupinus luteus (Yellow lupine)
  CDS (1)..(978)
atgggtggttggagcatagctctgcacggcggcgctggcgacattccattttcactgccaccggagcggcgaaagcctcgggaagaaggactccgccactgccttcaaatcggtgttgaagctctcaaagcccaaaagcctcctttggacgttgtagaacttgttgttcgtgagttagagaatattgaacatttcaatgcgggaataggatctgtgttgaccaatagtgggacagtggaaatggaagcatcaataatggatgggaatactatgaaatgtggagcagtttctggtctgagtacagttctgaatcctatttcactagctcgactcgttatggataaaactcctcatatatatcttgctttccaaggagctcaggattttgctaaacaacaaggtgttgagactgtagattcaagtcatcttattactgcagaaaatgttgaaagactaaagctggcaatagaagccaatagggtccaggttgattatagtcaatataattatcccgaacctgtcaaagatgatgctgagaaggaattaccacttacaaatggtgatagtcaaattggaactgttgggtgtgtggctgttgatagtcatgggaatctagcttctgcaacatccactggtggattggttaacaaaatggttggtcgaatcggtgacacgcccctcatcggtgccgggacttatgccaatgaactttgtgcagtttctgcaacaggcaaaggtgaagaaataatacgtgcaacggtagcaagagatgtggctgcactcatggagttcaaaggcctttctctcaaggaagctgctgattttgttatacatgagcgtacaccaaaaggcactgttggtttgattgctgtgtctgctgcaggagaaattgcaatgccttttaacacaacaggcatgttcagagcatgtgctactgaagatggctattcagagattgcaatttggcctactacctaa

SEQ ID NO: 1726 - protein, 325 aa, Lupinus luteus (Yellow lupine)
MGGWSIALHGGAGDIPFSLPPERRKPREEGLRHCLQIGVEALKAQKPPLDVVELVVRELENIEHFNAGIGSVLTNSGTVEMEASIMDGNTMKCGAVSGLSTVLNPISLARLVMDKTPHIYLAFQGAQDFAKQQGVETVDSSHLITAENVERLKLAIEANRVQVDYSQYNYPEPVKDDAEKELPLTNGDSQIGTVGCVAVDSHGNLASATSTGGLVNKMVGRIGDTPLIGAGTYANELCAVSATGKGEEIIRATVARDVAALMEFKGLSLKEAADFVIHERTPKGTVGLIAVSAAGEIAMPFNTTGMFRACATEDGYSEIAIWPTT

SEQ ID NO: 1727 - DNA, 1041 bp, Mus musculus (Mouse)
  CDS (1)..(1041)
atggagcggaagtcgaatctgtctctgcttctcctactgctggtcctgggcatgcccctggtgcggggctccagccctctgcccctggtcgtcaacacttggccttttaagaatgccactgaagcagcgtggtggacattgctatctggaggttctgccctggatgcagtggagaacggctgtgctgtgtgtgagaaggagcagtgtgatgggactgtaggctttggaggaagtcctgatgaaggtggcgaaaccaccctggatgccatgataatggatggcactgccatggatgtgggagcagtgggaggccttagaagaattaaaaacgcgattggcgtggcgcggagagtcctggagcataccacacacacgcttttagtgggggactcagccaccaagtttgctgaaagtatggggtttactaatgaggacttgtctaccaaaacctcaagagatcttcattcagattggctttctcgaaattgccagccaaattattggaggaatgttattccagatccctcaaaatactgtggaccctacaaaccatctggtttcttaaagcagagtatttctccccacaaagaagaagtggatatccacagccatgatactattggcatggttgtaatccataagacgggacatactgctgctggcacatccacaaatggtataaaattcaaaatacctggtcgtgtaggggattcaccaatccctggagccggagcctatgctgatgacacggctggagcagctgcagccactggcgatggtgacacactcctgcgctttctgccgagctaccaagctgtagaatatatgagaggaggagatgacccagccatagcttgccaaaaagtgattttaagaattcagaaatactatccaaacttctttggagcggtcatatgtgccagtgtgaacggaagttatggtgctgcttgcaacaaacttccaacatttacacaatttagtttcatggtttctaattctttacacaatgagccaaccgaaaaaaaagtagactgcatctaa

SEQ ID NO: 1728 - protein, 346 aa, Mus musculus (Mouse)
MERKSNLSLLLLLLVLGMPLVRGSSPLPLVVNTWPFKNATEAAWWTLLSGGSALDAVENGCAVCEKEQCDGTVGFGGSPDEGGETTLDAMIMDGTAMDVGAVGGLRRIKNAIGVARRVLEHTTHTLLVGDSATKFAESMGFTNEDLSTKTSRDLHSDWLSRNCQPNYWRNVIPDPSKYCGPYKPSGFLKQSISPHKEEVDIHSHDTIGMVVIHKTGHTAAGTSTNGIKFKIPGRVGDSPIPGAGAYADDTAGAAAATGDGDTLLRFLPSYQAVEYMRGGDDPAIACQKVILRIQKYYPNFFGAVICASVNGSYGAACNKLPTFTQFSFMVSNSLHNEPTEKKVDCI

SEQ ID NO: 1729 - DNA, 1033 bp, Spodoptera frugiperda (Fall armyworm)
  CDS (1)..(966)
atggagaagaacatgccgatcgtaataacgacatggtcgtttacaaatgcttcacaaaaagcctgggaagttctaaaggatgaaggcaaagctttagatgctgtggaacaaggcggtatagtatgtgaaaacgagcaatgtgatcggacagtaggttatggaggaagtcctgatgaagatggggagacgacactagatgcttttatcatggatgggagtacaatgaacgttggtgcggtagcagcactccgtaggataaaaagtgcaatatcagttgcccgacatgtaatggagtacacaacacattcattcctagctggagaactggctacgaagtttgctgttgaaatgggattcaaggaggagtctctttcaactgatgaatccagggaattatggtcaaaatggcgttttgaaaaacaatgccaaccgaattttcgaaagaatgtgaaaccagatccacgtaaacattgtgggccttatcataaaaagaggaattttgtggattacatacatccagaagtgtttgtagttgatcaatacaatcacgacacgattgggatggttgctgtggacagcaagggagatgtagcagctggtacctccactaatggcgctaagttcaaaatacctggaagagtaggcgactctcccattcccggtgcaggggcttacgctgacaatacagtaggaggagcagcggctacaggtaacggcgacaccatgatgagatttttacctagtttcttagcggtagaggaaatgcgtcgaggagcgtcaccggcgaatgccgcgaaaactgcaatcaaaagaatctcagcacatcatcctgatttcatgggtgctgtaatagctttatctaagaatggtcaatacggggccgcgtgtaacggtatcgaaacgttcccattcgtcgtacaagataaaactcgaaaaacatttgaagtcgttactattaaatgttgatttttgtatatttcgtattatacctaaaaatctgtaaaataaatccaattttgaattaaaaaaaaaa

SEQ ID NO: 1730 - protein, 321 aa, Spodoptera frugiperda (Fall armyworm)
MEKNMPIVITTWSFTNASQKAWEVLKDEGKALDAVEQGGIVCENEQCDRTVGYGGSPDEDGETTLDAFIMDGSTMNVGAVAALRRIKSAISVARHVMEYTTHSFLAGELATKFAVEMGFKEESLSTDESRELWSKWRFEKQCQPNFRKNVKPDPRKHCGPYHKKRNFVDYIHPEVFVVDQYNHDTIGMVAVDSKGDVAAGTSTNGAKFKIPGRVGDSPIPGAGAYADNTVGGAAATGNGDTMMRFLPSFLAVEEMRRGASPANAAKTAIKRISAHHPDFMGAVIALSKNGQYGAACNGIETFPFVVQDKTRKTFEVVTIKC

SEQ ID NO: 1731 - DNA, 1263 bp, Homo sapiens (Human)
  CDS (1)..(1263)
atgaccatggagaaggggatgagttctggagaagggctgccttccagatcatctcaggtttcggctggtaaaataacagccaaagagttggaaacaaagcagtcctataaagagaaacgaggaggctttgtgttggtgcatgcaggtgcaggttatcattctgaatccaaagccaaggagtataaacatgtatgcaaacgagcttgtcagaaggcaattgaaaagctgcaggccggtgctcttgcaactgacgcagtcactgcagcactggtggaacttgaggattctccttttacaaatgcaggaatgggatctaatctaaatctgttaggtgaaattgagtgtgatgccagcataatggatggaaaatccttaaattttggagcagttggagcactgagtggaatcaagaacccagtctcggttgccaacagactcttatgtgaagggcagaagggcaagctctcggctggcagaattcctccctgctttttagttggagaaggagcctacagatgggcagtagatcatggaataccctcttgccctcctaacatcatgaccacaagattcagtttagctgcatttaaaagaaacaagaggaaactagagctggcagaaagggtggacacagattttatgcaactaaagaaaagaagacaatcaagtgagaaggaaaatgactcaggcactttggacacggtaggcgctgtggttgtggaccacgaagggaatgttgctgctgctgtctccagtggaggcttggccttgaaacatccggggagagttgggcaggctgctctttatggatgtggctgctgggctgaaaatactggagctcataacccctactccacagctgtgagtacctcaggatgtggagagcatcttgtgcgcaccatactggctagagaatgttcacatgctttacaagctgaggatgctcaccaagccctgttggagactatgcaaaacaagtttatcagttcacctttccttgccagtgaagatggcgtgcttggcggagtgattgtcctccgttcatgcagatgttctgccgagcctgactcctcccaaaataagcagacacttctagtggaatttctgtggagccacacgacggagagcatgtgtgtcggatatatgtcagcccaggatgggaaagccaagactcacatttcaagacttcctcctggtgcggtggcaggacagtctgtggcaatcgaaggtggggtgtgccgcctggagagcccagtgaactga

SEQ ID NO: 1732 - protein, 420 aa, Homo sapiens (Human)
MTMEKGMSSGEGLPSRSSQVSAGKITAKELETKQSYKEKRGGFVLVHAGAGYHSESKAKEYKHVCKRACQKAIEKLQAGALATDAVTAALVELEDSPFTNAGMGSNLNLLGEIECDASIMDGKSLNFGAVGALSGIKNPVSVANRLLCEGQKGKLSAGRIPPCFLVGEGAYRWAVDHGIPSCPPNIMTTRFSLAAFKRNKRKLELAERVDTDFMQLKKRRQSSEKENDSGTLDTVGAVVVDHEGNVAAAVSSGGLALKHPGRVGQAALYGCGCWAENTGAHNPYSTAVSTSGCGEHLVRTILARECSHALQAEDAHQALLETMQNKFISSPFLASEDGVLGGVIVLRSCRCSAEPDSSQNKQTLLVEFLWSHTTESMCVGYMSAQDGKAKTHISRLPPGAVAGQSVAIEGGVCRLESPVN

SEQ ID NO: 1733 - DNA, 1263 bp, Mus musculus (Mouse)
  CDS (1)..(1263)
atgatcatggagaaggggatgaattctggagaaggactgccttccagatcatctcaggcatctgctgctaaagtaacagtcaaggagttagaaacacagcagccctgtaaggagaaacgagggggctttgtgctggtgcatgcaggtgcaggctatcattctgaatccaaagccaaggaatataaacatgtatgcaaacgagcttgtcagaaggcaattgagaagctacaggctggtgctcttgctacagatgcagtggctgctgctctggtggaacttgaggattctccttttacaaatgcaggaataggatctaatctaaatctcttaggagagattgaatgtgatgccagcataatggatggaaagtccttaaactttggagccgttggagcactgagtggaatcaagaatccagtctcagttgctcacaggctcttgtgtgaagggcagaagggcaagctctctgcaggcagaattcctccctgctttttagttggagaaggagcctacagatgggcagtggatcatgggataccctcttgccctcctagcaccatgaccacaagattcagcttagctgcatttaaaaggaacaagaggaaactagagctggcagaaagggtggaaacagacttcatccagctgaagagaagacgacaatcaagcgcaaaggaaaatgactcaggcactttggacacggtgggtgctgtggtcgtggatcacgaagggaatgttgctgctgctgtctccagtgggggcttggccttgaaacatccagggagagttgggcaggctgctctttatggatgtggctgctgggctgagaatactggcgctcagaacccctactccacagctgtgagtacctcaggatgtggcgagcatcttgtgcgcaccatactggctagagaatgttcacacgctttacaagctgaagatgctcaccaagctctgttggagactatgcaaaacaagtttatcagttcacctttccttgcctgtgaagatggcgtgctcggtggagtgatcgttctccggtcatgcagatgttcttcagagtctgactcctcccaagataaacagacactgcttgtggaatttctgtggagccatactacagagagcatgtgcgtgggatatatgtcagcccaggacggcaaagccaagactcacatttcacgactccctcctggtgctgtggcaggacagtctgttgccatcgaaggtggggtttgccgcctggagagccccgtgaactga

SEQ ID NO: 1734 - protein, 420 aa, Mus musculus (Mouse)
MIMEKGMNSGEGLPSRSSQASAAKVTVKELETQQPCKEKRGGFVLVHAGAGYHSESKAKEYKHVCKRACQKAIEKLQAGALATDAVAAALVELEDSPFTNAGIGSNLNLLGEIECDASIMDGKSLNFGAVGALSGIKNPVSVAHRLLCEGQKGKLSAGRIPPCFLVGEGAYRWAVDHGIPSCPPSTMTTRFSLAAFKRNKRKLELAERVETDFIQLKRRRQSSAKENDSGTLDTVGAVVVDHEGNVAAAVSSGGLALKHPGRVGQAALYGCGCWAENTGAQNPYSTAVSTSGCGEHLVRTILARECSHALQAEDAHQALLETMQNKFISSPFLACEDGVLGGVIVLRSCRCSSESDSSQDKQTLLVEFLWSHTTESMCVGYMSAQDGKAKTHISRLPPGAVAGQSVAIEGGVCRLESPVN

SEQ ID NO: 1735 - DNA, 1337 bp, Drosophila melanogaster (Fruit fly)
  CDS (259)..(1269)
ccaagacttctcgtagagaccattacgattaaccatgagaaggcacttgcgggcaagtctttggatcctttgtttggccaccatggcgttttccatccttgcggcagtgaatacttcgcccaaaccaacgctggcttcggcgtttaggtgagcagcgcatacagcgtattctttgttcgctaagatccgcccctttgcagtggaaaagctggcaccactgccgtgaaggcgaataagacgacgggtgagctgctgcccatggtcattaacacttggaacttcacggctgccaatgtgctcgcctggcgaatcctgaagcaaagcaagggtggactccggcagacgcggaatgcggtagtggagggctgctcgaagtgtgagaaactccagtgtgaccgaacggtgggctatggcggatcgccggacgagttgggcgaaaccacactggatgccatggtcatggacggggccaccatggatgtgggggcagtggctggtctgcgacgcattaaggatgccattaaggtagcccggcatgttctggaacacacgcagcacaccatgctggtgggtgatgcggcgtcagctttcgccaatgctatgggattcgaatcagagtcgctggtcacgccggagtcgaaggacatgtggttacagtggacggctgagaactgccagccaaacttctggaagaacgttcacccggatcccaaggtctcttgcggcccgtataagccgcggccgactccgctgacccgctggaaggaggaccgtgcccgcaatgagtatgagatcggacgcaagaaccacgataccatcggcatgatcgccatcgacgtggaaagcaacatccacgccggcacctccaccaacggggcgcgtcataagattcccggacgggtcggcgattcccccattccgggtgccggcgcttatgcagacaacgaggtgggtgcagccgtggcaaccggagatggagatgtgatgatgcgctttctgccctccctgctagctgtggagaccatgcgggcgggaaaacctccggctgaggcagctcaagagggccttcgccgcattctcaagcaccacaaggatttcatgggtgctctcatagccgtagatcggctgggtaattatggcgccgcctgctacggcctggccgaattcccctttatggttagcagtccagccggaggggatgggcctacgcgcttggaaacggtcaaatgcataggtggtcaggacaaagtaaatatcgtggcgttgtgaggtggcgaaaactgaaacgtatttcaataaaatttaaatttcgtggaaaaaaaaaaaaaaaaaaaaaa

SEQ ID NO: 1736 - protein, 336 aa, Drosophila melanogaster (Fruit fly)
MVINTWNFTAANVLAWRILKQSKGGLRQTRNAVVEGCSKCEKLQCDRTVGYGGSPDELGETTLDAMVMDGATMDVGAVAGLRRIKDAIKVARHVLEHTQHTMLVGDAASAFANAMGFESESLVTPESKDMWLQWTAENCQPNFWKNVHPDPKVSCGPYKPRPTPLTRWKEDRARNEYEIGRKNHDTIGMIAIDVESNIHAGTSTNGARHKIPGRVGDSPIPGAGAYADNEVGAAVATGDGDVMMRFLPSLLAVETMRAGKPPAEAAQEGLRRILKHHKDFMGALIAVDRLGNYGAACYGLAEFPFMVSSPAGGDGPTRLETVKCIGGQDKVNIVAL

SEQ ID NO: 1737 - DNA, 24 bp, Primer
atgggcaaagcagtcattgcaatt

SEQ ID NO: 1738 - DNA, 23 bp, Primer
ttactgtgtggcaacggtgtccc

SEQ ID NO: 1739 - DNA, 1845 bp, Escherichia coli K12
  CDS (1)..(1845)
atgattaaaaaagcttcgctgctgacggcgtgttccgtcacggcattttccgcttgggcacaggataccagcccggatactctcgtcgttactgctaaccgttttgaacagccgcgcagcactgtgcttgcaccaaccaccgttgtgacccgtcaggatatcgaccgctggcagtcgacctcggtcaatgatgtgctgcgccgtcttccgggcgtcgatatcacccaaaacggcggttcaggtcagctctcatctatttttattcgcggtacaaatgccagtcatgtgttggtgttaattgatggcgtacgcctgaatctggcgggggtgagtggttctgccgaccttagccagttccctattgcgcttgtccagcgtgttgaatatatccgtgggccgcgctccgctgtttatggttccgatgcaataggcggggtggtgaatatcatcacgacgcgcgatgaacccggaacggaaatttcagcagggtggggaagcaatagttatcagaactatgatgtctctacgcagcaacaactgggggataagacacgggtaacgctgttgggcgattatgcccatactcatggttatgatgttgttgcctatggtaataccggaacgcaagcgcagacagataacgatggttttttaagtaaaacgctttatggcgcgctggagcataactttactgatgcctggagcggctttgtgcgcggctatggctatgataaccgtaccaattatgacgcgtattattctcccggttcaccgttgctcgatacccgtaaactctatagccaaagttgggacgccgggctgcgctataacggcgaactgattaaatcacaactcattaccagctatagccatagcaaagattacaactacgatccccattatggtcgttatgattcgtcggcgacgctcgatgagatgaagcaatacaccgtccagtgggcaaacaatgtcatcgttggtcacggtagtattggtgcgggtgtcgactggcagaaacagactacgacgccgggtacaggttatgttgaggatggatatgatcaacgtaataccggcatctatctgaccgggctgcaacaagtcggcgattttacctttgaaggcgcagcacgcagtgacgataactcacagtttggtcgtcatggaacctggcaaaccagcgccggttgggaattcatcgaaggttatcgcttcattgcttcctacgggacatcttataaggcaccaaatctggggcaactgtatggcttctacggaaatccgaatctggacccggagaaaagcaaacagtgggaaggcgcgtttgaaggcttaaccgctggggtgaactggcgtatttccggatatcgtaacgatgtcagtgacttgatcgattatgatgatcacaccctgaaatattacaacgaagggaaagcgcggattaagggcgtcgaggcgaccgccaattttgataccggaccactgacgcatactgtgagttatgattatgtcgatgcgcgcaatgcgattaccgacacgccgttgttacgccgtgctaaacagcaggtgaaataccagctcgactggcagttgtatgacttcgactggggtattacttatcagtatttaggcactcgctatgataaggattactcatcttatccttatcaaaccgttaaaatgggcggtgtgagcttgtgggatcttgcggttgcgtatccggtcacctctcacctgacagttcgtggtaaaatagccaacctgttcgacaaagattatgagacagtctatggctaccaaactgcaggacgggaatacaccttgtctggcagctacaccttctga

SEQ ID NO: 1740 - protein, 614 aa, Escherichia coli K12
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 1741 - DNA, 1836 bp, Vibrio cholerae
  CDS (1)..(1836)
atgcaaaaatcagcactggcgatcgctctagcatcgctgcttacccctatctcttatttacacgccaacgaagcacaacctcaagaaacggttgttgtgacggcaaatcgttttgagcaaaaggccagttcaactttggcggatgtggaaatcattacccgccaagatatcgaacaaactcaagctaagacattgcctgagttgttacgtagattaacgggtgttcagatcacgcaaaatggtggacgtggtcagttagcctctttattcgtacgtggaacaagttcagatcaagtattggtattagtggatggaattcgttttgctcgtgctgcaaaaggagcggtcgatttcaaccaaattccactaacttatgttgaccgtattgagtatgtgcgtggcgctcgagcttcgttatatggatctgaagcgattggtggtgtcattaacatcattactaaagctcgttcacaacaacaaggcacaaccgtaagtgctggactgggttcattggattaccaagaactcagtattgcttctggggttgcgattggtgaaaaaggccagatgaatgtggctttgggcacagagagtgataaagggtacaacgttcgtccagttcctggagtgaatgatggtgatcgtcacggtttcaggtcagataatgcgttgttgggttacgtgcaccaatttgatgagtcttggtctttgtttgccaatgcccgcgcttatgaaaatatttatcagtacgacaacagctatggtactcgtgactataaagaggcagaaaaggatgacctttcttttacaattggtactcagtatcaaagtgaacgttgggtatctgaattgcagctaactacccagaagcaaaaatcatgggattacacccagtctaagggaaaatactcggacacatcggataatcttgaacaacgaaatatccagtggattaatcgctatttggtcaatgatgtgtggacgttcgctggtggtgtggactggcgagacgagtcgtatattgataaaacagcggataaagagtttgaccgcagcaacactgctgcatttgctgtggttgctgctgagtggcaacaatggctgttggaggcaagtctacgctttgatgataaccaagagtatggttcgcaaactacccacaacattgctctagggtatcagtttatccctgagttcggggttaaagcatcttatggctcagcatttaaggctcccaatttatatcaacagtacgatccgtcttatggcaatgttaatttacaaccggaagacgcagattcagcagagttgagcttctacggcttattttcaggtattaaatggtctatcactggctatgattacaaaatcaataacctgatcgattacaactcaacaacgaagaattaccaaaacgtaataggtgagagcaatataaaaggagttgagtttacagccgagtttgccactggaattgtgcagcaccagttaagtgttgacctcaaagatgccgatgatagtaaagggaaaacattacagcgtcgtgctgagcatatgtataagtggaatgcgctagtggctttcgaacaagtggattggtcaattggttaccaatatgtaggtaaacgcccagatttggactacaacacttaccccactcaaaacataacacttgatgcgtattctctcgttgatacctcagttagctactatgtcacagactcgacgactattagcgctcgaattgataacttattagataaagagtacgaaaccgccaatggctaccctgctgctgagcgcgcgtattatcttaatattggttatcagttttaa

SEQ ID NO: 1742 - protein, 611 aa, Vibrio cholerae
MQKSALAIALASLLTPISYLHANEAQPQETVVVTANRFEQKASSTLADVEIITRQDIEQTQAKTLPELLRRLTGVQITQNGGRGQLASLFVRGTSSDQVLVLVDGIRFARAAKGAVDFNQIPLTYVDRIEYVRGARASLYGSEAIGGVINIITKARSQQQGTTVSAGLGSLDYQELSIASGVAIGEKGQMNVALGTESDKGYNVRPVPGVNDGDRHGFRSDNALLGYVHQFDESWSLFANARAYENIYQYDNSYGTRDYKEAEKDDLSFTIGTQYQSERWVSELQLTTQKQKSWDYTQSKGKYSDTSDNLEQRNIQWINRYLVNDVWTFAGGVDWRDESYIDKTADKEFDRSNTAAFAVVAAEWQQWLLEASLRFDDNQEYGSQTTHNIALGYQFIPEFGVKASYGSAFKAPNLYQQYDPSYGNVNLQPEDADSAELSFYGLFSGIKWSITGYDYKINNLIDYNSTTKNYQNVIGESNIKGVEFTAEFATGIVQHQLSVDLKDADDSKGKTLQRRAEHMYKWNALVAFEQVDWSIGYQYVGKRPDLDYNTYPTQNITLDAYSLVDTSVSYYVTDSTTISARIDNLLDKEYETANGYPAAERAYYLNIGYQF

SEQ ID NO: 1743 - DNA, 1878 bp, Yersinia pestis
  CDS (1)..(1878)
atgacaattaaaaaatatacgctgctcacagccctttctgtgacggcattttctggctgggcgcagggtaataacaccacggacaacaatgatgaaatggttgtaacagccaaccgttttccacaaccgaaaagtagtgtattagcgcctgtcgatgtagtcactcgtgccgatattgatcgctggcaatctacaaatataaatgatgtcttacgccgcttaccgggtgttgatattgctcaggatggcggtatgggccagcgcagttctttatttatccggggcactaattctagccatgtcttggttctgatcgatggcgtccgcctcaatcaagcggggattaccggcgcatcagatctcagtcaaatccctatttcattggtacagcgcatcgaatacattcgtggtccacgttctgccgtctatggttcagatgccattggaggggtgattaatatcctgactggacgggataaaccaggaaccacactttctgctgggttgggttcaaacggttatcaaacctatgatggttccactcaacagaaactgggtgaagacacgacggtgacattggcgggaaattacacttatagcaaagggtatgatgtggttgctggtatgccgggagcaggtggaccacgtcagcctgaccgggatggtttcatggggaaaatgctgtgggcgggcttagaacatcagtttaacgagcagtttaatggttttgcccgagtatatggtttcgataaccgcagtgattatgacgggtataccaactatagcaatccattggcgttaatcgatacccgtaaactctccagccgtacctatgacacgggactacgctacaagaatggcatttatgcttcccaatttattgccagttataaccgaactaaagattataattacagcccacttttcggccagcatgatattacggcctcgttagatgaagctgagcaatataacttgcaatggggtaacaccttccagttaacgaatggcatgatcagtgcgggtgcggattggcaagagcaaagaaccgaacgtaaaagcagtaaccagaatactacggccgattttacgcagcacaacacgggcatctatttgacaggccaacagcaaatcagcgacgttacattagagggggctgtacgcagtgacgataactcgcagtttgggtggcactcaacttggcagaccagcgccggttgggaatttattgatggctaccgcttgattggttcttacggcacagcctataaggcacctaatctgatgcagctttatagcgcttacggtggtaatgccaatctgaaaccggaagaaagtaagcaatgggaaggtggcgtcgaaggattaacggggccgctgacttggcgtctatctgcttatcgtaacgatattgatcagcttatcgattacagcaatctgaccaacggttatttcaatatcaataaagccacgattaaaggtgttgaatggacaggttcgtttgatactgggccgttatcacatcaagtgacgctggaatatctggacccacgtaatgcagatacccacgaaattctggtgcgccgagccaagcaacaagtaaaatatcagttggattggcaggtagctgatttggattggtctgttacctaccaatatcttggtcagcgttatgacaaagactacagcacttatccagaagaaacggttgaactcggtggtgtgagcctttgggatctcgctgtttcgtatccggtcacatctcatctcacggttcgtggtagaattgccaacctgtttgataaagattatgagatggtttatggctaccaaaccccaggacgcgaatactacttcacgggaagctataacttctaa

SEQ ID NO: 1744 - protein, 625 aa, Yersinia pestis
MTIKKYTLLTALSVTAFSGWAQGNNTTDNNDEMVVTANRFPQPKSSVLAPVDVVTRADIDRWQSTNINDVLRRLPGVDIAQDGGMGQRSSLFIRGTNSSHVLVLIDGVRLNQAGITGASDLSQIPISLVQRIEYIRGPRSAVYGSDAIGGVINILTGRDKPGTTLSAGLGSNGYQTYDGSTQQKLGEDTTVTLAGNYTYSKGYDVVAGMPGAGGPRQPDRDGFMGKMLWAGLEHQFNEQFNGFARVYGFDNRSDYDGYTNYSNPLALIDTRKLSSRTYDTGLRYKNGIYASQFIASYNRTKDYNYSPLFGQHDITASLDEAEQYNLQWGNTFQLTNGMISAGADWQEQRTERKSSNQNTTADFTQHNTGIYLTGQQQISDVTLEGAVRSDDNSQFGWHSTWQTSAGWEFIDGYRLIGSYGTAYKAPNLMQLYSAYGGNANLKPEESKQWEGGVEGLTGPLTWRLSAYRNDIDQLIDYSNLTNGYFNINKATIKGVEWTGSFDTGPLSHQVTLEYLDPRNADTHEILVRRAKQQVKYQLDWQVADLDWSVTYQYLGQRYDKDYSTYPEETVELGGVSLWDLAVSYPVTSHLTVRGRIANLFDKDYEMVYGYQTPGREYYFTGSYNF

SEQ ID NO: 1745 - DNA, 2109 bp, Agrobacterium tumefaciens
  CDS (1)..(2109)
atggaattgaagtaccgcggccagaacaggactgcgacaataataaaggccggcgtttcggcagcaatggcgggaacggcgttgggttttgccgtgccggctttcgcgcagcaggcctccgagggaaacacggttcttcagcagatcgttgtcaccgcatccggcttcgagcagaatgtgaaggacgcacctgccagcatcacggttgttacgcgcgaggatctggaaaaggggtcttatcgcgatctgactgatgccctgcgggaagtgcagggtgtgtccgtcaccggcatcgccaatgaaaaggatgtttttattcgtggcctgcccggcgcttacacgctgatcctcgttgacggcaaaagacagagcacgcgcgatgcacgcaccaatggcaattccggtttcgaacagagtttcgtgccgccggtctcggcaatcgaacgcatcgaagtggtgcgcggtccaatgtcctcgctttatggttcggatgccatgggcggcgtcatcaacatcatcacccgcaaggtcggtgatgtctggtccggttccgtcaccaccgagggcacggtccagcagcattccaagttcggcaacagcggtcaggtctcctggtatgccaacgggccgatcctgaaggatcagcttggtctgcagctctggggcaggggttttacgcgcggcgaagaccgtattctgaacggcaccacgggcgccaaggaatatgatttcaacggccgcctgacatttacgccgaatgaagatcacgacatctatctagaaggcggcaagacccgcctgcgccgcgacgctgaacccggcgatacgctggctgcgacggatgccaatggcacctacaacaccaatacccgggatcactggtcgctttcgcatactggccgctgggggccgacgacgtccgaattctcgttccagcaggaatgggccgagcgtacaaatttcaccagaaacacccgtaccggcagggtaaccgaaaatccgcgctcaccggaaatccgtaacaccgttctcgacggcaagttcaccacgccgttcgaactattcggcaaccacacgctggtgaccggcgggcaatatttcgaggcgcggctgaccgaccagaatccgggccgccgcaccgaccgcgacgaaaccttctccgcaacgcagtgggcacttttcctcgaagatgaatggcgcatcgtcgataattttgcgctgacgggcggccttcgtctcgataatcacgagaaatacggcaatcatttcagcccgcggctttatggcgtttggagcgccaccgaagagctgaccatcaagggtggggtttccaccggtttccgtgccccggaaatccgccagatcgcgccgggttacgcctatactaccggtggcggcggttgcagctatggcccgagcggcacctgcggcgtgatcattggtgatcccaatctggaagcggaaaaaagcacgagttacgaaatagctgccctctgggacaatggcgacattgccctcggcgccacctatttctacaccgatttcaaggacaagatttccaatgcgctggtgctcaatccggatggaacgccggcccgctggagcgaggaccgtaactatcgtctctggtacaactacaacatcgacgatgcgatcattcagggcgtggagctgactgcgacctggtatgcgacatcggaactgacgctgcggggtaattacacctatacacattccgaacagaagaccggcgattatgaaggtttcccgctggcgcggacgcccgaacatatggccaatctgcgcggcgactgggtaaccccgatcgatgggctggaagcctgggtttcactgaattaccacggatcggaaattaatgccggcccgcgtatcggcgccaacggcacgccggtgacgatcaacggccagtccggccgtaaatacgatgcctacaccacgctggatatcggcgcgaaatatgcggttgccgagaatgtcgacctcaatgccgccgtctataatgtcttcgacaaggacgtcggcaccgatgatttcaacacggtcatggaaggccgtcgtttctggatcagcatgacggcaaaattctga

SEQ ID NO: 1746 - protein, 702 aa, Agrobacterium tumefaciens
MELKYRGQNRTATIIKAGVSAAMAGTALGFAVPAFAQQASEGNTVLQQIVVTASGFEQNVKDAPASITVVTREDLEKGSYRDLTDALREVQGVSVTGIANEKDVFIRGLPGAYTLILVDGKRQSTRDARTNGNSGFEQSFVPPVSAIERIEVVRGPMSSLYGSDAMGGVINIITRKVGDVWSGSVTTEGTVQQHSKFGNSGQVSWYANGPILKDQLGLQLWGRGFTRGEDRILNGTTGAKEYDFNGRLTFTPNEDHDIYLEGGKTRLRRDAEPGDTLAATDANGTYNTNTRDHWSLSHTGRWGPTTSEFSFQQEWAERTNFTRNTRTGRVTENPRSPEIRNTVLDGKFTTPFELFGNHTLVTGGQYFEARLTDQNPGRRTDRDETFSATQWALFLEDEWRIVDNFALTGGLRLDNHEKYGNHFSPRLYGVWSATEELTIKGGVSTGFRAPEIRQIAPGYAYTTGGGGCSYGPSGTCGVIIGDPNLEAEKSTSYEIAALWDNGDIALGATYFYTDFKDKISNALVLNPDGTPARWSEDRNYRLWYNYNIDDAIIQGVELTATWYATSELTLRGNYTYTHSEQKTGDYEGFPLARTPEHMANLRGDWVTPIDGLEAWVSLNYHGSEINAGPRIGANGTPVTINGQSGRKYDAYTTLDIGAKYAVAENVDLNAAVYNVFDKDVGTDDFNTVMEGRRFWISMTAKF

SEQ ID NO: 1747 - DNA, 2097 bp, Nostoc sp. PCC 7120
  CDS (1)..(2097)
atgagaaagagctttttttggctgcctgttgcttttcctagtttatttttagcatttccggctttgggtagtgatacggaaattactcaaacagtagataattctgatattccgtatttgagtgaaattgagttacccaccaccagtgctgaattattaactcaatcgacaccaggggacttaaatccagagggtgaacctagcgaacagccggaaattgaggaaacttctagtgacgatgcagatattaccatagaagcgatcgccgaaccagaaaccctgccagcatctactcccacttacgtcattgaccaagaagaaattcaaaaacaaggtgctaccagtgtcgctgatgtcttaaaaagaatgcctggttttgccattaatgatgttggtcatggtgcagatatacacacaggtacttattatcggggagcctcaattaatcagtctgtatttcttataaatggcagacgaattaacaatgatgtcaacacatatcatggtgcaactgacctgaatagcattcctgtagaatctattgagcgtgtcgaattatctagcggtgtgacctctgctttatatggttcctccgcttttggaggagtggttaatatcatcaccaaaaaaggttatccacaacctaaactgacaagtagtttagaatttggctcactcaatctcaataatcaacagtttagttatagtggggcagttggtgcggcgacttataattttagttttgagcggtactttgttgataaccgttatcgtgtgcctgtaggtgcagcaaatcgtgactcccaagggtttttatcaaatgcagatacatctactagcacctattttggcaatattggtttagatttagatcaaagaaactctttaagtttagatatcactaaactcagcagtcgtagaggcttagtttatttcggatttcccctacaaagagatagattagaccatgatggtttaaatattggtttatcttggaaaactcgcctcggtaatggcaataactctaacctgacaactacatttggttataaccaaaattatttcagcacctacggccctacagtttttgcaggtagagaattttatcgcactggtgttttagatacacaacaattcactggtaggattgatcatgattggagaatttctccaaataataagttgcgttggggactagatttaaaaaatactgatttaagtggcgatgttttaagctctagtccgaatcggattgcgtttaacgaaactgaaaatagaaacgtattaaatacagctttatttgctgtgaatacatggaatctgagtaatagttttcagttagatttaggactgagacaaagttttgatggtcagtttggcaattatcttaatcctagtgtggggctacgttacgacatcacaccattaattgctatgcgtggtagttgggctggaggacagcgcaacccaggtttagatcagttatatgtttatgatacagttcatggttgggaagcaaacccagatttagagccggagacaggttcctcttggactgcgggggtagatgtcaagcttgctgataatttaacagggcagtttacctattttggcagcagtctgaataatcgcttaggaattgtggctggaagatgggcaaatattggcttagtagataccaatggtttagaagccgcactgcaattaaaagttgccgctaactggtcaacttttctcaactacacttatacagatgcccaaattaagacaggttcagaaagaggtttacagttgggaatgattccctattctgtattacaaactggcgtaggttatcaaaactcaggatggcaggctaatttgtatgttacctacaatagtggcgctcgtagagcttttttcacccgaccaggtgagacaactaccgatttcgtcccgtcttttgtcaatttagatttgagtggtcgtattcccttaactcgtactttaggactaacagtttacttggaaaatttactaggtgaacaatatgagcgagtgaatcgaatttatagtcctgggtttacttttcgcttgggtttaagttcgagtatttaa

SEQ ID NO: 1748 - protein, 698 aa, Nostoc sp. PCC 7120
MRKSFFWLPVAFPSLFLAFPALGSDTEITQTVDNSDIPYLSEIELPTTSAELLTQSTPGDLNPEGEPSEQPEIEETSSDDADITIEAIAEPETLPASTPTYVIDQEEIQKQGATSVADVLKRMPGFAINDVGHGADIHTGTYYRGASINQSVFLINGRRINNDVNTYHGATDLNSIPVESIERVELSSGVTSALYGSSAFGGVVNIITKKGYPQPKLTSSLEFGSLNLNNQQFSYSGAVGAATYNFSFERYFVDNRYRVPVGAANRDSQGFLSNADTSTSTYFGNIGLDLDQRNSLSLDITKLSSRRGLVYFGFPLQRDRLDHDGLNIGLSWKTRLGNGNNSNLTTTFGYNQNYFSTYGPTVFAGREFYRTGVLDTQQFTGRIDHDWRISPNNKLRWGLDLKNTDLSGDVLSSSPNRIAFNETENRNVLNTALFAVNTWNLSNSFQLDLGLRQSFDGQFGNYLNPSVGLRYDITPLIAMRGSWAGGQRNPGLDQLYVYDTVHGWEANPDLEPETGSSWTAGVDVKLADNLTGQFTYFGSSLNNRLGIVAGRWANIGLVDTNGLEAALQLKVAANWSTFLNYTYTDAQIKTGSERGLQLGMIPYSVLQTGVGYQNSGWQANLYVTYNSGARRAFFTRPGETTTDFVPSFVNLDLSGRIPLTRTLGLTVYLENLLGEQYERVNRIYSPGFTFRLGLSSSI

SEQ ID NO: 1749 - DNA, 1953 bp, Caulobacter crescentus
  CDS (1)..(1953)
atgatccgagccctcttgagctccaccgccctggccaccgcgctgctggctgctccggccctcgccgatgaccagaaggcccctgaagccgacgtcgccggcgccaccggcgccaacggcgtcgccgaactggtggtcaccgccacccgcaccgtgcaaccgatcgagaaggtcggcgccgcggtgaccgtcctgacccagcccgcgatcgaggccagccaggccatctcggtcaccgaactgctggcccagacgcccagcgtgaccttcgcccgcaacggcggcgtcggcacggcgaccagcctttatatccgcggcgccgagagccatcacaccgtcgtgctgatcgacggcgtcaagctgaacgatccgtcgtccatccagggcggcttcaacagcggcaacctgctggtcggcgacatctcgcgcatcgaagtgctgcgcggcgcgcaatccaccctctggggcagccaggcggtcggcggcgtcgtcaacattgtcaccgccgaaccgaccacgccgttcaccagctcgctgtcggccgaggccggcgcgcgcaaaaccggctatctgcgcggcgccgtcggcggcgcttcggacaaggtcacctggcgtgtcgcgggcggctattacaccaccgacggtttctccgcccacaagacgggcaaggaggcggacggctatcagaacgcgggcgcctcgggccgcctgcgggtgaaactgaccgatgcggtctcggtcgagacccgggcggtctattcgcgcggcaagaacgacttcgacggcttcaacaccgacagccccgagtttggccgcaccaaggagctggtgatctatcaaggcctgaacgccgccttgctggacggtcgttggaacaaccgcgtcggctttgcctataccgacaccgaccgcgagaactacaatcccgcccgcgccgccgtgccgatgacgttcgatgcggccggcaagaacaagcgctgggaatatcagggcgtgttcgcgatcaccgagacctggaccgcgaccttcggcgccgagagcgaacgctcgcgcatgcgcacccgctcgccgtcggtcgccaatccgaacgtggcgttccgcaccggcaagaccagcgccgacagcctgtatggccaactgcaggccgagatcgcccccggcctgacggtgaccggcggtctgcgctacgaagaccacgacgcctacggcgcccacacgctggggcaagtcggcgcggcctgggccctgaatgacaacgccacggttcttcgtgccggctacagccaaggcttccgcgcgccgggcctctatgagctgttcagcgagtacggcaatcccgcgctgtctcctgaagagttcgacagctgggaagccggcgtcgagcagcgctttctggagggcaaggtccgcgcctcggcgacggtcttccaccgtgaggccgacaacgagatccgcttcttctcgtgctcgttcggcgcgactgacacgatatgcgcgccgggcggggtcttccggttcggctactaccgcaatctgcagaagaccaaggcccaggggctggagctgatcgccgaggcgcgcccggtcgagggcctgacgatcaccggcaactacacctataccgaggccgaactggcggcgggcgcgaacaccggcaagcagctgtcgcgtcgcccgaaggacctcgccaacctgtcggcgacctatcgctggccggtggggctctcgaccacggtggcggtgcgctatgtgggcaagacctacaataacgaggccaacaccgtggcggtgtcggactatgcgacggtggatctgcgggcgtcctatccgatcagcgagaccctggaggtctatggtcgggtcgagaacgccttggacaaggactatcagacgatcctgaactacggcacgccgggccgtggcgcgttcctgggtctgcgggcgcgcttctag

SEQ ID NO: 1750 - protein, 650 aa, Caulobacter crescentus
MIRALLSSTALATALLAAPALADDQKAPEADVAGATGANGVAELVVTATRTVQPIEKVGAAVTVLTQPAIEASQAISVTELLAQTPSVTFARNGGVGTATSLYIRGAESHHTVVLIDGVKLNDPSSIQGGFNSGNLLVGDISRIEVLRGAQSTLWGSQAVGGVVNIVTAEPTTPFTSSLSAEAGARKTGYLRGAVGGASDKVTWRVAGGYYTTDGFSAHKTGKEADGYQNAGASGRLRVKLTDAVSVETRAVYSRGKNDFDGFNTDSPEFGRTKELVIYQGLNAALLDGRWNNRVGFAYTDTDRENYNPARAAVPMTFDAAGKNKRWEYQGVFAITETWTATFGAESERSRMRTRSPSVANPNVAFRTGKTSADSLYGQLQAEIAPGLTVTGGLRYEDHDAYGAHTLGQVGAAWALNDNATVLRAGYSQGFRAPGLYELFSEYGNPALSPEEFDSWEAGVEQRFLEGKVRASATVFHREADNEIRFFSCSFGATDTICAPGGVFRFGYYRNLQKTKAQGLELIAEARPVEGLTITGNYTYTEAELAAGANTGKQLSRRPKDLANLSATYRWPVGLSTTVAVRYVGKTYNNEANTVAVSDYATVDLRASYPISETLEVYGRVENALDKDYQTILNYGTPGRGAFLGLRARF

SEQ ID NO: 1751 - DNA, 1851 bp, Pseudomonas aeruginosa
  CDS (1)..(1851)
atgaacagagttttcctgaccccggcagccgtggcgctgtgcggcgcgtcttccctgagcctggccgaaccggtcagccttgccgaccaggtggtgaccgccacccgtaccgcccagaccgcttcccagagcctggcggcggtgagcgtcatcgaccgcgaggatatcgagcgcagccaggcgcgcagcgtgccggagctgttgcgccaggtacccggcgtgtcgctggcgaacaacggcggtttcggcaagaacaccacgctgttcctgcgcggcaccgagtccgaccatgtgctggtgctgatcgacggcatcaaggtcggctcggccagcgctggcctcaccgcgttccaggacttgccggtggagctgatcgagcgcatcgaggtggtccgcgggccgcgttccagcctgtacggctcggaggccatcggcggggtgatccagatcttcacccggcgcggcgacggccagggcgccaagccgttcttctccgccggttacggcacccatcagaccctggagggcagcgccggggtcagcggcggcgccggcaacggctggtacagcctcggggtgagcagcttcgatacggcggggatcaataccaagcgcgccggtactgcgggctatgagccagaccgagacggctaccgcaacctgtccggcaacctgcgcggcggctatcgcttcgacaatggcctggaactcgacggtaccctgctgagggccaagtcgcacaacgactatgaccaggtcttcggcaactccggtttcaatgccaacgccgacggcgagcagaacctggtcggcggccgtgcccgcttcactccgttcgatccctggctggtgaccctccaggccgggcgcagcgaggacaaggccgatgcctatcaggatggccgtttctactcgcgcttcgatacccgtcgcgacagcctgtcctggcagaacgacctgaccctggccgaaggccatgtgctgaccctcggctacgactggcagaaggacgagatcagcagcagcgaagccttcagcgtcgactcgcggctgaacaaaggctggttcgcccagtacctcggccagtacggtcgccaggattggcaactgagcctgcgccgcgacgacaaccagcagttcggcgtgcacgacaccggcagcgccgcctggggctacgcgctgagcgacgcgctgcgcttcaccgtcagctacggcacggcgttcaaggcgccgaccttcaacgaactctactaccccgactacggcaatcccgacctggacgccgagacttcgcgcagcctggaagtcgggctgagcggtacgcatggctgggggcactgggcggtaaatgccttccgtaccaacgtcgacgacctgatcggcaacgatccgcgtccggcgccggggcgcccctgggggcagccgaacaacatcgacgaagcgcgcatccgtggcgtcgaactggtcctcggcagccagtggctgggctgggactggaacgccaacgcgaccttcctcgacccgcaaaaccgttccggcggcgtcaacgacggcaacgagctgccgcgccgggcgcggcggatgttcaacctggaactggaccggcgcttcgagcgtctttcgctgggcgccagcgtgcacgccgaaggccgacgctatgatgacccggccaacaaggtgcgcctgggcggctacgccaccctcgacctgcgcagcgaataccggctgaacgacgaatggcgcctgcagggccggatcgccaacctgttcggtgccgaccacgaaaccgcgtatggctacaaccagcctggccaggcggtctacctcagcgtgcgctaccaggctctgtga

SEQ ID NO: 1752 - protein, 616 aa, Pseudomonas aeruginosa
MNRVFLTPAAVALCGASSLSLAEPVSLADQVVTATRTAQTASQSLAAVSVIDREDIERSQARSVPELLRQVPGVSLANNGGFGKNTTLFLRGTESDHVLVLIDGIKVGSASAGLTAFQDLPVELIERIEVVRGPRSSLYGSEAIGGVIQIFTRRGDGQGAKPFFSAGYGTHQTLEGSAGVSGGAGNGWYSLGVSSFDTAGINTKRAGTAGYEPDRDGYRNLSGNLRGGYRFDNGLELDGTLLRAKSHNDYDQVFGNSGFNANADGEQNLVGGRARFTPFDPWLVTLQAGRSEDKADAYQDGRFYSRFDTRRDSLSWQNDLTLAEGHVLTLGYDWQKDEISSSEAFSVDSRLNKGWFAQYLGQYGRQDWQLSLRRDDNQQFGVHDTGSAAWGYALSDALRFTVSYGTAFKAPTFNELYYPDYGNPDLDAETSRSLEVGLSGTHGWGHWAVNAFRTNVDDLIGNDPRPAPGRPWGQPNNIDEARIRGVELVLGSQWLGWDWNANATFLDPQNRSGGVNDGNELPRRARRMFNLELDRRFERLSLGASVHAEGRRYDDPANKVRLGGYATLDLRSEYRLNDEWRLQGRIANLFGADHETAYGYNQPGQAVYLSVRYQAL

SEQ ID NO: 1753 - DNA, 1962 bp, Pseudomonas aeruginosa
  CDS (1)..(1962)
atgaccccccattcctccccgcaccgtcttcctccgctgcggctggcccgcgccgtgccgttcctctacctgcttccctgcctggcgctggccgcgccggtcgacctggagccgaccgtggtcagcgccaccactaccgagcgcaagctgcgcgacgccccggccagcgtttcgctgatcgccgccgaggacctgcggcggcgcccggtgcgcgacctgcaggaagccctgcgcggttcggaaagcctgcagttcaacggcgtcggcatgtcccggcggggcatcagcgttcgcggcatgtccagcgagcacaccctggtgctggtggacggccagcggatctccacctcgtccggggccatcgcccattccgacttcgacctcggctgggtgccggtggagagcatcgagcgtatcgaggtggtacgcggaccgatgtcctcgctctacggttcggaagccctcggcggggtggtgaacgtgatcacccggcgcgccaccgatacctggacgggcagcggtctgctcgatggcggcgtgcgcgaggacggcctcggcgggcagagccaccagctcggcgcctatctcgccgggccgctggtgcccggcaagctgggcctcgccctgaacggcgagagccgccgccagcaggaaaccccggacgccgatgagcgccgactctccgagctggaaggcggcaacgccgacagcggtgggctgaacctcagctggaccccggacgacgcccagcgcatcgacctcggccaccagcgcgggcgcgaacgacgctggcgcaacagcgagaccggagggccgcgctcgcgctactacgagtcgcgcgacgtgatcgaacgcgagcgctggtcgctcgcccacaatggccagtgggactggggcagcagccagctgcgcacctaccgcaaccgcctggagcggcacaacgcgcgttccgacggacaaccgccgagcaacccgcagcgccttaccgacagcgtggtcgacggccacctcagcgtgccggccttcgagcgacatctcttcaccctcggcggcgaatggcgcaaggaagaactggaggatcgctcggtgaataccgccggcgacgccagcgcgcgacacaaggcgctgttcctgcaggacgagatcgccttcggcccggactggtcgctgaccctcggcagccgcttcgacaagcacgaggcgttcggctgggaaagcagtccgcgcctgtacctgctgcaccacctttccgatgtgctgaccctgcgcgccggcgtcggccgcggctacaaggcgccgagcctgaagcagctatcgccggagtatgcggcggtcggtggcggcgggcgcttcaccatctacggcaatcccgacctgaagccggagaccaatacgtcctacgaactgggcgccgactaccagggcgatggctggtcgctgaagggcacggtgttcgagaacgatgtccgcgacctgatccagaccgtctgcgtagcgcgctgcggggtgcgcggcggcgagatacgcaactacgagaacgtcgacagggcacggatccgcggcctcgagctgggcggcggcgtggacctgccggcggacctgcgctgggaactcaactacacctacctcgacgcgcgcaaccgcaccgccggccagcgcctcggcgatcgctcccggcacctcgccaacagccaattgcgctggagccccaatgtccgcttcagcgcccagttgcgcaccgaatacgtcggcagccaggtggcctacagcagcaacgtcggctacgccttgccggcctacagcctgtggcacctggagctgagccagaaactcagcgagaacctgacgctgcgcggcggcatcgagaaccttggcgaccagcgcctggccgacgacgacacgcacttcacctatgccgaacctgggcggaccttccatctcggcctggtggcgagcttctga

SEQ ID NO: 1754 - protein, 653 aa, Pseudomonas aeruginosa
MTPHSSPHRLPPLRLARAVPFLYLLPCLALAAPVDLEPTVVSATTTERKLRDAPASVSLIAAEDLRRRPVRDLQEALRGSESLQFNGVGMSRRGISVRGMSSEHTLVLVDGQRISTSSGAIAHSDFDLGWVPVESIERIEVVRGPMSSLYGSEALGGVVNVITRRATDTWTGSGLLDGGVREDGLGGQSHQLGAYLAGPLVPGKLGLALNGESRRQQETPDADERRLSELEGGNADSGGLNLSWTPDDAQRIDLGHQRGRERRWRNSETGGPRSRYYESRDVIERERWSLAHNGQWDWGSSQLRTYRNRLERHNARSDGQPPSNPQRLTDSVVDGHLSVPAFERHLFTLGGEWRKEELEDRSVNTAGDASARHKALFLQDEIAFGPDWSLTLGSRFDKHEAFGWESSPRLYLLHHLSDVLTLRAGVGRGYKAPSLKQLSPEYAAVGGGGRFTIYGNPDLKPETNTSYELGADYQGDGWSLKGTVFENDVRDLIQTVCVARCGVRGGEIRNYENVDRARIRGLELGGGVDLPADLRWELNYTYLDARNRTAGQRLGDRSRHLANSQLRWSPNVRFSAQLRTEYVGSQVAYSSNVGYALPAYSLWHLELSQKLSENLTLRGGIENLGDQRLADDDTHFTYAEPGRTFHLGLVASF

SEQ ID NO: 1755 - DNA, 2241 bp, Escherichia coli
  CDS (1)..(2241)
atgaacaagaagattcattccctggccttgttggtcaatctggggatttatggggtagcgcaggcacaagagccgaccgatactcctgtttcacatgacgatactattgtcgttaccgccgccgagcagaacttacaggcgcctggcgtttcgaccatcaccgcagatgaaatccgcaaaaacccggttgcccgcgatgtgtcgaagatcatccgtaccatgccaggcgttaacctgaccggtaactccaccagtggtcagcgtgggaataaccgacagattgatattcgcggtatgggtccggaaaacacgctgattttgattgacggcaagccggtaagcagccgtaactcggtgcgtcagggctggcgtggcgagcgcgatacccgtggtgatacttcctgggtgccacctgaaatgattgaacgtattgaagttctgcgtggtccggcagctgcgcgttatggcaacggcgcggcgggcggcgtggttaacatcattaccaaaaaaggcagcggcgagtggcacggctcctgggacgcatatttcaatgcgccagaacataaagaggaaggtgccaccaaacgcactaactttagcctgaccggtccgctgggcgacgaattcagcttccgtttgtatggcaacctcgacaaaacccaggctgacgcgtgggatatcaaccagggccatcagtccgcgcgtgccggaacgtatgccacgacgttaccagccgggcgcgaaggggtaatcaacaaagatattaatggcgtggtgcgctgggatttcgcgccattgcaatcgctggaactggaagcaggttacagccgccagggtaacctgtatgcgggcgacacccagaataccaactccgattcctatacccgctcgaaatatggcgatgaaaccaaccgtctgtatcgccagaactacgcgctgacctggaacggtggctgggataacggcgtgaccaccagcaactgggtgcagtacgaacacacccgtaactcgcgtattccggaaggtctggcgggcggtaccgaagggaaatttaacgaaaaagcgacacaggatttcgtcgatatcgatcttgatgacgtgatgctgcacagcgaagttaacctgccgattgatttcctcgttaaccagacgctgacgctgggtacggagtggaatcagcaacggatgaaggacttaagttccaacacccaggcactgaccggaacgaataccggtggcgctattgatggcgtgagtaccaccgaccgtagcccgtattcaaaagcagaaattttctcgctgtttgccgaaaacaacatggagctgactgacagcaccatcgtaacgccggggctgcgtttcgatcatcacagtattgtcggcaataactggagcccggcgctgaacatatcgcaaggtttaggcgatgacttcacgctgaaaatgggcatcgcccgtgcttataaagcgccgagcctgtaccagactaacccgaactacattctctacagtaaaggtcagggttgctatgccagcgcgggcggctgctatctgcaaggtaacgatgacctgaaagcagaaaccagcatcaacaaagagattggtctggagttcaaacgcgacgggtggctggcgggcgtcacctggttccgtaacgattatcgcaataagattgaagcgggctatgtggctgtagggcaaaacgcagtcggcaccgatctctatcagtgggataacgtgccgaaagcggtggttgaaggtctggaaggatcgttaaacgtaccggttagcgaaacggtgatgtggaccaataacatcacttatatgctgaagagtgaaaacaaaaccacgggcgaccgtttgtcgatcatcccggagtatacgttgaactcaacgctgagctggcaggcacgggaagatttgtcgatgcaaacgaccttcacctggtacggcaagcagcagccgaagaagtacaactataaaggtcagccagcggttggaccggaaaccaaagaaattagtccttacagcattgttggcctgagcgcgacctgggatgtgacgaagaatgtcagtctgaccggcggcgtggacaatctgttcgacaaacgtttgtggcgtgcgggtaatgcccagaccacgggcgatttggcaggggccaactatatcgccggtgccggggcgtatacctataacgagccgggacgtacgtggtatatgagcgtaaacacccacttctga

SEQ ID NO: 1756 - protein, 746 aa, Escherichia coli
MNKKIHSLALLVNLGIYGVAQAQEPTDTPVSHDDTIVVTAAEQNLQAPGVSTITADEIRKNPVARDVSKIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSTTDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 1757 - DNA, 1992 bp, Escherichia coli
  CDS (1)..(1992)
atgtttaggttgaaccctttcgtacgggtcgggctgtgtttgtccgctatttcttgtgcatggcctgtgttagcggtcgatgatgatggcgaaacgatggttgtcactgcatcttccgtggaacaaaatcttaaagatgcacctgccagtatcagcgtcattacccaggaagacctgcagcgaaaaccggtacagaatctgaaggatgtcctcaaagaagtgcctggcgtacaactgacgaacgaaggggataaccgtaagggcgttagtattcgtggtctggacagcagctataccctgattctcgtcgacggtaaacgcgtgaactcccgcaatgccgtcttccgccacaatgatttcgatctgaactggatcccggtcgattccatcgaacgtattgaagtggtccgtggcccgatgtcgtcgctgtacggttccgatgcgctcggcggtgtagtgaatatcatcaccaaaaaaatcggtcagaaatggtcgggtaccgttaccgtcgataccaccattcaggaacatcgcgatcgcggtgacacctataacggtcagttctttaccagtggaccattaattgatggtgtgctgggaatgaaagcttacggcagcctggcaaaacgtgaaaaggatgacccgcaaaactcaacgaccaccgataccggagaaacgccgcgtattgaaggattctccagccgcgacggcaatgtcgaatttgcctggacaccgaatcaaaatcacgattttactgccggatacggtttcgaccgtcaggatcgtgattccgactcgctggacaaaaaccgcctggaacgccagaactactccgtcagccataatgggcgttgggattacggcaccagcgaactgaaatactacggtgagaaagtcgagaacaaaaaccctggcaacagcagcccgataacttccgaaagcaatacggtcgacggcaaatacacgttgccgctgacggcgattaatcagtttctcacggttggcggtgaatggcgtcacgacaaacttagcgatgcggtgaacctgaccgggggaaccagctccaaaacgtctgccagccagtacgcgctgtttgtggaagatgaatggcggatcttcgagccgctggcgctgacgaccggcgtgcgtatggacgatcacgaaacctacggtgaacactggagtccgcgtgcctacctggtttataacgccaccgacaccgtaacggtgaaagggggctgggcgacggcatttaaagcaccttctctgttgcaacttagccctgactggacgagcaattcctgccgtggcgcatgtaagattgtgggtagcccggatctgaaaccagaaaccagcgaaagttgggagctggggctttactacatgggtgaagaaggctggctggaaggggttgaatccagcgttaccgttttccgtaacgatgtgaaagatcgtatcagcatcagccgtacgtctgacgtcaacgctgcaccgggctaccaaaactttgttggttttgagacgggcgctaacggacggcgcataccggtatttagctactacaacgttaacaaagctcgtattcagggcgtggaaaccgaactgaaaattccgttcaacgatgaatggaaactgtcgatcaactacacctacaacgatggtcgtgatgtcagcaacggcgaaaacaaaccgctatccgatctgccgttccatactgctaacggtacgctggactggaaaccgctggcgctggaagactggtcattctatgtttctgggcactataccgggcagaaacgcgccgacagcgcgacggctaaaacaccgggcggttataccatctggaataccggcgcggcctggcaggtgactaaagacgtcaaactgcgcgcaggcgtgctgaaccttggcgacaaggatctcagtcgtgacgactacagctataacgaagacggacgtcgttactttatggcagtggattatcgcttctga

SEQ ID NO: 1758 - protein, 663 aa, Escherichia coli
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 1759 - DNA, 1959 bp, Vibrio cholerae
  CDS (1)..(1959)
atgtccagattcaatccatcccccgtcagtttatctgtgacactaggcttaatgttttcggctagcgcttttgctcaagacgcgacgaaaacggatgaaaccatggtggtcactgcggcgggatacgcgcaagtgattcaaaatgcaccagccagtatcagtgtgatttcaagagaagatctggaatctcgctattaccgtgatgtgaccgatgcgctaaaaagcgtaccgggtgtgacagtcaccggagggggcgatactaccgatatcagcattcgtggtatgggatcaaactatactcttatcttggtggatggtaagcgccaaacctcacgccagacccgtccaaacagcgatggcccgggcattgagcaaggttggttaccgccactgcaagcgattgaacgtatcgaggtgatccgtggcccgatgtctacgctgtacggctcggatgcgattggcggcgtgatcaacatcatcactcgtaaagatcagcagcagtggtcaggcaatgtgcagctatcgaccgtggtacaagaaaatcgcgcctcaggcgatgaacaaagcgctaatttcttcgtaacaggacctttaagtgatgctctatcgctgcaagtctacggacaaaccacgcaacgcgatgaagacgaaattgagcatggttacggcgataaatcactgcgcagcttaacctcaaagctcaactaccagcttaatccagatcatcaactgcaactggaagccggtgtatcagcccaagatcgcgaaaataacgtgggcaagtcggcgcaatccagcggatgtcgcggtacatgcagcaataccgataaccagtaccgtcgcaaccatgttgccgtctctcaccaaggggattggcagggtgttgggcagtctgatacttatctgcaatatgaagagaacaccaataaatctcgtgagatgagcattgataatacggtgttcaaatccacgttagtggctcctattggtgagcatatgttgagctttggtgtggaaggtaaacacgaaagtttagaggataaaacctccaacaaaatttcgtctcgcacgcatatctcgaacactcaatgggcgggattcattgaagatgaatgggcgctcgcagagcaattccgcctgacctttggtggccgtctggatcatgataaaaactacggcagccacttcagcccacgtgtgtatggcgtatggaatctcgatcctctatggacagtaaaaggtggtgtttctactggcttccgtgcaccgcaattacgtgaagtgacgccggattgggggcaagttagtggcggcggtaatatttacggcaacccggatttacagcctgaaacttcgattaacaaagaactgagtttgatgtacagcactggctcaggtctggcggcatcgttaaccgctttccataatgattttaaagataaaatcacccgcgtcgcttgccctgcaaatatttgtactgccggccccaaccaatggggtgcaactcctacttatcgtgtgaatattgatgaagcggaaacctatggtgcagaagctacgttaagtctgccgattaccgaaagcgttgagttatcgtctagctacacgtacacccattcggagcaaaaatcagggaattttgctggccgtccgctactgcagttacctaaacatctgttcaatgccaacttgagctggcaaaccacagatcgcctcaatagctgggctaacctcaactatcgtggtaaggagatgcagccggagggtggggcatcgaacgatgatttcatcgcgccaagctacacctttatcgatactggcgtgacttacgcactcaccgataccgcaacgattaaagctgcggtgtacaacctgtttgatcaagaggtgaattacgcggagtatggctatgtagaagatggccgccgctactggttgggtttagacatcgccttctaa

SEQ ID NO: 1760 - protein, 652 aa, Vibrio cholerae
MSRFNPSPVSLSVTLGLMFSASAFAQDATKTDETMVVTAAGYAQVIQNAPASISVISREDLESRYYRDVTDALKSVPGVTVTGGGDTTDISIRGMGSNYTLILVDGKRQTSRQTRPNSDGPGIEQGWLPPLQAIERIEVIRGPMSTLYGSDAIGGVINIITRKDQQQWSGNVQLSTVVQENRASGDEQSANFFVTGPLSDALSLQVYGQTTQRDEDEIEHGYGDKSLRSLTSKLNYQLNPDHQLQLEAGVSAQDRENNVGKSAQSSGCRGTCSNTDNQYRRNHVAVSHQGDWQGVGQSDTYLQYEENTNKSREMSIDNTVFKSTLVAPIGEHMLSFGVEGKHESLEDKTSNKISSRTHISNTQWAGFIEDEWALAEQFRLTFGGRLDHDKNYGSHFSPRVYGVWNLDPLWTVKGGVSTGFRAPQLREVTPDWGQVSGGGNIYGNPDLQPETSINKELSLMYSTGSGLAASLTAFHNDFKDKITRVACPANICTAGPNQWGATPTYRVNIDEAETYGAEATLSLPITESVELSSSYTYTHSEQKSGNFAGRPLLQLPKHLFNANLSWQTTDRLNSWANLNYRGKEMQPEGGASNDDFIAPSYTFIDTGVTYALTDTATIKAAVYNLFDQEVNYAEYGYVEDGRRYWLGLDIAF

SEQ ID NO: 1761 - DNA, 1839 bp, Citrobacter freundii
  CDS (1)..(1839)
atgatcaaaaaatcattgctgtgcacggcgctgtccgtcacggcattttctggttgggcacaggacactcgcccggatactctcgtcgtcactgccaaccgttttcagcagcctcgtagcgcagtactcgctcctattaccgttgttacgcgtcaggatatcgatcgctggcaatctacctccgtgaatgatgtgcttcgtcgcctgcctggcgtcgatatcgctcaatacggtggtatgggacaaaactcgtctatctctattcgcggcaccaacgccagccatgttctggtgctgattgacggcgtgcgcctgaacctggcaggggttagcggcgcagccgatctcagccagttcccggtctcgttagtgcagcgtatcgaatacattcgagggccgcgttcggcggtttatggttctgatgcgattggcggcgtggtgaatatcattaccacgcgcgaaaagccggggacggaactgaccgctggcgtgggaagcaatggctaccagaattacgatgtctcaacccaacaacagctcggcgaaaatacgcgcgtcacgctgatgggcgattatgcctataccaaaggctttgatgttgtagcatacggcagcaccggctctcaggctcagcccgataaagacggttttttaagtaaaacgctgtatggcgcgctggaacacaacttttccgatacatggagcgggtttgttcgcggttatggttatgataaccgcacgaattacgactcatattactctcctggctcgccgctcctcgatacccgaaaactctacagccaaagctgggatgccggactgcgttttaatggcgagcttatccagtcgcagctggtttcgagctatagccatagcaaagactacaactatgatccggattatggccgctatgattcctcggccacactggatgagatgaagcaatataatgtgcagtggtcaaacagcatagtggttggtcatggtaatgtgggcgctggtgtcgactggcaaaagcaaactacggagcctggcaccgggtatgtcacggacggttacgaccagcgaaataccggcctctacttgacgggattacagcaactgggtgatttcactttcgaaggtgctgcgcgcagtgatgataactccgagtttggacgtcatggcacatggcaaaccagcgccggatgggagtttattgaaggctatcgctttattgcgtcctacggtacatcttacaaagcacctaatctcgggcagttgcatggttattacggcaattcgaacctggatcctgaacaaagtaagcaatgggaaggggcgtttgaaggcttaacggcgggtgtgaactggcgagtttcagggtatcgtaacgatatcgatgacatgatcgattatgacccacataccgagaaatactttaacgaaggtaaagtacgcattaaaggcgttgaagcgaccgcaaactttgataccggaccgctggcacatacgttgagctacgatatggtcgattcgcgcaatgcaattacggacaagccgctcgcacgacgttctaaacagcaggtgaaataccagcttgactggcaggtctatgattttgactggggcctgacgtatcactacctgggaacgcgttatgacacggactacgtaacctaccagccggtaaaaatgggaggagttagcctgtgggatcttgccgtgtcatatccaatcacctcacagctgacagttcgtggtaaaatcgccaaccgtttcgataaagattacgagacagtttatggctacgcaactgcaggacgggaatacaccttgtctggcagctacaccttctga

SEQ ID NO: 1762 - protein, 612 aa, Citrobacter freundii
MIKKSLLCTALSVTAFSGWAQDTRPDTLVVTANRFQQPRSAVLAPITVVTRQDIDRWQSTSVNDVLRRLPGVDIAQYGGMGQNSSISIRGTNASHVLVLIDGVRLNLAGVSGAADLSQFPVSLVQRIEYIRGPRSAVYGSDAIGGVVNIITTREKPGTELTAGVGSNGYQNYDVSTQQQLGENTRVTLMGDYAYTKGFDVVAYGSTGSQAQPDKDGFLSKTLYGALEHNFSDTWSGFVRGYGYDNRTNYDSYYSPGSPLLDTRKLYSQSWDAGLRFNGELIQSQLVSSYSHSKDYNYDPDYGRYDSSATLDEMKQYNVQWSNSIVVGHGNVGAGVDWQKQTTEPGTGYVTDGYDQRNTGLYLTGLQQLGDFTFEGAARSDDNSEFGRHGTWQTSAGWEFIEGYRFIASYGTSYKAPNLGQLHGYYGNSNLDPEQSKQWEGAFEGLTAGVNWRVSGYRNDIDDMIDYDPHTEKYFNEGKVRIKGVEATANFDTGPLAHTLSYDMVDSRNAITDKPLARRSKQQVKYQLDWQVYDFDWGLTYHYLGTRYDTDYVTYQPVKMGGVSLWDLAVSYPITSQLTVRGKIANRFDKDYETVYGYATAGREYTLSGSYTF

SEQ ID NO: 1763 - DNA, 2229 bp, Pseudomonas aeruginosa
  CDS (1)..(2229)
atgtacccccaattccgtcgcggccatctcgccgctgccgtccttttcgcttcatcgagcctgctgggcgggcaggccctggccgaggacgagcgcctggaagaactggacgaacgcgccgaatcggtggtccagctgggtgacgaggtggtgctgggcaccgccgaacaggagctcaagcaggcaccgggggtatccatcatcaccgccgaggacatcaggaagcgcccgccggtgaacgatctctccgagatcatccgcaccatgcccggggtcaacctcaccggcaacagttccagcggccagcgcggcaacaaccggcagatcgacatccgcggcatggggccggagaacaccctgatcctggtcgacggcaaaccggtcagctcgcgcaactcggtgcgctacggctggcgcggcgaacgcgacacccgcggcgacagcaactgggtgccgccggaggaggtcgagcgcatcgaggtcctccgtgggcccgcggcggcacgctacggttccggcgcggcgggcggggtagtcaacatcatcaccaagcgcccgaccgatcgtttgcgtggttccatgacggtgttcaccaacattccggaaagctccaaggatggcgccacgcgccgcgccaacttcagccttagcgggccgctgaccgaagccttgagcttccgcgcgtacggcagcgcgaacaagaccgattcggacgataccgacatcaacctcggacataccgtcaacccgagccgtaccgtggccggacgcgaaggggtacgcaatcgcgatctcagcgggatgctgtcgtggcaggtgacccccgaccaggtcgtcgatttcgaagcgggcttcagccgacagggcaatatctatgccggcgatacccagaacaacaacggcaccgccaatacccagggactcgccgacgacggtgcggagaccaaccgcatgtatcgcgagaactacgccatcacccacaacgggacctggtcgttcggtacttccaggttcgtcgcccagtacgactccacccgcaaccaaccgtctggaggagggctggccggttccgtcgaggggcagatcggcgccgaccgttcgttcagcgccagcaagctggagaactatcgcctcagcggcgaactcaaccttccgttgcatgcgttgttcgagcaggtgctgacggtgggcgcggagtggaacaaggaaaccctcaacgacccgtcctcgctcaagcagggcttcgtgggaagcgatagcttgccggggacccccgcggccggctcgcgaagcccgaaaagcaaggcggagatccgcgcgctgtacgtggaagacaatatcgaactgcgccccggcaccatgctcacccccgggctgcgcctggacgatcacagcgacttcggcctgaactggagcccgagcctgaacgcttcccaaacgctcggcgaatacttcacggtcaaggccggtatcgcacgggccttcaaggcgcccaacctgtaccagagcaacccgaactacctgctctatacccgtggcaacggttgcccgatccagactagcagcggcggctgctacctggtcggcaacgagaacctggacgccgagaccagcgtaaacaaggaactgggcatcgagttccggcgcgatggctgggtcgccgggctcacctacttccgcaacgactacaagaacaagatcgtcgcgccgctggatgtcatgggacagaccgggaccggcaacaacatcctgcaatggagcaacgcgaagaaagcagtggtcgagggcctggaaggcaacctgctggtccccctgcacgaggacctgagctggagcaccaacctgacctatatgctgcaatccaaggacaaggacaccggcaacccgctttcggtgatccccgagtacaccctgaactcgaccctggactggcaggccagcgagcgtctttccacccaactgaccagcaccatctacggccgccaggagccgccgaagcatggcaccagccgcaacacgccggtggtctcgcgaaaagaggtgggtacctatggcatctggggcgtcagcgccggctacaccttcagcgagaacctgagcgtacggggcggggtaagcaacctcttcgacaagcgcctgtaccgccagggcaactccttcgacgccggcgcggcaacctacaacgagccgggtcgcgcctactacgtttcgatgaccacctcgttctga

SEQ ID NO: 1764 - protein, 742 aa, Pseudomonas aeruginosa
MYPQFRRGHLAAAVLFASSSLLGGQALAEDERLEELDERAESVVQLGDEVVLGTAEQELKQAPGVSIITAEDIRKRPPVNDLSEIIRTMPGVNLTGNSSSGQRGNNRQIDIRGMGPENTLILVDGKPVSSRNSVRYGWRGERDTRGDSNWVPPEEVERIEVLRGPAAARYGSGAAGGVVNIITKRPTDRLRGSMTVFTNIPESSKDGATRRANFSLSGPLTEALSFRAYGSANKTDSDDTDINLGHTVNPSRTVAGREGVRNRDLSGMLSWQVTPDQVVDFEAGFSRQGNIYAGDTQNNNGTANTQGLADDGAETNRMYRENYAITHNGTWSFGTSRFVAQYDSTRNQPSGGGLAGSVEGQIGADRSFSASKLENYRLSGELNLPLHALFEQVLTVGAEWNKETLNDPSSLKQGFVGSDSLPGTPAAGSRSPKSKAEIRALYVEDNIELRPGTMLTPGLRLDDHSDFGLNWSPSLNASQTLGEYFTVKAGIARAFKAPNLYQSNPNYLLYTRGNGCPIQTSSGGCYLVGNENLDAETSVNKELGIEFRRDGWVAGLTYFRNDYKNKIVAPLDVMGQTGTGNNILQWSNAKKAVVEGLEGNLLVPLHEDLSWSTNLTYMLQSKDKDTGNPLSVIPEYTLNSTLDWQASERLSTQLTSTIYGRQEPPKHGTSRNTPVVSRKEVGTYGIWGVSAGYTFSENLSVRGGVSNLFDKRLYRQGNSFDAGAATYNEPGRAYYVSMTTSF

SEQ ID NO: 1765 - DNA, 2010 bp, Escherichia coli
  CDS (1)..(2010)
atgattgtctcggcatccggctatgagaaaaagctgactaacgcagccgccagtgtttctgtgattagccaggaggaattgcagtccagccagtaccacgatctggcggaggctctgagatcagtagagggtgtggatgttgaaagtggtacgggtaaaaccggtgggctggaaatcagcatccgaggaatgccagccagttacacgctgatactgattgatggtgttcgtcagggcggaagcagtgacgtgactcccaacggtttttctgccatgaataccgggttcatgccccctctggccgccattgagcgtattgaggttatcagggggccgatgtccacactgtatggctctgatgcgatgggcggtgtggtgaatatcattaccagaaagaatgcagacaaatggctctcttccgtcaatgcagggctgaatctgcaggaaagcaacaaatggggtaacagcagccagtttaatttctggagcagtggtccccttgtggatgattctgtcagcctgcaggtacgcggtagcacacaacagcgtcagggctcatcggtcacatcactgagcgatacagcagccacgcgtattccttatcccacggagtcacagaattataatcttggtgcacgtcttgactggaaggcgtcggagcaggatgtgctctggtttgatatggataccacccggcagcgttatgataaccgggatgggcaactggggagtctgacggggggatatgaccggaccctgcgctatgagcgaaacaaaatttcagctggctatgatcatactttcaccttcggaacatggaaatcgtatctgaactggaacgagacagaaaataaaggtcgtgagctcgtacgcagtgtactgaagcgcgacaaatgggggcttgccggtcagccgcgggagcttaaggaatcgaaccttatcctgaattcattactgcttacccctctgggagaatctcatctggttacggtggggggcgagtttcagagctcgtccatgaaagacggagttgtccttgccagcacaggtgaaactttccggcagaaaagctggtcggtatttgctgaggatgagtggcatctcacggatgcacttgcgctgactgcgggcagccgctatgaacatcatgagcaattcgggggacacttcagtccgcgtgcatatctggtctgggatgtggcagatgcctggacgctgaaaggcggtgtgaccacgggatataaggcacccagaatggggcagctacataaagggattagtggtgtatccgggcagggaaaaacaaatctacttggtaaccccaacctgaagccggaagagagcgtcagttatgaggctggggtgtattacgataaccccgccggtctgaatgccaatgtcacaggttttatgactgacttctccaacaagattgtctcttattccataaatgataacaccaatagctatgtaaacagcggaaaggcccggttgcatggtgtggaatttgccggcacattgccgctgtggtcagaggatgtcacgctgtcactgaattacacctggacccgaagtgaacaacgtgatggtgataacaaaggtgcgccgctgagttatacccctgaacacatggtgaatgcgaaactgaactggcagatcaccgaagaggtggcatcatggctgggtgcccgttatcgcgggaaaacaccacgtttcacccagaattattcgtcactgagcgctgtacagaagaaagtgtatgatgagaaaggagaatacctgaaagcctggacggtggtggatgcaggtctgtcgtggaagatgacggatgccctgacgctgaatgctgcggtgaataacctgctcaacaaggattacagtgacgtgagcctgtacagtgccggtaagagtacgctgtatgccggtgattacttccagacgggatcatcaacaacaggatatgtgatacctgagcgaaattactggatgtcgctgaactatcagttctga

SEQ ID NO: 1766 - protein, 669 aa, Escherichia coli
MIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTAGSRYEHHEQFGGHFSPRAYLVWDVADAWTLKGGVTTGYKAPRMGQLHKGISGVSGQGKTNLLGNPNLKPEESVSYEAGVYYDNPAGLNANVTGFMTDFSNKIVSYSINDNTNSYVNSGKARLHGVEFAGTLPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVDAGLSWKMTDALTLNAAVNNLLNKDYSDVSLYSAGKSTLYAGDYFQTGSSTTGYVIPERNYWMSLNYQF

SEQ ID NO: 1767 - DNA, 1941 bp, Porphyromonas gingivalis (Bacteroides gingivalis)
  CDS (1)..(1941)
atgaaaagtgtagtaacaaagcaggccctcatcggcctgcttttctttagtataagtatatactcccatgcggccaaccctccggcccaacctaccgacaccatcgtatccggcaatatcgcacttgaggatatagtggtgaccggtagccgtacagcccgtctgcttaaagatgtacctgtccccacaaaggtgttcaaggccaaagatatcaaagctatagccccatcttctttcattgacgtactgcagtatattcttcccgggatcgagtttaccaagcatggttccagagatcagctcaatgctcagggatttgacgaaagttctattctcttcctcgtcgatggcgaattgatttcaacgggatctaccagtggaatagacttcgaacgaatcaatccggatgacatcgagcgaatcgaagtgcttcgtggagcttcctctgctttgtacggatctaatgccatcggaggtgttatcaatatcatcacccgtacagccaaggatccttttcgcgtatctgcttcggctcgatacgatagtcgcgacggacagaaatacgatgtggcagcaggagtgaaacgtgggatcttcaccagtcagtccggcgtacaatatagagcagacaaaagttatattttggccgatcagttcgagcaggaactgaatgttgcaggcaatacgacatggaatataaatcagaagtttacaatctctccgacggaaaacttatccttcaaccttaccggactggtgaatctgcgtaagcagcactggacggataagatcgattttctgtacaactcctacgatgtcaaagccggtgccaactggcgtatcagcgagacttcggatctggacgtctcttatcattacgacaaatatagccgtgatacctgtctgatcaagactgagaaccaaaagaaacttcccattttcgatgaggatatgcaccatttgcgagcacaatacaatctcaatcttgctgaagtccaccttctcaatgtgggtctggagtatatccatgataatgtagcatcgccccgtctttcctctccgaacgacccgggggaaaagtccgtgaacaacaaaatcctatacggacagtacatatataaagttacccccaaactcgtattgagctatggagggcgcttggacaagcactccggattcggcttgtactatacatcgcgcctgtctgccatgtacaagtgcagccatgtcaccaatcgcttgtcctacgcggaagggtatcgtgccccctctttgcaggaaatgtactttttcttcaatcatggtgctttctttatttacggcaatccggatttgaagccggagaagagtcgcatgctctcatactcggcagaagctcactggaacaagcgtacactgatggggaatgtcttcttcaatcatgttcgcaatcggatcgatttcacctacaaaggcacagatttgatctacaccaacgtatcgaaagaaatgagaatattcggctttgaaggacaagcgaatgtggtactgccttacggctttggttttcgagcttcatattcctacacttatgatcgatggaaggcgaccgataaggccggaactgagatgaagctctcaaacacccgccctcatgcagctactgccactctctcttatggacataatttttcgaagaattacagactagcctccaacttctccacgcgcttcctttccgatctgaaaacagggcgtatgaactccgacgagttgtttgaggaaataacgtatccgggttatacgatctgtcgtttggatattgaaaatcatttctatcggaactatacgctccatatcggtgcggagaacctgttcgattataaacccaaagcattggcattcaattccccgacatcacccggacgtatcatatacgggttggttcggatcactttctaa

SEQ ID NO: 1768 - protein, 646 aa, Porphyromonas gingivalis (Bacteroides gingivalis)
MKSVVTKQALIGLLFFSISIYSHAANPPAQPTDTIVSGNIALEDIVVTGSRTARLLKDVPVPTKVFKAKDIKAIAPSSFIDVLQYILPGIEFTKHGSRDQLNAQGFDESSILFLVDGELISTGSTSGIDFERINPDDIERIEVLRGASSALYGSNAIGGVINIITRTAKDPFRVSASARYDSRDGQKYDVAAGVKRGIFTSQSGVQYRADKSYILADQFEQELNVAGNTTWNINQKFTISPTENLSFNLTGLVNLRKQHWTDKIDFLYNSYDVKAGANWRISETSDLDVSYHYDKYSRDTCLIKTENQKKLPIFDEDMHHLRAQYNLNLAEVHLLNVGLEYIHDNVASPRLSSPNDPGEKSVNNKILYGQYIYKVTPKLVLSYGGRLDKHSGFGLYYTSRLSAMYKCSHVTNRLSYAEGYRAPSLQEMYFFFNHGAFFIYGNPDLKPEKSRMLSYSAEAHWNKRTLMGNVFFNHVRNRIDFTYKGTDLIYTNVSKEMRIFGFEGQANVVLPYGFGFRASYSYTYDRWKATDKAGTEMKLSNTRPHAATATLSYGHNFSKNYRLASNFSTRFLSDLKTGRMNSDELFEEITYPGYTICRLDIENHFYRNYTLHIGAENLFDYKPKALAFNSPTSPGRIIYGLVRITF

SEQ ID NO: 1769 - DNA, 1842 bp, Vibrio vulnificus (strain YJ016)
  CDS (1)..(1842)
atgcaaaaatctcttttagcgatcgccatggcatcgctgcttacccctatctcttatttacacgctcaagaagtgcaaaccaatgacactgttgtcgtgacggccaaccgttttgagcaagttgaatcttccgttttagcgtcgattagcgtggtgacgaaggctgaaatcgagcaactgaatgtgaccactgcgcttgatattttgaaaacacttcccggtgtggaggtaaatagtcaaggtggtaaagggcaaatcagcagcatctttttacgcggtacttcatcaaaacacactctagtgctcgttgatggtgtcaaaattaactcagcaacagcaggtggtgcatcattaggcttaatcccagctttcgctattgaacaaattgaagtggtgcgcgggcctcgagcggcaatttatggttcagatgcaattggtggcgtcattcatatcaagactatcccagcaaaccgccaaactaagcatgacgcgaacttgggttatggcaatgatgaccattcatcattggcatggcgatcttcaggacagttaaatgattcaactcaggcttcttttgtcttttccgatgaaaaaagtgatggttatcgagtcaatgaagttgcaccaagtggtgatagccacggttatcaatctcaaactttgtttggttcacttcgtcatgagatcgacgacgcttggtctgttcagtttaatggttatcagctgagttcagacgttgaatacgcaaaccagttttcaggcgtgaagaatgagagcaataccgatttttatagcattgctggttcattaaatttccataaagacaattattcttctcagttgatggtgtcacgtagtgataatgaatcgtgggatggtgtcgccagcggtatggttgctaaaaccgcgcttttctccagccgaaattcagtctcgtggctgaaccattgggtcgttgtgcccgcactcacgttagcggctggcgtggattatgatcaagagaatgcgcgccaaggcggcgcgaatgccacaaattacagcaaaacggaaaaagacaataaagccgcatatgtaacggctcatttctctaagaacattgtgactgctgaagccagtattcgctctgatgatgatagcgcctttggtaaacacaacacttggaatctaggcttaggtattgcgccatctgattatgttgagtttatagcttcaacgggcacaggtttcaaagctccaacatttaacgatctatattggccaagttcaggtaatccaaacttgaagccagaaacctcaaagtcctcagaagtagggattcgcagctatttgccttttgttcaaattgatatttcagcatacagaaacgaaattgaagatatgatcgattgggcccctacaggacctggaggtgcttggaccccttcaaatattgataatgcgaaaattgaaggcattgaaattgaagcgttgttcgagactggtgtgattgaacatcgtgtttctgcagaatggaaagatcctcgagataagtcagacgatagctttttgatccgcagagcgcgcgaaaacttcagctgggtgtcgacctattcggctgatcgctttggattttctgccgttgcgaattacgtgggtgatcgcaaagacagtacgggcaaaacgatggatgcctatactttgctggatataagtgctaactacaagatgacagaagcattaacgctaggtgccagagtcggtaacctgtttgacaaagagtatcaaaccgcacatagctcgggtggaaaatactacgtaggtgaaggccgaaattggtttgcaacggtcaattaccgtttctaa

SEQ ID NO: 1770 - protein, 613 aa, Vibrio vulnificus (strain YJ016)
MQKSLLAIAMASLLTPISYLHAQEVQTNDTVVVTANRFEQVESSVLASISVVTKAEIEQLNVTTALDILKTLPGVEVNSQGGKGQISSIFLRGTSSKHTLVLVDGVKINSATAGGASLGLIPAFAIEQIEVVRGPRAAIYGSDAIGGVIHIKTIPANRQTKHDANLGYGNDDHSSLAWRSSGQLNDSTQASFVFSDEKSDGYRVNEVAPSGDSHGYQSQTLFGSLRHEIDDAWSVQFNGYQLSSDVEYANQFSGVKNESNTDFYSIAGSLNFHKDNYSSQLMVSRSDNESWDGVASGMVAKTALFSSRNSVSWLNHWVVVPALTLAAGVDYDQENARQGGANATNYSKTEKDNKAAYVTAHFSKNIVTAEASIRSDDDSAFGKHNTWNLGLGIAPSDYVEFIASTGTGFKAPTFNDLYWPSSGNPNLKPETSKSSEVGIRSYLPFVQIDISAYRNEIEDMIDWAPTGPGGAWTPSNIDNAKIEGIEIEALFETGVIEHRVSAEWKDPRDKSDDSFLIRRARENFSWVSTYSADRFGFSAVANYVGDRKDSTGKTMDAYTLLDISANYKMTEALTLGARVGNLFDKEYQTAHSSGGKYYVGEGRNWFATVNYRF

SEQ ID NO: 1771 - DNA, 1860 bp, Photorhabdus luminescens (subsp. laumondii)
  CDS (1)..(1860)
atgataaataaaaagcggttattattatccactgtttcaattatggtgatttctggctggaatcaagcttctgctgcggtggagtcgcaggattcattggttgtgacggcgagtcgttttaaacagccgatatcaagcatattggctccttatactgttgtaacacgagatgaaattgatcgttggcagtcaaatagtgtagccgatattttgcgtcgtttacccggtgttgatattgcgcggcatggagggattggacaattaagctctttgtttatacgtggtactcatgctagtcatgtattagtactgatggatggaatacgtttgaatcaagcgggcatcagtggctcctctgatttaagccaaatacctgtatcattggttcagaaaattgagtatatccgtggaccacgctccgctgtttatggttctgatgctattggtggtgttattaatatcatcactaccagagagaagctaggaaccagccttaatgtaggtatcggctcacatggctatcaaacttatgatggtgcaactcaacaaacgctagctgaaaatacagttctgacagcagcagctaactatacttataccaaaggatacgatgttgttgctgatggtaataccggtggttttagacaacctgatcgtgacggcttcatgagcaaaatgctttggttaggagtcgatcaaaaatttaatgagcaagtcagtggatttgttcgagcttatggctataacaatagaacatcttatgatgcggatattaattggagttatccatatgccagaccggatactcgtgaactttatagtcgccactatgacatgggagtcagatttaaccaagggatctactcatcccagttaattacaagttatagtcatacaaaagactataactttgatcctcaatatggacgctatgataagtctgctagccttaatgattctgaacaatataacttgcaatgggggaatacttttcagctatatcagggcatagtcagtaccggtgtggatttccaaaaacaatcgatagaagctggaaccagttatattccgaagagtaaaacggtacgtaatacaggaatgtatctgacagcacagcaacaactgaaagattttattttagaaggtgcaattcgttcagataaacattcagaagctggctggaatacaacatggcaagccagtttaggttgggagtttattaaagattatcgcttgatagcctcttatggtacggcatttaaggctccaacgctcagccagatgtacggttttggtggtaatcatgatttgaaaccggaagaaagtaaacaatgggaaggcggtatcgaaggcgtcactggccagctaacttggcgtatgactgtatatcgcaatgagattgagcaattgatcgattatgcgaatagccgctactacaatattggtaaagcgaaaattaaaggtgttgagtggactggcttaatagacactggcatgtttcagcatcaattgacaatacagtatattgacccccgtaatagtgaaactaatgaaattttagttcgtcgtgcgaagcagcaagtgaaatatcaacttgactggcagttatatgattttgattgggggttaacttatcaatatctagggcggcgttatgacaaggatttcagtacatccccggctaagcgtgtgaaattaggtggcgtcagcttttgggatttaacagtttcatatccagtcacttcttatctgacaattcgtgctagaatagccaacctgcttgataaagattacgagacagtttatggctatcgcattccaggacgtgaatactacctcactgggagctataacttctga

SEQ ID NO: 1772 - protein, 619 aa, Photorhabdus luminescens (subsp. laumondii)
MINKKRLLLSTVSIMVISGWNQASAAVESQDSLVVTASRFKQPISSILAPYTVVTRDEIDRWQSNSVADILRRLPGVDIARHGGIGQLSSLFIRGTHASHVLVLMDGIRLNQAGISGSSDLSQIPVSLVQKIEYIRGPRSAVYGSDAIGGVINIITTREKLGTSLNVGIGSHGYQTYDGATQQTLAENTVLTAAANYTYTKGYDVVADGNTGGFRQPDRDGFMSKMLWLGVDQKFNEQVSGFVRAYGYNNRTSYDADINWSYPYARPDTRELYSRHYDMGVRFNQGIYSSQLITSYSHTKDYNFDPQYGRYDKSASLNDSEQYNLQWGNTFQLYQGIVSTGVDFQKQSIEAGTSYIPKSKTVRNTGMYLTAQQQLKDFILEGAIRSDKHSEAGWNTTWQASLGWEFIKDYRLIASYGTAFKAPTLSQMYGFGGNHDLKPEESKQWEGGIEGVTGQLTWRMTVYRNEIEQLIDYANSRYYNIGKAKIKGVEWTGLIDTGMFQHQLTIQYIDPRNSETNEILVRRAKQQVKYQLDWQLYDFDWGLTYQYLGRRYDKDFSTSPAKRVKLGGVSFWDLTVSYPVTSYLTIRARIANLLDKDYETVYGYRIPGREYYLTGSYNF

SEQ ID NO: 1773 - DNA, 2100 bp, Chromobacterium violaceum
  CDS (1)..(2100)
atgaaaaacaagcgctccccgcacctcgcgcgcccggccttccgcctggccatgctgtccgccgccgtcggcgccctctacctgcccgccgcgcacgccgccgaagccgtgctgccctcggtggtggtgaccgccaccggctacgagcagaaaatcaaggaagccccggccagcatttcggtgatcacccgcgaagagctggaaaagaaaccgttcaccaacctggccgacgcgatccaggatctggaaggcgtcaacatcaacggctccggccccgccgacaaggacatctccatccgcggcatgcccggcgaatacacattgatcttggtggacggccgccgccagaacacccgcgaggcccgcagccgtggcaccggcggtttccagcagtaccagatcccgccgatggaggcgatcgagcgcatcgaagtggtgcgcggcccgatgtcgtcgctgtacggctccgacgcgatgggcggcgtggtcaacatcatcacccgcaaatcgcccaaggaatggcacggttcgatgacgctgggcggcaccatcaccgagcacgccgatgaaggcaacaccggccagagcagcttctgggtcggcggcccgctggtgaaagacctgctgtcgctgcaactgtacggcgcgctgaacaatcaggcggaagataatatttactacgcccgaagccgcgatggcggcaaagatgccgcccatctgggcgacttcaacgccaagctgagctttaccccgaacaaagatcatgagatcaccttcgaggccggccacaatgaattgcgcaaaaccacgacgccgggcaaaaccctcgccctcacatccgacaaatatgatcaattggaccagcgagaccactggagcctgagccacaacggcaagtacggcatcgtgcgctcgaatctggcgctctatcaggaaatcgaaaaatccagttccgacacaaacaatatcaacgacggcacggatctgaagattaccaatactacgctggatggccagctgtccttcctgttcgatcgccacacgctgaagatcggtacacaggtcggccaacaagtgggttccagcctgcgagcccaggaagcgctgaaaccgccgttcaaatatgtcggcacgcagaacccggataaggtcaccgtaaatacctgggcactgttcgccgaggatacctatgaccttaccgacagcctgaaattgactggcggtggccgccttgaccatcacagcgtgttcggcagccacttcacgccgcgtctgtacctggtcgagcaactgaactcgcaatggactttgaaaggcggcgtcggcaagggcttcaaggccccgaccatacgccagagcaccgacggttactgcatgcgcaccggcagccaggtggaaaccggcctgctgtgcggcaattccaatctgaagccggaagaaagcacctcctacgaggccagcctgcacttcgacaacaaccaagacctgagcgccaacgccacgctgttctacaacgacttcaagaacaaagtggtcagctacggcaccgaccagttcaccaatcagctgatcgcaaagggcaaaccggcgcgcgtctatgtttacggcaatgtcgactcggtgaacatccgcggcctggagctctccggcaactggacgttcgcgccacgctggaccgtatccggcaactacacctacaccaagtccaaacgccacggcggcaaggaaaccagctactccggccagtcgctggaaggcatgccgctggacaagacgccggagcacgccggcaacgtcaagctggcctggaacccggtggagaagcttgacctctatacccgcctgaacttcgaaggcaagcagtactacaccggcttccgcaacggcgccaacgtcgcccgcacccgcggcggctccagcacctgggacctgggcggcacttaccgcatcaacaagaccttcgacgtcaatttcgctgtgttcaacgtcggcgaccgcaaggtggccatcgacgaccgcgcccgcgatggcggcctggacggcaactggatggtcgacgagggccgccgctattggctgaccctgaccggcaagttctaa

SEQ ID NO: 1774 - protein, 699 aa, Chromobacterium violaceum
MKNKRSPHLARPAFRLAMLSAAVGALYLPAAHAAEAVLPSVVVTATGYEQKIKEAPASISVITREELEKKPFTNLADAIQDLEGVNINGSGPADKDISIRGMPGEYTLILVDGRRQNTREARSRGTGGFQQYQIPPMEAIERIEVVRGPMSSLYGSDAMGGVVNIITRKSPKEWHGSMTLGGTITEHADEGNTGQSSFWVGGPLVKDLLSLQLYGALNNQAEDNIYYARSRDGGKDAAHLGDFNAKLSFTPNKDHEITFEAGHNELRKTTTPGKTLALTSDKYDQLDQRDHWSLSHNGKYGIVRSNLALYQEIEKSSSDTNNINDGTDLKITNTTLDGQLSFLFDRHTLKIGTQVGQQVGSSLRAQEALKPPFKYVGTQNPDKVTVNTWALFAEDTYDLTDSLKLTGGGRLDHHSVFGSHFTPRLYLVEQLNSQWTLKGGVGKGFKAPTIRQSTDGYCMRTGSQVETGLLCGNSNLKPEESTSYEASLHFDNNQDLSANATLFYNDFKNKVVSYGTDQFTNQLIAKGKPARVYVYGNVDSVNIRGLELSGNWTFAPRWTVSGNYTYTKSKRHGGKETSYSGQSLEGMPLDKTPEHAGNVKLAWNPVEKLDLYTRLNFEGKQYYTGFRNGANVARTRGGSSTWDLGGTYRINKTFDVNFAVFNVGDRKVAIDDRARDGGLDGNWMVDEGRRYWLTLTGKF

SEQ ID NO: 1775 - DNA, 2214 bp, Bordetella pertussis
  CDS (1)..(2214)
atgtccaccccccgattcgcgctgcattacgccagcgcgtcagtcctgctggccgcatccggcctggccatggcgcagacggccacccagatccacgatccgtcgcaggtgcagcagatggcgacggtgcaggtgctgggcacggccgaagaggaaatcaaggagtcgctgggcgtctcggtcatcaccgccgaggagatcgcccgccgcccgcccaccaatgacctgtccgacctgatccgccgcgaacccggcgtcaacctgaccggcaacagcgccagcggcgcgcggggcaacagccgccaggtcgacatccgcggcatgggccccgagaacaccctcatcctgatcgacggcaagcccgtcacctcgcgcaatgcggtgcgctatggctggaacggcgaccgggacacgcgcggggacaccaactgggtgcccgccgaggaagtcgagcgcatcgaagtgatccgcggcccggccgccgcccgctacggttccggggccatgggcggcgtggtcaacatcatcaccaagcgccccgccgatcgcgccaccggctccatcacctactacacgaaccagccggaagacagccgcgagggcaacaccaaccgcgtcaatgcgcgcatcagcgcgccgatcagcgacacgctgagcatgcggctgtacggcaactacaacaagaccaatccggatgcccgcgacatcaacgccggccacgcgaacaccagcgacaacggcaacccctcgaccgccggacgcgagggcgtcatcaaccaggacctgagcgcgctgttctcgtggaaagccgacagccacaacaccgtggacctggacatgggcttcagccggcagggcaacctgttcgccggcgacaccatgaacaacgccaacagcgacttctcggacagcctgtacggcaaggaaaccaatgcgatgtaccgcgagaactatgcgctgacgcaccgcggcgtctacgactggggcacctcgcgcgccagcgtcggctatgactacacgcgcaacgcgcgccagcgcgaaggcctggccggcggccccgagggcgcgcccaccgcgggcggctacgacaccgcgcgcctgaagaactggcgcgccgcggccgaggccagcgtgccgttccatctcggtttcgagcaggtcgccacggtcggcgtggaatggctgcgcgaatcgctggaagaccccgccggcacgcgccagacctataccggcggcgccatcggcggcacggccccggccgaccgcgacccgaaatcgcgccagaccagctatgcgctgttcgccgaggacaacatcgagatcgacgagcgcaccatgctcacgcccggcgtgcgcctggaccacaacagcgaattcggcagcaactggagtcccagcctgaacgcctcgtacgccgtcaccgacgcgctcaagctcaagggtggcatcgcgcgcgcctacaaggcgcccaacctctaccaatccaaccccaactacctgctgtacagccgcggcaatggctgcctggcctcgcagaccaacaccaacggctgctatctggtcggcaacgaggacctctcgccggaaaccagcgtcaacaaggaaatcggcttcgagtacgacccgggcacgtggcgcaccagcatggcctatttccgcaacgactaccgcaacaagatcgtcgccggcaccgacgtccagtaccgcctggccaatggcgcccgggtgctgcaatggaccaacagcggcaaggccgtggtcgaagggctggaaggcaacctgttcattccgctggccagcaatctcgactggaacaccaacttcacctacatgatccagtccaaggaaaaggctaccggcgaacccttgagcgtgattcccgaatacaccatcaacagcacgctggactggttctacacgccgcagctgtcgttccaggccaatctcacctattacggcaagcaggaaggcccgtccaccaatgtacgcaccggcgtcgaactgaacggcgacggccgccagaccatcagtccgtatgccctggcgggcctgagcatgggctacgaagtcaaccggaacctgaagttccgcgtcggcgtgagcaacctgttcgacaagcagctgtaccgcgaaggcaatgccagcagcgcgggcgcggccacctacaacgaaccggggcgcgcctattacgccacggcgacggtgtcgttctga

SEQ ID NO: 1776 - protein, 737 aa, Bordetella pertussis
MSTPRFALHYASASVLLAASGLAMAQTATQIHDPSQVQQMATVQVLGTAEEEIKESLGVSVITAEEIARRPPTNDLSDLIRREPGVNLTGNSASGARGNSRQVDIRGMGPENTLILIDGKPVTSRNAVRYGWNGDRDTRGDTNWVPAEEVERIEVIRGPAAARYGSGAMGGVVNIITKRPADRATGSITYYTNQPEDSREGNTNRVNARISAPISDTLSMRLYGNYNKTNPDARDINAGHANTSDNGNPSTAGREGVINQDLSALFSWKADSHNTVDLDMGFSRQGNLFAGDTMNNANSDFSDSLYGKETNAMYRENYALTHRGVYDWGTSRASVGYDYTRNARQREGLAGGPEGAPTAGGYDTARLKNWRAAAEASVPFHLGFEQVATVGVEWLRESLEDPAGTRQTYTGGAIGGTAPADRDPKSRQTSYALFAEDNIEIDERTMLTPGVRLDHNSEFGSNWSPSLNASYAVTDALKLKGGIARAYKAPNLYQSNPNYLLYSRGNGCLASQTNTNGCYLVGNEDLSPETSVNKEIGFEYDPGTWRTSMAYFRNDYRNKIVAGTDVQYRLANGARVLQWTNSGKAVVEGLEGNLFIPLASNLDWNTNFTYMIQSKEKATGEPLSVIPEYTINSTLDWFYTPQLSFQANLTYYGKQEGPSTNVRTGVELNGDGRQTISPYALAGLSMGYEVNRNLKFRVGVSNLFDKQLYREGNASSAGAATYNEPGRAYYATATVSF

SEQ ID NO: 1777 - DNA, 1890 bp, Bordetella parapertussis
  CDS (1)..(1890)
atgaaatcccgctcactccggcgctgcgccggtgtcctggcctgtgccgctccgttggccggccacgcccaggccggcgccgccgccggccaacccatccccgaactcgatccggtcgtcgtcaccgccgcgcgctcgccccagctgctcaggaatgtgctggccgacgccagcgtgatcgagcgcgatacgctggcgcgcgccggccagtccagcctggccgaagtgctggcgcagcagcacggcatcgaattcgccgacagcggcggcccgcaaagcgtcaccagcctgttcatgcgcggcgccaacagcaaccagaccctggtcctgctcaacggccagcgcatcaacaacgccaacggcggcggcattgcgctcaacgcgctgccgccgcaagccatcgaacgcatcgagatcgtgcgtggcgcggccagcagcctgtacggggccgacgcgatcggcggcgtgatcaacatcattacccgcgagccgggcgacaaggcgctgtcggcctatgccaacgccggttacggcacctacggcaccagccgctacgacgccggcgtatcgggcgcggccgacggcttcagctacagcctgtccaccggctatggccagagccatggcttcaacgccaccaaccgccgctcgttctcgtacaacccggacaaggacagctactaccagaactacgccaccggcacgctgggctacgaatggcggcccgagcagaaagtggtggcgcaggtctaccgcagccgcatcaacggcggctacgacgcctcggcctcgtacgactacaacgaccgctacatccaggacctgcaggcctattcgctggccagcgagaaccgcctgacccgctactggaagagcacgctgcgcgccggctatgtggaagacaagaacgattcgcgcgccgaaggcatgttcgaagacaacaacacgcgcttccggacccgccagatgcagtacctgtggcagaacgacttcaccctggccgccggccagacgctgacgctggcctacgagcacctggaccagcgcgccgacggccagatgagcacccccaccggcatcggcaactacaccgagacgcgccgccacgtgaattcgtacaccggcgtctacctgggcgatttcggccgccaccatgtgcaggccagcctgcgcaacgacgacaactcgcagttcggcagccacaccaccggcggcctggcctacgggttcgacctgacgcccaacctgcgcgccaccgtggccgccaacacgggctttcgggcgccgtcgttcaacgacctgtacacgccgaccagcgcgttcggctatcgcggcaaccccgacctcaagccggaagagtcgcgcaacgccgagatcggcctgaagtaccaggacgaggacagcgagctgggcgtggtgtattaccagacccgcatcaagaacctgatccaggtgaccgaggactgcagcacggtcgagaacgtcgggcgcgcccgcctgcaaggcttcaccatcagcggcgcgcaccgcttcggcaacacgcgcctgcgcgccagcctggacctgagcaacccgcgcaacgaagacaccggcaagcaattgctgcgccgcgcccgcacggtgctgcgcgccggcatcgaccatcgcttcgaccgcctgctggtgggcgccgaatggtacgcctcggacgagcgctacgactacggcttccccgaggaaaagcgcctgggcggctacggcctggtcaacctgaccgcggcctacgacctgagccgcaacatgcaggtgcaggtgcgctggaacaacgtgctcggccagcgctacaccttggccgacggctacaacacggccggctcgaacgccttcgtcaacctgtcgtggcgcatgtag

SEQ ID NO: 1778 - protein, 629 aa, Bordetella parapertussis
MKSRSLRRCAGVLACAAPLAGHAQAGAAAGQPIPELDPVVVTAARSPQLLRNVLADASVIERDTLARAGQSSLAEVLAQQHGIEFADSGGPQSVTSLFMRGANSNQTLVLLNGQRINNANGGGIALNALPPQAIERIEIVRGAASSLYGADAIGGVINIITREPGDKALSAYANAGYGTYGTSRYDAGVSGAADGFSYSLSTGYGQSHGFNATNRRSFSYNPDKDSYYQNYATGTLGYEWRPEQKVVAQVYRSRINGGYDASASYDYNDRYIQDLQAYSLASENRLTRYWKSTLRAGYVEDKNDSRAEGMFEDNNTRFRTRQMQYLWQNDFTLAAGQTLTLAYEHLDQRADGQMSTPTGIGNYTETRRHVNSYTGVYLGDFGRHHVQASLRNDDNSQFGSHTTGGLAYGFDLTPNLRATVAANTGFRAPSFNDLYTPTSAFGYRGNPDLKPEESRNAEIGLKYQDEDSELGVVYYQTRIKNLIQVTEDCSTVENVGRARLQGFTISGAHRFGNTRLRASLDLSNPRNEDTGKQLLRRARTVLRAGIDHRFDRLLVGAEWYASDERYDYGFPEEKRLGGYGLVNLTAAYDLSRNMQVQVRWNNVLGQRYTLADGYNTAGSNAFVNLSWRM

SEQ ID NO: 1779 - DNA, 1839 bp, Nitrosomonas europaea
  CDS (1)..(1839)
atgtccgaaaatcatgcttcatctgtactgactctgtggctgggagccagtctttctgccctttcatgggcagaagaaatcagttatctcgaaaaaccagtagtcgttaccgccagccgtaccaatgaggctgcagaagatacgctcgcctcggttaccgtcatcacgcgaactgatatcgagcgccagcaagcgcgctccatgcaggatctgctgcacggtatcgcaggtatcaatatcgccaataccggcggccctggaaaattgaccacacttctcctgcgagggacagagtctgaccacgtactggttctggtcgatggcatcagaatgggctccgccacatccggattttctgaaatccagaactatccggtagaactgatcgatcgtatcgaaatcgtccggggaccccgatccagtctgtatggcccggaagccgtgggaggggtaatccagatattcacccgcaaaggtggaaaaaaaggattgaaacccactctcagcttcggaggtggcagctacggaaccatcaatggctcagccaccctctccggcagcagtgaacgtgcctggttcaatctcggtatcagcggatcggacaccaatggcttcaatgcctgcaaaggatctttcagtgcgggatgcttcaccatcgaaccggacaaggatggctatcgcaacatctccggctcggctcgcgctggttaccgttttgataatggattggatgtcgaagcgagttttttacatactgatggtcattacgagtatgacggcagctttcaaaacagaactcagctggcacaacaagtattcgggggaacagcacgctattcactctttgaaccctggcgtatcacgttgacagcgggacgcagcaatgaagattccgataatttcaaggaaaagctattcacgacacgctaccacgcccggcgcgatacgatctcctggcaaaatgacataaccatcaccccgaatcagcttttgaccatcggtacggattatctgtacgatcgtatcaacagctcggaaaaattcaccaccacttcacgctataactggggcgtatttgcgcaacaccagatttcactcgcagcgcacaaactgcaactttctgtacgccatgatgacaaccagcaatttggcagtcaggtaaccggtggcgcttcctggggctattcactgaccgaacgggtcaggctgactgccggctttggcagcgcattcaaggcccctactttcaacgaactgtatttccccggatttggcaatcctgatctcaaaccggaagatgcccgcacggtggaactgggtgcagccggacggtttgactggggcaactggtcactcaacctgtatgaaacctggatcgatgacttgatctcatacaatgccgcaacattcactccggataatatcgataaagcacgcatacaagggctggaagctatcctcaacaccgaaatcaaaggctggctgattcaaaccaacctcacttttcttgacccgcaaaatcgttccaagggagccaataaaggtaatatcctgccccggcgcagcaagcaggctttccggatcgatgccagtcgtcagctcggtgattttgttgtaggagcaatgtttctggcagaaaccaatcgctatgatgatctggcaaacaatcagaaactcgatgattatgtcaaagttgacttgcgagcagaatatctgatcaatccgcaatggcgcattcaggggcggatcgaaaacctgtttgacaaagactatgaaaccgctgcattcttcaaccagcccgggcgcaacttttttgtcaccctgcgttaccaaccatag

SEQ ID NO: 1780 - protein, 612 aa, Nitrosomonas europaea
MSENHASSVLTLWLGASLSALSWAEEISYLEKPVVVTASRTNEAAEDTLASVTVITRTDIERQQARSMQDLLHGIAGINIANTGGPGKLTTLLLRGTESDHVLVLVDGIRMGSATSGFSEIQNYPVELIDRIEIVRGPRSSLYGPEAVGGVIQIFTRKGGKKGLKPTLSFGGGSYGTINGSATLSGSSERAWFNLGISGSDTNGFNACKGSFSAGCFTIEPDKDGYRNISGSARAGYRFDNGLDVEASFLHTDGHYEYDGSFQNRTQLAQQVFGGTARYSLFEPWRITLTAGRSNEDSDNFKEKLFTTRYHARRDTISWQNDITITPNQLLTIGTDYLYDRINSSEKFTTTSRYNWGVFAQHQISLAAHKLQLSVRHDDNQQFGSQVTGGASWGYSLTERVRLTAGFGSAFKAPTFNELYFPGFGNPDLKPEDARTVELGAAGRFDWGNWSLNLYETWIDDLISYNAATFTPDNIDKARIQGLEAILNTEIKGWLIQTNLTFLDPQNRSKGANKGNILPRRSKQAFRIDASRQLGDFVVGAMFLAETNRYDDLANNQKLDDYVKVDLRAEYLINPQWRIQGRIENLFDKDYETAAFFNQPGRNFFVTLRYQP

SEQ ID NO: 1781 - DNA, 1995 bp, Acinetobacter baumannii
  CDS (1)..(1995)
atggtaatcgttataaaatataaggaccgagaaatgacgttaacaaaaaaggcgctggtggtcgccctctcaacactgcttccatttgcagtccaagcaaataccgatattgaccaacaaggcacaaatgaacctgttcaaaaacttaaaactattgtggtttctgctgctttaaaagaacaagatgtagataaagcacctgcatcgattagtgtaatcacaagtgaagatattgaacgtagcgcggcactcagccttgccgatgttttacaaaaacaagctggggtttataactataacagtggtcaagataaaatcgttatacggggaatgctgaatacctcagggaactacaccttaattcttttaaacggtaaacgcatgtcatctaatggcgccatgtggcgaggcaatgactttgactggagtgcgattcctttaaatagtattgagcgtgttgaggtgattcgtgggccaatgtcatctctctatggtgcagatgcgatgggcggtgttattaacattattaccaaaaaagcagaagatggacaattacacggttctatttttggtcaatataaccgagcagaccgtggtgatggtaaaaaccagtaccgttacgggtttaatctatacggtggtttaaccgataatttaagtttcactctggcaggtgatgcttataaccgcgatgcatggtatagaaagggccagccagatccagatggtgcatattttgtagaaaaagacaccaaaaacgtaaatggtactttaagctggaatattaatgaccagcaaaccttagatctagatttgggctataacaacgataaacgcccgctaactcaagatgcagctacctccattcaagaatcagaaatgaaacgtaccaatgtggggattgctcaccgtggtaaatgggcttggggtaaaacagaagcttatatcggtaaagaaaccgccaaaatttatgactatgacagtgaatacgatgcgcctcaaagccgtcactataaacaagaaaatttaattggccgtgcttttgccaactttgactggctcatgaataatacgaccagtggttttgattataaagatcagaaaattacagatgtcgtaagttatatcggcactggaaagaatcagcaaaagagctacggtatatttgttcaaaacgatacccatattaatgacgcacttaccttaacattaggtggtcgttatgacgattttgatgactttgatggtaaaaccacaggtaaagcctatttagcatatcaactcgctgaaggagtcatacttaaaggtggcgtgggacaagcttataaagttccggctcctgctcagttagacattaactactcgatgatttcatgtggaggtagttgtcacattcgaggtaatccaaacctagcacccgaagaaagtacaaactatgaagcatccttaattgtgacccgtccaaactggaatgctggcgttacagttttccaaaacgatgtgaagaacttgattgaagcaattaccttgagtgatggtgacccgcgtttagtaggtgattttagaaaaatctggaccaatgtgagtcgcgcagaactcaaaggtgttgagcttacaggtggatatgatttcactgacaatttaggtgttaaggcaaacgcaacttatctcgacgcaaaaaataaaaccacaggtaaagacttaaccgaacgaccagaatggcttgccaatggctctatttcctgggcaccagttcaagactttcgtgtaaatgcaggcgtgagttatgtaggcaaacaaatgtactctgcaactaaagagttgccagcttataccacctatgacgtgacatttacttctcctattacgccacgtttaacactggactatggtgtaaaaaacctgaccgatgttgatttggaggataaaaacaaaacctttaataccaaactttatggccgcaattacttcttaaaagcgacttatagtttctaa

SEQ ID NO: 1782 - protein, 664 aa, Acinetobacter baumannii
MVIVIKYKDREMTLTKKALVVALSTLLPFAVQANTDIDQQGTNEPVQKLKTIVVSAALKEQDVDKAPASISVITSEDIERSAALSLADVLQKQAGVYNYNSGQDKIVIRGMLNTSGNYTLILLNGKRMSSNGAMWRGNDFDWSAIPLNSIERVEVIRGPMSSLYGADAMGGVINIITKKAEDGQLHGSIFGQYNRADRGDGKNQYRYGFNLYGGLTDNLSFTLAGDAYNRDAWYRKGQPDPDGAYFVEKDTKNVNGTLSWNINDQQTLDLDLGYNNDKRPLTQDAATSIQESEMKRTNVGIAHRGKWAWGKTEAYIGKETAKIYDYDSEYDAPQSRHYKQENLIGRAFANFDWLMNNTTSGFDYKDQKITDVVSYIGTGKNQQKSYGIFVQNDTHINDALTLTLGGRYDDFDDFDGKTTGKAYLAYQLAEGVILKGGVGQAYKVPAPAQLDINYSMISCGGSCHIRGNPNLAPEESTNYEASLIVTRPNWNAGVTVFQNDVKNLIEAITLSDGDPRLVGDFRKIWTNVSRAELKGVELTGGYDFTDNLGVKANATYLDAKNKTTGKDLTERPEWLANGSISWAPVQDFRVNAGVSYVGKQMYSATKELPAYTTYDVTFTSPITPRLTLDYGVKNLTDVDLEDKNKTFNTKLYGRNYFLKATYSF

SEQ ID NO: 1783 - DNA, 1875 bp, Vibrio parahaemolyticus
  CDS (1)..(1875)
atgaaaaaatccgcattggcgatcaccctggcatcgctgctttcacctgtctcttatctacaggcccaagaaatttctgttgacgaaaccatcgtagttactgcgaatcgattcaagcaaatcgatggtgctgttctagctcaaaccgtgacagtaacgaaagaagatattcgccgtcagcaagccgacagtttgtttgatgtgttccgtactttgcctagtattgaggttgctcaatatggtggccgtggccaaagcgcatcgatttttgttcgcggtggcagtgccacccaagtgttggttttggttgatggtgtacgtatgcctcgcgcaatcatgggcggtatcgatttcaaccaatttccaatcaactctattgaacgtatcgactacattcgcggcgcacgcgcatctatctatggctcagaggcgatttccggcgtaatcaacattattactcgagcaagtattgatgatgatgcaagccgagtgtcggcgggttatggctccaacaatcataaaaaaggcacgtttgccgtatctaaacctgtaggtgaaggtaagcacatcaaaggggtattaggttacgagaaaacggatggttttaacgttaaacctttgccgggtttgaatgatggcgatgagcacggatttgaaacgttgaaccttaaattaggttaccagcaaaacttttctgataatttttctggttacgtaggctttagtacatacagcaacgaatacgactatgacaacagcagttatggcaatcctgggtggggaacagtagataagcacgaaaagaaaacgggtgaagtggaatacgtaggtgcagatttgtcacttgagtattctaaagatgtttacacttctgagttgaagttagcttacggtcaacaagacaactatgaccttaaatcgggccaaagtaagtcgaccggcgatcacgtggccatcgaacagttcaatgcaatttggctaaactcatacagcatcaatgatgaactgagtattggaggcggcttagattaccgtaatgagaagttagcaaaaggctaccttgcaccaagtgactggggaccagcgaaagactacaacccagagaagaacccaagaacaaacattggcatcagcgcaattgctcaatatgcattgaatgcatggaccttcgaagccagcgtacgtaatgatgaaaacaaccagtttggcaacaacactacgtggcaaaccgcagcaggttggaaagtttacgaaggatacgaattaacgctgagccacggcactgcattccgtgcgcctagctttgttgacttgtattaccctggctatgaaatgccgaacttaaagcctgaagagtcaaaaaacacggaactatcgttatctggtgtggcatcgattgttgattggactgtaactgggtattacaaccaaattgaaaacatgctgatctggaaaggtgcgggcatgcaaaacattggtgaagctgagattaaaggtatcgaactagaagttaaactcgatactgatattgtctctcatgagttctacctagattacaaagatcctgtcgacaagtctggtgcagaagatacccaactagcataccgctccaagcgtggtgctaagtggaatgcttatgcgacatttgaccaatggacgttgggctcgcagtatctttaccaaggtgagcgctttaatggtagtacaagactaccgagctacagcctatggaacttcaccgcttcttacgctgtaaactcaagttgggacatcaacgccaaactaagcaacgctttcgataagaactacgagatgtactcaggttacgcaactcctgggcgtcagtactttgtatccgctgactatcgattctaa

SEQ ID NO: 1784 - protein, 624 aa, Vibrio parahaemolyticus
MKKSALAITLASLLSPVSYLQAQEISVDETIVVTANRFKQIDGAVLAQTVTVTKEDIRRQQADSLFDVFRTLPSIEVAQYGGRGQSASIFVRGGSATQVLVLVDGVRMPRAIMGGIDFNQFPINSIERIDYIRGARASIYGSEAISGVINIITRASIDDDASRVSAGYGSNNHKKGTFAVSKPVGEGKHIKGVLGYEKTDGFNVKPLPGLNDGDEHGFETLNLKLGYQQNFSDNFSGYVGFSTYSNEYDYDNSSYGNPGWGTVDKHEKKTGEVEYVGADLSLEYSKDVYTSELKLAYGQQDNYDLKSGQSKSTGDHVAIEQFNAIWLNSYSINDELSIGGGLDYRNEKLAKGYLAPSDWGPAKDYNPEKNPRTNIGISAIAQYALNAWTFEASVRNDENNQFGNNTTWQTAAGWKVYEGYELTLSHGTAFRAPSFVDLYYPGYEMPNLKPEESKNTELSLSGVASIVDWTVTGYYNQIENMLIWKGAGMQNIGEAEIKGIELEVKLDTDIVSHEFYLDYKDPVDKSGAEDTQLAYRSKRGAKWNAYATFDQWTLGSQYLYQGERFNGSTRLPSYSLWNFTASYAVNSSWDINAKLSNAFDKNYEMYSGYATPGRQYFVSADYRF

SEQ ID NO: 1785 - DNA, 1959 bp, Vibrio parahaemolyticus
  CDS (1)..(1959)
atgtccactcttagactgccagtgctaactgcaactggtgttttagccttcgtcagtgtccctcatgtatttgctaacgactcagtttctaaaatggaaaccgtcgtggtgacagcgtcaagttatgagcaatcccaagcggatgcgcctgcaagtattagtgttatctcgcgagaagaattggactcgcgctactaccgcgacgtgactgatgcactgaaaagtgtgccgggtgttgttgtgactggtggtggtgatacaaccgatatcagcattcgtggtatgggctctaagtacacgttaattcttgtggatggtaagcgccaaagtactcgcgaaactcgcccaaatagcgatggccctggtattgaacaaggttggttgccaccacttcaagccattgagcgaatcgaagtgatccgtggcccgatgtcgacattatatggttccgatgcgattggtggtgtgattaacgtgatcacccgtaaagatgcgcttgagtggacaggtaatgtgcagctggggacggttatccaagaaaacagccgttctggtggtgaacagagtgcaaacttctttgtaaatggccctcttgcagaaaacttattgctacaggtttatggtcaatacaccgcaagggaagaagatgacattgattatggttatgaagacaaagatatgcagagcatctcttcaaaactgatctatcaaatcaatgatcgtcactctgtgcagttagagggtggtacatcggcacaaagtcgtcgcggtaatgttggtctttctgtacctacgacgggctgtcgtagaggctgtgaagattcattgaatgaataccgtcgtaactacgttacgcttagtcacaccggggagtgggagttattgggtaactctgatacctacttgcagcgcgaggagagtgaaaacaaatctcgcgaaatgactattgtaaataccacgtttaaatccagcctagttaaagggttgggcgcgcatactctgacaactggtgtcgatgcgacgcatgccgagttggaagattttacgtctaacaaagcatcatctaaaacgaaagcatcaaatacacaatgggctgtgttcatcgaagatgaatggaagatcgcagaaccttttagtctgacattaggtggtcgtttggatcacgatgaaaactacggcgcgcattttagcccgagagtgtatggtgtgtggcgtgttgctcctgcttggacggtcaaaggcggtgtggcgacaggtttccgctctcctcagttacgtgaaattaccccaggttgggcgcaagtcagtggtggcggcaatatttatggtaacccagatttggatccggaaacttcactgaacaaagaaatcagtgtgctttaccaaggtgattctggtcttgatgtgacgttaaccgccttccacaatgagtttaaagataagattactcgcgtggtgtgcccagatacaatttgtacggatggcccaaaccaatggggggcggatcctacttaccgcattaatgtggatgaagctgttactcagggtgtagaagcaacgttggcgaaaccactaaccgagactatctacttaagctcaagctatacctttaccgactcggagcaaaaaacgggtgaatacaaaggcatgccacttcagcaacttccaaagcacctgtttaatgttgatgtcacttggcaaacaacagacaacctagagagctggacgaaagtgacctaccgaggaaaagaaatggatcccgtcactggcccatcacgcaacagcatcgttgaacctgcttatacgtttgtagatgccggcgtaacgtatcagttgacggataacaccaagatcaaaggtgcgatttacaacctgttcgatgaagacatcaactacaaagaatatgggtacgtcgaagatggacgccgttactggttagggttagacgtagcattctaa

SEQ ID NO: 1786 - protein, 652 aa, Vibrio parahaemolyticus
MSTLRLPVLTATGVLAFVSVPHVFANDSVSKMETVVVTASSYEQSQADAPASISVISREELDSRYYRDVTDALKSVPGVVVTGGGDTTDISIRGMGSKYTLILVDGKRQSTRETRPNSDGPGIEQGWLPPLQAIERIEVIRGPMSTLYGSDAIGGVINVITRKDALEWTGNVQLGTVIQENSRSGGEQSANFFVNGPLAENLLLQVYGQYTAREEDDIDYGYEDKDMQSISSKLIYQINDRHSVQLEGGTSAQSRRGNVGLSVPTTGCRRGCEDSLNEYRRNYVTLSHTGEWELLGNSDTYLQREESENKSREMTIVNTTFKSSLVKGLGAHTLTTGVDATHAELEDFTSNKASSKTKASNTQWAVFIEDEWKIAEPFSLTLGGRLDHDENYGAHFSPRVYGVWRVAPAWTVKGGVATGFRSPQLREITPGWAQVSGGGNIYGNPDLDPETSLNKEISVLYQGDSGLDVTLTAFHNEFKDKITRVVCPDTICTDGPNQWGADPTYRINVDEAVTQGVEATLAKPLTETIYLSSSYTFTDSEQKTGEYKGMPLQQLPKHLFNVDVTWQTTDNLESWTKVTYRGKEMDPVTGPSRNSIVEPAYTFVDAGVTYQLTDNTKIKGAIYNLFDEDINYKEYGYVEDGRRYWLGLDVAF

SEQ ID NO: 1787 - DNA, 2235 bp, Pseudomonas putida (strain KT2440)
  CDS (1)..(2235)
atgcagtgcagaacttcacccaacagcctggccctggcgttcgttgcgctggcgtcgccgtccatgctggcgaccgcggcagagtccgaggagcggcgtgcgggtgaggtcctggaagtgcccgtcgccgacaacgctctggtgatccaggacaccctgatcaccgccgagcgcgaggcgcgacaggccctgggcacgtcgatcatcacggccgaagacatcaagcgccacccgccggccaatgacctgtccgacatcatccgccgcgagcccggggttaacctgaccggcaacagtgccagtggggcacgcggaaacaaccggcagatcgacctgcgcggcatgggcccggaaaacaccttgatcctcatcgacggcaagccatccagcgcgcgcaacgccgtacgctatggctggaacggtgaccgtgatactcggggtgaaaccaactgggtgccggccgaagcggtcgagcgcatcgaaatcctgcgtggcccggccgccgcacgctatggctctggcgccatgggcggggtggtcaacatcatcaccaagcgcccttccgacgagctgaaaggcagcgtcagcctgtacacgcagctgccggaagacagcgcagagggcgccagccgccgagccaacttcaacctcggtggcggcctgaccgataacctgggtttccgcctgtacggcggcctggccaagactgacgccgacgatctggacatcaacgccgggcatgccaccagcgccctggtagcggggcgggaaggcgttcgcaacaaggacatcaacggcctgctgagctggaaactgaacgacgagcaccgcctcgaagccagtgccggctacagccgtcagggcaacatttttgccggcgacaccatgaacagcaacggcggcggagatgtcgacttcgtctccagcctctacggccacgaaaccaacgtgatgcagcgcagtacttatgacctgacccacctcggtgatttcacctggggtaccagcaagaccacgctggcctacgaatacgtacgcaactggcggcttaacgagggcttggctggccgcaccgaaggtgccccaagcaacgaagggggagccatgtcacgtttacgcaacacacgcctgagcagtgaggtgaacctgccgttcgccatgggcagcacagaccatgtgcttaccttgggcggcgagtacctgtacgaaaccctcaacgaccaaggttcgttgcgcccgcaaagctccgaccccaccaacaatgacggtcttgtcggcttcgatcgcagcagctcgaagatgaccgcacgcagctatgcgctgtttgtcgaagacaacatcatcgttggcgacaccacccttacgccgggcctgcgtttcgaccaccacgaaaccttcggcgacaacttcagccccagcctgaacctgtcgcacaagctcaccgaagcactgtcggtaaaaggcggcatcgcccgtgcctacaaggttccgaacctgtaccagtccaaccccaactacctgctgtacagccgcggtaatggctgcagcgtgcaacagaccaacaatggtggctgttacctgcagggcaacgccgacctcaagcccgagatcagcgtcaacaaggaaatcggcctgctgtacgaccgtggtacctggcgcaccagtgccacctacttccgcaacgactacaagaacaagatcatcggtgataccgatgtgctttacaccattggtaccggcagccgcgtgacgcagtgggacaacgccggcaaggcgcgggtggaaggtgtcgaaggcaacttcttcatcgagttggccccgaacctggactggaacaccaacctgacctggatgctcgataacgataatcgcgaaacgggcgagccgctgtcggtgatcccggaatacaccgtcaacaccagcctcgactggcgcgccaccgagcaactgtcattccagctggcgggtacatacttcggcaagcagaaatcgccgacctacgactaccgcacccagcaggactacgacaagaccgcccagcaggacgtcgaggcctatggcctggtggacgtgagtgccgggtacaagttcaatgccaactacgacgtgcgggtaggcgtgaacaacgtcttcgacaagcagatcctgcgcggcggcaacgccagcagctcgggggcaaacacgtataaccagccgggcagggcggtgtttgctgcgctgaatatcaacttctga

SEQ ID NO: 1788 - protein, 744 aa, Pseudomonas putida (strain KT2440)
MQCRTSPNSLALAFVALASPSMLATAAESEERRAGEVLEVPVADNALVIQDTLITAEREARQALGTSIITAEDIKRHPPANDLSDIIRREPGVNLTGNSASGARGNNRQIDLRGMGPENTLILIDGKPSSARNAVRYGWNGDRDTRGETNWVPAEAVERIEILRGPAAARYGSGAMGGVVNIITKRPSDELKGSVSLYTQLPEDSAEGASRRANFNLGGGLTDNLGFRLYGGLAKTDADDLDINAGHATSALVAGREGVRNKDINGLLSWKLNDEHRLEASAGYSRQGNIFAGDTMNSNGGGDVDFVSSLYGHETNVMQRSTYDLTHLGDFTWGTSKTTLAYEYVRNWRLNEGLAGRTEGAPSNEGGAMSRLRNTRLSSEVNLPFAMGSTDHVLTLGGEYLYETLNDQGSLRPQSSDPTNNDGLVGFDRSSSKMTARSYALFVEDNIIVGDTTLTPGLRFDHHETFGDNFSPSLNLSHKLTEALSVKGGIARAYKVPNLYQSNPNYLLYSRGNGCSVQQTNNGGCYLQGNADLKPEISVNKEIGLLYDRGTWRTSATYFRNDYKNKIIGDTDVLYTIGTGSRVTQWDNAGKARVEGVEGNFFIELAPNLDWNTNLTWMLDNDNRETGEPLSVIPEYTVNTSLDWRATEQLSFQLAGTYFGKQKSPTYDYRTQQDYDKTAQQDVEAYGLVDVSAGYKFNANYDVRVGVNNVFDKQILRGGNASSSGANTYNQPGRAVFAALNINF

SEQ ID NO: 1789 - DNA, 1890 bp, Escherichia coli O6
  CDS (1)..(1890): n means a or g or c or t/u
atgatgaaacctgcggcatccttcttctattgtggatgctttacaatgattaaaaaagcttcgctgctgacggcgtgttccgtcacggcattttccgcttgggcacaggataccagcccggatactctcgtcgttactgctaaccgttttgaacaaccgcgcagcactgtgcttgcgccaactactgttgtgacgcgtcaggatatcgaccgctggcagtcgacctcggtcaatgatgtgctgcgccgtcttccgggcgtggatatcacccaaaacggcggttcaggtcagctctcatctatttttattcgcggtacaaatgccagtcatgtgttggtgttaattgatggcgtccgcctgaatttggcgggggtgagtggttctgctgatcttagtcagttccctattgcgcttgtccagcgtgttgaatatatccgtgggccgcgctccgctgtttatggttcagatgcaataggcggggtcgtgaatatcatcacgacgcgcgatcaccccggaacggaaatttcagcagggtggggaagcaatagttatcagaactatgatgtctctacacagcaacaactgggggataagacacgggtaacgctgttgggcgattatgcccatactcatggttatgatgttgtcgcctatggtaataccggaacgcaagcgcagccagataacgatggttttttaagtaaaacgctttatggcgcgctggagcataattttactgatgcctggagcggctttgtgcgcggctatggctatgataatcgtaccaattatgacgcatattattctcccggcttgccactggtcgatacccgtaaactctatagccaaagttgggatgccggactgcgctataacggcgaactgattaaatcacaactgattaccagctacagccatagcaaagattacaactacgatccgcattatggtcgttatgattcgtccgcgacgctcgatgagatgaaacagtacaccgtccagtgggcaaacaacatcatcattggccacggtaatattggtgcgggtgttgactggcagaagcagagcacggcaccgggcacagcttatgttgaggatggatatgatcaacgtaataccggcatctatctgactgggctgcagcaagtcggcgattttacttttgaaggcgcaggacgcagcgacgataattctcagtttggtcgtcatggtacctggcaaaccagcgccggttgggagttcatcgaaggttatcgctttattgcttcctacggaacatcttataaggcaccaaatcttgggcaactgtacggctcctacggtaatccgaatctgaatcctgagaaaagcaaacaatgggaaggcgcgtttgaaggcttaactgctggggttaactggcgtatttccggatatcgtaacgatgtcagtgacttgatcgattatgatgatcacaccctgaaatattacaatgaagggaaagcgcggattaagggtgtcgaggcgaccgctaattttgataccggaccactgacgcatactgtgagttatgattatgttgatgcgcgcaatgcgattactgacacgccgttgttacgccgtgctaaacagcaggtgaaataccagctcgactggcagttgtatgacttcgactgggggattacttatcagtatttaggcactcgctatgataaggattactcctcttatccttatcaaaccgttaaaatgggcggtgtgagcttgtgggatcttgcggttgcgtatccggtcacctctcacctgacagttcgtggtaaaatagccaacctgttcgacaaagattacgagacagtctatggctaccaaactgcaggacgggaatataccttgnctggcagctacaccttctga

SEQ ID NO: 1790 - protein, 629 aa, Escherichia coli O6
  misc_feature (624)..(624): Xaa can be Thr or Ala or Pro or Ser
MMKPAASFFYCGCFTMIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDHPGTEISAGWGSNSYQNYDVSTQQQLGDKTRVTLLGDYAHTHGYDVVAYGNTGTQAQPDNDGFLSKTLYGALEHNFTDAWSGFVRGYGYDNRTNYDAYYSPGLPLVDTRKLYSQSWDAGLRYNGELIKSQLITSYSHSKDYNYDPHYGRYDSSATLDEMKQYTVQWANNIIIGHGNIGAGVDWQKQSTAPGTAYVEDGYDQRNTGIYLTGLQQVGDFTFEGAGRSDDNSQFGRHGTWQTSAGWEFIEGYRFIASYGTSYKAPNLGQLYGSYGNPNLNPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLXGSYTF

SEQ ID NO: 1791 - DNA, 1863 bp, Brucella suis
  CDS (1)..(1863)
atgcatattctgaaattgtcagctcttctggcgtcggcctgtgcggccacgttatcacccgctttggcgcaggatggcggggataaggatgatggtgtcacacttgatactatcgtggtgacaccgctccgccgggcctcgtcgcttcagcgatccacgtcctcggtgagcgttattgacgctgccgatatcgaacggtccgccgcgcccgatctgcaatccttgctgcaaacctatagcggcatttcggtcaagacgaatggcgggcaggggtcttccgccaatatctatatgcgcggcatgtcgtcgaagcagacggtcgtgctggtcaatggggtgcgcacggcttcggcaacgagtggatcgaccgcgcttgccaatattccgctgacctccatcgaacgtatcgagattgccaggggcgcgcattcctcgcaatatggcgcggatgcaatcggcggtgtcatcaatatcatcaccaaacagggcggggcctgcggcgaacgcgcatggtgcggcagcgtttcaacaggcgtgtcgcatccatggggcggttatgcatcgggttcgttacaaggccgcagcagcgacggtatcgattatgccgtaggggcagcgtttaccggcactcaaggctatgatttcaccacgccggaagcattcggccacgagccggacgatgatggtttcctgcagggctcgttcaattttgcgctgtcgaaagatttcgactggggcaaaatctatgcggacggcctcttcagccgtgggcgcaaccagtatgatgcgaccgcacccgcattcaacgaagcggatagtacggcctttaccggcaaggtcggcacacggatcgaccatacggccgactggtcctcgacggtggaattcagcaccgggatcgacaatagccggaatttccgcaaggggatcgaaggttcggaccggttcgagaccaggcgttacggggtgttcgcctcgaccgaaaaaagcttcgataccggcaaggtctcgcatgttgtgactggcggcgttgaagcctatcgggaaaaaatcaatacgaccatcgattatgacgagacaggccgcgatcttgccgccgtgttcgggcaatattcgctggaatatgatgcattgcgtttcgatggcggcattcgctacgaccataatggccagttcggcaatgtgaccacctataatcttggcgcgagctatgaaatcctgcctgatctggtgctgcgttcatcctatgcgacgggtttccgcgccccgactttcaacgagctttattatccgggctttgccaatcccgacctgcaacccgaaaaatcccgttctgtggaagtcgggctgaactggcaggcgacggcttcgacaagcctcgacatggcactctatcagacccggctcagcgatgcgatcatgagcactgcgccgtcctatattccgtataatattgcaagcgcgaaggtgaccggccttgaagcgacactcagccatcgcttcaacgaacaatggggcatcaagggaatggtggacctcaagcggcctgtcgatgaagatagcgggaatgatcttccctatcgcgagcgtttcaaggcggccgccgaagtgaacttcaagccggtggaaaagctcgatctgacggcacgggtgctctatggcggttcgcgctataccaatgcgaaaaatacgaagaaactcggcgattatgtcaccgcggattttgtggcgctctattcgatcgacaaacaatcgcagttgaagttctcggtggagaatatcttcgacaaggattacgagacgagttccggctatgttgcgccgggccgcaccatcactatcgggctgacccgtaatttctga

SEQ ID NO: 1792 - protein, 620 aa, Brucella suis
MHILKLSALLASACAATLSPALAQDGGDKDDGVTLDTIVVTPLRRASSLQRSTSSVSVIDAADIERSAAPDLQSLLQTYSGISVKTNGGQGSSANIYMRGMSSKQTVVLVNGVRTASATSGSTALANIPLTSIERIEIARGAHSSQYGADAIGGVINIITKQGGACGERAWCGSVSTGVSHPWGGYASGSLQGRSSDGIDYAVGAAFTGTQGYDFTTPEAFGHEPDDDGFLQGSFNFALSKDFDWGKIYADGLFSRGRNQYDATAPAFNEADSTAFTGKVGTRIDHTADWSSTVEFSTGIDNSRNFRKGIEGSDRFETRRYGVFASTEKSFDTGKVSHVVTGGVEAYREKINTTIDYDETGRDLAAVFGQYSLEYDALRFDGGIRYDHNGQFGNVTTYNLGASYEILPDLVLRSSYATGFRAPTFNELYYPGFANPDLQPEKSRSVEVGLNWQATASTSLDMALYQTRLSDAIMSTAPSYIPYNIASAKVTGLEATLSHRFNEQWGIKGMVDLKRPVDEDSGNDLPYRERFKAAAEVNFKPVEKLDLTARVLYGGSRYTNAKNTKKLGDYVTADFVALYSIDKQSQLKFSVENIFDKDYETSSGYVAPGRTITIGLTRNF

SEQ ID NO: 1793 - DNA, 1881 bp, Xanthomonas campestris (pv. campestris)
  CDS (1)..(1881)
atgatgtccctttcttccgtttcgccgtgccgtgccgtgctggccgtgtgcctgtcgatgtgcgtggccgcgctggcccaggccgaggccgctgtcgatctcgaccaggtggtggtcaccgcgacgcgcaccgcgcagacccaggaccagaccctggcgccggtgacggtgatcgaccgtgcgcagatcgagcgccgccagatcaattcgctgcaggacctgttgcgcggcgaagccggcgtgtcgctggccaataacggcggccccggcaagcagacctcgttgttcctgcgcggcaccgaggccgaccacctggtggtgctggtggacggcgtgcgtgtcggctcggccaccgccggcggcgcggcgttgcaggacatcccgttcgagcagatcgaacggatcgagatcgtgcgtggcccgttctccagcctgtacggctccgaggcacttggcggcgtcatccagctgtttacccggcgcccggaaggccgcttcgtgccgaccttcggcgctgctgctggcagcgacaacgcgcgccgctacagcgccggcgtggccgggcgcagcgatggcgatctgggcgagcgcggcggttggtattcggtcaacgcggtgcacgacgagaccgacggcatcaacgcctatctggacacccgctccagcagctacgacccggaccgcgacggctaccgcaacgattcgttgaatgtgcagggcggttggcgcttcaaccgccagtgggatgccgacgtgcacgccttgcgcgcgcagagccgcaacgaatacgacggctcggcctttggcggcaacctgtccaagggtgtgcagcaagccgtgggcggccgcgtgcggtatgcgccgaccgacgcgttcaagctcactgccagcctcgggagcagcgtggattttagcgatgcgtattttgacggcacctacgtgtccacctacgacacgcggcgcaagcagggttcgttgcaggccgatgtggatgccggcccgggcttgctgacggtggggtttgactggcagcgcgatgcgattgccagcagcgacacctacgatgccgacagccgcattgaccgcgccgcattcgcgcagtggcagcagagcttcggcacgcagtcgctgcaggccagcttgcgtcgcaacgacaacagccagttcggtggcaaaaccaccggcagcctgctgtggggctgggatattgccgcgcatctgcgtgtgaccgccagctatggcaccgcgttcaaggcgcccacgttcaacgagttgtattacccggactacggcaatccgctgctggggccggaaacctccaggagcgccgagctgggcctgcgtggcaactacgactggggcacctggacgctgagcgcgttccagacccgcatcgatgatctgattgcctacgacgccgggctggtggatgccacgcatccgttcggccagccaaacaatatcgaccaggcgcgcatccgcggcgtggaagccggctacgacaccgaactggccggctggaccgtgcgtagcgcgctgacctggctggacccgcgtgccgatggcgacgtcaaccatggcaactggctgccgcggcgtgcacgccagagcgggcgcatcgatgcggaccgcagcttcggcgcgtacggcgtgggcgccagcctgttcggcgccggcaagcgctacgacgacctggccaacagcgaccgcctggccggttacggcctgctcgatctgcgcgtgagctatgcggtgaacgcagactggaaggtgtcgctgagcgccaacaacgtgttcgaccgccagtacgaaaccgcgcgctggtacaaccagccggggcgcgcctacctgctgacgttgcgttatcacccggcgcagtga

SEQ ID NO: 1794 - protein, 626 aa, Xanthomonas campestris (pv. campestris)
MMSLSSVSPCRAVLAVCLSMCVAALAQAEAAVDLDQVVVTATRTAQTQDQTLAPVTVIDRAQIERRQINSLQDLLRGEAGVSLANNGGPGKQTSLFLRGTEADHLVVLVDGVRVGSATAGGAALQDIPFEQIERIEIVRGPFSSLYGSEALGGVIQLFTRRPEGRFVPTFGAAAGSDNARRYSAGVAGRSDGDLGERGGWYSVNAVHDETDGINAYLDTRSSSYDPDRDGYRNDSLNVQGGWRFNRQWDADVHALRAQSRNEYDGSAFGGNLSKGVQQAVGGRVRYAPTDAFKLTASLGSSVDFSDAYFDGTYVSTYDTRRKQGSLQADVDAGPGLLTVGFDWQRDAIASSDTYDADSRIDRAAFAQWQQSFGTQSLQASLRRNDNSQFGGKTTGSLLWGWDIAAHLRVTASYGTAFKAPTFNELYYPDYGNPLLGPETSRSAELGLRGNYDWGTWTLSAFQTRIDDLIAYDAGLVDATHPFGQPNNIDQARIRGVEAGYDTELAGWTVRSALTWLDPRADGDVNHGNWLPRRARQSGRIDADRSFGAYGVGASLFGAGKRYDDLANSDRLAGYGLLDLRVSYAVNADWKVSLSANNVFDRQYETARWYNQPGRAYLLTLRYHPAQ

SEQ ID NO: 1795 - DNA, 1881 bp, Xanthomonas axonopodis (pv. citri)
  CDS (1)..(1881)
atgatgtccctttcttccgtttcgccgcgtcgtgccgtgctcgccgtggggctgtcgctgtgcattgccactgtggcccaggccgaggccgccatcgatctggaccaagtcgtggtcaccgcctcgcgtaccgcacagacccaggaccagacgctggcgccggtcacggtgatcgaccgcgcgcagatcgagcgtcgtcaggtcaattcgctgcaggacctgttgcgtggcgaagcgggcgtgtcgctggccaacaatggcgggcctggcaaggcgacctcgctgttcctgcgcggcaccgaggcagaccatgtggtggtgctgatcgatggcgtgcgcatcggctcggccaccgctggcggcgcggcgttgcaggatctgccgatcgagcagatcgaacgcatcgaaatcgtgcgtggcccgttttccagcctgtatggctccgaagcgctgggcggggtggtccagatctttacccggcgtccgcaaggcggtttggtgccgaccttgagcgtggcggccggcagcgacaacgcgcgacgctacggcgcgggcattgcggggcgcagcccgggcgatctgagcgacgccggtggttggtattcggtgaacgccgtgcacgacgaaaccgacggtatcaacgcgtatctggataccggctccagcgcctacgacccggaccgcgacggctatcgcaacgattcgttgagcgcgcagggcggctggcgtttcaatcgccagtgggatgccgatgtgcatgtattgcgcgcgcagagccgtaacgaatacgacggttcggcattcggcggcaatctgagcaagggcgtgcagcaggccatcggcggccgcgtgcgttacgcgccgagcgatgcgctcaagctcactgccagcgtgggcagcagcgccgatctgagcgatgcttactaccaaggcgcctatctgtcgacctacgacacccgccgcaagcagggtgcgttgcaggccgatctcgacaccggccccggtctgctcacggtcggcttcgattggcagcgcgacgccatcgccagcagcgatacctacgatgccgacagccgcatcgaccgcgccgcatttgcgcaatggcagcagacgtttggcagccaatcgctgcaggccagcctgcgtcgcaacgacaacagccagttcggcggcaagaccaccggcagcctgctgtggggttgggatgtcgccgagcatctgcgcctgaccgccagctacggcactgcgttcaaggcgcccaccttcaatgagttgtattaccccgaatacggaaacccgctgctcggcccggaaacctccaagagtgccgagctcggcctgcgcggtcgctacgactggggcacctggacgctcagcgcgttccagacccgtatcgacgacctcatcgcctacgacgcctcgttggtggatgcgacgcatccgttcgggcagccgaacaatatcgatcgggcgcgcattcgcggcgtggaagcgggctacgacaccgaactggccggctggaccgtgcgcagcgcgttgacctggcttgccccgcaggccgatggcgaggtcaatcatggcaactggttgccgcggcgtgcgcgtcagagtgggcgcatcgatgccgaccgcaacatcggtgcattcggcatcggcgcaagcctgttcggatcgggtgcacgctacgacgatctggccaataccgatcgcctggccggctacggcttgctggatctgcgcgtgagttatgcagtgaacgcggactggaaggtgcaactggccgccaacaatgtgttcgaccgccactacgaaaccgcacgttggtacgcccagccaggccgcaattatctgctgaccttgcgctaccaaccggcgcactga

SEQ ID NO: 1796 - protein, 626 aa, Xanthomonas axonopodis (pv. citri)
MMSLSSVSPRRAVLAVGLSLCIATVAQAEAAIDLDQVVVTASRTAQTQDQTLAPVTVIDRAQIERRQVNSLQDLLRGEAGVSLANNGGPGKATSLFLRGTEADHVVVLIDGVRIGSATAGGAALQDLPIEQIERIEIVRGPFSSLYGSEALGGVVQIFTRRPQGGLVPTLSVAAGSDNARRYGAGIAGRSPGDLSDAGGWYSVNAVHDETDGINAYLDTGSSAYDPDRDGYRNDSLSAQGGWRFNRQWDADVHVLRAQSRNEYDGSAFGGNLSKGVQQAIGGRVRYAPSDALKLTASVGSSADLSDAYYQGAYLSTYDTRRKQGALQADLDTGPGLLTVGFDWQRDAIASSDTYDADSRIDRAAFAQWQQTFGSQSLQASLRRNDNSQFGGKTTGSLLWGWDVAEHLRLTASYGTAFKAPTFNELYYPEYGNPLLGPETSKSAELGLRGRYDWGTWTLSAFQTRIDDLIAYDASLVDATHPFGQPNNIDRARIRGVEAGYDTELAGWTVRSALTWLAPQADGEVNHGNWLPRRARQSGRIDADRNIGAFGIGASLFGSGARYDDLANTDRLAGYGLLDLRVSYAVNADWKVQLAANNVFDRHYETARWYAQPGRNYLLTLRYQPAH

SEQ ID NO: 1797 - DNA, 1992 bp, Salmonella typhimurium
  CDS (1)..(1992)
atgtttaggtttaaccctttcgttcgggtagggctttgtatgtccgcagttacgttggcctggccggttgccgcggcaacggatgatggtgaaaccatggtcgttaccgcgtccgccatcgaacaaaatctgaaagatgcgccagcaagtatcagcgtcattacccagcaagatttacagcgcaggcccgtgcaaaacctgaaagatgtcctgaaagaggtgccgggcgtacagctcactaacgaaggggataaccgtaaaggcgtgagtattcgtggtctggacagcagttatacgctgatcctgatcgacggtaagcgcgttaactcccgtaacgcggtcttccgccataatgattttgatctgaactggataccggttgacgctatcgaacgtattgaagtggtgcgtggccccatgtcctcgctgtatggctccgatgcgctgggcggcgtggtcaacattatcaccaaaaaaattggtcagaaatggcacggcagcgtcacggttgactccactattcaggaacatcgcgaccgtggcgatacttataacggtcagttctttaccagcggtccgctgatcgacggcgtgctgggaatgaaagcctacggtagcctggcgaaacgcgaaaaagacgagcagcagagttccgccaccaccgctacgggtgaaacgccgcgcattgaaggatttaccagccgggatggaaacgtcgagtttgcctggacaccaaacgaaaatcatgacgttaccgcaggctacggttttgatcgccaggaccgggactcagactcgctggataaaaaccgtctggaacggcaaaactatgcgttgagccataacggacgttgggatctcggcaatagtgagctcaaattctacggcgaaaaagtggaaaacaaaaaccccggcaacagtagccctatcacgtcagaaagcaattcgattgacgggaaatacgttctgccgttagcgtctgtcaaccagttcctcaccttcggcggcgaatggcgtcacgataaactgagcgatgcggtgaacctgaccggcggttccagtactaaaacctccgccagccagtacgctctgttccttgaagatgagtggcgcatcttcgaaccgctggcgctgaccaccggtattcgtatggatgaccatgaaacctatggcgatcactggagcccgcgtgcttatctggtctataacgcaacggataccctgacggtgaaaggtgggtgggccacggcctttaaagcgccgtcgctattgcaattaagcccggactgggcgaccaactcctgccgtggcggatgccgcattgtcggtagcccggatctgaaacctgaaaccagtgaaagctgggagctcggcctttattaccggggcgaagaaggcatactggagggcgtggaagcgagcgttaccacgttccgtaacgatgtggacaatcgcatcagcattagccgtacccctgacgttaacgccgcgcccggctattccaactttgtcggtttcgaaaccaacagtcggggacagcgcgttccggtcttccgttattacaacgtgaataaagcgcgtattcagggcgtggaaaccgagttgaaagttccgtttaacgaggcgtggaaactgtcgttgaattacacctataacgacgggcgcgacgtcagtaatggcgggaacaagccgctttccgatctgccgttccacaccgcgaacggtacgctggactggaaaccggtgcagctcgaagactggtcattctacgtatcagggaattataccgggcgtaagcgggccgacagcgcaacagcgaaaacgccgggcgggtacgtggtctgggataccggcgcggcatggcaggcgacgaaaaacgttaaactgcgtgcgggcgttctgaacgtgggcgataaagatctcaaacgcgacgactacggttataccgaagacggacgtcgttactttatggcggtggattaccgtttctga

SEQ ID NO: 1798 - protein, 663 aa, Salmonella typhimurium
MFRFNPFVRVGLCMSAVTLAWPVAAATDDGETMVVTASAIEQNLKDAPASISVITQQDLQRRPVQNLKDVLKEVPGVQLTNEGDNRKGVSIRGLDSSYTLILIDGKRVNSRNAVFRHNDFDLNWIPVDAIERIEVVRGPMSSLYGSDALGGVVNIITKKIGQKWHGSVTVDSTIQEHRDRGDTYNGQFFTSGPLIDGVLGMKAYGSLAKREKDEQQSSATTATGETPRIEGFTSRDGNVEFAWTPNENHDVTAGYGFDRQDRDSDSLDKNRLERQNYALSHNGRWDLGNSELKFYGEKVENKNPGNSSPITSESNSIDGKYVLPLASVNQFLTFGGEWRHDKLSDAVNLTGGSSTKTSASQYALFLEDEWRIFEPLALTTGIRMDDHETYGDHWSPRAYLVYNATDTLTVKGGWATAFKAPSLLQLSPDWATNSCRGGCRIVGSPDLKPETSESWELGLYYRGEEGILEGVEASVTTFRNDVDNRISISRTPDVNAAPGYSNFVGFETNSRGQRVPVFRYYNVNKARIQGVETELKVPFNEAWKLSLNYTYNDGRDVSNGGNKPLSDLPFHTANGTLDWKPVQLEDWSFYVSGNYTGRKRADSATAKTPGGYVVWDTGAAWQATKNVKLRAGVLNVGDKDLKRDDYGYTEDGRRYFMAVDYRF

SEQ ID NO: 1799 - DNA, 2256 bp, Salmonella typhimurium
  CDS (1)..(2256)
atgaacaagaagattcattccctgaccttactggtcaatttagggatttacggggccactctgcccgtgatggcggaagacaaaaccgatagcgctgcgctcaccaatgaagacaccatcgtggtgaccgctgcccagcaaaacctacaggcgccaggcgtatccaccatcaccgccgatgagatccgcaaaaatccgcccgcgcgcgacgtgtcagaaatcatccgcaccatgccgggcgtaaacctgaccggcaactccaccagcggtcagcgcgggaataaccgccaaatcgatattcgcggcatggggccggaaaacaccctcatcctgatagacggtaaacccgtcaccagccgtaactcggtgcgcctgggctggcgcggcgaacgcgatacccgcggcgataccgcgtgggtgccgccggagatgatcgaacgcattgaagtgctgcgtggccctgccgccgcacgctacggtaacggcgcggcgggtggcgtagtcaatatcattaccaaaaaaggcggtagcgagtggcacggttcctggaatacctatttcaacgcgccggaacataaagacgaaggcgcgaccaaacgcactaactttagcctgaacggcccgctgggcggggatttcagcttccgcctgtatggcaacctcgacaaaacgcaggcggatgcgcgtaatattaaccaggggcatcagtctgaacgtaccgggagttacgccgacacgctaccagcaggacgcgagggggtcattaacaaagatatcaacggcgtggttcgttgggattttgctccgcttcagtctctggagctggaggccggatacagtcgccagggcaatctctatgccggcgatactcagaacaccaatacgaaccaactggtgaaagataattacggaaaagagacgaaccgcctctatcggcagaactactctctgacctggaacggcggctggaataatggcgtaaccaccagtaactgggtgcaatacgaacatacccgtaactcccggatgccggaaggcctggcaggcggcaccgaaggaattttcgatcccaaagcatcgcaaaaatatgccgatgccgatttgaatgacgtcaccctacacagcgaagtgagccttcctttcgatctgctggtcaatcaaaacctgacgctgggtactgaatgggcccaacagcgtatgaaagaccagctctccaactcgcaaacctttatggggggaaatatcccgggttacagcagtaccaatcgtagcccctattcaaaagcggaaattttctctctgtttgctgaaaacaacatggaactgaccgacagcaccatgctgacgccggggctacgtttcgatcatcacagtattgtgggggataactggagcccgtccctcaacctgtcgcaaggtctgggggatgactttaccctgaaaatgggaatcgcccgcgcttataaagccccgagtctgtaccagactaacccaaactatattttgtacagtaaaggtcagggttgctacgcgactggcgcgggtaccggcatcggctgctatatgatgggtaacgatgatctgaaagccgaaactagcatcaataaagagatcggtctggaatttaaacgcgatggctggctggccggcgtcacctggttccgcaatgattaccgcaataagattgaagcgggtacagtgccgttgcagcgtatcaacaacggcaaaacggatgtttatcagtgggagaacgtgccgaaagcggtcgttgaaggtctggaaggcacgttaaacgtaccggttagcgacaccgtcaactggacgaataacgttacgtatatgctgcagagtaaaaacaaagagaccggcgaacgcctgtcgattattccacagtacacgcttaactcaaccctgagctggcaggtacgtcaggacgtttctctgcaatcgaccttcacctggtacggcaaacaagagccgaagaaatatgattatcagggtaaccccgttaccggaacagataagcaagcggtcagcccatacagtattgttggcctgagcgcgacctgggacgtgaccaaaaatgtcagcctgaccggtggcgtggataacctctttgacaaacgtctgtggcgtgaaggtaacgcgcaaaccgtcagggatacgcaaactggcgcttatatggcgggcgctggcgcgtacacctataacgaaccaggacgtacgtggtatatgagcattaatacccatttctga

SEQ ID NO: 1800 - protein, 751 aa, Salmonella typhimurium
MNKKIHSLTLLVNLGIYGATLPVMAEDKTDSAALTNEDTIVVTAAQQNLQAPGVSTITADEIRKNPPARDVSEIIRTMPGVNLTGNSTSGQRGNNRQIDIRGMGPENTLILIDGKPVTSRNSVRLGWRGERDTRGDTAWVPPEMIERIEVLRGPAAARYGNGAAGGVVNIITKKGGSEWHGSWNTYFNAPEHKDEGATKRTNFSLNGPLGGDFSFRLYGNLDKTQADARNINQGHQSERTGSYADTLPAGREGVINKDINGVVRWDFAPLQSLELEAGYSRQGNLYAGDTQNTNTNQLVKDNYGKETNRLYRQNYSLTWNGGWNNGVTTSNWVQYEHTRNSRMPEGLAGGTEGIFDPKASQKYADADLNDVTLHSEVSLPFDLLVNQNLTLGTEWAQQRMKDQLSNSQTFMGGNIPGYSSTNRSPYSKAEIFSLFAENNMELTDSTMLTPGLRFDHHSIVGDNWSPSLNLSQGLGDDFTLKMGIARAYKAPSLYQTNPNYILYSKGQGCYATGAGTGIGCYMMGNDDLKAETSINKEIGLEFKRDGWLAGVTWFRNDYRNKIEAGTVPLQRINNGKTDVYQWENVPKAVVEGLEGTLNVPVSDTVNWTNNVTYMLQSKNKETGERLSIIPQYTLNSTLSWQVRQDVSLQSTFTWYGKQEPKKYDYQGNPVTGTDKQAVSPYSIVGLSATWDVTKNVSLTGGVDNLFDKRLWREGNAQTVRDTQTGAYMAGAGAYTYNEPGRTWYMSINTHF

SEQ ID NO: 1801 - DNA, 2049 bp, Escherichia coli
  CDS (1)..(2049)
atgaagaacaaatatatcattgctccgggcattgccgtgatgtgttctgcagttatatcatcaggttatgccagttctgataaaaaagaagatacgcttgttgttactgcctccgggttcactcagcagctcagaaatgccccggccagtgtctcagtcattacttcagaacaactgcaaaaaaaaccggtttcagatctggtcgatgcagtaaaagatgttgaagggattagtatcactggtgggaatgaaaaaccggatatcagtatacgtggtctaagtggcgattacacgctgattctggtcgatggacgacgtcagagcggtcgggaatccagaccaaacggcagcggcggttttgaagccggatttatccctcctgtggaagcaattgaacgcattgaagtgatccgtggccctatgtcttccctgtatggttctgatgccatcggaggggtcattaatatcataaccaaaccagttaataaccaaacatgggatggcgtacttggacttggggggattattcaggaacatgggaaatttggtaactcaaccacaaatgacttctatctgtcaggcccattgattaaggataaacttggtcttcagctatatggaggaatgaactatcgcaaggaagatagtatctctcagggaacaccggcaaaagataataagaatataacggcaacgctccagtttactccgactgaaagccagaagtttgtttttgaatatggaaaaaataaccaggtgcatacattaacacctggtgagtctctcgatgcctggactatgcggggaaatcttaaacaaccaaacagtaaaagagaaacgcataattcacgtagtcactgggtagcagcatggaatgcccagggcgaaatactgcatcctgaaattgctgtttatcaggagaaagttattcgtgaggttaaatcaggtaaaaaagataaatataatcattgggatcttaattacgagtcaagaaaaccggaaataaccaacacaatcatagatgcaaaagtgacggcatttctgccggaaaatgtactgaccatcggaggtcaatttcagcatgcagagctccgtgatgactcagccacgggtaaaaaaacgacagaaacacagtctgtttcaattaaacagaaagctgtttttatagaaaatgaatatgcagcaacggattctctcgccctgactggaggactgcgtctcgatgatcatgaaatctatggcagttactggaatccaagattgtacgctgtttataacctgaccgataatctcacactcaaaggggggatcgcaaaagcatttcgggctccttcaattcgtgaggtgagtcctggatttggaacactgacgcagggtggtgcctctattatgtatggaaacagggacctgaaaccggagaccagtgtaaccgaagagatcggtattatttatagtaatgatagtggtttttcggcgagcgcgacgctgtttaatactgattttaaaaataagttgaccagttacgatataggtacaaaagatccagtcaccgggttaaacacttttatttatgataatgtaggtgaggcaaatatcagaggggtggagcttgcaactcagattcctgtgtatgataaatggcatgtatctgcaaactatacatttactgactctcgtcgaaaaagtgatgacgaaagtctcaatggcaagtcgctgaaaggggaacctctggaaagaactcccagacatgcagccaatgcaaaactggaatgggattacactcaggatattacattttattcatctctgaattatacgggaaaacaaatctgggcagcacaaagaaatggtgctaaggttccccgcgttcgtaatggattcacatctatggatattggtctaaattaccagattctgccagacacgctgattaattttgccgttcttaacgtcacagacagaaagagcgaggatatcgataccattgatggtaactggcaggtcgatgaaggacgccgttattgggctaatgtaagagtatccttctga

SEQ ID NO: 1802 - protein, 682 aa, Escherichia coli
MKNKYIIAPGIAVMCSAVISSGYASSDKKEDTLVVTASGFTQQLRNAPASVSVITSEQLQKKPVSDLVDAVKDVEGISITGGNEKPDISIRGLSGDYTLILVDGRRQSGRESRPNGSGGFEAGFIPPVEAIERIEVIRGPMSSLYGSDAIGGVINIITKPVNNQTWDGVLGLGGIIQEHGKFGNSTTNDFYLSGPLIKDKLGLQLYGGMNYRKEDSISQGTPAKDNKNITATLQFTPTESQKFVFEYGKNNQVHTLTPGESLDAWTMRGNLKQPNSKRETHNSRSHWVAAWNAQGEILHPEIAVYQEKVIREVKSGKKDKYNHWDLNYESRKPEITNTIIDAKVTAFLPENVLTIGGQFQHAELRDDSATGKKTTETQSVSIKQKAVFIENEYAATDSLALTGGLRLDDHEIYGSYWNPRLYAVYNLTDNLTLKGGIAKAFRAPSIREVSPGFGTLTQGGASIMYGNRDLKPETSVTEEIGIIYSNDSGFSASATLFNTDFKNKLTSYDIGTKDPVTGLNTFIYDNVGEANIRGVELATQIPVYDKWHVSANYTFTDSRRKSDDESLNGKSLKGEPLERTPRHAANAKLEWDYTQDITFYSSLNYTGKQIWAAQRNGAKVPRVRNGFTSMDIGLNYQILPDTLINFAVLNVTDRKSEDIDTIDGNWQVDEGRRYWANVRVSF

SEQ ID NO: 1803 - DNA, 2178 bp, Escherichia coli
  CDS (1)..(2178)
atgagaattaacaaaatcctctggtcgctaactgtgctcctggttgggttgaatagccaggtatcagtagccaaatactccgacgatgataatgacgagactctggtggtggaagccaccgctgagcaggtattaaaacagcagccgggcgtgtcggttattaccagcgaggatattaaaaagacccctccggtaaacgacctttcagatattattcgtaaaatgcctggtgtcaatcttaccggcaatagcgcctcgggcacacgcggtaataaccgccagatcgatattcgtggtatggggccggaaaacaccttaattttaattgatggtgtaccggtgacgtcacgtaactccgtgcgttatagctggcgtggggagcgtgatacccgcggtgacaccaactgggtgccaccggaacaggttgagcgtattgaagtgatccgcggccctgcggcggcgcgctacggttcgggggccgccgggggggtggtgaacatcattaccaaacgtcccaccaacgactggcacggttcgctgtcgttatacaccaaccagccggaaagtagcgaagagggcgctacgcgtcgcgccaatttcagccttagtgggcctctggctggtgatgctcttaccacgcgtttgtatggtaacctgaataaaacggatgctgacagttgggatattaattctccggtcggtacgaaaaacgcagccgggcatgaaggggtacgtaacaaagatattaacggcgttatctcgtggaaattaaatccgcagcagattctcgatttcgaagccggatatagccgccaggggaatatctatgcgggcgatacgcagaacagttcttccagtgcagttaccgaaagcctggcaaaatccggcaaagagacgaaccgcctgtaccgacagaattatggcattacgcataatggtatctgggactggggacaaagtcgctttggtatttattacgagaaaaccaataatacccgcatgaatgaaggattatccggcggtggtgaaggacgtattttagcgggtgaaaagtttacgaccaatcgcctgagttcctggcgaaccagcggtgagcttaatattcctttgaatgtgatggttgatcaaacgctgaccgttggtgcagagtggaaccgcgataagctcgatgatccttcctctaccagcctgacggtgaatgacagagatatcagcggtatttctggctctgctgcggatcgcagcagtaaaaatcattctcaaatcagtgcgctgtatattgaagataacattgagccggttcctggcacgaatatcattcccggcctgcgctttgattatctcagcgactccggcgggaacttcagccccagtctgaatctttcgcaggaattgggcgattatttcaaagtcaaagcaggggttgcccgaacctttaaagccccaaacctgtatcaatccagtgaaggctatctgctctactcgaaaggcaatggctgtccaaaagatattacctcaggcgggtgctacctgatcggtaataaagatctcgatccggaaatcagcgtcaataaagaaattggactggagttcacctgggaagattaccacgcaagtgtgacctacttccgcaatgattaccagaataagatcgtggccggggataacgttatcgggcaaaccgcttcaggcgcatatatcctcaagtggcagaatggcgggaaagctctggtggacggtatcgaagccagtatgtctttcccactggtgaaagatcgtctgaactggaataccaatgccacatggatgatcacttcggagcaaaaagacaccggtaatcctctgtcggtcatcccgaaatatactatcaataactcgcttaactggaccatcacccaggcgttttctgccaacgtcaactggacgttatatggcagacaaaaaccgcgtactcatgcggaaacccgcagtgaagatactggcggtctgtcaggtaaagagctgggcgcttattcactggtggggacgaacttcaattacgatattaataaaaatctgcgtcttaatgtcggcgtcagtaatatcctcaataaacagatcttccgatcttctgaaggggcgaatacctataacgagccaggccgggcttattatgccggagttaccgcatcattctga

SEQ ID NO: 1804 - protein, 725 aa, Escherichia coli
MRINKILWSLTVLLVGLNSQVSVAKYSDDDNDETLVVEATAEQVLKQQPGVSVITSEDIKKTPPVNDLSDIIRKMPGVNLTGNSASGTRGNNRQIDIRGMGPENTLILIDGVPVTSRNSVRYSWRGERDTRGDTNWVPPEQVERIEVIRGPAAARYGSGAAGGVVNIITKRPTNDWHGSLSLYTNQPESSEEGATRRANFSLSGPLAGDALTTRLYGNLNKTDADSWDINSPVGTKNAAGHEGVRNKDINGVISWKLNPQQILDFEAGYSRQGNIYAGDTQNSSSSAVTESLAKSGKETNRLYRQNYGITHNGIWDWGQSRFGIYYEKTNNTRMNEGLSGGGEGRILAGEKFTTNRLSSWRTSGELNIPLNVMVDQTLTVGAEWNRDKLDDPSSTSLTVNDRDISGISGSAADRSSKNHSQISALYIEDNIEPVPGTNIIPGLRFDYLSDSGGNFSPSLNLSQELGDYFKVKAGVARTFKAPNLYQSSEGYLLYSKGNGCPKDITSGGCYLIGNKDLDPEISVNKEIGLEFTWEDYHASVTYFRNDYQNKIVAGDNVIGQTASGAYILKWQNGGKALVDGIEASMSFPLVKDRLNWNTNATWMITSEQKDTGNPLSVIPKYTINNSLNWTITQAFSANVNWTLYGRQKPRTHAETRSEDTGGLSGKELGAYSLVGTNFNYDINKNLRLNVGVSNILNKQIFRSSEGANTYNEPGRAYYAGVTASF

SEQ ID NO: 1805 - DNA, 2001 bp, Escherichia coli
  CDS (1)..(2001)
atgtggacacggtcatccggtgggtggtcatctctttgtatcttcagatgcccttctaggtctgaagacctgtcggttaacgtcgcatctggttctcatcatcgcttactatcgatggtaactgcgatattcttcttctgttgtggatgcgttacaatgattaaaaaatattggtttctaatggtgtactccgtcacagccttttctgtctgggcacaggatacccctctggatactctcgttgttactgctaaccgttttcaggaaccattaagtaccgtgcttgctcctgtaactattgtgacacgagaagatatagatcgctggcaagtttcttctgtaaatgatgttctgcgtcgtttgcctggcgttgcaatttctcagcatgggggagaagggcagctctcaacaatttttgttcgtgggacaaactctaaccacactctggtattgattgatggagtgcgcctgaatttagcgggtgtcagtggagctgcagacctgagtcagtttcccgtcgctttagtgcagcgtatagaatatatccgtgggccacgttcagcaatttatggttcagatgccattggcggagtgataaatattattacatcccgtgagaatactggcactgaaatttccgcaggatggggaagtaatagttatcaacattacgatatatccactcatcagcaacttggggaaaatacccgtgtaacacttcttggcgattatacctatactagggggtttgatgctgttgcctatggcagtacagggatgcaaccacagtcagacagagacggttttttaagtaaaacattctatggcaaacttgaacataacttatctgatacgtggagcggatttgttcgtggctacggctataataaccgaactaaatatgacgcctggtactctcccggttctccactgattgatactcgaaaactttatagtcaaagctgggatgcaggtcttcgctacgctggtgaaacactgcaatctcaacttgtttccagttatagccatagtaaagattacaactacgatccacattatggacgctatgacacatcagctaacctggatgatatgaaacaatacaatctccagtggacaaatagcgtcacagtcggccacggtaatgttggcgctggtatcgactggcaaaaacaatccactactcctggaactggatatctgccaaaaggttacgatcagcgtaacacggggatttatctgacaggactgcaaaaacttggcgattttacgttagaaggcgcggtgcgtaatgacgacaactcgcaatttgaacgccacacaacatggcaatccagtgcgggatgggagtttattgagggttatcgctttatcgcttcctatggaactgctttcaaagcgccaaatctggggcagctatatggtatgtatggtaatccgaatctggctccggaaaagagtaaacagtgggaaggggcatttgaaggtttaactgggggcgtaaattggcgtatttcaggataccgtaatgatatcagtgaaatgattaactataatcctcatacccttcgttattacaacgacggaaaagtacacgttaaaggaattgaggctacagtaaactttgatacaggagcactgacgcatactgttagttacgattatacggatgccagaaatgccttaactgacaaaccattggaacgtcgtccaaaactgcaagtgaagtatcaacttgactggcaagtattcgattttgactgggggataacttatcaatatatgggatcgcgatacgattcggactactcatcctggccctataagtcagtcaaaatgggcggtgtgagtttatgggatgttgcggttgcgtatccggtcactcctcacctgatagttcgcggtaaaatagctaatctgttcaacaaagattatgagactggttatggctatcaggcagcaggacgggaatatatattgtctggcagctatactttctga

SEQ ID NO: 1806 - protein, 666 aa, Escherichia coli
MWTRSSGGWSSLCIFRCPSRSEDLSVNVASGSHHRLLSMVTAIFFFCCGCVTMIKKYWFLMVYSVTAFSVWAQDTPLDTLVVTANRFQEPLSTVLAPVTIVTREDIDRWQVSSVNDVLRRLPGVAISQHGGEGQLSTIFVRGTNSNHTLVLIDGVRLNLAGVSGAADLSQFPVALVQRIEYIRGPRSAIYGSDAIGGVINIITSRENTGTEISAGWGSNSYQHYDISTHQQLGENTRVTLLGDYTYTRGFDAVAYGSTGMQPQSDRDGFLSKTFYGKLEHNLSDTWSGFVRGYGYNNRTKYDAWYSPGSPLIDTRKLYSQSWDAGLRYAGETLQSQLVSSYSHSKDYNYDPHYGRYDTSANLDDMKQYNLQWTNSVTVGHGNVGAGIDWQKQSTTPGTGYLPKGYDQRNTGIYLTGLQKLGDFTLEGAVRNDDNSQFERHTTWQSSAGWEFIEGYRFIASYGTAFKAPNLGQLYGMYGNPNLAPEKSKQWEGAFEGLTGGVNWRISGYRNDISEMINYNPHTLRYYNDGKVHVKGIEATVNFDTGALTHTVSYDYTDARNALTDKPLERRPKLQVKYQLDWQVFDFDWGITYQYMGSRYDSDYSSWPYKSVKMGGVSLWDVAVAYPVTPHLIVRGKIANLFNKDYETGYGYQAAGREYILSGSYTF

SEQ ID NO: 1807 - DNA, 2133 bp, Vibrio mimicus
  CDS (1)..(2133)
atgtataaaaaatctctgctcgctagtgcaattgttgtagcacttatgccttcagcatacgctgaacaacaatcacaattcaacgaagttgttgttactgcaacacgttcaacccaaaacaaacaagatgttgcggcatcaattgacacggttagcgctcaagacatcgataacactctagctacagatgtcaaagatgcactcaaatatacaccgggtgtcgaggtaaaatcaggtagccgttttggaatctcaggctttaatattcgtggcatggaagatagccgtattcttacggtcattgacggtgttcaacaacccgtaggttataaccctgacgcaagcgaacagcgaaaatacagtaatgctattgaagttgacaccttacaagcaattgaggtgaacaaaggcccttcttctaccctttacggttctgacgctctaggaggtttagttcagtttcgaactaaaaacccaagcgatgtattgattaacgatgaagatggccaccgttttggtattaaatcaacctacacatcggtcgatgaacaatttaaaaacacgctaacctgggcaatgagacaaggcaaacttgaaaccttgttgatggccacttatgcccaaggtcatgaaacaaaatcacacgactcaggtgcagatattgaaggccccggacgtggcttaactaaccctgctgatacggaattaggcaatctactggctaaagctcaataccaagctaatgaagatcatcgttttggcttaaccgttgagcattacactaaaaactatgatgaagatgagcttaactacaacggttatgccatcatgccgggctttgtctatagcaacaactataacgaagacgtaaataaacgtactcgtatttcattagaccaccaatggttaatggacacactattggtcgaccaaagccttgtaacgctgagttaccaagactccagtactctaaataaaaactacgatacaacaccaagtagcggtgctcgtatgcgtgagcgtgactcggccgataaggcagtacagtttgacgttcagcttaataagcttattgataccgatggtttatcacatgacgtcacttatggtggctcttatctaaataacgcatttagcttacaaaataccgaccatttatataaaacaggcacatcgcgtaatggtagtacgggggttccggatgctgacatcatcaaatggggtcttttcgcccaagatcagatgtactttttggatgagcagctaattttaactgctggtttgcgttacgactcttttgaagcgacaccaaaaactgattctgcctttactaccgagtacaaaccaaacaaagataatgcctttacgggcaaactcggagcggtttatcacttacaagacaacctcgctgttttcggccaaattagccaaggcttcaaagcgccaaccgtttacgatctttattacttctacaatcaaggcgcaattattgaggcgaaccctgatttgaaagcagaacgaagtattgcttatgaaatcggtactcgtggcaataatgcctatggcaacatggaatttgcgttgttcgtcaatgactacaaagatttcattacccaaacgaaaacaggccaatccggtggtaaagatgtcatcagtaaatacaatatcgatgaagttcagatctatggcgctgaattcagttcgactctactattagataccatttcaccattaccacaaggtagctatgctcgtctttccattgcttatgcgcatggtgaagataaagccactggtaaagaaattgacacggttgcacctttaaccagcgtgcttggcttaggttatgaacaagccgattttggctcagccttgaatgtaaaaatggtggcaagcaaaaatgagtggcaggttgagaacaatttagacgttgcaggttatgcggtggttgacctcgcagcttactacgtcccagtcaaagatctcaccgttcgtgcagggcttttcaacctgtttgataagaaatattggaactactctgatatctcaggaaaaactggcactgaaagattcaatgactacgacactcaaccaggacgcaactggggtatttctctcgattatcaattctag

SEQ ID NO: 1808 - protein, 710 aa, Vibrio mimicus
MYKKSLLASAIVVALMPSAYAEQQSQFNEVVVTATRSTQNKQDVAASIDTVSAQDIDNTLATDVKDALKYTPGVEVKSGSRFGISGFNIRGMEDSRILTVIDGVQQPVGYNPDASEQRKYSNAIEVDTLQAIEVNKGPSSTLYGSDALGGLVQFRTKNPSDVLINDEDGHRFGIKSTYTSVDEQFKNTLTWAMRQGKLETLLMATYAQGHETKSHDSGADIEGPGRGLTNPADTELGNLLAKAQYQANEDHRFGLTVEHYTKNYDEDELNYNGYAIMPGFVYSNNYNEDVNKRTRISLDHQWLMDTLLVDQSLVTLSYQDSSTLNKNYDTTPSSGARMRERDSADKAVQFDVQLNKLIDTDGLSHDVTYGGSYLNNAFSLQNTDHLYKTGTSRNGSTGVPDADIIKWGLFAQDQMYFLDEQLILTAGLRYDSFEATPKTDSAFTTEYKPNKDNAFTGKLGAVYHLQDNLAVFGQISQGFKAPTVYDLYYFYNQGAIIEANPDLKAERSIAYEIGTRGNNAYGNMEFALFVNDYKDFITQTKTGQSGGKDVISKYNIDEVQIYGAEFSSTLLLDTISPLPQGSYARLSIAYAHGEDKATGKEIDTVAPLTSVLGLGYEQADFGSALNVKMVASKNEWQVENNLDVAGYAVVDLAAYYVPVKDLTVRAGLFNLFDKKYWNYSDISGKTGTERFNDYDTQPGRNWGISLDYQF

SEQ ID NO: 1809 - DNA, 1845 bp, Salmonella typhimurium
  CDS (1)..(1845)
atgattaaaaaagctacgctgctgacggcgttctccgtcacggccttttccgcttgggcgcaggacactagcccggataccctggttgtcaccgccaaccgttttcagcagccgcgcagcgcggttctggcgcccgttaccatcgtgacgcgtcaggatattgaacgctggcaatcgacctccgtaaatgatgttctgcgccgtttgcctggcgtcgatattgcgcagagcggcggcgccggacaaaactcctccattttcattcgcggcaccaactccagccatgtactggtattgattgacggcgtgcgtctgaatttagcaggcgtgagcgggtccgccgatctcagccagttcccggtgtcgctggtacagcgcattgaatatattcgcggtccgcgctccgctatttatggttccgatgctatcggcggcgtagtgaatatcattacgacgcgcgataacccaggcacagaattaaccgctggatggggaagcaatagctaccagaattacgacatctcgacgcaacagcaacttggcgaaaacacgcgggcgacgttgatcggcgattacgaatacaccaaagggtttgacgtggtagcgaaaggcggtaccgggatgcaggcgcagcctgaccgggacggctttttgagtaaaacgctttatggcgcgttagagcataccttttctgatcgctggagcggattcgtgcgtggttatggctacgataaccgtaccgattacgacgcctattactcgccgggctcgccgctgattgatacacgcaaactttatagccaaagctgggacgccgggctgcactttaatggcgaacgtattcagtctcagctggtttcaagctatagccacagtaaagattacaactatgatccgcactatggccggtatgatacctccgccacgctggatgagatgaaacagtacaatgttcaatggaccaacagtgtggtcgtggggcacggtaatgttggggcgggcgtagactggcagaaacagactaccacgccaggtaccggctatgtgcccgagggatatgaccagcgtaataccggggtttacctgacaggattacaacagttgggtgacttcactctggaagcggcggcgcgcagtgatgacaactcccagtttggtcgtcatggtacatggcaaaccagcgcgggatgggagtttatagaaggttatcgctttattgcctcctacggaacctcctacaaagcgcctaatttgggccaactgtatggttattacggtaatccgaacctgaatcctgaaaagagtaaacagtgggaaggcgcatttgaagggctaaccgctggcgtcagctggcgtatttcaggttatcgtaacgatattaatgacatgatcgattatgacgatcatctgcaaaaatattacaacgaaggtaaggcgcgcattaaaggtattgaggcgacggcgaatttcgataccggaccgttaacgcatacggtcagttatgattacgttgatgcgcgtaatgcgattaccgatacgccattaccccggcgttccaaacagatggcaaaatatcaacttgactgggacgtttacgattttgactgggggatgacatatcaataccttggttcccgctatgattcggattactccgcttacccataccggacagtaaaaatgggcggcgtcagtttatgggatcttacggttgcatatccggtcacctcacatctgacagttcgtggtaaaatagccaacctgttcgacaaagattacgagacagtttatggctaccaaactgcaggacgagaatacaccttgtctggcagctacaccttctga

SEQ ID NO: 1810 - protein, 614 aa, Salmonella typhimurium
MIKKATLLTAFSVTAFSAWAQDTSPDTLVVTANRFQQPRSAVLAPVTIVTRQDIERWQSTSVNDVLRRLPGVDIAQSGGAGQNSSIFIRGTNSSHVLVLIDGVRLNLAGVSGSADLSQFPVSLVQRIEYIRGPRSAIYGSDAIGGVVNIITTRDNPGTELTAGWGSNSYQNYDISTQQQLGENTRATLIGDYEYTKGFDVVAKGGTGMQAQPDRDGFLSKTLYGALEHTFSDRWSGFVRGYGYDNRTDYDAYYSPGSPLIDTRKLYSQSWDAGLHFNGERIQSQLVSSYSHSKDYNYDPHYGRYDTSATLDEMKQYNVQWTNSVVVGHGNVGAGVDWQKQTTTPGTGYVPEGYDQRNTGVYLTGLQQLGDFTLEAAARSDDNSQFGRHGTWQTSAGWEFIEGYRFIASYGTSYKAPNLGQLYGYYGNPNLNPEKSKQWEGAFEGLTAGVSWRISGYRNDINDMIDYDDHLQKYYNEGKARIKGIEATANFDTGPLTHTVSYDYVDARNAITDTPLPRRSKQMAKYQLDWDVYDFDWGMTYQYLGSRYDSDYSAYPYRTVKMGGVSLWDLTVAYPVTSHLTVRGKIANLFDKDYETVYGYQTAGREYTLSGSYTF

SEQ ID NO: 1811 - DNA, 2181 bp, Klebsiella pneumoniae
  CDS (1)..(2181)
atgggtatgagaattaacaagatcctctggccgtcaattgcgctcttggcagggttgaatagtcaagtatcagtagccaaatcctacgacgataacgacgagaccttggtggtggtagccaccgcagagcaagtactaaaacagcagcctggcgtgtcgattattaccagcgaagatattaaaaagacccctccggtcaacgacctctccgatattattcgcaaaatgccaggtgtcaatctgaccggcaatagcgcctcgggtacacgcggtaataaccgccagatcgatattcgcggtatggggccggaaaacacattaattttaattgatggtgtaccggtgacgtcgcgcaactccgtgcgttatagctggcgtggggagcgtgatacccgcggcgacaccaactgggtgccaccggaacaggttgagcgtatcgaagtgatccgtggccctgcggcggcgcgctacggttcgggcgccgcgggcggggtggtaaacatcattaccaaacgtccctccaacgactggcacggttcgctgtcgctatacaccaaccagccggaaagcagcgatgaaggcgctacgcatcgcaccaacttcagccttagtgggccactggctggcgatgcgctgaccatgcacctctacggtaacctgaataaaaccgatgccgacagctgggatattaactcctcagccggtacgaaaaacgcggccgggcatgaaggggtgcgcaacaaagatattaacggcgttgtttcgtggaaattaaatccgcagcaaattctcgatttcgaagccggatatagccgtcaggggaatatttatgcgggcgatacgcaaaacagttcttccagtgctgttactgaaaacctagcgaaatcccgcaaagagacgaaccgcctttaccggcagaattatggcattgcgcataatggtatttgggactggggacaaagtcgttttggtgtttattacgagaaaaccaataacaaccgcatgaatgaaggattatccggcggcagtgaagggcgtattttggcggatgaaaaattcacgaccaatcgcctgagctcttggcgaaccagcggtgagattaatattccgctgaatgaaccggtcgatcaaacgctaacagttggtgtggagtggagtcgagataaactcgacgccccttcctctaccagccttacggtgaatgacagtgatataggcggcatttctggctctgctgcggatcgcagcagtaaaaaccattcccaaatcagtgcgctgtatattgatgataatattgagccggttcccggcacgaatatcatttccggcttgcgctttgattatctcaacgagtccggcggtaacttcagccccagcctgaacctatcgcaggaattgggcgattacttcaaagtcaaagcggggattgcccgaaccttcaaagcaccaaacttgtatcaatccagcaaaggttatctgctctactcgaaaggcaacggttgtccaaaagatattacatcgggcggctgctacctgaaaggaaataaagatctcgatccggaaatcagtatcaataaagaaattgggctggagttcgcctgggaagattactacgccagcgtgacctacttccgcaatgactaccagaataagatcgtggccggggataatgctatcgggcaaaccgcttcaggcgcatatatcctccagtggcagaatggagggaaagcgctggttgacggtatcgaagccagcatggcgttcccgctggtgaaagatcgtctgaactggaataccaatgccacctggatgatcacctcggagcaaaaagacaccggtaacccactgtcgatcatcccgaaatatacaattaataactcgcttgactggaccatcacccaggcgttttccgccagcgtcaactggacgttatacggcagacaaaaaccgcgtacccatgcggaaagtcgaagtgaagatactcgcggcatgtcaggtaaagtcttgggggcttattctctggtgggaacgaacttcaattacgatattaataaaaatcttcgtcttaacatcggtgtcagtaatatcctcgataagcagatctaccgaacttcagaaggtgctagtacctataatgagccagggcgggcttattatgtgggggcggtagtttcattctga

SEQ ID NO: 1812 - protein, 726 aa, Klebsiella pneumoniae
MGMRINKILWPSIALLAGLNSQVSVAKSYDDNDETLVVVATAEQVLKQQPGVSIITSEDIKKTPPVNDLSDIIRKMPGVNLTGNSASGTRGNNRQIDIRGMGPENTLILIDGVPVTSRNSVRYSWRGERDTRGDTNWVPPEQVERIEVIRGPAAARYGSGAAGGVVNIITKRPSNDWHGSLSLYTNQPESSDEGATHRTNFSLSGPLAGDALTMHLYGNLNKTDADSWDINSSAGTKNAAGHEGVRNKDINGVVSWKLNPQQILDFEAGYSRQGNIYAGDTQNSSSSAVTENLAKSRKETNRLYRQNYGIAHNGIWDWGQSRFGVYYEKTNNNRMNEGLSGGSEGRILADEKFTTNRLSSWRTSGEINIPLNEPVDQTLTVGVEWSRDKLDAPSSTSLTVNDSDIGGISGSAADRSSKNHSQISALYIDDNIEPVPGTNIISGLRFDYLNESGGNFSPSLNLSQELGDYFKVKAGIARTFKAPNLYQSSKGYLLYSKGNGCPKDITSGGCYLKGNKDLDPEISINKEIGLEFAWEDYYASVTYFRNDYQNKIVAGDNAIGQTASGAYILQWQNGGKALVDGIEASMAFPLVKDRLNWNTNATWMITSEQKDTGNPLSIIPKYTINNSLDWTITQAFSASVNWTLYGRQKPRTHAESRSEDTRGMSGKVLGAYSLVGTNFNYDINKNLRLNIGVSNILDKQIYRTSEGASTYNEPGRAYYVGAVVSF

SEQ ID NO: 1813 - DNA, 1782 bp, Geobacter sulfurreducens
  CDS (1)..(1782)
atgttttacgaggacaaggaactggttgtgacccccacccgggaccccaagcccgtctctcaggtggccgaaaacattaccgtcattaccgccaaagaaatcaggaacctgaatgcccataccctggcagacgttctggtcaccataaccggtgtccagcaagactggcggggtggtcccggcagtctcgccttccccggtatccaggggtcgaaccccaatcaggtactcgttctgatcgatggggtctcgcagaccagtacctcttcaaactttgccgatgtgggcgctatcccggtgcagaatatcgagcgggtcgagatcatcaaaggaccagcctccacctcctgggggtcgtcccttggcggcatcatcaacgtcatcaccaagtcccccgaggagaacagggccgcggccggcatggtgtcggcgtctctgggtgagcggttcaccggcgactaccggggcgaactcaccggcacggtgggatcgttcggctattatctctcgggcggcaagctccactccgacggactccttccccacaacagcgttgataccgaccgggcatatctgaagctgacccaccagttgcccgacggcggagatctacgcttctctctcggctacagcgccggcgaccgcggcgaccaaatggaccccgttgctcgaacgtcctatgacaatacgttcgacaatctgttgacgacgctctcaatctcgctcccccttaccgagcggatcgactgggacctttcgctccgctcccagtggctggaatatgaccagtttcgcaatggtctcgacaccggactcgttgatgcctcgctgctggatgaccgttccttcggagccacaaccaagcttgtctggcgtaccggtgaccacagcctgactgtcggggcggagtttgacaggggtgatttcaggctggaacaggagagctctggaattggacggtcttctgtccgttcacatattgcaaaatcggcaatctttgccaacgacaccattgtgtttgggcctttgaccataaccccgggcatccgttttgatcacacgaccaccaatggggactttctgagccccagtcttggggtgacctggggcattggtgaacatacggtgctacgtggcgcattggcgagggggttcacggtccctcccgttatttacactgtcggtgatggctttgccctggcccctaaccccgaccttaagatggaaaaggttctttcctggcaggcaggcttcgagacatcgctcctgcgctacctgtggctcaagtctactttttttctgcatgatgtttctgatgctgttgttgctaccattttgtcagatgggcagtttcggtatgaaaatcgagaaaagcagcgccgacagggtatggagatcgaggtcaagaccattccttttatgtacactacgctgggagccggttatacctttgtggattcgaaagatcggaacacgcatcagcgaataccctcggcggctcggcagacggtcaatacaaccatacagttcgatgacttaaagggtacaagggcgaaccttgtggggcgctacatctggtggaatgctcctgatttcatccaaggtagctatacctcaatggtctgggatctgaatgttgcccgaaatatctatcgtgatgaacgttacagtgtggagttgttcctagctggccgcaatctgtttaatggttcacagtatgttgacgccaccctcaaaaacccctgccgctggttcgagggagggatacggttcgatttttga

SEQ ID NO: 1814 - protein, 593 aa, Geobacter sulfurreducens
MFYEDKELVVTPTRDPKPVSQVAENITVITAKEIRNLNAHTLADVLVTITGVQQDWRGGPGSLAFPGIQGSNPNQVLVLIDGVSQTSTSSNFADVGAIPVQNIERVEIIKGPASTSWGSSLGGIINVITKSPEENRAAAGMVSASLGERFTGDYRGELTGTVGSFGYYLSGGKLHSDGLLPHNSVDTDRAYLKLTHQLPDGGDLRFSLGYSAGDRGDQMDPVARTSYDNTFDNLLTTLSISLPLTERIDWDLSLRSQWLEYDQFRNGLDTGLVDASLLDDRSFGATTKLVWRTGDHSLTVGAEFDRGDFRLEQESSGIGRSSVRSHIAKSAIFANDTIVFGPLTITPGIRFDHTTTNGDFLSPSLGVTWGIGEHTVLRGALARGFTVPPVIYTVGDGFALAPNPDLKMEKVLSWQAGFETSLLRYLWLKSTFFLHDVSDAVVATILSDGQFRYENREKQRRQGMEIEVKTIPFMYTTLGAGYTFVDSKDRNTHQRIPSAARQTVNTTIQFDDLKGTRANLVGRYIWWNAPDFIQGSYTSMVWDLNVARNIYRDERYSVELFLAGRNLFNGSQYVDATLKNPCRWFEGGIRFDF

SEQ ID NO: 1815 - DNA, 1974 bp, Aeromonas salmonicida subsp. salmonicida
  CDS (1)..(1974)
atgcagttgcagcctggcgtatttcgcttgaacccgattttgctttccctcggtctgtttgccctgccgggcctggcccaggccgagttgcccaaagccaacgagaccatggtggtcaccgccacccagaccaagcacacggaactgtccgctccggccagcgtctctgtggtgacccgcgccgatctggacaagatgaacgccaacaacataggcgatgccctcaagcatgtgccgggtgtcaacatcataggcaccaaccccacgggtcgcagcgagatcaagatccgcggtatgggcggcgactacacactgctgctgatcaacggcaaacgggtcaacgcccgcgagaccctgggcagctcctttggcaatgacttcgacttgagctccatccccatggcggccatagagcgcatcgaagtgatccgtggtcccgtctcctctctgtacggtgccgacgccctcggcggcgtggtcaacgtgatcctgcgccaggccaaggagaagacggaagcggccttcggctacacccactccatgcccaccaagggcgacgggggcgatgccaaccagggcagcgcctttgtctccggtgccctcatcgacaacaagctgctgggcagcgtggtggtcgaaggctaccagcgtgaccgctggcacagcgatcagtccaacaacctggatgccgatgcgctggaaaaacgggaagtggtcaatgtgctctccagcctgaagtggctggtcagtgacaaccaggatatcgatttcgatctgggctacaaccagaacgacatggacagctacttcaacaacgtgccccgtgccccgaccgcaccggccaccccgcacaacgtgcaaaaactcgatcgtctgagcctggggctgacccacaacggccgttgggagcacttcgacagccgcgcccgctactacttcgagcagacggatctgatggatgactcccagctcaatggcggcgccgccgatgtcacccagaccaaccacacggtcgatggccagctgagcggctatctggggaatcacctgctgacctcgggtgccgagatgcgcaagaccgagctggagcacagccgcagcatcaccaacggcagcgtggatgccagccagagtgccctctatctgcaggacgaattcagcctgggggatctggcgttgaccctctccggccgcctcgaccaccatgaaacctatggcaacgaattcagcccgcgcgcctatgccctctacaaactgaccgacgagtgggtgatcaagggtggcgccggcaaggcgttcaaggcaccgaccctggcccagtccagcgaaggcttcgccaccaccgcctgccgtggcgcctgcaaggtggtcggcaacccgaacctgaaaccggaaaccgccgtcagctatgagctgggcaccgcctacgagagtgagcgtttcggcgccggtgtgaccggcttccacaacgacatcgaagatctgatccagagcgatcagtggggcccgggctaccgtccgaccgtcatgacctacctcaacgtcaagaaggcacgggtgaaagggctggagctgaccggctgggtcgacgtactggacaacgtcaagctgaccggcaactggagcctgctggattcccaagacaagagcacgggcgacgatctgaccaagaccccggaccacaccggcaacctcagcctggattggcaagccaccgagatcgtcagtaccaacctggcctggcaatacgtgggcagccagttcatcaaggtgccgatgcacaactcccaggcgctcaagtccaagcactatcagaccctggacctcaacaccaactggaaagtcacgccggcgctcgacttcaaactcggcatcaccaacctgaccaacacccagcgtgaccaggtcgccaccgacgccgatttcattctggaaggtcgcaccgtctatgccggggtgaattacaagctgtaa

SEQ ID NO: 1816 - protein, 657 aa, Aeromonas salmonicida subsp. salmonicida
MQLQPGVFRLNPILLSLGLFALPGLAQAELPKANETMVVTATQTKHTELSAPASVSVVTRADLDKMNANNIGDALKHVPGVNIIGTNPTGRSEIKIRGMGGDYTLLLINGKRVNARETLGSSFGNDFDLSSIPMAAIERIEVIRGPVSSLYGADALGGVVNVILRQAKEKTEAAFGYTHSMPTKGDGGDANQGSAFVSGALIDNKLLGSVVVEGYQRDRWHSDQSNNLDADALEKREVVNVLSSLKWLVSDNQDIDFDLGYNQNDMDSYFNNVPRAPTAPATPHNVQKLDRLSLGLTHNGRWEHFDSRARYYFEQTDLMDDSQLNGGAADVTQTNHTVDGQLSGYLGNHLLTSGAEMRKTELEHSRSITNGSVDASQSALYLQDEFSLGDLALTLSGRLDHHETYGNEFSPRAYALYKLTDEWVIKGGAGKAFKAPTLAQSSEGFATTACRGACKVVGNPNLKPETAVSYELGTAYESERFGAGVTGFHNDIEDLIQSDQWGPGYRPTVMTYLNVKKARVKGLELTGWVDVLDNVKLTGNWSLLDSQDKSTGDDLTKTPDHTGNLSLDWQATEIVSTNLAWQYVGSQFIKVPMHNSQALKSKHYQTLDLNTNWKVTPALDFKLGITNLTNTQRDQVATDADFILEGRTVYAGVNYKL

SEQ ID NO: 1817 - DNA, 25 bp, Primer
atgattaaaaaagcttcgctgctga

SEQ ID NO: 1818 - DNA, 25 bp, Primer
ttagaaggtgtagctgccagacaag

SEQ ID NO: 1819 - DNA, 360 bp, Escherichia coli,
  CDS (1)..(360)
atgattaatccaaatccaaagcgttctgacgaaccggtattctggggcctcttcggggccggtggtatgtggagcgccatcattgcgccggtgatgatcctgctggtgggtattctgctgccactggggttgtttccgggtgatgcgctgagctacgagcgcgttctggcgttcgcgcagagcttcattggtcgcgtattcctgttcctgatgatcgttctgccgctgtggtgtggtttacaccgtatgcaccacgcgatgcacgatctgaaaatccacgtacctgcgggcaaatgggttttctacggtctggctgctatcctgacagttgtcacgctgattggtgtcgttacaatctaa

SEQ ID NO: 1820 - protein, 119 aa, Escherichia coli,
MINPNPKRSDEPVFWGLFGAGGMWSAIIAPVMILLVGILLPLGLFPGDALSYERVLAFAQSFIGRVFLFLMIVLPLWCGLHRMHHAMHDLKIHVPAGKWVFYGLAAILTVVTLIGVVTI

SEQ ID NO: 1821 - DNA, 393 bp, Vibrio cholerae
  CDS (1)..(393)
atgttcttattgtggtgtaaggagcttattgtgattaataccaacccaaaacgttcagacgaacccgtatggtggagcctgtttggtgctggtggcacttggtttgccatgatcaccccgattaccgttctggtactgggcattcttgcgccactgggagtaattgatgccgaagcactgagctatgagcgagtgtctagctttgcaactagcatcattggtgcactgttcatcatcggcactttagctctaccaatgtggcatgccatgcaccgtgttcaccacgggatgcatgatttgaaattccacaccggtgtggcagggaaaatcgcttgctacggctttgcaaccatcatctccgcactggcggtcgtgtttatcttcatgatctaa

SEQ ID NO: 1822 - protein, 130 aa, Vibrio cholerae
MFLLWCKELIVINTNPKRSDEPVWWSLFGAGGTWFAMITPITVLVLGILAPLGVIDAEALSYERVSSFATSIIGALFIIGTLALPMWHAMHRVHHGMHDLKFHTGVAGKIACYGFATIISALAVVFIFMI

SEQ ID NO: 1823 - DNA, 357 bp, Yersinia pestis
  CDS (1)..(357)
atgaatcaagtccctaaacgctccgatgaaccgatcttctggggtctgtttggtgcgggtggcatgtggggtgcaattattgcccctgtgattattctgctggtcgcgattttgttgccattgggtgcattcccaggcgacgcgctgagctacgaacgcattctggcattttgtcagagctttattggccgggtattcctgctgctgatgatcattttgcctttgtggtgcggtttacaccgtattcatcatgcaatgcatgatttgaaaatccacgtcccggcagggaaatgggtattctatggccttgcggcaatcttgagtgtggtcacttttatcggtgtactgacgctgtag

SEQ ID NO: 1824 - protein, 118 aa, Yersinia pestis
MNQVPKRSDEPIFWGLFGAGGMWGAIIAPVIILLVAILLPLGAFPGDALSYERILAFCQSFIGRVFLLLMIILPLWCGLHRIHHAMHDLKIHVPAGKWVFYGLAAILSVVTFIGVLTL

SEQ ID NO: 1825 - DNA, 360 bp, Salmonella enterica subsp. enterica serovar Typhi
  CDS (1)..(360)
atgattaatccaaacccaaaacgttctgatgaacccgtattctggggactgtttggcgcaggcggtatgtggggcgcgatcatcgcgccggtgatcgtgctactggttggcatcatgctgccgctggggctatttccgggcgatgccctgagttttgagcgcgtactgacgttcgcccaaagcttcattggtcgcgtttttctgttcctgatgatcgtgctgccgctatggtgtggcctacaccgtatgcaccacgcgatgcatgacctgaaaatccacgtgcccgcgggcaaatgggtcttctacggtctggcggcaatcctgaccgttgtgacggcgattggcgttatcactctctaa

SEQ ID NO: 1826 - protein, 119 aa, Salmonella enterica subsp. enterica serovar Typhi
MINPNPKRSDEPVFWGLFGAGGMWGAIIAPVIVLLVGIMLPLGLFPGDALSFERVLTFAQSFIGRVFLFLMIVLPLWCGLHRMHHAMHDLKIHVPAGKWVFYGLAAILTVVTAIGVITL

SEQ ID NO: 1827 - DNA, 345 bp, Haemophilus influenzae
  CDS (1)..(345)
atggttgatcaaaatccaaaacgctccggcgaaccgccagtatggttaatgttcggtgcgggcggcacagtgagtgcaattttccttcctgtcgttattctaatcatcggtttgttattaccatttggtttagtcgatgtgcataatttaattacttttgcttattcttggattggtaaattagttattttagtgcttactattttcccaatgtggtgtggtttacaccgtattcatcacggtatgcacgatcttaaagtgcatgtgccagctggtggatttatcttttatggtttagccacaatttataccgtttgggtgttatttgcggtaataaacttgtaa

SEQ ID NO: 1828 - protein, 114 aa, Haemophilus influenzae
MVDQNPKRSGEPPVWLMFGAGGTVSAIFLPVVILIIGLLLPFGLVDVHNLITFAYSWIGKLVILVLTIFPMWCGLHRIHHGMHDLKVHVPAGGFIFYGLATIYTVWVLFAVINL

SEQ ID NO: 1829 - DNA, 360 bp, Proteus mirabilis
  CDS (1)..(360)
atgaatcagaatcaacttcctaagcgctctgatgaacctattttctggggattatttggtgcaggtggtatgtggagtgcgattgtctctccagcaattattatcctgctcggtattctaatcccgatgggtattgcgccagaagcatttacttacgatcgtatcatggcatttagccaaggttttattggtcgtattttcttactgctaatgattattctgccagtttggtgtgcattacaccgtattcaccatacgttgcacgattttaaagtgcatgtacctgctagtaattgggtattttatggtgctgcagcaattattagtgttatcgcaattattggtgtttttacactataa

SEQ ID NO: 1830 - protein, 119 aa, Proteus mirabilis
MNQNQLPKRSDEPIFWGLFGAGGMWSAIVSPAIIILLGILIPMGIAPEAFTYDRIMAFSQGFIGRIFLLLMIILPVWCALHRIHHTLHDFKVHVPASNWVFYGAAAIISVIAIIGVFTL

SEQ ID NO: 1831 - DNA, 378 bp, Vibrio vulnificus (strain YJ016)
  CDS (1)..(378)
atgaaaccgaattacaacgtagatagagcgccaaaacgttctgatgagccagtttggtggagcttgtttggtgcaggtggtacttggtttgccatgatcacaccagttactgttttggtgctgggtattctcgtgccaatgggcgtgatcaatgcagaagcactgagttacgaccgagtggtgagctttgccaccagcatcatcggcgcattgtttatcatcgcgacactggccttaccaatgtggcatgcgatgcaccgtgttcaccacggcatgcatgatctcaaattccacactggcgtggtcggcaaaattgcctgttacgcgattgctggattgatttcagcattggcggtggtgttcattttcatgctgtaa

SEQ ID NO: 1832 - protein, 125 aa, Vibrio vulnificus (strain YJ016)
MKPNYNVDRAPKRSDEPVWWSLFGAGGTWFAMITPVTVLVLGILVPMGVINAEALSYDRVVSFATSIIGALFIIATLALPMWHAMHRVHHGMHDLKFHTGVVGKIACYAIAGLISALAVVFIFML

SEQ ID NO: 1833 - DNA, 354 bp, Photorhabdus luminescens (subsp. laumondii)
  CDS (1)..(354)
atgaatcaaatacctaaacgttccgatgagccgattttttggggattatttggtgccggtggtatgtggggcgcaattgtggctccagccattattttactcgtcgccatccttttgccattggaagtcgcgccggaagcgttaagctacgcacgaattctggctttctgtcagagccttattggtcgtgcgttcctattgctgatgattattctaccactatggtgcggtttacaccgtatccaccacggtatgcatgacctgaaaattcatatccctgcgagtaaatggattttctacggcttggcagcgattctgagtgttgtcgctatcatcggcgtttttactctgtag

SEQ ID NO: 1834 - protein, 117 aa, Photorhabdus luminescens (subsp. laumondii)
MNQIPKRSDEPIFWGLFGAGGMWGAIVAPAIILLVAILLPLEVAPEALSYARILAFCQSLIGRAFLLLMIILPLWCGLHRIHHGMHDLKIHIPASKWIFYGLAAILSVVAIIGVFTL

SEQ ID NO: 1835 - DNA, 363 bp, Chromobacterium violaceum
  CDS (1)..(363)
atgaaaaaccgccaattgaagcgttcccacgcgcccatcttctggggattgttcggcgcaggcggcatgctggccgcgctgttcgggccgatgctggtggccatcaccggcttcgccgcgccgctgggctggctgccggccaaggccgccagctaccagggcgcgctggcgctggcgcagagcctgaccggcaagctggtgttgtggggactgatcagcctgctgctgtggcatgcggcgcaccgcatctatcacagtctgcacgatgtcggcgtgcatggcggcccgctggccaaggcgctgacctatggcgtggcggcggcgggcacgctggcggcgatgtggctgttggccggcatctga

SEQ ID NO: 1836 - protein, 120 aa, Chromobacterium violaceum
MKNRQLKRSHAPIFWGLFGAGGMLAALFGPMLVAITGFAAPLGWLPAKAASYQGALALAQSLTGKLVLWGLISLLLWHAAHRIYHSLHDVGVHGGPLAKALTYGVAAAGTLAAMWLLAGI

SEQ ID NO: 1837 - DNA, 360 bp, Escherichia coli
  CDS (1)..(360)
atgattaatccaaatccaaaacgctctgacgaacccgtattctggggcctgtttggtgcaggcggtatgtggagcgcaatcattgcgccagtaatgatcctgctggtcggcattatgctgccgctgggctttgttccgggtgatgctttcagctatgaacgcgtactggcattcgctcagagcttcatcggacgtgcgtatctgttcctgatgatcgttctgccgctgtggtgtggtttacaccgtatgcaccacgcgatgcatgacctgaaaatccacgtgcctgctggcaaatgggtattctacggactggcagcaatcctgaccgtcgtaacggctattggcattctgaccatctaa

SEQ ID NO: 1838 - protein, 119 aa, Escherichia coli
MINPNPKRSDEPVFWGLFGAGGMWSAIIAPVMILLVGIMLPLGFVPGDAFSYERVLAFAQSFIGRAYLFLMIVLPLWCGLHRMHHAMHDLKIHVPAGKWVFYGLAAILTVVTAIGILTI

SEQ ID NO: 1839 - DNA, 345 bp, Haemophilus ducreyi
  CDS (1)..(345)
atgaacaaacaagatccaaagcgttcaaatgagccacctgtatggctaatgtttagtgcaggcggtactattagtgcaatttgttttccggtgttaattttaattttaggaatattattaccgcttgggctgattccgatggataatatcattgtgtttgcgcatacttggttaggtaaattagttattctagcggtcaccatttttccgatgtgggcaggtatgcaccgcgttcatcacgggttacatgatctcaaaattcatttacctgcatcgggttggctattttatggtttatcgacactttactcgatcgttgtgttatttgcggtgattgcactttag

SEQ ID NO: 1840 - protein, 114 aa, Haemophilus ducreyi
MNKQDPKRSNEPPVWLMFSAGGTISAICFPVLILILGILLPLGLIPMDNIIVFAHTWLGKLVILAVTIFPMWAGMHRVHHGLHDLKIHLPASGWLFYGLSTLYSIVVLFAVIAL

SEQ ID NO: 1841 - DNA, 351 bp, Pasteurella multocida
  CDS (1)..(351)
atgaaagatacaccaaaacgttctaatgaacctgttgtatggttattgtttggcgcaggaacaactgtcagtgccatgttctatcctgtgttagtattaattcttggcttcttgctaccatttggtttaattgatcccaaaaatatcattgaacttataggcttcttacacagcccattaggtaaattactgttacttgtgttattaattttcccaatgtggggagcgatgcaccgtatccatcatggtatgcatgacttcaaaatccacattccagcaagtggtgtcattttctatggtttatctgtgctttatacggtattagtttgcttcgctgtatttagcttataa

SEQ ID NO: 1842 - protein, 116 aa, Pasteurella multocida
MKDTPKRSNEPVVWLLFGAGTTVSAMFYPVLVLILGFLLPFGLIDPKNIIELIGFLHSPLGKLLLLVLLIFPMWGAMHRIHHGMHDFKIHIPASGVIFYGLSVLYTVLVCFAVFSL

SEQ ID NO: 1843 - DNA, 378 bp, Vibrio parahaemolyticus; identical to SEQ ID NO: 1831
  CDS (1)..(378)

SEQ ID NO: 1844 - protein, 125 aa, Vibrio parahaemolyticus; identical to SEQ ID NO: 1832

SEQ ID NO: 1845 - DNA, 360 bp, Citrobacter murliniae
  CDS (1)..(360)
atgattaatccaaatccaaaacgctctgacgaacccgtattttggggcctgttcggtgcaggtggtatgtggggcgcaatcattgcgccggtagtggttctgctggttggcattatgctgccgctgggacttttcccgggcgatgcgctgagctatgagcgcgtgctggcatttgcccagagcttcatcggacgggcatttctgttcctgatgatcgttctgccgctgtggtgcggtttacaccgtatgcaccatgccatgcatgacctgaaaatccacgtgccagctggcaagtgggtattctacggtctggctgcaatcctgacggtagtaacagcgatcggtattctgactatctaa

SEQ ID NO: 1846 - protein, 119 aa, Citrobacter murliniae
MINPNPKRSDEPVFWGLFGAGGMWGAIIAPVVVLLVGIMLPLGLFPGDALSYERVLAFAQSFIGRAFLFLMIVLPLWCGLHRMHHAMHDLKIHVPAGKWVFYGLAAILTVVTAIGILTI

SEQ ID NO: 1847 - DNA, 26 bp, Primer
atgattaatccaaatccaaagcgttc

SEQ ID NO: 1848 - DNA, 22 bp, Primer
ttagattgtaacgacaccaatc

SEQ ID NO: 1849 - DNA, 792 bp, Escherichia coli
  CDS (1)..(792)
atggctaacgcagatctggataaacagcctgattctgtatcttccgtgctaaaagtttttggcattttgcaggcgctgggtgaagagcgcgaaatagggataaccgagctgtcgcagcgcgtcatgatgtcaaaaagcaccgtttatcgctttttacagaccatgaaaaccttaggttatgtggcgcaggaaggggagtcggagaaatattccctgaccctgaaattgtttgaactgggcgctcgcgcgttacaaaacgtcgatttaattcgtagcgcagatatccagatgcgtgagctctcccgcctgaccaaagaaactatccacctcggcgcactggacgaagacagtattgtttacattcacaaaattgactctatgtacaatttgcgcatgtattcacggattgggcgtcgtaatccgctgtacagcaccgcgattggtaaggtactgctggcatggcgcgatcgcgatgaagtgaagcaaattcttgagggcgtggagtataaacgcagtaccgagcggaccatcaccagtacagaagcgttattacccgttctggaccaggtgcgcgagcaggggtatggcgaagataatgaagagcaggaagaagggctgcgatgcattgcggtaccggtatttgatcgctttggcgtggtcattgccggtttgagcatctccttcccgacgttgcgtttctctgaagagcgtttacaggaatatgtcgcaatgttgcataccgcagcgcgcaaaatttctgcccaaatgggttatcacgactatccgttctga

SEQ ID NO: 1850 - protein, 263 aa, Escherichia coli
MANADLDKQPDSVSSVLKVFGILQALGEEREIGITELSQRVMMSKSTVYRFLQTMKTLGYVAQEGESEKYSLTLKLFELGARALQNVDLIRSADIQMRELSRLTKETIHLGALDEDSIVYIHKIDSMYNLRMYSRIGRRNPLYSTAIGKVLLAWRDRDEVKQILEGVEYKRSTERTITSTEALLPVLDQVREQGYGEDNEEQEEGLRCIAVPVFDRFGVVIAGLSISFPTLRFSEERLQEYVAMLHTAARKISAQMGYHDYPF

SEQ ID NO: 1851 - DNA, 756 bp, Bacillus halodurans
  CDS (1)..(756)
atggttaaatccgtcgatcgagcattaacgatcatttcgcttgtgagcgaacataaacaaggactaggggttaccgatgtggcagccaagctatcactcacaaaaagctcagcctataagcttttggctacacttgtggaacacggatttattgagcaagacgaagaaacaaaaaaataccgtctaggttaccgatatttagagttaagcgcaaccttgttagaatcgatcgacattcgccgacaagcgcggccatttttagaacagcttgaggcaacaacaaatgaggtcgtccatctcgtcttatatgatcaaggggagatggtttacattgacaaactggaagggacaaagacacttcgaactcattcaaaaattggccggagagcaccgattcattgcacgagtgtcggcaaagtaattatggcctacttaccagaaaaggtgcaaattagtttaattgaacgctatgggttgccacctcatacggagcggacgatcaccgataaagaaacgtttatgaaggaattagagaaaatacgcttagaaggctacgggtatgaaatggaagaaaacgagccaggaattacgtgcattgcagctccaattttcgactatcaaggggctataacggctgctgttagtatttctggcccatctattcgcctatcgaaagagcgcttgcatgagttacgaccattgatcatagctattggtaagaagatatcccagcgtttaggctatcaagacatttaa

SEQ ID NO: 1852 - protein, 251 aa, Bacillus halodurans
MVKSVDRALTIISLVSEHKQGLGVTDVAAKLSLTKSSAYKLLATLVEHGFIEQDEETKKYRLGYRYLELSATLLESIDIRRQARPFLEQLEATTNEVVHLVLYDQGEMVYIDKLEGTKTLRTHSKIGRRAPIHCTSVGKVIMAYLPEKVQISLIERYGLPPHTERTITDKETFMKELEKIRLEGYGYEMEENEPGITCIAAPIFDYQGAITAAVSISGPSIRLSKERLHELRPLIIAIGKKISQRLGYQDI

SEQ ID NO: 1853 - DNA, 792 bp, Yersinia pestis
  CDS (1)..(792)
atggctattgcagatctagataaacagcccgactctgtctcgtcggtgctgaaggtttttggcatattacaagcgttgggtgaagaacgggaaataggtattaccgagctttctcagcgagtcatgatgcctaagagtacagtttatcgttttctccaaaccatgaagtccttgggttatgtggcacaggaaggcgaatcggagaaatattccctcaccctgaagctatttgaattgggtgcgaaagcgctgcaaaatgtcgatttgattcgcagtgctgatattcagatgcgtgaattatctaatgaaactcgtgaaactattcacttgggtgcattggatgaagatagcattgtgtatattcataaaattgactcgatgtataacctacgaatgcattcccgcattggccgccgcaacccattacacagtactgccattgggaaggtgctattagcctggcgtgatcgtggtgaagtagaagaaattctgtctcatatcgaatttacccgcagcaccaaatatacgttggatagcactgctgcactgttaccggttttagataaggtacgtgagcaagggtttggtgaggatattgaagaacaggaagaaggtttgcgttgtatcgcagttcctgtctttgaccgttttggtgtggtgattgccggattaagtatttctttcccgacactacgtttcgctgaagacagaaagagtgattacgttaaatcgttacattgcgcagcccgcaatatttctgagcaaatgggttaccgcgattatcctttctga

SEQ ID NO: 1854 - protein, 263 aa, Yersinia pestis
MAIADLDKQPDSVSSVLKVFGILQALGEEREIGITELSQRVMMPKSTVYRFLQTMKSLGYVAQEGESEKYSLTLKLFELGAKALQNVDLIRSADIQMRELSNETRETIHLGALDEDSIVYIHKIDSMYNLRMHSRIGRRNPLHSTAIGKVLLAWRDRGEVEEILSHIEFTRSTKYTLDSTAALLPVLDKVREQGFGEDIEEQEEGLRCIAVPVFDRFGVVIAGLSISFPTLRFAEDRKSDYVKSLHCAARNISEQMGYRDYPF

SEQ ID NO: 1855 - DNA, 792 bp, Salmonella enterica subsp. enterica serovar Typhi
  CDS (1)..(792)
atggcaaacgcagatctggataagcagcctgattctgtatcttctgtgctgaaagttttcggcattctgcaggcgctgggtgaagagcgtgaaatagggattaccgagctatcgcagcgcgtcatgatgtcgaaaagcaccgtttatcgctttttgcaaaccatgaaaacgctgggctacgtggctcaggagggggagtctgaaaaatactctctgacgctaaagctgtttgagctgggcgcgcgagctttgcaaaatgttgatctcatccgcagtgcggacattcagatgcgcgaactgtctcgtctgacaaaagaaactatccatcttggcgcgctggatgaagacagcattgtctatatccataaaattgactctatgtacaatctgcggatgtactcacgtattgggcgtcgtaatccgctgtacagtacggccatcggtaaagtgcttctggcctggcgcgaccgtgatgaggttaagcagattctcgacggcgtagagtataagcaaagcacgggacgcacgattaccagcactgaagcgttgctgccgctgttggatgaagtgcgtgcgcaaggctacggtgaagataacgaagaacaggaagaagggttacgttgtatcggcgtaccggtatttgaccgttttggcgtagtcatcgcagggttaagcatttcgttcccgacgctgcgtttttcagaagaacgcctacaggaatatgtggctatgttacacgtcgccgcgcgtaaaatttctgaacaaatgggttacaacgattatcccttctaa

SEQ ID NO: 1856 - protein, 263 aa, Salmonella enterica subsp. enterica serovar Typhi
MANADLDKQPDSVSSVLKVFGILQALGEEREIGITELSQRVMMSKSTVYRFLQTMKTLGYVAQEGESEKYSLTLKLFELGARALQNVDLIRSADIQMRELSRLTKETIHLGALDEDSIVYIHKIDSMYNLRMYSRIGRRNPLYSTAIGKVLLAWRDRDEVKQILDGVEYKQSTGRTITSTEALLPLLDEVRAQGYGEDNEEQEEGLRCIGVPVFDRFGVVIAGLSISFPTLRFSEERLQEYVAMLHVAARKISEQMGYNDYPF

SEQ ID NO: 1857 - DNA, 741 bp, Bacillus subtilis
  CDS (1)..(741)
atgcagaataaaaataaaaccgtagtcaaatctatggcgctgcttaatttgtttttgcataaaccaagcctaaccttaagtgaactggtgtcgctgacgggaatgccgaagacctctgttcaccggatggtcagctccttggaggaaatggggttcctcagtcgggatgcgtccggcgcttattcgctgggattggtgtttttggaattcggacagcttgtcgctgacaggctggatatcagaaaaatagcgaaaccggtgatggaagagctgtgccgggaagtggatgaggccgtgcagttgatcatgagggacggcaatgaagcgatatacgttgagaaaatagaagggacacagactgtgcggctgtatacggcgatcggcaggcgttcccccctatacgcgggagcgtgcgccagaagcattctgtcctttcttccccgtgaagaaatcgaagcatacatcaaacaaaccgagctcatttcgattggctccggaacgattaccgatcccgaaaaactgcttcaggagattgatgcctctgtgcaaaatggctatactgtcagctattcagagctcgaaaactatacggcggcgatcggcgccccgatctttaaccatgagcgccaggtggcagccggcattagcattgcaggctttgaagcgagatttacagaagacaggctgccctatttaacagaaaaggtgaaggacgccgctttacagatttcaagaaaatag

SEQ ID NO: 1858 - protein, 246 aa, Bacillus subtilis
MQNKNKTVVKSMALLNLFLHKPSLTLSELVSLTGMPKTSVHRMVSSLEEMGFLSRDASGAYSLGLVFLEFGQLVADRLDIRKIAKPVMEELCREVDEAVQLIMRDGNEAIYVEKIEGTQTVRLYTAIGRRSPLYAGACARSILSFLPREEIEAYIKQTELISIGSGTITDPEKLLQEIDASVQNGYTVSYSELENYTAAIGAPIFNHERQVAAGISIAGFEARFTEDRLPYLTEKVKDAALQISRK

SEQ ID NO: 1859 - DNA, 897 bp, Agrobacterium tumefaciens
  CDS (1)..(897)
atggaattattctcttggcgtctcgatgatgtcaagaccgatgacggtggatggcgcatgcctgatgataaaaaagccaatggcggaaagcccgatgcggttccgccctcacaccagaaaaccgaaaacgccaccggcacgctcggcaaggtcgtctcgctgctggaactgatcgcccttgccgaaaagccgatgcgttttaccgatgtcgtcgaggcaagcggtcagcctcgcggcacggttcaccgccagctcgcgcatctggttgccgagggcctggtggatcatgccgccgatcagacctatgcggtggggctgaggctcctgcaactggcggcgaaggcctggagcggcaatgatctgcgcaacgtcgcagcacctcatctttcggccttgcaggaagcgacgcaggaatccgtgcatctcgccgttctgaacggcgggcaggtcacctatctcgacaagatggagggtcgccatacattgcgcatgcattcgcaggtcggcaaaacctcgccggcctattgcacgggggtgggcaaggcggcgctgtcgctgctgcccgtcgatgagctggcggaacttgccgcaggaatggagtttcaccgtttcacggaggcgacgctgataacgccggaagccctgatggccgatgtcgccgccatctgcgacaatggttacggtttcgatcttcaggaacatgaaatcggaattcattgcgtcgccgcaccggtccgggcgcggggccgcaattttgtggcggcgatctcggtcaccggtcccgcctaccgggtggatgcggaacagctgcgcaactgggcgccgctggtgcgcgaaacggccgataaaatctctgcggaactcgcctgcagattatccccggttgcggatgattga

SEQ ID NO: 1860 - protein, 298 aa, Agrobacterium tumefaciens
MELFSWRLDDVKTDDGGWRMPDDKKANGGKPDAVPPSHQKTENATGTLGKVVSLLELIALAEKPMRFTDVVEASGQPRGTVHRQLAHLVAEGLVDHAADQTYAVGLRLLQLAAKAWSGNDLRNVAAPHLSALQEATQESVHLAVLNGGQVTYLDKMEGRHTLRMHSQVGKTSPAYCTGVGKAALSLLPVDELAELAAGMEFHRFTEATLITPEALMADVAAICDNGYGFDLQEHEIGIHCVAAPVRARGRNFVAAISVTGPAYRVDAEQLRNWAPLVRETADKISAELACRLSPVADD

SEQ ID NO: 1861 - DNA, 741 bp, Thermotoga maritima
  CDS (1)..(741)
atgaataccctcaaaaaagccttcgaaatactggatttcatcgtaaagaatcctggcgatgtaagcgtttctgaaatagccgaaaagttcaatatgagcgtttcaaacgcatacaaatacatggttgttctcgaagagaaagggtttgttctcagaaaaaaagacaagagatacgtaccggggtacaaattgatagagtacggttcattcgttctgaggcgcttcaacattagggatatagctcacgaccatctcgtggatatcatgaaaagaacgggggaaacagtacacctgattttgaaagatggcttcgagggagtttacatagacaaggtggagggtgagcagagcattcctatggtctcaagacttggtatgaaagtcgacctttactccacagcctctggtaaatccattctcgccttcgttcccgaaaaagaattgaaggaatacctgaaaattgtggaactaaaaccaaaaaccccaaacaccatcacgaatcccagagtactgaagagagagcttgaaaaaattagaaagcgaggatacgccgtagacaacgaagaaaacgaaataggtatcatgtgtgtgggagttcctatatttgatcacaacggatatccggtggctggagtgagtatttccggggttgcacgaaagttcacagaggaaaaaatagaagaatactccgatgtactcaaagaaaaggcagaagaaatatccagaaaacttggatattga

SEQ ID NO: 1862 - protein, 246 aa, Thermotoga maritima
MNTLKKAFEILDFIVKNPGDVSVSEIAEKFNMSVSNAYKYMVVLEEKGFVLRKKDKRYVPGYKLIEYGSFVLRRFNIRDIAHDHLVDIMKRTGETVHLILKDGFEGVYIDKVEGEQSIPMVSRLGMKVDLYSTASGKSILAFVPEKELKEYLKIVELKPKTPNTITNPRVLKRELEKIRKRGYAVDNEENEIGIMCVGVPIFDHNGYPVAGVSISGVARKFTEEKIEEYSDVLKEKAEEISRKLGY

SEQ ID NO: 1863 - DNA, 822 bp, Sinorhizobium meliloti
  CDS (1)..(822)
atggaggcgaagggcaaggggaagagggggcgcaaggcgggagagaacgccgcgccggcttccgttcaggtgctggacaggagcctgtccctgctggcgatcatcgccgaaggcgacggctcgaccttgaccgcactttcggagcggtcaggcatggcgccttcgaccgtgcaccggctgctgacgtcgctcgcccagcacgagatggtggcgaacgacgcggaggccggcacgtggaccgtcggcgtcaaggcgttcgagatcggcaacgccttcctgcgctttcgcaagctcggcacgatcagccgtccgttcctgaagcggctcatggacgaaagcggcgagacggcgaatatcggcatagaggaagacggcgacgtggttttcatctcccaggtcgaaagccacgcgccgatgcgcgccttcttccgtcccgggcggcgggggccgatccacgcttccggcatcggcaaggccattctttcgacctggtccgatacggagatcgccaagaccctgagcggcagaacgctcgcgtgctttaccgggcggacgctcgccacgctgccggacctgatccgcaacgttcaggagatccgctttcgcggctggtcggtcgatgacgaagagcacacgctgggcatgcgctgcatcgccgccccgctcttcaacgagtacggtgaggcgatcggcggcatctccatctccggccccaccgtccgcatcgacgacgagagactcggcgtcctcggccccgccgtgcgccgcatggcggacgagttgacgcgcgcgatcggcgggcacaggccggaagaaggctga

SEQ ID NO: 1864 - protein, 273 aa, Sinorhizobium meliloti
MEAKGKGKRGRKAGENAAPASVQVLDRSLSLLAIIAEGDGSTLTALSERSGMAPSTVHRLLTSLAQHEMVANDAEAGTWTVGVKAFEIGNAFLRFRKLGTISRPFLKRLMDESGETANIGIEEDGDVVFISQVESHAPMRAFFRPGRRGPIHASGIGKAILSTWSDTEIAKTLSGRTLACFTGRTLATLPDLIRNVQEIRFRGWSVDDEEHTLGMRCIAAPLFNEYGEAIGGISISGPTVRIDDERLGVLGPAVRRMADELTRAIGGHRPEEG

SEQ ID NO: 1865 - DNA, 783 bp, Escherichia coli
  CDS (1)..(783)
atgttggaatcaagcaaagttcccgccctgacacgggctattgatattctcaatttgattgcccgcattggcccctgtagtgctgcgacgatcattgacacattgggaatccctaaaagcacggcctatttgctgcttaatgaactcaggcgtcagcgttttcttagccttgatcaccaggaaaatttttgtttgtggaccaggctggtggagctttccggtcatgcgttaagcaagatggatctccgggaactggctcgaccgcgtttgacgcaactgatggataccaccgggctgttatgtcacctggggattattgataacggcagcgcttattacattttgaaagtggagtcatcagccactatcagcgtgcgttcccatgaaggaaaaagcctttcgctttatcgctccggaataggtaaatgcctgcttgcctggcaacctgcagcggtacagcaaagtattatcgaagggctggtctgggagcaggcgacacccacaacgattactcatccacagcaacttcacgaagaactggcgcgtattcgccgtcagggctggagctatgacaacggcgaagattacgccgatgtccgttgtgtcgctgcgccggtgtttaacgccaataacgagcttaccgctgcgatctcggtggtcggtacccgcttacaaatcaatgaagaataccgtgattatctggcgggcaaggccattgcctgcgccagggatatttcacgtctgttgggatggaaaagtccctttgacttacaagcctcataa

SEQ ID NO: 1866 - protein, 260 aa, Escherichia coli
MLESSKVPALTRAIDILNLIARIGPCSAATIIDTLGIPKSTAYLLLNELRRQRFLSLDHQENFCLWTRLVELSGHALSKMDLRELARPRLTQLMDTTGLLCHLGIIDNGSAYYILKVESSATISVRSHEGKSLSLYRSGIGKCLLAWQPAAVQQSIIEGLVWEQATPTTITHPQQLHEELARIRRQGWSYDNGEDYADVRCVAAPVFNANNELTAAISVVGTRLQINEEYRDYLAGKAIACARDISRLLGWKSPFDLQAS

SEQ ID NO: 1867 - DNA, 816 bp, Escherichia coli
  CDS (1)..(816)
atgacggaagttagacggcgcggcaggccaggacaggcggagcctgtggcacagaagggcgcacaggcgttagagcggggaattgcgattctgcaatatttggaaaaaagtgggggaagttcgtcggttagcgatatttctctcaatctggatttgccgctctccacgacctttcgcttgctgaaggttttacaggcagcggattttgtctatcaggacagtcaattaggctggtggcatataggattaggtgtctttaacgtcggtgcggcgtacatccataaccgcgatgtcctctccgtcgccgggccgtttatgcgccgcctgatgttactttccggcgaaacggtcaatgtcgcgatccgtaacggcaatgaagcggtattaattggtcagttagagtgtaaatcgatggtcaggatgtgtgcgccactgggcagtcgtctgccactgcatgcttccggtgcgggcaaagcgctgctttatccgctggcggaagaggagttgatgagcatcattctgcaaaccggtttgcagcagtttacgccaactacgcttgtggatatgcccaccttgctgaaggacctggaacaagcgcgtgaactgggctataccgtagataaagaagagcatgttgtaggtctgaattgcatagcttcagcaatttacgatgatgtcggtagtgttgttgccgctatctccatctccgggccttcatcaagactgacagaagatcgttttgtcagtcagggtgagctggtcagagacaccgcccgcgatatcagcacggcgttgggactcaaagcacatccataa

SEQ ID NO: 1868 - protein, 271 aa, Escherichia coli
MTEVRRRGRPGQAEPVAQKGAQALERGIAILQYLEKSGGSSSVSDISLNLDLPLSTTFRLLKVLQAADFVYQDSQLGWWHIGLGVFNVGAAYIHNRDVLSVAGPFMRRLMLLSGETVNVAIRNGNEAVLIGQLECKSMVRMCAPLGSRLPLHASGAGKALLYPLAEEELMSIILQTGLQQFTPTTLVDMPTLLKDLEQARELGYTVDKEEHVVGLNCIASAIYDDVGSVVAAISISGPSSRLTEDRFVSQGELVRDTARDISTALGLKAHP

SEQ ID NO: 1869 - DNA, 759 bp, Escherichia coli
  CDS (1)..(759)
atgccgattattcagtctgttgaacgtgcgttgcagatcctcgacctgttcaacgagcaggccaccgagcttaagatcaccgacatcagcaaactgatggggctgagcaagagtaccctccactcgctgctaaaaaccctgcagcttcacggctatatcgatcagaacccggagaacggcaagtatcgcctcggcatgaagctggtcgagcgcggccattttgtcgtgggctccatcgatattcggcagaaggcaaaaggctggctgacggagctgtcccggcggaccgggcagaccacccatctggggatcctggacgggcgtgaaggggtctatatcgagaagattgaaggcaagctggccgccatcgcctattcacgcatcggccgccgcctgccggtgcacgccaccgccatcggcaaggtgttgattgcctggctgggcgaggccgagctgaacgccctgctggagggctatcagtacactacctttacgcccgccaccctcgcgtctcgcgaagccttaatgagcgccctggcgcagacccgcgagcaaggctacgccctggacagcgaagagaacgagcagggcgtgcgctgcgtggcggtgccggtgtggaaccacgagtcccgcgtcatcgccgccctgagcctgtcgacgctgacctcccgcgtggacgacgcggagctggctaatttccgcgagcagcttcagcaggccgggctcgcgctctcgcgcgcgctgggctacccggcctga

SEQ ID NO: 1870 - protein, 252 aa, Escherichia coli
MPIIQSVERALQILDLFNEQATELKITDISKLMGLSKSTLHSLLKTLQLHGYIDQNPENGKYRLGMKLVERGHFVVGSIDIRQKAKGWLTELSRRTGQTTHLGILDGREGVYIEKIEGKLAAIAYSRIGRRLPVHATAIGKVLIAWLGEAELNALLEGYQYTTFTPATLASREALMSALAQTREQGYALDSEENEQGVRCVAVPVWNHESRVIAALSLSTLTSRVDDAELANFREQLQQAGLALSRALGYPA

SEQ ID NO: 1871 - DNA, 804 bp, Deinococcus radiodurans
  CDS (1)..(804)
atgaccgaggcgcccaaactcaagtcgggccgcgcccgcagcggtgaggcgggcagtgtccgcacgctcgaacgtggcctgagtgtcctctcggcgcttgccgaactgcgcgaggccacgctgacgcaggtcgccaagaaggcggggctgtcggccagcacgacttaccgcctgctcgaaacactgcgccagcagggctacgtggagtgggaggagcgctcgggtctgttcagcgtgggcctgcgcgcttatcaggtcggcgcggccttcagtgaacgcaactcgctgctcagtgccgccggagccgtcatgcaggcgctggtggaagaagtgaacgaaaccgccaacctcgccgtgctgcgcggcaacgaggcggtgtacgtgcatcaggtcgaggccagtcagttgatgcgaatgtttacccacatcggcgccgctgccccgctgcactgctcgggcgtgggcaaggtgctgaccgcgtggctgccccccgccgaggtgcggcgcaaggtgggcgacggcccttttcccgcctacacgccccactcgattaccacgctcgccgctctgacgcgcgaactgaacaccgtgcgcggccaggactacgcgctcgacgacgaggaacgcgaactcggcgtgcgctgcctcgccaccccggtgcgcgccgcctcgggcgaggtggtggcgagcctgagcgtgtcggcgccgacctcgcgctttcccaaaaagaacattcccgacatgctggggcgcgtgcaggccgcgtccgagcagatttccgcccggctggggtggcgcggctga

SEQ ID NO: 1872 - protein, 267 aa, Deinococcus radiodurans
MTEAPKLKSGRARSGEAGSVRTLERGLSVLSALAELREATLTQVAKKAGLSASTTYRLLETLRQQGYVEWEERSGLFSVGLRAYQVGAAFSERNSLLSAAGAVMQALVEEVNETANLAVLRGNEAVYVHQVEASQLMRMFTHIGAAAPLHCSGVGKVLTAWLPPAEVRRKVGDGPFPAYTPHSITTLAALTRELNTVRGQDYALDDEERELGVRCLATPVRAASGEVVASLSVSAPTSRFPKKNIPDMLGRVQAASEQISARLGWRG

SEQ ID NO: 1873 - DNA, 765 bp, Streptomyces coelicolor
  CDS (1)..(765)
atggcacggaacatccagtcgctcgagcgggcggccgccatgctgcgcctgctcgcgggcggcgagcggcggctcggcctgtcggacatcgcctcgtcgctgggtctggccaaaggcaccgcgcacggcatcctgcgcaccctccagcaggaggggttcgtggagcaggacgacgcctccgggcgctaccagctgggcgccgagctgctgcgcctgggcacgacctacctggacgtgcacgaactgcgggcccgcgccctggtgtggaccgacgacctggcccgctccagcggtgagagcgtccacctcggcgtcctgcaccagcagggcgtcctgatcgtgcaccacgtcttccgccccgacgacagccggcaggtcctggagatcggggccatgcagccgctgcactccacggcgctgggcaaggtgctgtcggcgtacgacccggtcgcgcacagcgaggcactggaggccgaccgcaaggcgttcaccgaccggaccgtctgcgaaccggacagcttcgagcacgtcctggacatcacgcgcgcgcgggggtacgccgccgacgtcgaggagacctgggagggcatcgcctccatcgccgcccccatccacgaccgcaggcggatgccggtcggcgcggtcggcatcaccggggccgtggaacggctgtgccgggagggcgagctgcggcccgagctggtcgcggcggtgcgggactgcgcccgcgcggtgtcgcgggacctgggcgccgggcggttctag

SEQ ID NO: 1874 - protein, 254 aa, Streptomyces coelicolor
MARNIQSLERAAAMLRLLAGGERRLGLSDIASSLGLAKGTAHGILRTLQQEGFVEQDDASGRYQLGAELLRLGTTYLDVHELRARALVWTDDLARSSGESVHLGVLHQQGVLIVHHVFRPDDSRQVLEIGAMQPLHSTALGKVLSAYDPVAHSEALEADRKAFTDRTVCEPDSFEHVLDITRARGYAADVEETWEGIASIAAPIHDRRRMPVGAVGITGAVERLCREGELRPELVAAVRDCARAVSRDLGAGRF

SEQ ID NO: 1875 - DNA, 849 bp, Escherichia coli
  CDS (1)..(849)
atggggaaagaagtgatgggaaaaaaagagaacgagatggcgcaggaaaaagagcgtccagccggaagccagagtctgtttcgcgggttgatgctgattgagattttgagcaactatccaaacggttgtccgttggcgcatctttcggagctggctggtttaaataagagtaccgtccatcgcttattgcagggattacagtcctgcggctatgtgaccaccgcgcctgccgcagggagttatcgcctgaccaccaaatttattgccgtcgggcagaaggcgctgtcttcgctgaatatcattcatatcgccgctccgcatcttgaggcactgaacatcgccactggtgaaaccattaacttctccagccgcgaagacgatcacgctattttgatttataagctggaacccacaaccgggatgctgcgaacccgtgcctatattggccagcatatgccgctctactgttccgcaatgggcaagatctacatggcgtttggtcacccggactacgtgaagtcatactgggaaagccatcagcatgagatccagccgttaacccgcaataccattaccgagctgcccgcgatgttcgacgaactggcgcacattcgtgaaagcggagcggcgatggacagagaagaaaacgaactcggcgtctcctgtattgctgttccggtgtttgatattcatgggcgggtgccgtacgccgtgtcgatttcgctttcgacatcacgtctgaaacaggtgggagagaaaaatctcctgaaaccactgcgtgaaaccgcgcaggctatttctaatgaactgggatttactgtcagggatgacctgggcgcgatcacataa

SEQ ID NO: 1876 - protein, 282 aa, Escherichia coli
MGKEVMGKKENEMAQEKERPAGSQSLFRGLMLIEILSNYPNGCPLAHLSELAGLNKSTVHRLLQGLQSCGYVTTAPAAGSYRLTTKFIAVGQKALSSLNIIHIAAPHLEALNIATGETINFSSREDDHAILIYKLEPTTGMLRTRAYIGQHMPLYCSAMGKIYMAFGHPDYVKSYWESHQHEIQPLTRNTITELPAMFDELAHIRESGAAMDREENELGVSCIAVPVFDIHGRVPYAVSISLSTSRLKQVGEKNLLKPLRETAQAISNELGFTVRDDLGAIT

SEQ ID NO: 1877 - DNA, 792 bp, Escherichia coli
  CDS (1)..(789)
atggttcgcaaagggtgtaattcattagtccgtgctgaaaaaatattaacccacattgcatgggttggtatggcaagttatatggagttattaaataaattccagtaccccaaaagcagcctgcttaatttattgaatgtaatggtggattgtggtttcttaattaaaaacaaaaacggctactattcactgggaataaaaaactacgaattgggttgtcaggcgttacaccgtcaaaatatatttgaggtgactaagcggccaatgcaggagttgtcgctgaaaagtggactggtttgtcatcttggggcgatggagagcatttcggctatctatctcgacaagatcgaaagtccggactctgtaccgacgagcaaaagctggattggcaaaaaacttgagttgcatattaccgcgttgggtaaggcattattagcctggaagacacgagaagaactggattattttttagaagcactcacgttaactccacatacgcgcaatacatttaccgataaaaaattgtttctggaagaattacaaaaaacacgccttcggggatgggccatagacaacgaagaatcaacctatggggcggtatgtttaagtatgccggtattcaatatgtataacagagttaactatgcaatctcactttctggcgatccggtagtttattcaggaaataagatagacagctatctggaattgctccggaaatgcgctgagcaaatatcatatgggctgggatacagaaacgaaaatgagcacttacgaaaaggaaactgaggt

SEQ ID NO: 1878 - protein, 262 aa, Escherichia coli
MVRKGCNSLVRAEKILTHIAWVGMASYMELLNKFQYPKSSLLNLLNVMVDCGFLIKNKNGYYSLGIKNYELGCQALHRQNIFEVTKRPMQELSLKSGLVCHLGAMESISAIYLDKIESPDSVPTSKSWIGKKLELHITALGKALLAWKTREELDYFLEALTLTPHTRNTFTDKKLFLEELQKTRLRGWAIDNEESTYGAVCLSMPVFNMYNRVNYAISLSGDPVVYSGNKIDSYLELLRKCAEQISYGLGYRNENEHLRKGN

SEQ ID NO: 1879 - DNA, 771 bp, Rhodococcus opacus (Nocardia opaca)
  CDS (1)..(771)
atgaccgagagcgatcgcgattacatccagagcatcgagcgcgggttcgcagtgctcctcgcgttcgacgcgcagcgtccgaacccgacgctcgccgaactcgccacagaagcgggactgtcgcgccccgcagtccgccggatcctgctcaccctgcagaagctggggtacgtcgccggctcgggtggccgatggtcgctcaccccccgcgtgctgagcatcggacagcactactcggagtcgcacgcactgatcgaggccgcgatgccccgactgctggaggtggccgagaagacccaggagtccgcgtcgctcggcgtgctcgacggcgccgacgtggtctacgcggcgcgcgttcccgtccggcggatcatgagcatcaacgtctctgtcggcacccgcgtccccgcgtacgccacgtccatgggtcgcgcgctcctggcctgggcccccgccgacgtggtcgagcaggtggtcgccgagtccacgttcgagaaactcgggcccgaaaccatcagcactgcagccgaactcgacaaggaactcgccaaggtccgcgagcaggggttcgccctgacgtccgaggagctggagaaggggctgatctcgctgcccgcccccgtccgcgacgccggcggcacagtggtcggcgtggtcgcctgctccacgtcgtccgcgcggaatactccggcacagttccgggaacaggccgttccgtgcgtcctcgccgccgcggccgccctgagcacggacatgggcttcgccggctga

SEQ ID NO: 1880 - protein, 256 aa, Rhodococcus opacus (Nocardia opaca)
MTESDRDYIQSIERGFAVLLAFDAQRPNPTLAELATEAGLSRPAVRRILLTLQKLGYVAGSGGRWSLTPRVLSIGQHYSESHALIEAAMPRLLEVAEKTQESASLGVLDGADVVYAARVPVRRIMSINVSVGTRVPAYATSMGRALLAWAPADVVEQVVAESTFEKLGPETISTAAELDKELAKVREQGFALTSEELEKGLISLPAPVRDAGGTVVGVVACSTSSARNTPAQFREQAVPCVLAAAAALSTDMGFAG

SEQ ID NO: 1881 - DNA, 819 bp, Erwinia chrysanthemi
  CDS (1)..(819)
atgataaatgaacatagcattgatgacgaggtgaaagcggaaaaaccgttgggaagtcaaagcctgtttcgtggtttacagttgatcgaaatactcagcgactatcctaatgggtgcccgctggcgcgtattgccgagttgtccgggatgaataaaagtaccgtccaccggttgttgcaggggcttgccggatgcggttacgtcgtgcccgcccgccagcccggcagctatcgcctgactaccaagtttatcgctatcggccagaaggcgctttcgtcgttaaatgtgttgcatgtagcggtgccgcaccttgaagcgctgaacctgacggtaggagaaaccgtcaatttttcaacgcgtgaagacgatcacgccattttgatttataagctggagccgaccaccggcatgatgcgcacccgcgcctatatcggccaacacatgcctttgcacagttcggcgatgggcaagattttcatggcttatggtacggaggattatccggctgaatactggcgtacccatcagaacagtatttgtcccctgactgacaataccattgttgagttgtcggccatgcgacaggaactggcggagatccgtcggcaggggctggcgatggacagggaagagaatgaactgggcgtttcctgcatttccgcgccggtgtttgatattcagcatcgtgtgccttatgccgtttccatttccttgtcgaaggcgcggttgcagcagattggtattgatacgttggttgcgccattacgggagacggcccgaaacatctccctcgagttggggtttacgccgccgacatag

SEQ ID NO: 1882 - protein, 272 aa, Erwinia chrysanthemi
MINEHSIDDEVKAEKPLGSQSLFRGLQLIEILSDYPNGCPLARIAELSGMNKSTVHRLLQGLAGCGYVVPARQPGSYRLTTKFIAIGQKALSSLNVLHVAVPHLEALNLTVGETVNFSTREDDHAILIYKLEPTTGMMRTRAYIGQHMPLHSSAMGKIFMAYGTEDYPAEYWRTHQNSICPLTDNTIVELSAMRQELAEIRRQGLAMDREENELGVSCISAPVFDIQHRVPYAVSISLSKARLQQIGIDTLVAPLRETARNISLELGFTPPT

SEQ ID NO: 1883 - DNA, 795 bp, Bordetella pertussis
  CDS (1)..(795)
atgcgctgcaaaggcatacgacatatggacaaaaccctgctcaagggcctcacggtcctcgaagccatcagccggctcgacggcgccacgcccacgctggaccagatcgccgaggaaatcggcctcacccgcagcaatacgcatcgcaccctgcagacgctggcccacgccggctatgtccggcgcgaccccgccacgggctcgtaccagtgcacgctgaagctgttcgagctgggcgcgcgccagctggccagcctggacgcccgcaaactggccccgccgttcatggacgaactggccaggctgaccaacgaaaccgtgcacctgtccgtgctcgacgggctggacgtggtctatgtcgacaagctggacagcccgcagcccctgctggcctattcgaccgtgggcggccgggcgccggcctacgcggtggccaccggcaaggccctgctggcttgccagacggccgactacctcgaccactatggcgccgccatcaagcggcacaccgaagacacgcacgtgtcgttgctcgccctcaagcaggagctggccgacgtcaaccgcatcggctacgccatcaaccgcggcgagtggcgccagggcatcggcggcattgccgcgccgattttcaacgggctggacaaggccgtggcggcgctgggcatctccggcccgctcgaacggctgacaaaccagaaaatgcgtgaatacgcgccgctggtgcaacaggcggcgcggcagttgtcggcgcacatgggttatcgcggcggctatttcggcggcgccgcctga

SEQ ID NO: 1884 - protein, 264 aa, Bordetella pertussis
MRCKGIRHMDKTLLKGLTVLEAISRLDGATPTLDQIAEEIGLTRSNTHRTLQTLAHAGYVRRDPATGSYQCTLKLFELGARQLASLDARKLAPPFMDELARLTNETVHLSVLDGLDVVYVDKLDSPQPLLAYSTVGGRAPAYAVATGKALLACQTADYLDHYGAAIKRHTEDTHVSLLALKQELADVNRIGYAINRGEWRQGIGGIAAPIFNGLDKAVAALGISGPLERLTNQKMREYAPLVQQAARQLSAHMGYRGGYFGGAA

SEQ ID NO: 1885 - DNA, 741 bp, Bordetella pertussis
  CDS (1)..(741)
atggatacgacaacgctgaaaggcctgactgtcctcgaggcgctggtgcgctcgggcgaaagccggtccgccggcgaactcgcccaggagttgggcctggtgcgcagcaacgtgcatcgcaccctgcagaccctggcgcatgcaggctacgtggaggccatcgccgactcggccaagtaccgccccaccttgcggctctgggagctgggcaacgtcgtcgtgcagcgcttcgacatccgcaagcaggcctatcccaccatgcaggcgctcgccgcgcataccggcgaaaccatcctgctggcggtgcgccagcggctcgaagtctgcttcctggacaagatccagaccgaaaaacccgtcgggacgttcgtgctgctgggcgcgcgggcgccggtgcattgcaccgcgccgggcaaggccatcctgtcgcgctgctcgcacggcgagctgcaagccctgcccgagaccttcgaacgctacaccgccaagaccatcaccacgcgcgaggcgctcatcgccgaactggccatcgcccgcgagcggggctacgccatcaatacctccgaatggcgcgagggcgtgaattcgctgggcgtgccgatcaccgcaccgggcggcgaagcgctcggcgcgatctcggtcaccggccccgatacccgggtgacgctgaaaaagctggacggctacgcgccggtcctggtcgaggccgcccgcgagctgtcgcgccgtattggcggctga

SEQ ID NO: 1886 - protein, 246 aa, Bordetella pertussis
MDTTTLKGLTVLEALVRSGESRSAGELAQELGLVRSNVHRTLQTLAHAGYVEAIADSAKYRPTLRLWELGNVVVQRFDIRKQAYPTMQALAAHTGETILLAVRQRLEVCFLDKIQTEKPVGTFVLLGARAPVHCTAPGKAILSRCSHGELQALPETFERYTAKTITTREALIAELAIARERGYAINTSEWREGVNSLGVPITAPGGEALGAISVTGPDTRVTLKKLDGYAPVLVEAARELSRRIGG

SEQ ID NO: 1887 - DNA, 744 bp, Bordetella bronchiseptica (Alcaligenes bronchisepticus)
  CDS (1)..(744)
atgggaaagacactggtcaagggtttgcatttgctcgagcggctggccgccagccccgagcccatgggtattacggaactggccgccgatctcgatctggtgcagagcaacgtgcatcgcctgctgcagacgctgatggaaagcggctatgtgcagcaggacgcgctgacgcgccgctaccgctgcaccatgcgcttatgggagatgggcacgcagatcgccgaccgcatggacctgtcgcgcatcgcccgcccgcacatgcaggcgctggtcaagcagagccaggaaaccgtgcatctggccatcctggacggcgccgacgtgctgtacatcgacaagatcgacagcccccagccggtacgctcgtatacccgcgtgggcgggcgtgcgccggcttattgcaccggcaccggcaagatgctgctggcctattgcgatgacctggcggccgcgctgccggccaagctggtcaagcataccgcccgcagcatcgccagccacgcggccctgaaggccgagctgcggcgcgtgcgcgaggagggattctccgagaacgcaggcgaatggcgcgaggacgtctacggcatgggcgcgccgctgttcgacgccaccggcaaggtgtcggcggccatcggcatttccggcccgctggcgcgcatggacgccgccgtggtggcgcgcgtgcggcccatgctgcaggagaccgcccgcatcatctcgcgcgagctgggctaccgggggtag

SEQ ID NO: 1888 - protein, 247 aa, Bordetella bronchiseptica (Alcaligenes bronchisepticus)
MGKTLVKGLHLLERLAASPEPMGITELAADLDLVQSNVHRLLQTLMESGYVQQDALTRRYRCTMRLWEMGTQIADRMDLSRIARPHMQALVKQSQETVHLAILDGADVLYIDKIDSPQPVRSYTRVGGRAPAYCTGTGKMLLAYCDDLAAALPAKLVKHTARSIASHAALKAELRRVREEGFSENAGEWREDVYGMGAPLFDATGKVSAAIGISGPLARMDAAVVARVRPMLQETARIISRELGYRG

SEQ ID NO: 1889 - DNA, 753 bp, Bacillus cereus (strain ATCC 14579 / DSM 31)
  CDS (1)..(753)
atgagtataaataaaacggcagttaagacaatggatattttagagttgttttatgagcatgaagagctaagtttaactgagatggttcagcttacaaatatgccgaagacatctgtttatcgtttaattggttcgttggaagagatggagtttttacaaaaaaacgaaaaggggaaatatcgtttaggggtcgtatttttacggttcggtcaacttgtttcacaccgattatcagtaagaaatatagcaattccttatatgaaagaacttagagatagtttaggacaggcagttaatttaataattcaggatggaaatgacgcaatttatgttgaaaaaatggaaggtgttcagccggtacgcgtgtatacggcggttggaagaagagcaccgctttatgctggcgcatgtccaagaattttactatcgtatttctctgaggaagagaaacggagatacatagaggaagtggatttaaaacagtttgcagatggaacaatcgtggataagaaacaattgttagaagtgttgcaaatggcaaaaaaggaaggctacaccattagttattctgagttagaaaatcatacagccgcgatagcagcacccattttcgcgagcgatggaacggttgtagcaggcattagtatttcgggattagcaattgagtacaacgaaagtaacatttcatattttattgcgaaggtgaaagaaacagcgcatcgcatttcgaaagaactcggctttttggcatag

SEQ ID NO: 1890 - protein, 250 aa, Bacillus cereus (strain ATCC 14579 / DSM 31)
MSINKTAVKTMDILELFYEHEELSLTEMVQLTNMPKTSVYRLIGSLEEMEFLQKNEKGKYRLGVVFLRFGQLVSHRLSVRNIAIPYMKELRDSLGQAVNLIIQDGNDAIYVEKMEGVQPVRVYTAVGRRAPLYAGACPRILLSYFSEEEKRRYIEEVDLKQFADGTIVDKKQLLEVLQMAKKEGYTISYSELENHTAAIAAPIFASDGTVVAGISISGLAIEYNESNISYFIAKVKETAHRISKELGFLA

SEQ ID NO: 1891 - DNA, 798 bp, Vibrio parahaemolyticus
  CDS (1)..(798)
atgaaaggggcaacaatggaaaagtcgactcagcctgaagcggtttcgtcagtacttaaggtttttcatattcttcaagcacttggtgaacagaaagccatcggcgtttcagagctttcacaacgtctaatgatgtcgaaagcgactacttaccgttttctgcaaaccatgaaatcgctcggttacgtgtctcaagaaggcgaagcggataagtactctctaacacttaagctgttcgagttgggcgcaaaatcgcttgagtacgtcgatctgatcgaactggccgacaaagaaatgcgccacatttcagaacaaaccaacgaagccttgcaccttggtgcgctggatgaaaatgccatcatttacatccacaaaatcgactctggctacaacctacgcatgcaatcgcgcatcggtcgtcgcaatccgctctacagtactgcgattggtaaagtgctactttctgagcgcgatgaaagcttcgttcgtgacgtattgagcgatgtcgagttcattaagcacacagaaaaaacattggaaaatactgatcaagtgctagaagaattggcgaaagtgcgcgatttccactatgcagaagataacgaagagcaagaaccaggtcttcgttgtatcgctgcgccaatttatgaccgctttggtcaaatcattgctggcttgtctatctcattcccaaccatccgtttcgatgaagagagaatggaatattacgtcggcttactgcatcaagcaggtaaaaacatttctgagcaattgggttaccacgattacccggcataa

SEQ ID NO: 1892 - protein, 265 aa, Vibrio parahaemolyticus
MKGATMEKSTQPEAVSSVLKVFHILQALGEQKAIGVSELSQRLMMSKATTYRFLQTMKSLGYVSQEGEADKYSLTLKLFELGAKSLEYVDLIELADKEMRHISEQTNEALHLGALDENAIIYIHKIDSGYNLRMQSRIGRRNPLYSTAIGKVLLSERDESFVRDVLSDVEFIKHTEKTLENTDQVLEELAKVRDFHYAEDNEEQEPGLRCIAAPIYDRFGQIIAGLSISFPTIRFDEERMEYYVGLLHQAGKNISEQLGYHDYPA

SEQ ID NO: 1893 - DNA, 876 bp, Pseudomonas putida (strain KT2440)
  CDS (1)..(876)
atgagtgacgaaaccctgggcaacgattccggcaatgctgaggtggcgcgacctgcttcggctgccatggcgccgccgatcgtggcttccccggccaagcgcatccaggcctttaccggtgacccggacttcatgacctcactggcacgtggcctggccgtgatccaggcattccaggagcgcaagcgccacctgaccatcgcccagatcagtcaccgtaccgaaatccctcgcgcggcggtgcgccgttgcctgcacacgttgatcaaactgggttacgccaccaccgacgggcgtacctattcgctgctgcccaaagtgctgaccttggggcatgcctacctgtcgtcgacgccgctggcaatttctgcacagccgtacctggatcgcatcagcgaccagctgcatgaggcggccaacatggccaccctcgagggcgacgacatcctttatatagcccgttcggccacggtcgagcggctgatctcggtcgatctgtcggtgggcgggcgcctgccggcctattgcacgtcgatggggcgcattctgctggcggccatggatgacaccagcctgcgtgagtacctggaacgtgccgacctcaaagcgcgcaccagccgcaccctgaatgaccccgaatcgttgttcgcctgcatccagcaggtgcgcgcacagggctggtgtgtggtagaccaggaactggaacaggggctgcgatcgattgccgtgccggtgtatgacgcttcggggcaggtgttggctgcgctgaacgtcagtacccatgtcgggcgggtgacccgcagtgaactggagcagcggttcttgccgattttgctggcagccagccgggacctttgccaccagttgtttggttga

SEQ ID NO: 1894 - protein, 291 aa, Pseudomonas putida (strain KT2440)
MSDETLGNDSGNAEVARPASAAMAPPIVASPAKRIQAFTGDPDFMTSLARGLAVIQAFQERKRHLTIAQISHRTEIPRAAVRRCLHTLIKLGYATTDGRTYSLLPKVLTLGHAYLSSTPLAISAQPYLDRISDQLHEAANMATLEGDDILYIARSATVERLISVDLSVGGRLPAYCTSMGRILLAAMDDTSLREYLERADLKARTSRTLNDPESLFACIQQVRAQGWCVVDQELEQGLRSIAVPVYDASGQVLAALNVSTHVGRVTRSELEQRFLPILLAASRDLCHQLFG

SEQ ID NO: 1895 - DNA, 834 bp, Bradyrhizobium japonicum
  CDS (1)..(834)
atggccaaggtccacaagaaggccgcgaagcgcaaacctgaagctagcccaaagaatcccaagaattatgtcgcttccgttgggaaggccttcgctgtgctcaggagtttcaccagcgaggccttcgaactcaccttgagtgaagtcgccgcacgcgccgatctcgatcgcgggaccgcgttccggctgatccagaccctgatcgagctcggctatctccagccggttccgcaaagccgccggttccgcctcgggctcgcctgtctcgacctcggctacacggtgctgtcgcacggatcgctgcgagccatcgtcgagccgctgctgcgcgacctcgtgcctgacgtgggcgatgcggcctcgctcggcatcctcgacggcggcgacgtgatctatctcgcgcgcgtcggcgccggcctcgaccgtcacaagatggatcgccggccgggttcgcgcattcccgcctacagcgccgcgctcggccatgtcatgctggcgcatctgccgcgggacgagcagatcgagcgactggaagcgcgccctcgcgtcaagctgtcggaacgaacgctgaccgatctcgacgccctgctcgcccggctcgacctggtgaggaagaaaggccacgccgtctccgacggcgagaacgcctatggcttgcggacgctggccacgccgatcttcgacgcccagggtgtcgtgatcgggggattgagcgtcaccatcgacgcgatgcgcatggacatgccggcctttcgcgaccaggcgctgccgcgactgacgcagttgacgcgccaggtgcaggatatcgcgatcaagtcgggattgtcgggctga

SEQ ID NO: 1896 - protein, 277 aa, Bradyrhizobium japonicum
MAKVHKKAAKRKPEASPKNPKNYVASVGKAFAVLRSFTSEAFELTLSEVAARADLDRGTAFRLIQTLIELGYLQPVPQSRRFRLGLACLDLGYTVLSHGSLRAIVEPLLRDLVPDVGDAASLGILDGGDVIYLARVGAGLDRHKMDRRPGSRIPAYSAALGHVMLAHLPRDEQIERLEARPRVKLSERTLTDLDALLARLDLVRKKGHAVSDGENAYGLRTLATPIFDAQGVVIGGLSVTIDAMRMDMPAFRDQALPRLTQLTRQVQDIAIKSGLSG

SEQ ID NO: 1897 - DNA, 783 bp, Vibrio vulnificus
  CDS (1)..(783)
atggaaaagtcgacacagccagaagctgtttcgtcagtgatgaaggtgttccacatccttcaagcactgggtgagcagaaagctattggcgtatcagaattgtcgcaacgtcttatgatgtctaaggcaaccacttaccgctttttacaaaccatgaagtcacttgggtatgtttctcaagaaggcgaagcggataagtattcactcactttaaaagtgtttgagctaggtgctcgctcactggaatacgttgatctgatcgaattggccgacaaagaaatgcgccaaatctctcaactgaccaatgaagcgcttcacttgggtgcactcgatgaaaacgcgatcatctacatccataagattgattccggttacaacctgcgcatgcaatcgcgcattggccgtcgtaaccctctttacagtactgctattggcaaagtgttgctttccgaacgtgaagagagctttatccgtgaatctcttgccgatgttgaattcatcaaacatacagaaaaaacactagaaaacacggaacaagtgcttgaagaactggcgaaagtgcgtgaacagcattttgcagaagataacgaagagcaagaaccgggtttacgttgtatcgcggctccgatttatgatcgttttggtcaaatcattgcggcggtatctatctcgttcccaaccattcgttttgatgaagagcgcaaagattactatgtgggtctgcttcatcaagcgggtaagaacgtttctgagcagcttggctaccacagctaccctgcttaa

SEQ ID NO: 1898 - protein, 260 aa, Vibrio vulnificus
MEKSTQPEAVSSVMKVFHILQALGEQKAIGVSELSQRLMMSKATTYRFLQTMKSLGYVSQEGEADKYSLTLKVFELGARSLEYVDLIELADKEMRQISQLTNEALHLGALDENAIIYIHKIDSGYNLRMQSRIGRRNPLYSTAIGKVLLSEREESFIRESLADVEFIKHTEKTLENTEQVLEELAKVREQHFAEDNEEQEPGLRCIAAPIYDRFGQIIAAVSISFPTIRFDEERKDYYVGLLHQAGKNVSEQLGYHSYPA

SEQ ID NO: 1899 - DNA, 774 bp, Oceanobacillus iheyensis
  CDS (1)..(774)
atgtcaaacgttcaatctattgaacgtgcttttacaattttaaaggtactttcaaataatcccgatggtttgagaataactgttttggctgaaaattctagcttaaccaaaagtacaacgcatcgaattacttcaacactcgtaaatttaggttatgtccaacaagaccctgaaactgaaaaatatatgcttgggaatcaattaataaaattaacaagtgtaatgttaaacaacatggatgtaattaaagttgcagaaccctaccttgttaatttatccagagatgttaatgaaacagttcatttatgtgtagaaagtaatggagaggtactttatgtagataaaaaagaaaagaatcaaaacatcagaatgtattctacaatcggtagtcgtgccccgctctattgtactgctgttggtaaagttctactttccggtatgaatccagtttattttgaggaagttattaataacatgacatttgaattaagaacagcgctaaccatcacctcacaagtgaagcttagaaaagaaatagagaaggtaaaattacaaggatatgcattagacaatgtggagaatgaagaaggaattcgctgcatcgcctcccctatctacgattacaaggggaatataatcgcaagttttagtatttcgggtccaactaatagggtatctattgatagagttaatcttgaattagtagataaagtaaatatgacttccaagttaatttctgagcaatttggatacataaaaaaagaaagtatttaa

SEQ ID NO: 1900 - protein, 257 aa, Oceanobacillus iheyensis
MSNVQSIERAFTILKVLSNNPDGLRITVLAENSSLTKSTTHRITSTLVNLGYVQQDPETEKYMLGNQLIKLTSVMLNNMDVIKVAEPYLVNLSRDVNETVHLCVESNGEVLYVDKKEKNQNIRMYSTIGSRAPLYCTAVGKVLLSGMNPVYFEEVINNMTFELRTALTITSQVKLRKEIEKVKLQGYALDNVENEEGIRCIASPIYDYKGNIIASFSISGPTNRVSIDRVNLELVDKVNMTSKLISEQFGYIKKESI

SEQ ID NO: 1901 - DNA, 747 bp, Oceanobacillus iheyensis
  CDS (1)..(747)
atgtctgttaaatctgctaagcgtgctttggacattcttgacttattagcaaaacatactaacggtctaaccattaaaaacatcggcgacaagttagaattaccacaaagcagtacgtttaatcttttaaaaacattacatagtgaaggatacgtacgacaggatagcatgaaactatattacttaggtgaaaagttaatacctctaggaacaagtgctttagaatcactagatattcacacggttgcaaaaccttatttagccgatctaatgaaagcggttaaggaaactgtatttatggcgatgttatctaaagatgagttagtgtatattgcaaaaatggatgctgaccggtcgatacgaacaacggcacaacccggatataaaaagccaatatattgtaccggacttggcaaaacattcttagcttttatgcctgaaacagagaaaaacagcttattaaatcacataacattagagaaaatcactgcaaatacaattaccgatagatctcaattagaagaacaactgcaattatttcagaaacaaggatacagtattgatgatgaagaaaatgaagaaggtctctactgtttagctgctcccatctttgatagtcaaagacagcttttagcagccgtaagtgtggcaggtccaaaagatagaatgctaaaacaaaaagaaacagttattacaaacttaagagatacagccaaacttatttcaaatggtatgggatatgtttaa

SEQ ID NO: 1902 - protein, 248 aa, Oceanobacillus iheyensis
MSVKSAKRALDILDLLAKHTNGLTIKNIGDKLELPQSSTFNLLKTLHSEGYVRQDSMKLYYLGEKLIPLGTSALESLDIHTVAKPYLADLMKAVKETVFMAMLSKDELVYIAKMDADRSIRTTAQPGYKKPIYCTGLGKTFLAFMPETEKNSLLNHITLEKITANTITDRSQLEEQLQLFQKQGYSIDDEENEEGLYCLAAPIFDSQRQLLAAVSVAGPKDRMLKQKETVITNLRDTAKLISNGMGYV

SEQ ID NO: 1903 - DNA, 783 bp, Escherichia coli O6
  CDS (1)..(783)
atgttggaatcaagcaaagttcccgccctgacacgggctattgatattctcaatttgattgcccggattggcccctgtagtgctgcgacgatcattgacacattggggatccctaaaagcacagcctatttgctgcttaatgaactcaggcgtcagcgttttcttagccttgatcaccaggaaaatttttgtttgtggaccaggctggtggagctttccggtcatgcgttaagcaagatggatctccgggaactggctcgaccgcgtttgacgcaactgatggataccaccgggctgttatgtcacctggggattattgataacggcagcgcttattacattttgaaagtggagtcatcagccactatcagcgtgcgttcccatgaaggaaaaagcctttcgctttatcgctccggaataggtaaatgcctgcttgcctggcaacctgaagctgtacagaaaagtattatcgaagagctggtctgggagcagatgacacccaccaccattacccatccacaacggctctacgaggaactggcgcgtattcgccgtcagggctggagctatgacaacggcgaagattatgccgatgtccgttgtgtcgctgcgccggtgtttaacgccaataacgagcttaccgctgcgatttcggtggtcggtacccgcttacaaatcaatgaagaataccgtgattatctggcgggcaaggctattgcctgcgccagggatatttcacgtttgttgggatggaaaagtccctttgacttacaggcctcataa

SEQ ID NO: 1904 - protein, 260 aa, Escherichia coli O6
MLESSKVPALTRAIDILNLIARIGPCSAATIIDTLGIPKSTAYLLLNELRRQRFLSLDHQENFCLWTRLVELSGHALSKMDLRELARPRLTQLMDTTGLLCHLGIIDNGSAYYILKVESSATISVRSHEGKSLSLYRSGIGKCLLAWQPEAVQKSIIEELVWEQMTPTTITHPQRLYEELARIRRQGWSYDNGEDYADVRCVAAPVFNANNELTAAISVVGTRLQINEEYRDYLAGKAIACARDISRLLGWKSPFDLQAS

SEQ ID NO: 1905 - DNA, 792 bp, Pectobacterium atrosepticum
  CDS (1)..(792)
atggctagtgcagatttagataaacaacccgattccgtgtcgtccgttttaaaggtttttggtattttacaggcattaggtgaagagagagaaattggtattaccgagctttctcagcgcgtcatgatgtctaagagtaccgtttaccgcttcttgcagacgatgaaatccttgggctatgttgcgcaggaaggtgaatcagagaaatattcgctgacgctcaagttgtttgaacttggggcaaaggcattgcagaacgtagatttaatccgcagtgcggatatacagatgcgtgagttgtctgcactaacgcgggaaacaatccaccttggcgcgttggatgaagacggcatcgtttatatccacaaaattgactcgatgtataacctgcgtatgtattcgcgcattggtcgccgtaatccgctgcacagtaccgcaattgggaaagtgctgttggcatggcgcgatcgcggcgaagtggaagaggttctgtcgactgtcgaattcacgcgcagtacgccgcatacgctgtgttctgctgaaacgcttctcaaccaattggatgtcgtgcgtgagcaaggctacggggaagacaacgaagaacaagaagaagggctgcgctgtattgctgtgccagtattcgatcgttttggcgtagtgattgctggtctcagtatttctttcccaacgattcgtttttcagaagataataaacacgaatatgtggctatgctgcacactgcggccagaaatatctctgagcaaatgggttaccacgattatcctttctga

SEQ ID NO: 1906 - protein, 263 aa, Pectobacterium atrosepticum
MASADLDKQPDSVSSVLKVFGILQALGEEREIGITELSQRVMMSKSTVYRFLQTMKSLGYVAQEGESEKYSLTLKLFELGAKALQNVDLIRSADIQMRELSALTRETIHLGALDEDGIVYIHKIDSMYNLRMYSRIGRRNPLHSTAIGKVLLAWRDRGEVEEVLSTVEFTRSTPHTLCSAETLLNQLDVVREQGYGEDNEEQEEGLRCIAVPVFDRFGVVIAGLSISFPTIRFSEDNKHEYVAMLHTAARNISEQMGYHDYPF

SEQ ID NO: 1907 - DNA, 756 bp, Salmonella typhimurium
  CDS (1)..(756)
atgaaaaagattacgacatctattccggctctcgataaaattatgcgcgtatttgcttaccttctggagtgcgatggcgcaacgtttacccagatccatcaaaattcagggattgcgaaaagcagtacctcatctttgctcaacggcatggtggagcatgggttattacgccaggaaaaagacaagtattatctggggctacgcctgtatgaattaggtaataaagcggcggaacagtacgatattaaaaaaatcgcgttaccgattcttgaagagattcgcgataacaccggcctgacctgccatcttggcgttctggagggcgatgcccctatttaccttctgaaagtcgaaagcccacaggctattgtgattcgaagctgggagggcaagcgcctctcattacatagctcagggctgggaaaggtgctgattgcatggcttagcggggaagagctggaggagttgctgcctccagatcagatattaacgcgttttacggatacgacgatcacggatgtgaatatccttaagcaggagttagcaggaattcgccgtcgcggctggggttatgataacgaagaagactcccttggcgtgcgctgcattgcggtgccggtattcaatacgcaggggaaagtgatcgccgccctgagcgtatccggcgttacgttccagatccccgatgataaacgcgagtcgcttgctacgctgatgatggatgccagccgtagcctgacgcgtctgatgtgctga

SEQ ID NO: 1908 - protein, 251 aa, Salmonella typhimurium
MKKITTSIPALDKIMRVFAYLLECDGATFTQIHQNSGIAKSSTSSLLNGMVEHGLLRQEKDKYYLGLRLYELGNKAAEQYDIKKIALPILEEIRDNTGLTCHLGVLEGDAPIYLLKVESPQAIVIRSWEGKRLSLHSSGLGKVLIAWLSGEELEELLPPDQILTRFTDTTITDVNILKQELAGIRRRGWGYDNEEDSLGVRCIAVPVFNTQGKVIAALSVSGVTFQIPDDKRESLATLMMDASRSLTRLMC

SEQ ID NO: 1909 - DNA, 855 bp, Rhizobium meliloti (Sinorhizobium meliloti)
  CDS (1)..(855)
atgaagcagaagaaagaagacgacatggaaggggaccccgccggcaccggcacgcttggcaaggcaatggccgtgctggaggcggtagccatggccgaccgccctcagcgcttcacggacatattgcagaccgtccgtcagccccgcggaaccctgcaccggctgctgggccatctcgtcgaagagggcttgctggtgcagcgccgggacttgtcctacgagcccgggcttcgcctgttgaaattcgcttatcgctcctggtcggggaaccggtttcgcgagatcgcagccccctatctcctgcacctgcaccaattgacgggcgagacggtgcatctcggcctgctgcgggaggccgaaatcatctacgtcgacaaggtggaaagccggcagaccgtgcgtatgagctcgcagataggcaaggcgtcgccggcctattgcacgggtatcggcaaggcggctctctcggttcttcctggaggcgaattgcagcggatttcgacaggaatggagtttcatccgttcacggcgcaaacgcatcgttcgatagaatcgctccttgccgagatagaggaaatccggcacgacggccatgcgttcgaccgggaggagcacgaggcggagatctgctgcgtggccgccccgatcagcgttccggaacacgacctggtcggggggatctcggtcaccggcccctcctatcgggtcagcttcaagcaactgaccgcctgggcgcaggacgtgcgcaaggtggcggcagagatcgaggaagaggtccggatccggcttggccccgggcgggaaacgggggctgcggcgccgcgtgttctgtcggacgcgcaaaggtcgcagtaa

SEQ ID NO: 1910 - protein, 284 aa, Rhizobium meliloti (Sinorhizobium meliloti)
MKQKKEDDMEGDPAGTGTLGKAMAVLEAVAMADRPQRFTDILQTVRQPRGTLHRLLGHLVEEGLLVQRRDLSYEPGLRLLKFAYRSWSGNRFREIAAPYLLHLHQLTGETVHLGLLREAEIIYVDKVESRQTVRMSSQIGKASPAYCTGIGKAALSVLPGGELQRISTGMEFHPFTAQTHRSIESLLAEIEEIRHDGHAFDREEHEAEICCVAAPISVPEHDLVGGISVTGPSYRVSFKQLTAWAQDVRKVAAEIEEEVRIRLGPGRETGAAAPRVLSDAQRSQ

SEQ ID NO: 1911 - DNA, 810 bp, Rhizobium loti (Mesorhizobium loti)
  CDS (1)..(810)
atgagttctgtcaaacattccccaaatgaccaggaccgagctcccggtgaggtttcgacggtacagagagcattgaacttgctgaaactgctcggcacaactgaaaagccgataggtgtgaatgagatcgcgcgccggctagggaagcatgtaagtgcagtctcaaggacgctggccacgctggagcacaatggcttcgtcgagcgtgacgaggagactgggcggtttgtgctcggagttgagcttatcgcgcttgcgagcagactccttgctgaacacgacgtggttcgtgtggcgcgaccctacctcgaggaacttgccgagagcacgagggaaacgacctccctcagtctttggaataagacacacgctatcaacgttgagcatgtgcttggccccgggtcgatcaagcacatcgctgcaccggggcgccgtaacccggcacactgcacggctactggaaaagccatgttgtcacacatgccagactccacactgagagaagtattagcgctcggactagaacgttacacagatcgtacgactactgaggtgagcgctcttgaaagtgagttggaccatattcgcaagcaaggatacgcgttgaatgttggggagttcattcctgagattgccgccgtcgcggccgttatccatgaccggaggggacgagttgccgctgcaattgccgttacaatgccggtttttcattttactcagcaaattgaacaacagctggcgccacttgtcataaatgcggcggcggctatctctaagcgtttaggatatcacagtgcccagccaatttga

SEQ ID NO: 1912 - protein, 269 aa, Rhizobium loti (Mesorhizobium loti)
MSSVKHSPNDQDRAPGEVSTVQRALNLLKLLGTTEKPIGVNEIARRLGKHVSAVSRTLATLEHNGFVERDEETGRFVLGVELIALASRLLAEHDVVRVARPYLEELAESTRETTSLSLWNKTHAINVEHVLGPGSIKHIAAPGRRNPAHCTATGKAMLSHMPDSTLREVLALGLERYTDRTTTEVSALESELDHIRKQGYALNVGEFIPEIAAVAAVIHDRRGRVAAAIAVTMPVFHFTQQIEQQLAPLVINAAAAISKRLGYHSAQPI

SEQ ID NO: 1913 - DNA, 822 bp, Rhizobium loti (Mesorhizobium loti)
  CDS (1)..(822)
atggaaaccaccgaaaaacgccagcgcggccgtccgcgcgctttcaacgggcctgccgaagccagttctgtgcagtcgctggatcgggccttgcgcatcctggccattgtggcggagggcagcggcctgtcgctgagcgagatatcggcgcagagcggccttgccgcctccaccgcctaccgcatgctgacgacgctcgaaaaccacggcatggtcgagttcgacacatcggaccagctatggtcgatcggcgtcgagacctatcgtatgggggcggcctttctacgccgccgcaagttggtcgaccgcgcccgcatcgttatgcaggagttgatggaaagaaccggcgagaccgccaatctcggcgtcgccgaggatgattgcgtggtgttcgtcagccaggtcgagacgcaccaggcgatccgcgctttcttccgcccgggcacgcgcagcccctttcatgcctccggcatcggcaaggcggtgctggcgcatctggaacccgagcgcgtcggcaccattctgcggaaggccggcctgcagcgcttcaccgacaggacgctgtccgagatccctgccctcgcccacgatctggccgtcatcaagcaacgcggctggtcggtcgacgatgaagaacggcaccccggcatgcgctgcgtggcggccgccatcttcaacgagttcggcgagccgatcggcggcgtctccgtatcggggccgaccgtgcgggtgacgccggagcggctggccgagatcgggccgatggtgcgcagtgccgcggccgaggtgacccggatgatcggcggcgcgcaagtcggctga

SEQ ID NO: 1914 - protein, 273 aa, Rhizobium loti (Mesorhizobium loti)
METTEKRQRGRPRAFNGPAEASSVQSLDRALRILAIVAEGSGLSLSEISAQSGLAASTAYRMLTTLENHGMVEFDTSDQLWSIGVETYRMGAAFLRRRKLVDRARIVMQELMERTGETANLGVAEDDCVVFVSQVETHQAIRAFFRPGTRSPFHASGIGKAVLAHLEPERVGTILRKAGLQRFTDRTLSEIPALAHDLAVIKQRGWSVDDEERHPGMRCVAAAIFNEFGEPIGGVSVSGPTVRVTPERLAEIGPMVRSAAAEVTRMIGGAQVG

SEQ ID NO: 1915 - DNA, 810 bp, Pasteurella multocida
  CDS (1)..(810)
atggatgtgatgaaagaagaggataaaacgaagaaagcaggcagtaatcaaagtctgattaggggcttactcctgatagatattttgagtaattttccaaacggttgcccactcgcaaaattatcagaattatcaaatttgaataaaagtactacacatcgtatgttgcaaacgttacagtcttgtggctatgtaaaacctgcaaatacgctaggggcttatcgcttaacgacaaaatgtttaactctcgggcaaaaaacgctgagttcattaaatattttgaatcttaccgcaccttatttggagcagttgaatttagaaacaggggaaaccgttaatttatcgacccgtgatcatcaccatgcggtcatgatttataagttagaaccgaccacaggtatgttacgtacacgtgcctatattgggcagcgtttagaactctattgttctgccatgggcaaaatttttatggcgtatgaaaaagggcatgcgctagatgattattgggaaaagaatcaagcgacgattcagcaactgaccgtgaatacgattgtgacacaagaagcaatggcattggaactggcgaaaattcgcgaattaggttacgccatggataatgaagaaaatgaacgaggtgtcacttgcttagcatgccctgtgtttgacattcatggcaatgtcacctattcggtttctatttccttatctaccgcacgtttgaaacaaattggtcaagacacgttgttgcgccatttaaaacaaacgactcaagcaatttcacaagaattgggtgcggttatgccgagttaa

SEQ ID NO: 1916 - protein, 269 aa, Pasteurella multocida
MDVMKEEDKTKKAGSNQSLIRGLLLIDILSNFPNGCPLAKLSELSNLNKSTTHRMLQTLQSCGYVKPANTLGAYRLTTKCLTLGQKTLSSLNILNLTAPYLEQLNLETGETVNLSTRDHHHAVMIYKLEPTTGMLRTRAYIGQRLELYCSAMGKIFMAYEKGHALDDYWEKNQATIQQLTVNTIVTQEAMALELAKIRELGYAMDNEENERGVTCLACPVFDIHGNVTYSVSISLSTARLKQIGQDTLLRHLKQTTQAISQELGAVMPS

SEQ ID NO: 1917 - DNA, 774 bp, Streptomyces coelicolor
  CDS (1)..(774)
atgggacgcctcgtgccggccgtgacccgggctctcgacatactggagctcttcctcgacggggacggcacgctctccgcccccgacatcgtgcgcaggctccagctgccgcgcaccaccgtgcacgagctggtcaccacgctcgccgcccgcaagtacatcgtcccggtcgccgggcagtccggacggtaccggctcggcgtgcgcccgtaccagctcggcgcccgctacgccgagtacctcgacctcgccgcggagggccaacaggtcgcccggaccgtcgccgagacctgcgacgagacggtgcacgtggcgatcctggaggacaccgacgtcatctacatcgccaaggtcgactccacgcacgcggtgcgcatggtgtccgcagcgggacgccggctgcccgcgcactgcacgtccgtcggcaagatgctgctggcctccctgcccgagccggaggtcgccgcgcgcttccccgacggcgccgagctgaccgcgatgaccccgaacagcatcaccgacccggccgcgctgcgcgaggccctggccgcgatccgcgagcgcggtacggcggtggagagccgcgagtccaacccggacgtgtcctgcgtggccgccccggtccgcgaccgcaccggccgggtcgtcgccgcgctgtcgatctcggtgcctatgatccgctggagcgaggaacgccgcgccgaactggagcagctcgcggtcaagggcgcggccgacctctccgagcggctcggccacaggagcgcggcatga

SEQ ID NO: 1918 - protein, 257 aa, Streptomyces coelicolor
MGRLVPAVTRALDILELFLDGDGTLSAPDIVRRLQLPRTTVHELVTTLAARKYIVPVAGQSGRYRLGVRPYQLGARYAEYLDLAAEGQQVARTVAETCDETVHVAILEDTDVIYIAKVDSTHAVRMVSAAGRRLPAHCTSVGKMLLASLPEPEVAARFPDGAELTAMTPNSITDPAALREALAAIRERGTAVESRESNPDVSCVAAPVRDRTGRVVAALSISVPMIRWSEERRAELEQLAVKGAADLSERLGHRSAA

SEQ ID NO: 1919 - DNA, 876 bp, Pseudomonas putida
  CDS (1)..(876)
atgagcgacgaaacaccggccaacgaatctgccaacccagagtcggcacgccctgccgcccccgcactggcgccgccgatcgtggcatcgccggccaagcgtattcaggcgtttaccggcgacccggacttcatgacctcgctcgcccgggggctggcggtgattcaggcgttccaggagcgcaagcgccacctgaccatcgcccagatcagccaccgcaccgagattcctcgtgcggcggtacgccgctgcctgcacacgctgatcaagctggggtatgcgacgaccgacgggcgcacctattcgctgttgcccaaggtgctgacattgggccatgcgtacctttcgtcgacgcccttggcgatttccgcccagccgtacctggaccgcatcagtgaccaactgcacgaggcggccaacatggccactcttgaaggcgacgacatcctttatatagcccgctcggcaaccgtggagcggctgatctcggtcgacctgtcggtaggcgggcgattaccggcgtattgcacgtcgatggggcgtatcctgctggcggcgatggatgacaccagcctgcgcgagtacctggaccgggctgatctcaaggcgcgcaccagccgcactttgaatgatgccgaatcgttgtttgcctgcatccagcaagtgcgtgcccagggctggtgcgtagtggaccaggagctggaacaagggctacgctccattgccgtgccgatctatgacgcgtcggggcaggtgctggcagcattgaatgtcagtacccatgtcgggcgggtaacgcgtagcgagctggaacagcgcttcttgccgatcctgttggcggccagtcgggatctttgccaccagttgtttggttga

SEQ ID NO: 1920 - protein, 291 aa, Pseudomonas putida
MSDETPANESANPESARPAAPALAPPIVASPAKRIQAFTGDPDFMTSLARGLAVIQAFQERKRHLTIAQISHRTEIPRAAVRRCLHTLIKLGYATTDGRTYSLLPKVLTLGHAYLSSTPLAISAQPYLDRISDQLHEAANMATLEGDDILYIARSATVERLISVDLSVGGRLPAYCTSMGRILLAAMDDTSLREYLDRADLKARTSRTLNDAESLFACIQQVRAQGWCVVDQELEQGLRSIAVPIYDASGQVLAALNVSTHVGRVTRSELEQRFLPILLAASRDLCHQLFG

SEQ ID NO: 1921 - DNA, 789 bp, Erwinia carotovora
  CDS (1)..(789)
atgaatatattccaacagctcgaacacagtaaagcgccagcagccgtccgtttagtgatgattattgactacatcgccaaacatgacgaagccagcttcactgagatttgcactgatttgtctatacccaaaagcagcgtacatcatctactggaagtgctggtggtgacgcaattgttacgtcaacgtgctgacggtcgttatgttttgggattaagactgtttgagcttggtggtttggtaataaagaatattgatctgcgtaaagacacgattaactttatgcatgaattagtcaaagagacagaactgacctgccatcttggtattatggatggcgataacggtttcttcctgagtaaagtcgaatcccccaaggccatcgtaaaaacatcctgggaaggtaagaaaattgtatttaaccgcatgtctctggggaaagtactcgtcgcctggctaccacaggaaagaattgaatcactgattgccgattgcacctttgagtatttgacgccccggacgattaccaataaagaagatttcctgcagcacctgaaaatcgtcaaggaacagggctgggccatagacgacggcgaagatatagaagagatctgctgtatggccgcgccaatctttaaccaaaatggtgaagtcatcgccgccattggcgttaacggtatgcagtcgcaatatgcgaatggaaaaaaagaaaagcatctggcaagcctgattaaaaccagcaaagcaattaccgctcatattaacagccggaatattgatagtagataa

SEQ ID NO: 1922 - protein, 262 aa, Erwinia carotovora
MNIFQQLEHSKAPAAVRLVMIIDYIAKHDEASFTEICTDLSIPKSSVHHLLEVLVVTQLLRQRADGRYVLGLRLFELGGLVIKNIDLRKDTINFMHELVKETELTCHLGIMDGDNGFFLSKVESPKAIVKTSWEGKKIVFNRMSLGKVLVAWLPQERIESLIADCTFEYLTPRTITNKEDFLQHLKIVKEQGWAIDDGEDIEEICCMAAPIFNQNGEVIAAIGVNGMQSQYANGKKEKHLASLIKTSKAITAHINSRNIDSR

SEQ ID NO: 1923 - DNA, 825 bp, Escherichia coli
  CDS (1)..(825)
atggtcgcacccattcccgcgaaacgcggcagaaaacccgccgttgccaccgcaccagcgactggacaggttcagtctttaacgcgtggcctgaaattactggagtggattgccgaatccaatggcagcgtggcactcacagagctggcgcaacaagccgggttacccaattccacgacccaccgcctgctaaccacgatgcaacagcagggtttcgtgcgtcaggtcggcgaactgggacactgggcaatcggcgcacatgcctttatggtcggcagcagctttctccagagccgtaatttgttagcaattgttcaccctatcctgcgcaatctaatggaagagtctggcgaaacggtcaatatggcggtgcttgatcaaagcgatcacgaagcgattattatcgaccaggtacagtgtacccacctgatgcgaatgtccgcgcctatcggcggtaaattgccgatgcacgcttccggtgcgggtaaagcctttttagcccaactgagcgaagaacaggtgacgaagctgctgcaccgcaaagggttacatgcctatacccacgcaactctggtgtctcctgtgcatttaaaagaagatctcgcccaaacgcgcaaacggggttattcatttgacgatgaggaacatgcgctggggctacgttgccttgcagcgtgtattttcgatgagcaccgcgaaccgtttgccgcaatttctatttccggaccgatttcacgtattaccgatgatcgcgtgaccgagtttggcgcgatggtgattaaagcggcgaaggaagtgacgctggcgtacggtggaatgcgctga

SEQ ID NO: 1924 - protein, 274 aa, Escherichia coli
MVAPIPAKRGRKPAVATAPATGQVQSLTRGLKLLEWIAESNGSVALTELAQQAGLPNSTTHRLLTTMQQQGFVRQVGELGHWAIGAHAFMVGSSFLQSRNLLAIVHPILRNLMEESGETVNMAVLDQSDHEAIIIDQVQCTHLMRMSAPIGGKLPMHASGAGKAFLAQLSEEQVTKLLHRKGLHAYTHATLVSPVHLKEDLAQTRKRGYSFDDEEHALGLRCLAACIFDEHREPFAAISISGPISRITDDRVTEFGAMVIKAAKEVTLAYGGMR

SEQ ID NO: 1925 - DNA, 918 bp, Erwinia chrysanthemi
  CDS (1)..(918)
atgatatttaatcggtctgtcacttatagtaatgcccgattgccatattcaaagcgttccctttatactaaaacacgtgttctattttttttaaaacaaaaaatactgagtagggtaaccacaaaaatggctattgcagatttagataaacaacccgattccgtgtcatctgtcttaaaggtctttggtattttgcaggcgttaggcgaagagcgtgagattggcattactgaactttcacagcgcgtgatgatgtctaaaagtactgtttatcgtttcctgcagacaatgaaatctctgggatatgttgcccaggaaggtgaatcagagaaatactcgctgacgttgaaattgttcgagctgggcgccaaagcgttgcagaacgttgatctgatccgcagtgcggatattcagatgcgcgaattgtcggcgttaacgcgtgaaaccatccacctcggtgcgttagatgaagacagcattgtctacatccataaaatcgattccatgtacaatttgcgtatgtattcccgcatcggtcgtcggaatccactgcacagcacggcgataggcaaggtgttgctggcctggcgtgaccgcgaagaggtcaaagaaattctgtctcaggtggaattcaagcgcacgactgtgcataccatcggtagtacggaagagttgttgcctcagcttgacctggtgcgtcagcagggatacggcgaggacaatgaagagcaggaagaaggtctgcgttgcatcgcggttccggtatttgatcgctttggcgtggtgattgccggcctgagtatctctttcccgacgattcgcttctcggaagataataaacacgaatatgtcgccatgttgcatacagcggcgcgcaatatctccgatcaaatgggataccacgattatccgttctga

SEQ ID NO: 1926 - protein, 305 aa, Erwinia chrysanthemi
MIFNRSVTYSNARLPYSKRSLYTKTRVLFFLKQKILSRVTTKMAIADLDKQPDSVSSVLKVFGILQALGEEREIGITELSQRVMMSKSTVYRFLQTMKSLGYVAQEGESEKYSLTLKLFELGAKALQNVDLIRSADIQMRELSALTRETIHLGALDEDSIVYIHKIDSMYNLRMYSRIGRRNPLHSTAIGKVLLAWRDREEVKEILSQVEFKRTTVHTIGSTEELLPQLDLVRQQGYGEDNEEQEEGLRCIAVPVFDRFGVVIAGLSISFPTIRFSEDNKHEYVAMLHTAARNISDQMGYHDYPF

SEQ ID NO: 1927 - DNA, 876 bp, Pseudomonas putida
  CDS (1)..(876)
atgagtgacgaaaccctggtcaacgatccggtcaatccagagccggcgcgacccgcttcggccgccatggcgccgccgatcgtggcttctccggccaagcgcatccaggcgtttacgggggatcccgacttcatgacctccctggcacgtggcctggccgtgatccaggcctttcaggagcgcaagcgccacctgaccatcgcccagatcagccaccgcaccgaaatccctcgcgcagcggtgcgccgttgcctgcacacgctgatcaagctgggttacgccacctccgacgggcgtacctattcgctgttgcccaaagtattgacgttggggcatgcctacctgtcgtcgacgccgctggcgatttctgcccagccttatctggaccgtatcagtgatcaactgcacgaagcggccaacatggccacactcgaaggcgacgacattctttatatagcccgttcggccacggtggaacggctgatatcggtcgacctgtccgttggcgggcgcctgccggcctattgcacatcgatggggcgcatcctgctggcggcgatggacgacaccagcctgcgtgaatacctggggcgtgccgacctgaaagcgcgcaccagccgtacgctgcatgaccctgagtcactgttcgcctgcatccagcaggtgcgcgcccagggctggtgcgtggtggaccaggagctggagcaggggctgcgttcgattgccgtgccgatctacgacgcgtcggggcaggtgttggcggcgctgaacgtgagcacccatgtggggcgggtgacgcgtagcgagctggaacagcgcttcctgccgatcctgctggcggccagccgggacctttgccatcagttgtttggctga

SEQ ID NO: 1928 - protein, 291 aa, Pseudomonas putida
MSDETLVNDPVNPEPARPASAAMAPPIVASPAKRIQAFTGDPDFMTSLARGLAVIQAFQERKRHLTIAQISHRTEIPRAAVRRCLHTLIKLGYATSDGRTYSLLPKVLTLGHAYLSSTPLAISAQPYLDRISDQLHEAANMATLEGDDILYIARSATVERLISVDLSVGGRLPAYCTSMGRILLAAMDDTSLREYLGRADLKARTSRTLHDPESLFACIQQVRAQGWCVVDQELEQGLRSIAVPIYDASGQVLAALNVSTHVGRVTRSELEQRFLPILLAASRDLCHQLFG

SEQ ID NO: 1929 - DNA, 807 bp, Mycobacterium vanbaalenii
  CDS (1)..(807)
atgcagaaacctcctgtcgcgggcatggagcatgacagcaccggaaagctcccgcaatatccgatcgagtctgtcgacaatgctcttcgcctaatcctcctcctgggagaccgctctgagatccggctcactgacgccagcgagtacctgcacgtcgcttcatcgaccgcgcatcgcctgttatcgatgcttcagtaccgcgggtttgtccgccaagatccgattagcagggcataccagcccggaccgtccttgacaaacgtggcgttcgctgtccactccaggatggacataccgcgcacggccgcgccgattctgcgccgcctcgcggacacgttgcaagaaaccgtgcacgtaggaacgttggacggcagactggttcgcttcatcgcggcactcgaaagcccttctgccgtccgggtgatctcgcgtttgggtggcacgcgtcctgcacactgcacgtcgaccggcaaagtcctactcgccggcctatccgacgacgagctggaccagttgtaccccgacccacatttggagccactcactgagcattccgtgcgcactctcaccgaactgcgcactcaattggcagaggtcaggaaaagcgggttcgcgatcagcaaccaggaaagtgaggaaggcgtcgcgtctgttgccgtggcggtaccccaaggtggttccgggataaggctggcgctggcactaaacgcgtcagcgccgagttatcgattccggccctccgatgttcgcaaagcttgcagtgccctaaaagacgccgccgccgagctagcccgcaatctcggctga

SEQ ID NO: 1930 - protein, 268 aa, Mycobacterium vanbaalenii
MQKPPVAGMEHDSTGKLPQYPIESVDNALRLILLLGDRSEIRLTDASEYLHVASSTAHRLLSMLQYRGFVRQDPISRAYQPGPSLTNVAFAVHSRMDIPRTAAPILRRLADTLQETVHVGTLDGRLVRFIAALESPSAVRVISRLGGTRPAHCTSTGKVLLAGLSDDELDQLYPDPHLEPLTEHSVRTLTELRTQLAEVRKSGFAISNQESEEGVASVAVAVPQGGSGIRLALALNASAPSYRFRPSDVRKACSALKDAAAELARNLG

SEQ ID NO: 1931 - DNA, 798 bp, uncultured bacterium 582
  CDS (1)..(798)
atgggaggagcggttttggataaggcaaccacctcggatggaaccgttggaaaggcgcttgagcttttagaccgggttgccgaaaaaaaacgcccggtgcgatttactgagttattagcagggtccccccatcccaaagccacgttgcaccgcctgctgcagacattgttaagccaagaaatgctgtcgtatgatcgggaacggcagacctattcattggggctgcgcttggtcactctggcacatgctgcctggcggcaaagttcgctggcgcccatagcgcggccttttttggatgcgcttgccgcacgattgggcgaaaccattcacttggcgcagctggacaatgggcaggtgctgtatctggataaacgaaacgccgccgatccgattgaaatgttttcgcaagcaggtaaaaccggcccgggatattgcacgggcattggcaaggcaatgctggcgtttttgccagacgaacagcgcagaatggccattcagcaacagggttattttgcccatacgcaccacacgatcaccaatgcctctgctctgagcgatgagctggcgatcattcgagaacagggcatggcctttgatcgcgaagaacacgagaccggtattatctgcgtcgctgtgccaatcctttcgcacaaaggacgacccattggcggcttgtcgctgacctcttcgacacagcgcgccgcccttgccgatctgcataaatttgcgcccattttgcatgaacaagcccaggaaatttcaagcgctgcggaacattggcaattcccattcccgtag

SEQ ID NO: 1932 - protein, 265 aa, uncultured bacterium 582
MGGAVLDKATTSDGTVGKALELLDRVAEKKRPVRFTELLAGSPHPKATLHRLLQTLLSQEMLSYDRERQTYSLGLRLVTLAHAAWRQSSLAPIARPFLDALAARLGETIHLAQLDNGQVLYLDKRNAADPIEMFSQAGKTGPGYCTGIGKAMLAFLPDEQRRMAIQQQGYFAHTHHTITNASALSDELAIIREQGMAFDREEHETGIICVAVPILSHKGRPIGGLSLTSSTQRAALADLHKFAPILHEQAQEISSAAEHWQFPFP

SEQ ID NO: 1933 - DNA, 816 bp, Mycobacterium paratuberculosis
  CDS (1)..(816)
atgccagccaagcgtgcgcgagtcgccgggccagccgcggccgcgccggccgccgatgcgcttgcgccgcagtatccaatcgaatcggtcgacaacgcgctcaagctgttgctgctgctgggtgagcaacccgagatccggttgagcgaggcgacccgctatctgggtgtggcgtcctcgacggcgcaccggctgctggcgatgctggcctaccgcggattcgtccggcaggacccggtgtccaaggcgtatctgcccggcccgtcgctgaccggtgtggcgttcgccatcttcggccgcctcgacatcgcgcgatcggccgcgcccctcatgcgcgcgctcagcgagcagctgcgcgagacggtgcacgtcggcatgctcgacggggccagcgtgcggttcgtcgccgccgtcgagggcccggccgcggtgcgggtggcctcccggctgggccgcgccttgccggcgcattgcacctcgacgggcaaggtgatgctggcacagttgtccgcggccgaactgcgggcgctgctgccgcgcgagcggctcaagcgcatcaccgcgcattccatcggcagccgcgccgcgctggaggccgagctggccgcgatccgcgagcgcggctacgccaccaaccgggaggagagcgaggagggtgtcgcgtcggtcgccgtgccgatcccgacccgggcgcccgggctgcggctggccctgaacgccgccgccccgcagaaccggctggacgccgcccgctaccccgcggtggccgccgcacttgtggccgccgccaaggagatcggcgatcagctcggctag

SEQ ID NO: 1934 - protein, 271 aa, Mycobacterium paratuberculosis
MPAKRARVAGPAAAAPAADALAPQYPIESVDNALKLLLLLGEQPEIRLSEATRYLGVASSTAHRLLAMLAYRGFVRQDPVSKAYLPGPSLTGVAFAIFGRLDIARSAAPLMRALSEQLRETVHVGMLDGASVRFVAAVEGPAAVRVASRLGRALPAHCTSTGKVMLAQLSAAELRALLPRERLKRITAHSIGSRAALEAELAAIRERGYATNREESEEGVASVAVPIPTRAPGLRLALNAAAPQNRLDAARYPAVAAALVAAAKEIGDQLG

SEQ ID NO: 1935 - DNA, 753 bp, Bacillus cereus (strain ATCC 10987)
  CDS (1)..(753)
atgattataaataaaacggcagttaagacaatggatattttagagttgttttatgagcatgaagagctaagtttaacagagatggttcagcttacaagtatgccgaaaacatctgtttatcgtttaattggctcgttagaagaaatggagtttttacaaaaaaacgaaaaggggaaatatcgtttaggagtcgtgtttttacggttcggtcaacttgtttcacaaagactatccgtaagaaatattgcgattccatatatgaaagagcttagagatagtttagggcaggcagttaatttaattattcaagatggtaatgatgcgatttatgtggaaaagatggaaggtgctcaacctgtacgtgtgtatacggcggttggaagaagagcgccactttatgcgggtgcatgtccgagaattttattatcgtatttctctgaggaagaaaaacgaaaatacatagaggaaacggatttaaagcaatttgcagatggaacaattgtagataagaaacaattgctagaagtgttacaaatggcaaaaaaggaaggacatacaattagctactctgagttagaaaatcatacagcggctatagcagcgcccattttcgcaagcgatggaacggttgtagcaggcattagtatttcgggattagcaattgagtatagcgaaagtaacattccttattttatcgagaaggtaaaagagacagcgaatcgcatttcgaaagaactcggctttttggcatag

SEQ ID NO: 1936 - protein, 250 aa, Bacillus cereus (strain ATCC 10987)
MIINKTAVKTMDILELFYEHEELSLTEMVQLTSMPKTSVYRLIGSLEEMEFLQKNEKGKYRLGVVFLRFGQLVSQRLSVRNIAIPYMKELRDSLGQAVNLIIQDGNDAIYVEKMEGAQPVRVYTAVGRRAPLYAGACPRILLSYFSEEEKRKYIEETDLKQFADGTIVDKKQLLEVLQMAKKEGHTISYSELENHTAAIAAPIFASDGTVVAGISISGLAIEYSESNIPYFIEKVKETANRISKELGFLA

SEQ ID NO: 1937 - DNA, 825 bp, Thermus thermophilus (strain HB27 / ATCC BAA-163 / DSM 7039)
  CDS (1)..(825)
atgtcaagaagcaaaaagattttttgcatcttgaaaaacagggccgcccccgttaccctaagcgacatggcgcgtcctcgggagaagccgccccaggcggtgaagaccctggagagggggcttcgggtcctcgaggccctggcccaggcgggggaaagccccttgggccccttggccgaacgggtgggcctcgccaagagcaccctctaccgcctcctcagggccctggcccaggcgggcttcgtggaggaggagggcggggtctaccgggtggggcccaaggccttcgccgtgggccaggcctaccccaagcgttcgctttcccaggcggtccgccccgagatggaggccttggcgagggagacgggggagagcgtaaacctggcggtgcccctggggcgggaggcgttgtacctggaccaggtggaggggacgaagctcgtccgcctcttcaccgcccccggctcccgggcccccctccacgccaccggggtgggcaaggtcttcctggcctatctgggggtgcccgaggggcttagcctcacgccttacaccccccacaccctcacccggcttcccgacctcctccgggagcttgaggcggtgcgcgggcggggctacgccctggacaacgaggagaaggagctcggggtgcggtgcgtggccgcccccgtcttcggggcctcagggggcgtggtggccgccctctccctctccgcccccgcaagccgcctctccctggaggaggcccaccgcctcgccccccgggtggtggaggcggcccggagagcttccctgcgcctcgggtacacaggcgaggtataa

SEQ ID NO: 1938 - protein, 274 aa, Thermus thermophilus (strain HB27 / ATCC BAA-163 / DSM 7039)
MSRSKKIFCILKNRAAPVTLSDMARPREKPPQAVKTLERGLRVLEALAQAGESPLGPLAERVGLAKSTLYRLLRALAQAGFVEEEGGVYRVGPKAFAVGQAYPKRSLSQAVRPEMEALARETGESVNLAVPLGREALYLDQVEGTKLVRLFTAPGSRAPLHATGVGKVFLAYLGVPEGLSLTPYTPHTLTRLPDLLRELEAVRGRGYALDNEEKELGVRCVAAPVFGASGGVVAALSLSAPASRLSLEEAHRLAPRVVEAARRASLRLGYTGEV

SEQ ID NO: 1939 - DNA, 756 bp, Rhodopseudomonas palustris
  CDS (1)..(756)
atggacaaagccttcatcaagggacttcgactgctcgagacccttgcgctcagcgatcaaccgcgcggcgtcaccgacctcgccaacgagctgaagttcaccaagagcaacgtgcaccggctgctggcgacgttgcagtcacagggctacgtccgccagattccgccgcacagcacctatgagctgaccaccaagctgtgggagcttggccatcacgtcatccagcgtatggatctggttcgggtcgcgcggccggcgatgaccaggctggccgagatcaccggcgagaccgtacacctgtcggtgctcgacggcaccgaagttctgtatgtcgataagatcgaaagcgcccatcacatccgcgcccacaccagcgtcggtatgcgcgcgcccgcgttcacggtcgcaaccggcaaggcgatgctggcgcagatgcccgacgattatctggaaatccttcgcccgcatctgaagcgctatacggattcgacccgcaccacgctcgaggagctgcgcgaagacatccgcaccatccggtcgcagggctatgcgtcggtgctgcacggcgagtggcgcgaaggcatcgccgcctgcgcctgcgccatcatcggccgttccggcgaattgatcggcgcgatcgggatgtccggcccggacatccgcgtcaagcgcaagcagatcaaggaatactccgtccacgtcatggaagccgcccgcaccattggtatggcgctcggccatggcggtgtgaagtaa

SEQ ID NO: 1940 - protein, 251 aa, Rhodopseudomonas palustris
MDKAFIKGLRLLETLALSDQPRGVTDLANELKFTKSNVHRLLATLQSQGYVRQIPPHSTYELTTKLWELGHHVIQRMDLVRVARPAMTRLAEITGETVHLSVLDGTEVLYVDKIESAHHIRAHTSVGMRAPAFTVATGKAMLAQMPDDYLEILRPHLKRYTDSTRTTLEELREDIRTIRSQGYASVLHGEWREGIAACACAIIGRSGELIGAIGMSGPDIRVKRKQIKEYSVHVMEAARTIGMALGHGGVK

SEQ ID NO: 1941 - DNA, 24 bp, Primer
atggctaacgcagatctggataaa

SEQ ID NO: 1942 - DNA, 25 bp, Primer
ttagaacggatagtcgtgataaccc

SEQ ID NO: 1943 - protein, 125 aa, Artificial
  conserved protein domain
  misc_feature (2)..(5): Xaa can be any naturally occurring amino acid
  misc_feature (8)..(15): Xaa can be any naturally occurring amino acid
  misc_feature (17)..(18): Xaa can be any naturally occurring amino acid
  misc_feature (22)..(26): Xaa can be any naturally occurring amino acid
  misc_feature (29)..(30): Xaa can be any naturally occurring amino acid
  misc_feature (32)..(40): Xaa can be any naturally occurring amino acid
  misc_feature (42)..(44): Xaa can be any naturally occurring amino acid
  misc_feature (46)..(46): Xaa can be any naturally occurring amino acid
  misc_feature (51)..(53): Xaa can be any naturally occurring amino acid
  misc_feature (57)..(57): Xaa can be any naturally occurring amino acid
  misc_feature (60)..(61): Xaa can be any naturally occurring amino acid
  misc_feature (67)..(67): Xaa can be any naturally occurring amino acid
  misc_feature (72)..(73): Xaa can be any naturally occurring amino acid
  misc_feature (76)..(84): Xaa can be any naturally occurring amino acid
  misc_feature (85)..(92): Xaa can be any naturally occurring amino acid or can be omitted
  misc_feature (94)..(95): Xaa can be any naturally occurring amino acid
  misc_feature (97)..(98): Xaa can be any naturally occurring amino acid
  misc_feature (101)..(104): Xaa can be any naturally occurring amino acid
  misc_feature (106)..(112): Xaa can be any naturally occurring amino acid
  misc_feature (115)..(117): Xaa can be any naturally occurring amino acid
  misc_feature (119)..(121): Xaa can be any naturally occurring amino acid
  misc_feature (123)..(123): Xaa can be any naturally occurring amino acid
PXXXXFIXXXXXXXXVXXPTLXXXXXYLXXLXXXXXXXXXGXXXTXHRIFXXXLILXAKXXNDSSPXNKHWXXYTXXXXXXXXXXXXXXXXXNXXEXXLLXXXXWXXXXXXXDLXXXLXXXLXPI

SEQ ID NO: 1944 - protein, 432 aa, Artificial
  conserved protein domain
  misc_feature (1)..(17): Xaa can be any naturally occurring amino acid
  misc_feature (20)..(21): Xaa can be any naturally occurring amino acid
  misc_feature (23)..(26): Xaa can be any naturally occurring amino acid
  misc_feature (28)..(30): Xaa can be any naturally occurring amino acid
  misc_feature (32)..(34): Xaa can be any naturally occurring amino acid
  misc_feature (37)..(42): Xaa can be any naturally occurring amino acid
  misc_feature (44)..(80): Xaa can be any naturally occurring amino acid
  misc_feature (82)..(82): Xaa can be any naturally occurring amino acid
  misc_feature (84)..(85): Xaa can be any naturally occurring amino acid
  misc_feature (88)..(89): Xaa can be any naturally occurring amino acid
  misc_feature (91)..(93): Xaa can be any naturally occurring amino acid
  misc_feature (98)..(98): Xaa can be any naturally occurring amino acid
  misc_feature (103)..(105): Xaa can be any naturally occurring amino acid
  misc_feature (109)..(110): Xaa can be any naturally occurring amino acid
  misc_feature (112)..(115): Xaa can be any naturally occurring amino acid
  misc_feature (117)..(120): Xaa can be any naturally occurring amino acid
  misc_feature (122)..(124): Xaa can be any naturally occurring amino acid
  misc_feature (126)..(126): Xaa can be any naturally occurring amino acid
  misc_feature (132)..(133): Xaa can be any naturally occurring amino acid
  misc_feature (140)..(140): Xaa can be any naturally occurring amino acid
  misc_feature (147)..(147): Xaa can be any naturally occurring amino acid
  misc_feature (153)..(153): Xaa can be any naturally occurring amino acid
  misc_feature (156)..(169): Xaa can be any naturally occurring amino acid
  misc_feature (171)..(171): Xaa can be any naturally occurring amino acid
  misc_feature (173)..(174): Xaa can be any naturally occurring amino acid
  misc_feature (177)..(177): Xaa can be any naturally occurring amino acid
  misc_feature (180)..(183): Xaa can be any naturally occurring amino acid
  misc_feature (186)..(191): Xaa can be any naturally occurring amino acid
  misc_feature (194)..(196): Xaa can be any naturally occurring amino acid
  misc_feature (198)..(199): Xaa can be any naturally occurring amino acid
  misc_feature (202)..(202): Xaa can be any naturally occurring amino acid
  misc_feature (205)..(295): Xaa can be any naturally occurring amino acid
  misc_feature (298)..(298): Xaa can be any naturally occurring amino acid
  misc_feature (300)..(318): Xaa can be any naturally occurring amino acid
  misc_feature (320)..(321): Xaa can be any naturally occurring amino acid
  misc_feature (324)..(324): Xaa can be any naturally occurring amino acid
  misc_feature (326)..(432): Xaa can be any naturally occurring amino acid
XXXXXXXXXXXXXXXXXALXXFXXXXVXXXMXXXLAXXXXXXIXXXXXXXXXXXXXXXXXXXXXXXXXXXXXXXXXXXXXPXLXXFIXXLXXXSNVQXPTLMXXXVYLXXLXXXXPXXXXGXXXTXHRIFLXXLILAAKXLNDSSPXNKHWAXYTXXXXXXXXXXXXXXEXNXXERXLLXXXXWDXXXXXXDLXXXLXXFLXPIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSRXSXXXXXXXXXXXXXXXXXXXTXXSRXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 1945 - protein, 59 aa, Artificial
  conserved protein domain
  misc_feature (2)..(2): Xaa can be Ala or Ser or Val
  misc_feature (3)..(6): Xaa can be any naturally occurring amino acid
  misc_feature (7)..(7): Xaa can be Phe or Tyr
  misc_feature (8)..(35): Xaa can be any naturally occurring amino acid
  misc_feature (35)..(48): Xaa can be any naturally occurring amino acid or can be omitted
  misc_feature (49)..(49): Xaa can be Phe or Tyr or His
  misc_feature (51)..(51): Xaa can be any naturally occurring amino acid
  misc_feature (53)..(57): Xaa can be any naturally occurring amino acid
  misc_feature (58)..(58): Xaa can be Leu or Val
YXXXXXXXXXXXXXXXXXXXXXXXXXXXXXXXXXXXXXXXXXXXXXXXXPXAXXXXXXD

SEQ ID NO: 1946 - protein, 545 aa, Artificial
  conserved protein domain
  misc_feature (1)..(249): Xaa can be any naturally occurring amino acid
  misc_feature (251)..(253): Xaa can be any naturally occurring amino acid
  misc_feature (256)..(259): Xaa can be any naturally occurring amino acid
  misc_feature (261)..(288): Xaa can be any naturally occurring amino acid
  misc_feature (290)..(290): Xaa can be any naturally occurring amino acid
  misc_feature (292)..(302): Xaa can be any naturally occurring amino acid
  misc_feature (304)..(304): Xaa can be any naturally occurring amino acid
  misc_feature (306)..(306): Xaa can be any naturally occurring amino acid
  misc_feature (308)..(308): Xaa can be any naturally occurring amino acid
  misc_feature (310)..(311): Xaa can be any naturally occurring amino acid
  misc_feature (313)..(317): Xaa can be any naturally occurring amino acid
  misc_feature (319)..(333): Xaa can be any naturally occurring amino acid
  misc_feature (335)..(380): Xaa can be any naturally occurring amino acid
  misc_feature (383)..(384): Xaa can be any naturally occurring amino acid
  misc_feature (386)..(389): Xaa can be any naturally occurring amino acid
  misc_feature (391)..(403): Xaa can be any naturally occurring amino acid
  misc_feature (405)..(408): Xaa can be any naturally occurring amino acid
  misc_feature (410)..(422): Xaa can be any naturally occurring amino acid
  misc_feature (425)..(449): Xaa can be any naturally occurring amino acid
  misc_feature (451)..(478): Xaa can be any naturally occurring amino acid
  misc_feature (480)..(485): Xaa can be any naturally occurring amino acid
  misc_feature (488)..(492): Xaa can be any naturally occurring amino acid
  misc_feature (494)..(545): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXYAXXXXYXXXXXXXXXXXXXXXXXXXXXXXXXXXXWXKXXXXXXXXXXXPXAXWXWXXDXXXXXMXXXXXXXXXXXXXXXLXXXXXXXXXXXXXXXXXXXXXXXXXXXXXXXXXXXXXXXXXXXXXXQDXXGXXXXSXXXXXXXXXXXXXDXXXXPXXXXXXXXXXXXXEQXXXXXXXXXXXXXXXXXXXXXXXXXNXXXXXXXXXXXXXXXXXXXXXXXXXXXXDXXXXXXGCXXXXXCXXXXXXXXXXXXXXXXXXXXXXXXXXXXXXXXXXXXXXXXXXXXXXXXXXXX

SEQ ID NO: 1947 - protein, 683 aa, Artificial
  conserved protein domain
  misc_feature (1)..(374): Xaa can be any naturally occurring amino acid
  misc_feature (376)..(378): Xaa can be any naturally occurring amino acid
  misc_feature (380)..(443): Xaa can be any naturally occurring amino acid
  misc_feature (445)..(445): Xaa can be any naturally occurring amino acid
  misc_feature (447)..(450): Xaa can be any naturally occurring amino acid
  misc_feature (452)..(454): Xaa can be any naturally occurring amino acid
  misc_feature (457)..(458): Xaa can be any naturally occurring amino acid
  misc_feature (460)..(461): Xaa can be any naturally occurring amino acid
  misc_feature (463)..(470): Xaa can be any naturally occurring amino acid
  misc_feature (472)..(478): Xaa can be any naturally occurring amino acid
  misc_feature (480)..(518): Xaa can be any naturally occurring amino acid
  misc_feature (524)..(535): Xaa can be any naturally occurring amino acid
  misc_feature (537)..(595): Xaa can be any naturally occurring amino acid
  misc_feature (597)..(683): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXFXXXXXXXXXXXXXXXXXXXXXXXXXXXXXXXXXXXXXXXXXXXXXXXXXXXXXXXXXXXXXXXXFXHXXXXHXXXNMXXLXXFXXXXXXXXGXXXXXXXYXXXXXXXXXXXXXXXXXXXXXXXXXXXXXXXXXXXXXXXGASGAXXXXXXXXXXXXPXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 1948 - protein, 212 aa, Artificial
  conserved protein domain
  misc_feature (2)..(26): Xaa can be any naturally occurring amino acid
  misc_feature (27)..(43): Xaa can be any naturally occurring amino acid or can be omitted
  misc_feature (44)..(44): Xaa can be Pro or Val
  misc_feature (45)..(45): Xaa can be Leu ir Val
  misc_feature (46)..(46): Xaa can be Trp or Tyr
  misc_feature (47)..(47): Xaa can be any naturally occurring amino acid
  misc_feature (49)..(51): Xaa can be any naturally occurring amino acid
  misc_feature (52)..(52): Xaa can be Lys or Arg
  misc_feature (53)..(53): Xaa can be Lys or Arg or Gln
  misc_feature (54)..(54): Xaa can be Lys or Arg or Gln or Ser
  misc_feature (55)..(61): Xaa can be any naturally occurring amino acid
  misc_feature (63)..(63): Xaa can be any naturally occurring amino acid
  misc_feature (64)..(64): Xaa can be Trp or Tyr
  misc_feature (65)..(65): Xaa can be Met or Leu
  misc_feature (66)..(69): Xaa can be any naturally occurring amino acid
  misc_feature (71)..(86): Xaa can be any naturally occurring amino acid
  misc_feature (87)..(146): Xaa can be any naturally occurring amino acid can be omitted
  misc_feature (148)..(180): Xaa can be any naturally occurring amino acid
  misc_feature (180)..(182): Xaa can be any naturally occurring amino acid or can be omitted
  misc_feature (184)..(185): Xaa can be any naturally occurring amino acid
  misc_feature (187)..(202): Xaa can be any naturally occurring amino acid
  misc_feature (203)..(206): Xaa can be any naturally occurring amino acid or can be omitted
  misc_feature (207)..(207): Xaa can be Asn or Gly
  misc_feature (208)..(211): Xaa can be any naturally occurring amino acid
PXXXXXXXXXXXXXXXXXXXXXXXXXXXXXXXXXXXXXXXXXXXXXXAXXXXXXXXXXXXXPXXXXXXXLXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXXXXXXXXXXXXXXXXXXXRXXKXXXXXXXXXXXXXXXXXXXXXXXXXE

SEQ ID NO: 1949 - protein, 355 aa, Artificial
  conserved protein domain
  misc_feature (1)..(18): Xaa can be any naturally occurring amino acid
  misc_feature (20)..(20): Xaa can be any naturally occurring amino acid
  misc_feature (22)..(23): Xaa can be any naturally occurring amino acid
  misc_feature (25)..(29): Xaa can be any naturally occurring amino acid
  misc_feature (31)..(72): Xaa can be any naturally occurring amino acid
  misc_feature (76)..(76): Xaa can be any naturally occurring amino acid
  misc_feature (78)..(79): Xaa can be any naturally occurring amino acid
  misc_feature (82)..(85): Xaa can be any naturally occurring amino acid
  misc_feature (87)..(90): Xaa can be any naturally occurring amino acid
  misc_feature (92)..(92): Xaa can be any naturally occurring amino acid
  misc_feature (94)..(98): Xaa can be any naturally occurring amino acid
  misc_feature (100)..(175): Xaa can be any naturally occurring amino acid
  misc_feature (177)..(185): Xaa can be any naturally occurring amino acid
  misc_feature (187)..(192): Xaa can be any naturally occurring amino acid
  misc_feature (194)..(201): Xaa can be any naturally occurring amino acid
  misc_feature (203)..(206): Xaa can be any naturally occurring amino acid
  misc_feature (208)..(211): Xaa can be any naturally occurring amino acid
  misc_feature (213)..(214): Xaa can be any naturally occurring amino acid
  misc_feature (216)..(235): Xaa can be any naturally occurring amino acid
  misc_feature (237)..(240): Xaa can be any naturally occurring amino acid
  misc_feature (242)..(355): Xaa can be any naturally occurring amino acid
XXXXXXXXXXXXXXXXXXFXAXXEXXXXXPXXXXXXXXXXXXXXXXXXXXXXXXXXXXXXXXXXXXXXXXXXPLWXAXXLKXXXXCXXXXPXWXXXXXLXXXXXXXXXXXXXXXXXXXXXXXXXXXXXXXXXXXXXXXXXXXXXXXXXXXXXXXXXXXXXXXXXXXXXXXXXXXXPXXXXXXXXXLXXXXXXDXXXXXXXXRXXXXDXXXXRXXKXXXXXXXXXXXXXXXXXXXXNXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 1950 - protein, 33 aa, Artificial; identical to SEQ ID NO: 228
  conserved protein domain
  misc_feature (2)..(11): Xaa can be any naturally occurring amino acid
  misc_feature (13)..(13): Xaa can be any naturally occurring amino acid
  misc_feature (15)..(15): Xaa can be any naturally occurring amino acid
  misc_feature (19)..(28): Xaa can be any naturally occurring amino acid
  misc_feature (30)..(32): Xaa can be any naturally occurring amino acid

SEQ ID NO: 1951 - protein, 104 aa, Artificial; identical to SEQ ID NO: 229
  conserved protein domain
  misc_feature (1)..(7): Xaa can be any naturally occurring amino acid
  misc_feature (9)..(9): Xaa can be any naturally occurring amino acid
  misc_feature (11)..(12): Xaa can be any naturally occurring amino acid
  misc_feature (14)..(15): Xaa can be any naturally occurring amino acid
  misc_feature (20)..(20): Xaa can be any naturally occurring amino acid
  misc_feature (27)..(27): Xaa can be any naturally occurring amino acid
  misc_feature (30)..(30): Xaa can be any naturally occurring amino acid
  misc_feature (32)..(32): Xaa can be any naturally occurring amino acid
  misc_feature (39)..(39): Xaa can be any naturally occurring amino acid
  misc_feature (41)..(45): Xaa can be any naturally occurring amino acid
  misc_feature (48)..(64): Xaa can be any naturally occurring amino acid
  misc_feature (66)..(67): Xaa can be any naturally occurring amino acid
  misc_feature (69)..(70): Xaa can be any naturally occurring amino acid
  misc_feature (72)..(73): Xaa can be any naturally occurring amino acid
  misc_feature (75)..(76): Xaa can be any naturally occurring amino acid
  misc_feature (78)..(81): Xaa can be any naturally occurring amino acid
  misc_feature (84)..(104): Xaa can be any naturally occurring amino acid

SEQ ID NO: 1952 - protein, 89 aa, Artificial
  conserved protein domain
  misc_feature (1)..(1): Xaa can be Tyr or Cys or Phe
  misc_feature (2)..(2): Xaa can be any naturally occurring amino acid
  misc_feature (3)..(3): Xaa can be Gly or Ala or Leu
  misc_feature (4)..(7): Xaa can be any naturally occurring amino acid
  misc_feature (8)..(14): Xaa can be any naturally occurring amino acid or can be omitted
  misc_feature (15)..(15): Xaa can be Gly or Thr or Asp or Gln
  misc_feature (16)..(17): Xaa can be any naturally occurring amino acid
  misc_feature (18)..(18): Xaa can be Phe or Trp or Met or Ile or Val
  misc_feature (19)..(19): Xaa can be Asp or Ser or Trp
  misc_feature (20)..(20): Xaa can be Ser or Asn or Thr or Ala
  misc_feature (21)..(21): Xaa can be Ser or Thr or Ile or Lys
  misc_feature (22)..(31): Xaa can be any naturally occurring amino acid
  misc_feature (32)..(44): Xaa can be any naturally occurring amino acid or can be omitted
  misc_feature (45)..(45): Xaa can be Leu or Met or Ile or Val or Ala
  misc_feature (46)..(46): Xaa can be any naturally occurring amino acid
  misc_feature (47)..(49): Xaa can be any naturally occurring amino acid or can be omitted
  misc_feature (50)..(50): Xaa can be Val or Ile or Leu or Thr
  misc_feature (51)..(51): Xaa can be Ile or Val or Phe
  misc_feature (52)..(52): Xaa can be any naturally occurring amino acid
  misc_feature (53)..(53): Xaa can be Gly or Ala or Cys
  misc_feature (54)..(54): Xaa can be Trp or Phe or Leu or Cys
  misc_feature (55)..(61): Xaa can be any naturally occurring amino acid
  misc_feature (61)..(71): Xaa can be any naturally occurring amino acid or can be omitted
  misc_feature (72)..(72): Xaa can be Met or Ile or Leu or Ala or His
  misc_feature (73)..(74): Xaa can be any naturally occurring amino acid
  misc_feature (76)..(86): Xaa can be any naturally occurring amino acid
  misc_feature (87)..(87): Xaa can be Ala or Gly
  misc_feature (88)..(88): Xaa can be Tyr or Phe
  misc_feature (89)..(89): Xaa can be Gly or Pro
XXXXXXXXXXXXXXXXXXXXXXXXXXXXXXXXXXXXXXXXXXXXXXXXXXXXXXXXXXXXXXXXXXXXXXXXXXGXXXXXXXXXXXXXX

SEQ ID NO: 1953 - protein, 496 aa, Artificial
  conserved protein domain
  misc_feature (1)..(274): Xaa can be any naturally occurring amino acid
  misc_feature (276)..(280): Xaa can be any naturally occurring amino acid
  misc_feature (283)..(283): Xaa can be any naturally occurring amino acid
  misc_feature (285)..(295): Xaa can be any naturally occurring amino acid
  misc_feature (297)..(298): Xaa can be any naturally occurring amino acid
  misc_feature (303)..(304): Xaa can be any naturally occurring amino acid
  misc_feature (306)..(320): Xaa can be any naturally occurring amino acid
  misc_feature (322)..(323): Xaa can be any naturally occurring amino acid
  misc_feature (325)..(326): Xaa can be any naturally occurring amino acid
  misc_feature (328)..(330): Xaa can be any naturally occurring amino acid
  misc_feature (333)..(333): Xaa can be any naturally occurring amino acid
  misc_feature (336)..(337): Xaa can be any naturally occurring amino acid
  misc_feature (339)..(352): Xaa can be any naturally occurring amino acid
  misc_feature (354)..(355): Xaa can be any naturally occurring amino acid
  misc_feature (357)..(360): Xaa can be any naturally occurring amino acid
  misc_feature (362)..(368): Xaa can be any naturally occurring amino acid
  misc_feature (371)..(372): Xaa can be any naturally occurring amino acid
  misc_feature (374)..(421): Xaa can be any naturally occurring amino acid
  misc_feature (423)..(427): Xaa can be any naturally occurring amino acid
  misc_feature (429)..(429): Xaa can be any naturally occurring amino acid
  misc_feature (431)..(432): Xaa can be any naturally occurring amino acid
  misc_feature (435)..(496): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXHYXGXXXXXXXXXXXGXXFDSSXXRXXXXXXXXXXXXXXXPXXFXXGXXXVIXGWXXGXXXXXXXXXXXXXXMXXGXXXXLXXXXXXXYGXXGXXXXXXXXXXXXXXXXXXXXXXXXXXXXXXXXXXXXXXXXXXXXXXXXIXXXXXLXFXXELXXXXXXXXXXXXXXXXXXXXXXXXXXXXXXXXXXXXXXXXXXXXXXXXXXXXXXXXXXXXXX

SEQ ID NO: 1954 - protein, 51 aa, Artificial
  conserved protein domain
  misc_feature (2)..(7): Xaa can be any naturally occurring amino acid
  misc_feature (9)..(13): Xaa can be any naturally occurring amino acid
  misc_feature (19)..(19): Xaa can be any naturally occurring amino acid
  misc_feature (24)..(25): Xaa can be any naturally occurring amino acid
  misc_feature (31)..(32): Xaa can be any naturally occurring amino acid
  misc_feature (34)..(44): Xaa can be any naturally occurring amino acid
  misc_feature (48)..(50): Xaa can be any naturally occurring amino acid
RXXXXXXNXXXXXRHLKKXDGEPXXRKDIQXXFXXXXXXXXXXXFTNXXXP

SEQ ID NO: 1955 - protein, 94 aa, Artificial
  conserved protein domain
  misc_feature (2)..(3): Xaa can be any naturally occurring amino acid
  misc_feature (6)..(6): Xaa can be any naturally occurring amino acid
  misc_feature (9)..(10): Xaa can be any naturally occurring amino acid
  misc_feature (12)..(14): Xaa can be any naturally occurring amino acid
  misc_feature (16)..(16): Xaa can be any naturally occurring amino acid
  misc_feature (18)..(18): Xaa can be any naturally occurring amino acid
  misc_feature (21)..(21): Xaa can be any naturally occurring amino acid
  misc_feature (28)..(28): Xaa can be any naturally occurring amino acid
  misc_feature (30)..(32): Xaa can be any naturally occurring amino acid
  misc_feature (34)..(40): Xaa can be any naturally occurring amino acid
  misc_feature (48)..(48): Xaa can be any naturally occurring amino acid
  misc_feature (52)..(52): Xaa can be any naturally occurring amino acid
  misc_feature (55)..(56): Xaa can be any naturally occurring amino acid
  misc_feature (59)..(60): Xaa can be any naturally occurring amino acid
  misc_feature (65)..(65): Xaa can be any naturally occurring amino acid
  misc_feature (67)..(68): Xaa can be any naturally occurring amino acid
  misc_feature (70)..(70): Xaa can be any naturally occurring amino acid
  misc_feature (73)..(80): Xaa can be any naturally occurring amino acid
  misc_feature (82)..(82): Xaa can be any naturally occurring amino acid
  misc_feature (86)..(86): Xaa can be any naturally occurring amino acid
KXXFAXLYXXTXXXSXKXSKXLRDKLLXDXXXAXXXXXXXLLVNIGRXNTTXNFXXEMXXQLRTXHXXPXLQXXXXXXXXKXLQDXPRLKSILK

SEQ ID NO: 1956 - protein, 827 aa, Artificial
  conserved protein domain
  misc_feature (1)..(57): Xaa can be any naturally occurring amino acid
  misc_feature (59)..(75): Xaa can be any naturally occurring amino acid
  misc_feature (77)..(110): Xaa can be any naturally occurring amino acid
  misc_feature (112)..(117): Xaa can be any naturally occurring amino acid
  misc_feature (119)..(123): Xaa can be any naturally occurring amino acid
  misc_feature (129)..(129): Xaa can be any naturally occurring amino acid
  misc_feature (134)..(135): Xaa can be any naturally occurring amino acid
  misc_feature (141)..(142): Xaa can be any naturally occurring amino acid
  misc_feature (144)..(154): Xaa can be any naturally occurring amino acid
  misc_feature (158)..(160): Xaa can be any naturally occurring amino acid
  misc_feature (162)..(195): Xaa can be any naturally occurring amino acid
  misc_feature (197)..(198): Xaa can be any naturally occurring amino acid
  misc_feature (201)..(201): Xaa can be any naturally occurring amino acid
  misc_feature (204)..(205): Xaa can be any naturally occurring amino acid
  misc_feature (207)..(209): Xaa can be any naturally occurring amino acid
  misc_feature (211)..(211): Xaa can be any naturally occurring amino acid
  misc_feature (213)..(213): Xaa can be any naturally occurring amino acid
  misc_feature (216)..(216): Xaa can be any naturally occurring amino acid
  misc_feature (223)..(223): Xaa can be any naturally occurring amino acid
  misc_feature (225)..(227): Xaa can be any naturally occurring amino acid
  misc_feature (229)..(235): Xaa can be any naturally occurring amino acid
  misc_feature (243)..(243): Xaa can be any naturally occurring amino acid
  misc_feature (247)..(247): Xaa can be any naturally occurring amino acid
  misc_feature (250)..(251): Xaa can be any naturally occurring amino acid
  misc_feature (254)..(255): Xaa can be any naturally occurring amino acid
  misc_feature (260)..(260): Xaa can be any naturally occurring amino acid
  misc_feature (262)..(263): Xaa can be any naturally occurring amino acid
  misc_feature (265)..(265): Xaa can be any naturally occurring amino acid
  misc_feature (268)..(275): Xaa can be any naturally occurring amino acid
  misc_feature (277)..(277): Xaa can be any naturally occurring amino acid
  misc_feature (281)..(281): Xaa can be any naturally occurring amino acid
  misc_feature (290)..(304): Xaa can be any naturally occurring amino acid
  misc_feature (306)..(316): Xaa can be any naturally occurring amino acid
  misc_feature (319)..(322): Xaa can be any naturally occurring amino acid
  misc_feature (324)..(378): Xaa can be any naturally occurring amino acid
  misc_feature (380)..(385): Xaa can be any naturally occurring amino acid
  misc_feature (387)..(399): Xaa can be any naturally occurring amino acid
  misc_feature (402)..(407): Xaa can be any naturally occurring amino acid
  misc_feature (409)..(412): Xaa can be any naturally occurring amino acid
  misc_feature (414)..(416): Xaa can be any naturally occurring amino acid
  misc_feature (418)..(418): Xaa can be any naturally occurring amino acid
  misc_feature (420)..(426): Xaa can be any naturally occurring amino acid
  misc_feature (428)..(430): Xaa can be any naturally occurring amino acid
  misc_feature (432)..(434): Xaa can be any naturally occurring amino acid
  misc_feature (436)..(438): Xaa can be any naturally occurring amino acid
  misc_feature (440)..(451): Xaa can be any naturally occurring amino acid
  misc_feature (453)..(465): Xaa can be any naturally occurring amino acid
  misc_feature (468)..(478): Xaa can be any naturally occurring amino acid
  misc_feature (480)..(488): Xaa can be any naturally occurring amino acid
  misc_feature (490)..(492): Xaa can be any naturally occurring amino acid
  misc_feature (494)..(516): Xaa can be any naturally occurring amino acid
  misc_feature (518)..(520): Xaa can be any naturally occurring amino acid
  misc_feature (524)..(526): Xaa can be any naturally occurring amino acid
  misc_feature (528)..(537): Xaa can be any naturally occurring amino acid
  misc_feature (539)..(548): Xaa can be any naturally occurring amino acid
  misc_feature (550)..(551): Xaa can be any naturally occurring amino acid
  misc_feature (553)..(553): Xaa can be any naturally occurring amino acid
  misc_feature (555)..(562): Xaa can be any naturally occurring amino acid
  misc_feature (564)..(566): Xaa can be any naturally occurring amino acid
  misc_feature (568)..(576): Xaa can be any naturally occurring amino acid
  misc_feature (579)..(585): Xaa can be any naturally occurring amino acid
  misc_feature (587)..(589): Xaa can be any naturally occurring amino acid
  misc_feature (591)..(599): Xaa can be any naturally occurring amino acid
  misc_feature (601)..(610): Xaa can be any naturally occurring amino acid
  misc_feature (612)..(617): Xaa can be any naturally occurring amino acid
  misc_feature (619)..(639): Xaa can be any naturally occurring amino acid
  misc_feature (641)..(668): Xaa can be any naturally occurring amino acid
  misc_feature (670)..(671): Xaa can be any naturally occurring amino acid
  misc_feature (673)..(685): Xaa can be any naturally occurring amino acid
  misc_feature (688)..(709): Xaa can be any naturally occurring amino acid
  misc_feature (712)..(718): Xaa can be any naturally occurring amino acid
  misc_feature (720)..(720): Xaa can be any naturally occurring amino acid
  misc_feature (722)..(736): Xaa can be any naturally occurring amino acid
  misc_feature (738)..(756): Xaa can be any naturally occurring amino acid
  misc_feature (758)..(770): Xaa can be any naturally occurring amino acid
  misc_feature (773)..(827): Xaa can be any naturally occurring amino acid
XXXXXXXXXXXXXXXXXXXXXXXXXXXXXXXXXXXXXXXXXXXXXXXXXXXXXXXXXPXXXXXXXXXXXXXXXXXSXXXXXXXXXXXXXXXXXXXXXXXXXXXXXXXXXXRXXXXXXNXXXXXRHLKKXDGEPXXRKDIQXXFXXXXXXXXXXXFTNXXXPXXXXXXXXXXXXXXXXXXXXXXXXXXXXXXXXXXKXXFAXLYXXTXXXSXKXSKXLRDKLLXDXXXAXXXXXXXLLVNIGRXNTTXNFXXEMXXQLRTXHXXPXLQXXXXXXXXKXLQDXPRLKSILKXXXXXXXXXXXXXXXKXXXXXXXXXXXVNXXXXIXXXXXXXXXXXXXXXXXXXXXXXXXXXXXXXXXXXXXXXXXXXXXXXXXXXXXXXNXXXXXXDXXXXXXXXXXXXXVEXXXXXXEXXXXDXXXEXKXXXXXXXKXXXKXXXAXXXFXXXXXXXXXXXXRXXXXXXXXXXXXXILXXXXXXXXXXXLXXXXXXXXXRXXXGXXXXXXXXXXXXXXXXXXXXXXXEXXXPAGXXXLXXXXXXXXXXPXXXXXXXXXXRXXRXEXXXXXXXXRXXXRXXXXXXXXXSIXXXXXXXDXXXEXXXXXXXXXEXXXXXXXXXXLXXXXXXTXXXXXXXXXXXXXXXXXXXXXEXXXXXXXXXXXXXXXXXXXXXXXXXXXXNXXDXXXXXXXXXXXXXNGXXXXXXXXXXXXXXXXXXXXXXDIXXXXXXXEXEXXXXXXXXXXXXXXXKXXXXXXXXXXXXXXXXXXXSXXXXXXXXXXXXXDDXXXXXXXXXXXXXXXXXXXXXXXXXXXXXXXXXXXXXXXXXXXXXXXXXXXXXXX

SEQ ID NO: 1957 - protein, 60 aa, Artificial
  conserved protein domain
  misc_feature (2)..(12): Xaa can be any naturally occurring amino acid
  misc_feature (13)..(13): Xaa can be any naturally occurring amino acid or can be omitted
  misc_feature (15)..(19): Xaa can be any naturally occurring amino acid
  misc_feature (21)..(21): Xaa can be any naturally occurring amino acid
  misc_feature (23)..(32): Xaa can be any naturally occurring amino acid
  misc_feature (34)..(44): Xaa can be any naturally occurring amino acid
  misc_feature (46)..(47): Xaa can be any naturally occurring amino acid
  misc_feature (49)..(59): Xaa can be any naturally occurring amino acid
LXXXXXXXXXXXXGXXXXXGXCXXXXXXXXXXCXXXXXXXXXXXCXXHXXXXXXXXXXXR

SEQ ID NO: 1958 - protein, 1007 aa, Artificial; identical to SEQ ID NO: 249
  conserved protein domain
  misc_feature (1)..(42): Xaa can be any naturally occurring amino acid
  misc_feature (44)..(162): Xaa can be any naturally occurring amino acid
  misc_feature (164)..(187): Xaa can be any naturally occurring amino acid
  misc_feature (189)..(357): Xaa can be any naturally occurring amino acid
  misc_feature (359)..(377): Xaa can be any naturally occurring amino acid
  misc_feature (379)..(379): Xaa can be any naturally occurring amino acid
  misc_feature (381)..(383): Xaa can be any naturally occurring amino acid
  misc_feature (385)..(405): Xaa can be any naturally occurring amino acid
  misc_feature (407)..(437): Xaa can be any naturally occurring amino acid
  misc_feature (439)..(439): Xaa can be any naturally occurring amino acid
  misc_feature (441)..(448): Xaa can be any naturally occurring amino acid
  misc_feature (451)..(458): Xaa can be any naturally occurring amino acid
  misc_feature (460)..(463): Xaa can be any naturally occurring amino acid
  misc_feature (465)..(465): Xaa can be any naturally occurring amino acid
  misc_feature (467)..(469): Xaa can be any naturally occurring amino acid
  misc_feature (472)..(490): Xaa can be any naturally occurring amino acid
  misc_feature (492)..(500): Xaa can be any naturally occurring amino acid
  misc_feature (502)..(503): Xaa can be any naturally occurring amino acid
  misc_feature (505)..(508): Xaa can be any naturally occurring amino acid
  misc_feature (511)..(511): Xaa can be any naturally occurring amino acid
  misc_feature (513)..(517): Xaa can be any naturally occurring amino acid
  misc_feature (519)..(519): Xaa can be any naturally occurring amino acid
  misc_feature (521)..(522): Xaa can be any naturally occurring amino acid
  misc_feature (524)..(527): Xaa can be any naturally occurring amino acid
  misc_feature (529)..(534): Xaa can be any naturally occurring amino acid
  misc_feature (536)..(537): Xaa can be any naturally occurring amino acid
  misc_feature (539)..(549): Xaa can be any naturally occurring amino acid
  misc_feature (551)..(612): Xaa can be any naturally occurring amino acid
  misc_feature (614)..(1007): Xaa can be any naturally occurring amino acid

SEQ ID NO: 1959 - protein, 196 aa, Artificial
  conserved protein domain
  misc_feature (2)..(4): Xaa can be any naturally occurring amino acid
  misc_feature (7)..(9): Xaa can be any naturally occurring amino acid
  misc_feature (11)..(16): Xaa can be any naturally occurring amino acid
  misc_feature (18)..(21): Xaa can be any naturally occurring amino acid
  misc_feature (23)..(23): Xaa can be any naturally occurring amino acid
  misc_feature (25)..(25): Xaa can be any naturally occurring amino acid
  misc_feature (29)..(29): Xaa can be any naturally occurring amino acid
  misc_feature (34)..(35): Xaa can be any naturally occurring amino acid
  misc_feature (41)..(43): Xaa can be any naturally occurring amino acid
  misc_feature (45)..(48): Xaa can be any naturally occurring amino acid
  misc_feature (49)..(52): Xaa can be any naturally occurring amino acid or can be omitted
  misc_feature (54)..(57): Xaa can be any naturally occurring amino acid
  misc_feature (59)..(60): Xaa can be any naturally occurring amino acid
  misc_feature (62)..(73): Xaa can be any naturally occurring amino acid
  misc_feature (75)..(75): Xaa can be any naturally occurring amino acid
  misc_feature (77)..(95): Xaa can be any naturally occurring amino acid
  misc_feature (97)..(98): Xaa can be any naturally occurring amino acid
  misc_feature (100)..(100): Xaa can be any naturally occurring amino acid
  misc_feature (102)..(103): Xaa can be any naturally occurring amino acid
  misc_feature (107)..(108): Xaa can be any naturally occurring amino acid
  misc_feature (110)..(110): Xaa can be any naturally occurring amino acid
  misc_feature (112)..(113): Xaa can be any naturally occurring amino acid
  misc_feature (115)..(124): Xaa can be any naturally occurring amino acid
  misc_feature (127)..(127): Xaa can be any naturally occurring amino acid
  misc_feature (129)..(139): Xaa can be any naturally occurring amino acid
  misc_feature (140)..(142): Xaa can be any naturally occurring amino acid or can be omitted
  misc_feature (144)..(146): Xaa can be any naturally occurring amino acid
  misc_feature (148)..(148): Xaa can be any naturally occurring amino acid
  misc_feature (150)..(153): Xaa can be any naturally occurring amino acid
  misc_feature (156)..(157): Xaa can be any naturally occurring amino acid
  misc_feature (160)..(160): Xaa can be any naturally occurring amino acid
  misc_feature (162)..(169): Xaa can be any naturally occurring amino acid
  misc_feature (171)..(172): Xaa can be any naturally occurring amino acid
  misc_feature (173)..(174): Xaa can be any naturally occurring amino acid or can be omitted
  misc_feature (176)..(178): Xaa can be any naturally occurring amino acid
  misc_feature (180)..(182): Xaa can be any naturally occurring amino acid
  misc_feature (186)..(186): Xaa can be any naturally occurring amino acid
  misc_feature (188)..(191): Xaa can be any naturally occurring amino acid
  misc_feature (193)..(195): Xaa can be any naturally occurring amino acid
KXXXKLXXXYXXXXXXLXXXXLXRXLILXPLVGXXFLPGGXXXFXXXXXXXXSXXXXIXXLXXXXXXXXXXXXTXLXXXXXXXXXXXXXXXXXXXHXXIXKXXSYSXXIXSXXLXXXXXXXXXXFKXKXXXXXXXXXXXXXXNXXXTXPXXXXSEXXLLXLXXXXXXXXSXXXXDXXXRXXXLAYXPXXXXAXXXL

SEQ ID NO: 1960 - protein, 243 aa, Artificial
  conserved protein domain
  misc_feature (1)..(7): Xaa can be any naturally occurring amino acid
  misc_feature (9)..(11): Xaa can be any naturally occurring amino acid
  misc_feature (14)..(16): Xaa can be any naturally occurring amino acid
  misc_feature (18)..(23): Xaa can be any naturally occurring amino acid
  misc_feature (25)..(28): Xaa can be any naturally occurring amino acid
  misc_feature (30)..(30): Xaa can be any naturally occurring amino acid
  misc_feature (32)..(32): Xaa can be any naturally occurring amino acid
  misc_feature (36)..(36): Xaa can be any naturally occurring amino acid
  misc_feature (41)..(42): Xaa can be any naturally occurring amino acid
  misc_feature (48)..(50): Xaa can be any naturally occurring amino acid
  misc_feature (52)..(59): Xaa can be any naturally occurring amino acid
  misc_feature (61)..(64): Xaa can be any naturally occurring amino acid
  misc_feature (66)..(67): Xaa can be any naturally occurring amino acid
  misc_feature (69)..(80): Xaa can be any naturally occurring amino acid
  misc_feature (82)..(82): Xaa can be any naturally occurring amino acid
  misc_feature (84)..(102): Xaa can be any naturally occurring amino acid
  misc_feature (104)..(105): Xaa can be any naturally occurring amino acid
  misc_feature (107)..(107): Xaa can be any naturally occurring amino acid
  misc_feature (109)..(110): Xaa can be any naturally occurring amino acid
  misc_feature (114)..(115): Xaa can be any naturally occurring amino acid
  misc_feature (117)..(117): Xaa can be any naturally occurring amino acid
  misc_feature (119)..(120): Xaa can be any naturally occurring amino acid
  misc_feature (122)..(131): Xaa can be any naturally occurring amino acid
  misc_feature (134)..(134): Xaa can be any naturally occurring amino acid
  misc_feature (136)..(149): Xaa can be any naturally occurring amino acid
  misc_feature (151)..(153): Xaa can be any naturally occurring amino acid
  misc_feature (155)..(155): Xaa can be any naturally occurring amino acid
  misc_feature (157)..(160): Xaa can be any naturally occurring amino acid
  misc_feature (163)..(164): Xaa can be any naturally occurring amino acid
  misc_feature (167)..(167): Xaa can be any naturally occurring amino acid
  misc_feature (169)..(176): Xaa can be any naturally occurring amino acid
  misc_feature (178)..(181): Xaa can be any naturally occurring amino acid
  misc_feature (183)..(185): Xaa can be any naturally occurring amino acid
  misc_feature (187)..(189): Xaa can be any naturally occurring amino acid
  misc_feature (193)..(193): Xaa can be any naturally occurring amino acid
  misc_feature (195)..(198): Xaa can be any naturally occurring amino acid
  misc_feature (200)..(202): Xaa can be any naturally occurring amino acid
  misc_feature (204)..(243): Xaa can be any naturally occurring amino acid
XXXXXXXKXXXKLXXXYXXXXXXLXXXXLXRXLILXPLVGXXFLPGGXXXFXXXXXXXXSXXXXIXXLXXXXXXXXXXXXTXLXXXXXXXXXXXXXXXXXXXHXXIXKXXSYSXXIXSXXLXXXXXXXXXXFKXKXXXXXXXXXXXXXXNXXXTXPXXXXSEXXLLXLXXXXXXXXSXXXXDXXXRXXXLAYXPXXXXAXXXLXXXXXXXXXXXXXXXXXXXXXXXXXXXXXXXXXXXXXXXX

SEQ ID NO: 1961 - protein, 113 aa, Artificial
  conserved protein domain
  misc_feature (1)..(1): Xaa can be Gly or Lys or Arg
  misc_feature (2)..(3): Xaa can be any naturally occurring amino acid
  misc_feature (5)..(6): Xaa can be any naturally occurring amino acid
  misc_feature (7)..(7): Xaa can be Gly or Asp or Ala
  misc_feature (8)..(8): Xaa can be Gly or Ser or Ala
  misc_feature (9)..(12): Xaa can be any naturally occurring amino acid
  misc_feature (13)..(13): Xaa can be any naturally occurring amino acid or can be omitted
  misc_feature (14)..(14): Xaa can be Gly or Ser
  misc_feature (15)..(15): Xaa can be any naturally occurring amino acid
  misc_feature (19)..(19): Xaa can be Gly or Ala or Ser
  misc_feature (20)..(20): Xaa can be Phe or Lys
  misc_feature (21)..(21): Xaa can be Val or Met or Ile or Thr
  misc_feature (22)..(31): Xaa can be any naturally occurring amino acid
  misc_feature (32)..(32): Xaa can be any naturally occurring amino acid or can be omitted
  misc_feature (33)..(33): Xaa can be Leu or Ile or Val
  misc_feature (34)..(34): Xaa can be Phe or Asp
  misc_feature (35)..(35): Xaa can be Arg or His
  misc_feature (36)..(54): Xaa can be any naturally occurring amino acid
  misc_feature (55)..(55): Xaa can be any naturally occurring amino acid or can be omitted
  misc_feature (59)..(59): Xaa can be Val or Ile or Leu
  misc_feature (60)..(60): Xaa can be Phe or Leu
  misc_feature (62)..(65): Xaa can be any naturally occurring amino acid
  misc_feature (66)..(71): Xaa can be any naturally occurring amino acid or can be omitted
  misc_feature (73)..(73): Xaa can be Val or Ile or Ala
  misc_feature (74)..(74): Xaa can be Gly or Ala
  misc_feature (75)..(75): Xaa can be Ile or Ala
  misc_feature (76)..(76): Xaa can be Tyr or Phe
  misc_feature (77)..(81): Xaa can be any naturally occurring amino acid
  misc_feature (82)..(82): Xaa can be Phe or Ser
  misc_feature (83)..(83): Xaa can be any naturally occurring amino acid
  misc_feature (84)..(84): Xaa can be His or Thr
  misc_feature (85)..(90): Xaa can be any naturally occurring amino acid
  misc_feature (91)..(93): Xaa can be any naturally occurring amino acid r can be omitted
  misc_feature (94)..(94): Xaa can be Val or Ile
  misc_feature (95)..(102): Xaa can be any naturally occurring amino acid
  misc_feature (104)..(104): Xaa can be Trp or Tyr
  misc_feature (105)..(112): Xaa can be any naturally occurring amino acid
XXXYXXXXXXXXXXXDCSXXXXXXXXXXXXXXXXXXXXXXXXXXXXXXXXXXXXXGDLXXFXXXXXXXXXXHXXXXXXXXXXXXXXXXXXXXXXXXXXXXXXYXXXXXXXXXR

SEQ ID NO: 1962 - protein, 288 aa, Artificial
  conserved protein domain
  misc_feature (1)..(61): Xaa can be any naturally occurring amino acid
  misc_feature (63)..(64): Xaa can be any naturally occurring amino acid
  misc_feature (66)..(148): Xaa can be any naturally occurring amino acid
  misc_feature (150)..(151): Xaa can be any naturally occurring amino acid
  misc_feature (153)..(154): Xaa can be any naturally occurring amino acid
  misc_feature (157)..(161): Xaa can be any naturally occurring amino acid
  misc_feature (163)..(163): Xaa can be any naturally occurring amino acid
  misc_feature (168)..(168): Xaa can be any naturally occurring amino acid
  misc_feature (170)..(180): Xaa can be any naturally occurring amino acid
  misc_feature (184)..(203): Xaa can be any naturally occurring amino acid
  misc_feature (207)..(207): Xaa can be any naturally occurring amino acid
  misc_feature (210)..(219): Xaa can be any naturally occurring amino acid
  misc_feature (225)..(229): Xaa can be any naturally occurring amino acid
  misc_feature (231)..(231): Xaa can be any naturally occurring amino acid
  misc_feature (233)..(241): Xaa can be any naturally occurring amino acid
  misc_feature (243)..(250): Xaa can be any naturally occurring amino acid
  misc_feature (253)..(260): Xaa can be any naturally occurring amino acid
  misc_feature (262)..(288): Xaa can be any naturally occurring amino acid
XXXXXXXXXXXXXXXXXXXXXXXXXXXXXXXXXXXXXXXXXXXXXXXXXXXXXXXXXXXXXLXXCXXXXXXXXXXXXXXXXXXXXXXXXXXXXXXXXXXXXXXXXXXXXXXXXXXXXXXXXXXXXXXXXXXXXXXXXXXXXXXXXXXXGXXYXXGGXXXXXGXDCSGXVXXXXXXXXXXXLPRXXXXXXXXXXXXXXXXXXXXGDLXFFXXXXXXXXXXHVGIYXXXXXFXHXXXXXXXXXVXXXXXXXXYWXXXXXXXXRXXXXXXXXXXXXXXXXXXXXXXXXXXX

SEQ ID NO: 1963 - protein, 136 aa, Artificial; identical to SEQ ID NO: 545
  conserved protein domain
  misc_feature (2)..(4): Xaa can be any naturally occurring amino acid
  misc_feature (6)..(8): Xaa can be any naturally occurring amino acid
  misc_feature (12)..(12): Xaa can be any naturally occurring amino acid
  misc_feature (14)..(16): Xaa can be any naturally occurring amino acid
  misc_feature (19)..(20): Xaa can be any naturally occurring amino acid
  misc_feature (23)..(24): Xaa can be any naturally occurring amino acid
  misc_feature (26)..(33): Xaa can be any naturally occurring amino acid
  misc_feature (35)..(36): Xaa can be any naturally occurring amino acid
  misc_feature (38)..(41): Xaa can be any naturally occurring amino acid
  misc_feature (43)..(43): Xaa can be any naturally occurring amino acid
  misc_feature (46)..(47): Xaa can be any naturally occurring amino acid
  misc_feature (49)..(51): Xaa can be any naturally occurring amino acid
  misc_feature (53)..(59): Xaa can be any naturally occurring amino acid
  misc_feature (62)..(63): Xaa can be any naturally occurring amino acid
  misc_feature (65)..(65): Xaa can be any naturally occurring amino acid
  misc_feature (67)..(71): Xaa can be any naturally occurring amino acid
  misc_feature (78)..(83): Xaa can be any naturally occurring amino acid
  misc_feature (85)..(85): Xaa can be any naturally occurring amino acid
  misc_feature (87)..(87): Xaa can be any naturally occurring amino acid
  misc_feature (93)..(94): Xaa can be any naturally occurring amino acid
  misc_feature (96)..(98): Xaa can be any naturally occurring amino acid
  misc_feature (104)..(105): Xaa can be any naturally occurring amino acid
  misc_feature (108)..(109): Xaa can be any naturally occurring amino acid
  misc_feature (111)..(112): Xaa can be any naturally occurring amino acid
  misc_feature (117)..(117): Xaa can be any naturally occurring amino acid
  misc_feature (120)..(120): Xaa can be any naturally occurring amino acid
  misc_feature (122)..(122): Xaa can be any naturally occurring amino acid
  misc_feature (126)..(126): Xaa can be any naturally occurring amino acid
  misc_feature (132)..(134): Xaa can be any naturally occurring amino acid
  misc_feature (136)..(136): Xaa can be any naturally occurring amino acid

SEQ ID NO: 1964 - protein, 46 aa, Artificial; identical to SEQ ID NO: 546
  conserved protein domain
  misc_feature (1)..(1): Xaa can be any naturally occurring amino acid
  misc_feature (3)..(5): Xaa can be any naturally occurring amino acid
  misc_feature (8)..(9): Xaa can be any naturally occurring amino acid
  misc_feature (11)..(12): Xaa can be any naturally occurring amino acid
  misc_feature (14)..(14): Xaa can be any naturally occurring amino acid
  misc_feature (17)..(17): Xaa can be any naturally occurring amino acid
  misc_feature (20)..(20): Xaa can be any naturally occurring amino acid
  misc_feature (23)..(24): Xaa can be any naturally occurring amino acid
  misc_feature (27)..(29): Xaa can be any naturally occurring amino acid
  misc_feature (31)..(33): Xaa can be any naturally occurring amino acid
  misc_feature (35)..(36): Xaa can be any naturally occurring amino acid
  misc_feature (40)..(40): Xaa can be any naturally occurring amino acid
  misc_feature (43)..(43): Xaa can be any naturally occurring amino acid
  misc_feature (46)..(46): Xaa can be any naturally occurring amino acid

SEQ ID NO: 1965 - protein, 301 aa, Artificial; identical to SEQ ID NO: 547
  conserved protein domain
  misc_feature (1)..(3): Xaa can be any naturally occurring amino acid
  misc_feature (5)..(6): Xaa can be any naturally occurring amino acid
  misc_feature (10)..(10): Xaa can be any naturally occurring amino acid
  misc_feature (13)..(13): Xaa can be any naturally occurring amino acid
  misc_feature (16)..(30): Xaa can be any naturally occurring amino acid
  misc_feature (32)..(38): Xaa can be any naturally occurring amino acid
  misc_feature (41)..(42): Xaa can be any naturally occurring amino acid
  misc_feature (44)..(46): Xaa can be any naturally occurring amino acid
  misc_feature (50)..(50): Xaa can be any naturally occurring amino acid
  misc_feature (52)..(54): Xaa can be any naturally occurring amino acid
  misc_feature (57)..(58): Xaa can be any naturally occurring amino acid
  misc_feature (61)..(61): Xaa can be any naturally occurring amino acid
  misc_feature (68)..(70): Xaa can be any naturally occurring amino acid
  misc_feature (73)..(74): Xaa can be any naturally occurring amino acid
  misc_feature (78)..(79): Xaa can be any naturally occurring amino acid
  misc_feature (81)..(81): Xaa can be any naturally occurring amino acid
  misc_feature (84)..(85): Xaa can be any naturally occurring amino acid
  misc_feature (88)..(89): Xaa can be any naturally occurring amino acid
  misc_feature (91)..(94): Xaa can be any naturally occurring amino acid
  misc_feature (97)..(97): Xaa can be any naturally occurring amino acid
  misc_feature (100)..(101): Xaa can be any naturally occurring amino acid
  misc_feature (105)..(107): Xaa can be any naturally occurring amino acid
  misc_feature (109)..(109): Xaa can be any naturally occurring amino acid
  misc_feature (117)..(121): Xaa can be any naturally occurring amino acid
  misc_feature (131)..(131): Xaa can be any naturally occurring amino acid
  misc_feature (134)..(136): Xaa can be any naturally occurring amino acid
  misc_feature (142)..(142): Xaa can be any naturally occurring amino acid
  misc_feature (146)..(147): Xaa can be any naturally occurring amino acid
  misc_feature (149)..(150): Xaa can be any naturally occurring amino acid
  misc_feature (158)..(158): Xaa can be any naturally occurring amino acid
  misc_feature (160)..(160): Xaa can be any naturally occurring amino acid
  misc_feature (164)..(164): Xaa can be any naturally occurring amino acid
  misc_feature (171)..(171): Xaa can be any naturally occurring amino acid
  misc_feature (174)..(199): Xaa can be any naturally occurring amino acid
  misc_feature (201)..(206): Xaa can be any naturally occurring amino acid
  misc_feature (209)..(210): Xaa can be any naturally occurring amino acid
  misc_feature (213)..(213): Xaa can be any naturally occurring amino acid
  misc_feature (216)..(217): Xaa can be any naturally occurring amino acid
  misc_feature (219)..(219): Xaa can be any naturally occurring amino acid
  misc_feature (225)..(225): Xaa can be any naturally occurring amino acid
  misc_feature (229)..(229): Xaa can be any naturally occurring amino acid
  misc_feature (234)..(234): Xaa can be any naturally occurring amino acid
  misc_feature (236)..(236): Xaa can be any naturally occurring amino acid
  misc_feature (240)..(241): Xaa can be any naturally occurring amino acid
  misc_feature (248)..(248): Xaa can be any naturally occurring amino acid
  misc_feature (251)..(254): Xaa can be any naturally occurring amino acid
  misc_feature (256)..(264): Xaa can be any naturally occurring amino acid
  misc_feature (267)..(267): Xaa can be any naturally occurring amino acid
  misc_feature (269)..(269): Xaa can be any naturally occurring amino acid
  misc_feature (271)..(278): Xaa can be any naturally occurring amino acid
  misc_feature (281)..(282): Xaa can be any naturally occurring amino acid
  misc_feature (287)..(288): Xaa can be any naturally occurring amino acid
  misc_feature (291)..(291): Xaa can be any naturally occurring amino acid
  misc_feature (294)..(301): Xaa can be any naturally occurring amino acid

SEQ ID NO: 1966 - protein, 11 aa, Artificial
  conserved protein domain
  misc_feature (1)..(1): Xaa can be Ile or Val or Leu
  misc_feature (2)..(2): Xaa can be any naturally occurring amino acid
  misc_feature (3)..(3): Xaa can be Ile or Val or Leu
  misc_feature (4)..(6): Xaa can be any naturally occurring amino acid
  misc_feature (10)..(10): Xaa can be Ile or Val
  misc_feature (11)..(11): Xaa can be Ala or Ser
XXXXXXGGTXX

SEQ ID NO: 1967 - protein, 15 aa, Artificial
  conserved protein domain
  misc_feature (1)..(1): Xaa can be Gly or Ala
  misc_feature (2)..(2): Xaa can be any naturally occurring amino acid
  misc_feature (3)..(3): Xaa can be Val or Ile
  misc_feature (4)..(4): Xaa can be Val or Ile or Leu
  misc_feature (5)..(5): Xaa can be Thr or Ser
  misc_feature (6)..(6): Xaa can be His or Gln
  misc_feature (10)..(10): Xaa can be Thr or Ser
  misc_feature (11)..(11): Xaa can be Leu or Met or Val
  misc_feature (12)..(13): Xaa can be any naturally occurring amino acid
  misc_feature (14)..(14): Xaa can be Thr or Ser or Met
  misc_feature (15)..(15): Xaa can be Ala or Ser or Pro
XXXXXXGTDXXXXXX

SEQ ID NO: 1968 - protein, 21 aa, Artificial
  conserved protein domain
  misc_feature (2)..(2): Xaa can be Val or Ile or Leu
  misc_feature (3)..(3): Xaa can be Val or Ile or Cys
  misc_feature (4)..(5): Xaa can be any naturally occurring amino acid
  misc_feature (6)..(6): Xaa can be Gly or Ala
  misc_feature (7)..(7): Xaa can be Ala or Ser
  misc_feature (8)..(8): Xaa can be any naturally occurring amino acid
  misc_feature (9)..(9): Xaa can be Arg or Lys
  misc_feature (10)..(16): Xaa can be any naturally occurring amino acid
  misc_feature (18)..(18): Xaa can be Gly or Ala or Ser or Asn
  misc_feature (19)..(20): Xaa can be any naturally occurring amino acid
PXXXXXXXXXXXXXXXDXXXN

SEQ ID NO: 1969 - protein, 473 aa, Artificial
  conserved protein domain
  misc_feature (1)..(108): Xaa can be any naturally occurring amino acid
  misc_feature (115)..(159): Xaa can be any naturally occurring amino acid
  misc_feature (161)..(185): Xaa can be any naturally occurring amino acid
  misc_feature (187)..(187): Xaa can be any naturally occurring amino acid
  misc_feature (189)..(189): Xaa can be any naturally occurring amino acid
  misc_feature (196)..(196): Xaa can be any naturally occurring amino acid
  misc_feature (199)..(199): Xaa can be any naturally occurring amino acid
  misc_feature (201)..(202): Xaa can be any naturally occurring amino acid
  misc_feature (204)..(212): Xaa can be any naturally occurring amino acid
  misc_feature (214)..(214): Xaa can be any naturally occurring amino acid
  misc_feature (216)..(217): Xaa can be any naturally occurring amino acid
  misc_feature (219)..(220): Xaa can be any naturally occurring amino acid
  misc_feature (222)..(228): Xaa can be any naturally occurring amino acid
  misc_feature (231)..(232): Xaa can be any naturally occurring amino acid
  misc_feature (234)..(236): Xaa can be any naturally occurring amino acid
  misc_feature (238)..(240): Xaa can be any naturally occurring amino acid
  misc_feature (242)..(249): Xaa can be any naturally occurring amino acid
  misc_feature (252)..(252): Xaa can be any naturally occurring amino acid
  misc_feature (254)..(273): Xaa can be any naturally occurring amino acid
  misc_feature (275)..(282): Xaa can be any naturally occurring amino acid
  misc_feature (284)..(288): Xaa can be any naturally occurring amino acid
  misc_feature (290)..(291): Xaa can be any naturally occurring amino acid
  misc_feature (293)..(333): Xaa can be any naturally occurring amino acid
  misc_feature (335)..(358): Xaa can be any naturally occurring amino acid
  misc_feature (360)..(360): Xaa can be any naturally occurring amino acid
  misc_feature (362)..(365): Xaa can be any naturally occurring amino acid
  misc_feature (367)..(367): Xaa can be any naturally occurring amino acid
  misc_feature (369)..(388): Xaa can be any naturally occurring amino acid
  misc_feature (390)..(397): Xaa can be any naturally occurring amino acid
  misc_feature (399)..(429): Xaa can be any naturally occurring amino acid
  misc_feature (432)..(433): Xaa can be any naturally occurring amino acid
  misc_feature (435)..(437): Xaa can be any naturally occurring amino acid
  misc_feature (439)..(473): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTGGTIAXXXXXXXXXXXXXXXXXXXXXXXXXXXXXXXXXXXXXXXXXXXXXSXXXXXXXXXXXXXXXXXXXXXXXXXGXVXTHGTDTXEEXAXXLXXXXXXXXXPXVXXGXXRXXXXXXXDGXXNXXXAXXXAXXXXXXXXGVXVXXXXXXXXXXXXXXXXXXXXKXXXXXXXXFXXXXXGXXGXXXXXXXXXXXXXXXXXXXXXXXXXXXXXXXXXXXXXXXXXVXXXXXXXXXXXXXXXXXXXXXXXXGXVXXXXGXGXXXXXXXXXXXXXXXXXXXXVXXXXXXXXGXXXXXXXXXXXXXXXXXXXXXXXXXXXXXXXARXXLXXXLXXXXXXXXXXXXXXXXXXXXXXXXXXXXXXXXXXX

SEQ ID NO: 1970 - protein, 79 aa, Artificial
  conserved protein domain
  misc_feature (2)..(10): Xaa can be any naturally occurring amino acid
  misc_feature (11)..(12): Xaa can be any naturally occurring amino acid or can be omitted
  misc_feature (14)..(14): Xaa can be any naturally occurring amino acid
  misc_feature (16)..(23): Xaa can be any naturally occurring amino acid
  misc_feature (24)..(27): Xaa can be any naturally occurring amino acid or can be omitted
  misc_feature (28)..(28): Xaa can be Ala or Gly
  misc_feature (29)..(29): Xaa can be Ile or Val or Leu
  misc_feature (30)..(32): Xaa can be any naturally occurring amino acid
  misc_feature (35)..(37): Xaa can be any naturally occurring amino acid
  misc_feature (38)..(38): Xaa can be Ala or Ser
  misc_feature (39)..(39): Xaa can be any naturally occurring amino acid
  misc_feature (40)..(40): Xaa can be Val or Ile
  misc_feature (40)..(42): Xaa can be any naturally occurring amino acid
  misc_feature (45)..(45): Xaa can be Leu or Ile
  misc_feature (46)..(54): Xaa can be any naturally occurring amino acid
  misc_feature (55)..(55): Xaa can be Val or Ile
  misc_feature (56)..(56): Xaa can be Ala or Gln
  misc_feature (57)..(57): Xaa can be Serin or Ala
  misc_feature (59)..(60): Xaa can be any naturally occurring amino acid
  misc_feature (62)..(63): Xaa can be any naturally occurring amino acid
  misc_feature (65)..(65): Xaa can be any naturally occurring amino acid
  misc_feature (67)..(68): Xaa can be any naturally occurring amino acid
  misc_feature (70)..(70): Xaa can be any naturally occurring amino acid
  misc_feature (72)..(72): Xaa can be any naturally occurring amino acid
  misc_feature (73)..(73): Xaa can be Asp or Glu
  misc_feature (74)..(78): Xaa can be any naturally occurring amino acid
  misc_feature (79)..(79): Xaa can be Leu or Ile or Val
GXXXXXXXXXXXAXFXXXXXXXXXXXXXXXXXDPXXXXXXXXRGXXXXXXXXXXXXXPXXKXXFXLXXGXCXXXXXXXX

SEQ ID NO: 1971 - protein, 139 aa, Artificial
  conserved protein domain
  misc_feature (1)..(26): Xaa can be any naturally occurring amino acid
  misc_feature (28)..(36): Xaa can be any naturally occurring amino acid
  misc_feature (38)..(40): Xaa can be any naturally occurring amino acid
  misc_feature (42)..(46): Xaa can be any naturally occurring amino acid
  misc_feature (48)..(48): Xaa can be any naturally occurring amino acid
  misc_feature (50)..(50): Xaa can be any naturally occurring amino acid
  misc_feature (52)..(63): Xaa can be any naturally occurring amino acid
  misc_feature (65)..(66): Xaa can be any naturally occurring amino acid
  misc_feature (68)..(68): Xaa can be any naturally occurring amino acid
  misc_feature (71)..(73): Xaa can be any naturally occurring amino acid
  misc_feature (75)..(75): Xaa can be any naturally occurring amino acid
  misc_feature (77)..(77): Xaa can be any naturally occurring amino acid
  misc_feature (81)..(86): Xaa can be any naturally occurring amino acid
  misc_feature (88)..(90): Xaa can be any naturally occurring amino acid
  misc_feature (95)..(96): Xaa can be any naturally occurring amino acid
  misc_feature (99)..(99): Xaa can be any naturally occurring amino acid
  misc_feature (101)..(101): Xaa can be any naturally occurring amino acid
  misc_feature (103)..(104): Xaa can be any naturally occurring amino acid
  misc_feature (106)..(106): Xaa can be any naturally occurring amino acid
  misc_feature (108)..(139): Xaa can be any naturally occurring amino acid
XXXXXXXXXXXXXXXXXXXXXXXXXXCXXXXXXXXXGXXXLXXXXXQXAXFXXXXXXXXXXXXAXXNXDPXXXAXVXSRGXXXXXXGXXXVASPXXKQXFXLXXGXCXXXXXXXXXXXXXXXXXXXXXXXXXXXXXXXX

SEQ ID NO: 1972 - protein, 48 aa, Artificial
  conserved protein domain
  misc_feature (2)..(7): Xaa can be any naturally occurring amino acid
  misc_feature (10)..(30): Xaa can be any naturally occurring amino acid
  misc_feature (31)..(44): Xaa can be any naturally occurring amino acid or can be omitted
  misc_feature (45)..(45): Xaa can be Serin or Thr
  misc_feature (47)..(47): Xaa can be any naturally occurring amino acid
GXXXXXXGRXXXXXXXXXXXXXXXXXXXXXXXXXXXXXXXXXXXXGXG

SEQ ID NO: 1973 - protein, 613 aa, Artificial
  conserved protein domain
  misc_feature (1)..(48): Xaa can be any naturally occurring amino acid
  misc_feature (50)..(85): Xaa can be any naturally occurring amino acid
  misc_feature (87)..(99): Xaa can be any naturally occurring amino acid
  misc_feature (101)..(107): Xaa can be any naturally occurring amino acid
  misc_feature (109)..(116): Xaa can be any naturally occurring amino acid
  misc_feature (118)..(118): Xaa can be any naturally occurring amino acid
  misc_feature (120)..(125): Xaa can be any naturally occurring amino acid
  misc_feature (127)..(131): Xaa can be any naturally occurring amino acid
  misc_feature (133)..(134): Xaa can be any naturally occurring amino acid
  misc_feature (136)..(136): Xaa can be any naturally occurring amino acid
  misc_feature (138)..(157): Xaa can be any naturally occurring amino acid
  misc_feature (161)..(172): Xaa can be any naturally occurring amino acid
  misc_feature (174)..(191): Xaa can be any naturally occurring amino acid
  misc_feature (193)..(210): Xaa can be any naturally occurring amino acid
  misc_feature (212)..(214): Xaa can be any naturally occurring amino acid
  misc_feature (216)..(218): Xaa can be any naturally occurring amino acid
  misc_feature (220)..(305): Xaa can be any naturally occurring amino acid
  misc_feature (307)..(307): Xaa can be any naturally occurring amino acid
  misc_feature (309)..(312): Xaa can be any naturally occurring amino acid
  misc_feature (314)..(316): Xaa can be any naturally occurring amino acid
  misc_feature (318)..(322): Xaa can be any naturally occurring amino acid
  misc_feature (326)..(326): Xaa can be any naturally occurring amino acid
  misc_feature (328)..(330): Xaa can be any naturally occurring amino acid
  misc_feature (332)..(333): Xaa can be any naturally occurring amino acid
  misc_feature (336)..(336): Xaa can be any naturally occurring amino acid
  misc_feature (339)..(342): Xaa can be any naturally occurring amino acid
  misc_feature (344)..(344): Xaa can be any naturally occurring amino acid
  misc_feature (346)..(347): Xaa can be any naturally occurring amino acid
  misc_feature (349)..(369): Xaa can be any naturally occurring amino acid
  misc_feature (372)..(372): Xaa can be any naturally occurring amino acid
  misc_feature (375)..(442): Xaa can be any naturally occurring amino acid
  misc_feature (444)..(613): Xaa can be any naturally occurring amino acid
XXXXXXXXXXXXXXXXXXXXXXXXXXXXXXXXXXXXXXXXXXXXXXXXGXXXXXXXXXXXXXXXXXXXXXXXXXXXXXXXXXXXXLXXXXXXXXXXXXXVXXXXXXXEXXXXXXXXGXGXXXXXXGXXXXXAXXMXGXXXXXXXXXXXXXXXXXXXXGAVXXXXXXXXXXXXAXXXXXXXXXXXXXXXXXXHXXXXXXXXXXXXXXXXXXAXXXAXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXTXGXXXXDXXXGXXXXXTSTXGXXXKXXGRXGDXXXXGXGXXAXXXXXXXXXXXXXXXXXXXXXTGXGEXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 1974 - protein, 117 aa, Artificial
  conserved protein domain
  misc_feature (1)..(1): Xaa can be Val or Leu or Ile or Thr
  misc_feature (2)..(16): Xaa can be any naturally occurring amino acid
  misc_feature (17)..(17): Xaa can be Asp or Glu or Ser or Lys
  misc_feature (18)..(18): Xaa can be any naturally occurring amino acid
  misc_feature (19)..(19): Xaa can be Leu or Ile or Val or Phe
  misc_feature (20)..(23): Xaa can be any naturally occurring amino acid
  misc_feature (24)..(24): Xaa can be any naturally occurring amino acid or can be omitted
  misc_feature (25)..(25): Xaa can be Gly or Ser
  misc_feature (26)..(26): Xaa can be Val or Ile or Leu or Phe
  misc_feature (27)..(45): Xaa can be any naturally occurring amino acid
  misc_feature (46)..(46): Xaa can be Arg or Gln or Leu
  misc_feature (47)..(47): Xaa can be Gly or Asn
  misc_feature (48)..(53): Xaa can be any naturally occurring amino acid
  misc_feature (54)..(54): Xaa can be Leu or Val
  misc_feature (55..(55): Xaa can be Val or Ile or Leu or Phe or Thr
  misc_feature (56)..(56): Xaa can be Leu or Val
  misc_feature (57)..(57): Xaa can be Ile or Val or Leu or Met
  misc_feature (58)..(58): Xaa can be any naturally occurring amino acid
  misc_feature (60)..(75): Xaa can be any naturally occurring amino acid
  misc_feature (76)..(85): Xaa can be any naturally occurring amino acid or can be omitted
  misc_feature (86)..(86): Xaa can be Pro or Asn or Glu or Leu
  misc_feature (87)..(89): Xaa can be any naturally occurring amino acid
  misc_feature (90)..(90): Xaa can be Ile or Leu or Val
  misc_feature (91)..(91): Xaa can be any naturally occurring amino acid
  misc_feature (92)..(92): Xaa can be Arg or lys or Gln or Ala
  misc_feature (93)..(93): Xaa can be Ile or Val
  misc_feature (94)..(94): Xaa can be Glu or Asp
  misc_feature (95)..(96): Xaa can be any naturally occurring amino acid
  misc_feature (97)..(97): Xaa can be Arg or Lys or Ser
  misc_feature (99)..(100): Xaa can be any naturally occurring amino acid
  misc_feature (101)..(101): Xaa can be Ser or Ala
  misc_feature (102)..(103): Xaa can be any naturally occurring amino acid
  misc_feature (104)..(104): Xaa can be Tyr or Trp
  misc_feature (106)..(106): Xaa can be Ser or Ala or Asn
  misc_feature (107)..(107): Xaa can be any naturally occurring amino acid
  misc_feature (108)..(108): Xaa can be Ala or Ser
  misc_feature (109)..(109): Xaa can be any naturally occurring amino acid
  misc_feature (110)..(110): Xaa can be Gly or Ser
  misc_feature (112)..(115): Xaa can be Val or Ile or Leu
  misc_feature (113)..(113): Xaa can be Val or Ile
  misc_feature (114)..(114): Xaa can be Asn or Gln or His
  misc_feature (115)..(115): Xaa can be Ile or Val or Leu or Phe
  misc_feature (116)..(116): Xaa can be any naturally occurring amino acid
  misc_feature (117)..(117): Xaa can be Thr or Leu
XXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXGXXXXXXGXXXXXGXXXXXX

SEQ ID NO: 1975 - protein, 177 aa, Artificial
  conserved protein domain
  misc_feature (2)..(2): Xaa can be any naturally occurring amino acid
  misc_feature (3)..(3): Xaa can be Asp or Glu or Ser or Asn
  misc_feature (4)..(8): Xaa can be any naturally occurring amino acid
  misc_feature (9)..(23): Xaa can be any naturally occurring amino acid or can be omitted
  misc_feature (24)..(24): Xaa can be Gly or Asp or Glu
  misc_feature (25)..(27): Xaa can be any naturally occurring amino acid
  misc_feature (28)..(28): Xaa can be Thr or Ser or Asn or Leu
  misc_feature (29)..(49): Xaa can be any naturally occurring amino acid
  misc_feature (50)..(51): Xaa can be any naturally occurring amino acid or can be omitted
  misc_feature (52)..(52): Xaa can be Phe or Tyr or Gln
  misc_feature (53)..(53): Xaa can be Lys or Arg or Thr
  misc_feature (54)..(54): Xaa can be any naturally occurring amino acid
  misc_feature (56)..(68): Xaa can be any naturally occurring amino acid
  misc_feature (69)..(91): Xaa can be any naturally occurring amino acid or can be omitted
  misc_feature (93)..(94): Xaa can be any naturally occurring amino acid
  misc_feature (96)..(100): Xaa can be any naturally occurring amino acid
  misc_feature (101)..(101): Xaa can be Glu or Ser or Thr or Gln
  misc_feature (102)..(117): Xaa can be any naturally occurring amino acid
  misc_feature (118)..(122): Xaa can be any naturally occurring amino acid or can be omitted
  misc_feature (123..(123): Xaa can be Phe or Tyr
  misc_feature (124)..(130): Xaa can be any naturally occurring amino acid
  misc_feature (131)..(131): Xaa can be Ile or Leu or Val
  misc_feature (132)..(147): Xaa can be any naturally occurring amino acid
  misc_feature (148)..(174): Xaa can be any naturally occurring amino acid or can be omitted
  misc_feature (96)..(174): Xaa can be any naturally occurring amino acid
  misc_feature (176)..(176): Xaa can be any naturally occurring amino acid
  misc_feature (177)..(177): Xaa can be Glu or Thr
RXXXXXXXXXXXXXXXXXXXXXXXXXXXXXXXXXXXXXXXXXXXXXXXXXXXXXPXXXXXXXXXXXXXXXXXXXXXXXXXXXXXXXXXXXXLXXEXXXXXXXXXXXXXXXXXXXXXXXXXXXXXXXXXXXXXXXXXXXXXXXXXXXXXXXXXXXXXXXXXXXXXXXXXXXXXXXGXX

SEQ ID NO: 1976 - protein, 877 aa, Artificial
  conserved protein domain
  misc_feature (1)..(96): Xaa can be any naturally occurring amino acid
  misc_feature (98)..(138): Xaa can be any naturally occurring amino acid
  misc_feature (140)..(159): Xaa can be any naturally occurring amino acid
  misc_feature (162)..(167): Xaa can be any naturally occurring amino acid
  misc_feature (169)..(169): Xaa can be any naturally occurring amino acid
  misc_feature (171)..(171): Xaa can be any naturally occurring amino acid
  misc_feature (174)..(199): Xaa can be any naturally occurring amino acid
  misc_feature (201)..(205): Xaa can be any naturally occurring amino acid
  misc_feature (209)..(210): Xaa can be any naturally occurring amino acid
  misc_feature (214)..(217): Xaa can be any naturally occurring amino acid
  misc_feature (221)..(221): Xaa can be any naturally occurring amino acid
  misc_feature (223)..(223): Xaa can be any naturally occurring amino acid
  misc_feature (227)..(227): Xaa can be any naturally occurring amino acid
  misc_feature (230)..(230): Xaa can be any naturally occurring amino acid
  misc_feature (232)..(522): Xaa can be any naturally occurring amino acid
  misc_feature (524)..(524): Xaa can be any naturally occurring amino acid
  misc_feature (526)..(545): Xaa can be any naturally occurring amino acid
  misc_feature (547)..(575): Xaa can be any naturally occurring amino acid
  misc_feature (578)..(610): Xaa can be any naturally occurring amino acid
  misc_feature (612)..(613): Xaa can be any naturally occurring amino acid
  misc_feature (615)..(615): Xaa can be any naturally occurring amino acid
  misc_feature (618)..(618): Xaa can be any naturally occurring amino acid
  misc_feature (620)..(622): Xaa can be any naturally occurring amino acid
  misc_feature (624)..(652): Xaa can be any naturally occurring amino acid
  misc_feature (654)..(696): Xaa can be any naturally occurring amino acid
  misc_feature (698)..(698): Xaa can be any naturally occurring amino acid
  misc_feature (700)..(741): Xaa can be any naturally occurring amino acid
  misc_feature (743)..(825): Xaa can be any naturally occurring amino acid
  misc_feature (827)..(863): Xaa can be any naturally occurring amino acid
  misc_feature (866)..(874): Xaa can be any naturally occurring amino acid
  misc_feature (876)..(877): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXXXXXXXXXXXXXXXXXXXXXXXXXGXXXXXXXXXXXXXXXXXXXXRGXXXXXXLXLXDGXXXXXXXXXXXXXXXXXXXXXXXXXXPXXXXXRIEXXRGPXXXXYGSXAXGGVXNIXTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXDXXXXXXXXXXXXXXXXXXXXGXXXXXXXXXXXXXXXXXXXXXXXXXXXXXAPXXXXXXXXXXXXXXXXXXXXXXXXXXXXXXXXXNXXLXPEXSXXXEXXXXXXXXXXXXXXXXXXXXXXXXXXXXXIXXXXXXXXXXXXXXXXXXXXXXXXXXXXXXXXXXXXXXXXXXXGXEXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXXXXXXXXGRXXXXXXXXXFXX

SEQ ID NO: 1977 - protein, 38 aa, Artificial
  conserved protein domain
  misc_feature (1)..(1): Xaa can be Pro or Leu
  misc_feature (5)..(5): Xaa can be any naturally occurring amino acid
  misc_feature (6)..(6): Xaa can be Glu or Ala
  misc_feature (8)..(9): Xaa can be any naturally occurring amino acid
  misc_feature (11)..(11): Xaa can be any naturally occurring amino acid
  misc_feature (12)..(12): Xaa can be Leu or Met
  misc_feature (14)..(14): Xaa can be Gly or Ser
  misc_feature (17)..(17): Xaa can be Gly or Thr
  misc_feature (18)..(20): Xaa can be any naturally occurring amino acid
  misc_feature (22)..(22): Xaa can be Ile or Leu or Met
  misc_feature (23)..(24): Xaa can be any naturally occurring amino acid
  misc_feature (26)..(27): Xaa can be any naturally occurring amino acid
  misc_feature (28)..(28): Xaa can be Ile or Val
  misc_feature (29)..(29): Xaa can be Leu or Ile or Ala
  misc_feature (30)..(30): Xaa can be Leu or Ile or Val
  misc_feature (31)..(31): Xaa can be Leu or Val or Ile or Thr
  misc_feature (32)..(32): Xaa can be Gly or Ala
  misc_feature (33)..(33): Xaa can be any naturally occurring amino acid
  misc_feature (34)..(34): Xaa can be Leu or Met or Ala
  misc_feature (35)..(35): Xaa can be any naturally occurring amino acid
  misc_feature (37)..(37): Xaa can be any naturally occurring amino acid
  misc_feature (38)..(38): Xaa can be Gly or Glu
XKRSXXPXXWXXFXAGXXXXAXXXPXXXXXXXXXXPXX

SEQ ID NO: 1978 - protein, 19 aa, Artificial
  conserved protein domain
  misc_feature (1)..(1): Xaa can be Pro or Leu
  misc_feature (2)..(2): Xaa can be Leu or Met
  misc_feature (4)..(4): Xaa can be any naturally occurring amino acid
  misc_feature (5)..(5): Xaa can be Gly or Ala
  misc_feature (6)..(6): Xaa can be Leu or Met or Ala
  misc_feature (9)..(9): Xaa can be Ile or Val or Met
  misc_feature (10)..(10): Xaa can be His or Tyr
  misc_feature (12)..(12): Xaa can be any naturally occurring amino acid
  misc_feature (13)..(13): Xaa can be Met or Leu
  misc_feature (16)..(16): Xaa can be any naturally occurring amino acid
  misc_feature (17)..(17): Xaa can be Lys or Gly
  misc_feature (18)..(18): Xaa can be any naturally occurring amino acid
XXWXXXHRXXHXXHDXXXH

SEQ ID NO: 1979 - protein, 130 aa, Artificial
  conserved protein domain
  misc_feature (1)..(15): Xaa can be any naturally occurring amino acid
  misc_feature (20)..(20): Xaa can be any naturally occurring amino acid
  misc_feature (23)..(24): Xaa can be any naturally occurring amino acid
  misc_feature (26)..(26): Xaa can be any naturally occurring amino acid
  misc_feature (33)..(35): Xaa can be any naturally occurring amino acid
  misc_feature (37)..(39): Xaa can be any naturally occurring amino acid
  misc_feature (41)..(43): Xaa can be any naturally occurring amino acid
  misc_feature (45)..(46): Xaa can be any naturally occurring amino acid
  misc_feature (48)..(50): Xaa can be any naturally occurring amino acid
  misc_feature (52)..(52): Xaa can be any naturally occurring amino acid
  misc_feature (54)..(67): Xaa can be any naturally occurring amino acid
  misc_feature (69)..(70): Xaa can be any naturally occurring amino acid
  misc_feature (72)..(73): Xaa can be any naturally occurring amino acid
  misc_feature (75)..(84): Xaa can be any naturally occurring amino acid
  misc_feature (86)..(86): Xaa can be any naturally occurring amino acid
  misc_feature (88)..(90): Xaa can be any naturally occurring amino acid
  misc_feature (93)..(93): Xaa can be any naturally occurring amino acid
  misc_feature (96)..(97): Xaa can be any naturally occurring amino acid
  misc_feature (100)..(100): Xaa can be any naturally occurring amino acid
  misc_feature (102)..(102): Xaa can be any naturally occurring amino acid
  misc_feature (104)..(112): Xaa can be any naturally occurring amino acid
  misc_feature (115)..(115): Xaa can be any naturally occurring amino acid
  misc_feature (117)..(130): Xaa can be any naturally occurring amino acid
XXXXXXXXXXXXXXXPKRSXEPXXWXLFGAGGXXXAXXXPXXXLXXGXXXPXGXXXXXXXXXXXXXXFXXSXXGXXXXXXXXXXPXWXXXHRXHHXXHDXKXHXXXXXXXXXYGXAXXXXXXXXXXXXXX

SEQ ID NO: 1980 - protein, 130 aa, Artificial
  conserved protein domain
  misc_feature (1)..(16): Xaa can be any naturally occurring amino acid
  misc_feature (20)..(21): Xaa can be any naturally occurring amino acid
  misc_feature (23)..(24): Xaa can be any naturally occurring amino acid
  misc_feature (26)..(27): Xaa can be any naturally occurring amino acid
  misc_feature (29)..(29): Xaa can be any naturally occurring amino acid
  misc_feature (32)..(35): Xaa can be any naturally occurring amino acid
  misc_feature (37)..(39): Xaa can be any naturally occurring amino acid
  misc_feature (41)..(50): Xaa can be any naturally occurring amino acid
  misc_feature (52)..(73): Xaa can be any naturally occurring amino acid
  misc_feature (75)..(86): Xaa can be any naturally occurring amino acid
  misc_feature (88)..(90): Xaa can be any naturally occurring amino acid
  misc_feature (93)..(94): Xaa can be any naturally occurring amino acid
  misc_feature (96)..(97): Xaa can be any naturally occurring amino acid
  misc_feature (100)..(102): Xaa can be any naturally occurring amino acid
  misc_feature (104)..(112): Xaa can be any naturally occurring amino acid
  misc_feature (114)..(130): Xaa can be any naturally occurring amino acid
XXXXXXXXXXXXXXXXKRSXXPXXWXXFXAGXXXXAXXXPXXXXXXXXXXPXXXXXXXXXXXXXXXXXXXXXXGXXXXXXXXXXXXWXXXHRXXHXXHDXXXHXXXXXXXXXYXXXXXXXXXXXXXXXXX

SEQ ID NO: 1981 - protein, 335 aa, Artificial
  conserved protein domain
  misc_feature (1)..(95): Xaa can be any naturally occurring amino acid
  misc_feature (97)..(102): Xaa can be any naturally occurring amino acid
  misc_feature (104)..(137): Xaa can be any naturally occurring amino acid
  misc_feature (139)..(144): Xaa can be any naturally occurring amino acid
  misc_feature (146)..(150): Xaa can be any naturally occurring amino acid
  misc_feature (152)..(184): Xaa can be any naturally occurring amino acid
  misc_feature (186)..(188): Xaa can be any naturally occurring amino acid
  misc_feature (190)..(195): Xaa can be any naturally occurring amino acid
  misc_feature (198)..(199): Xaa can be any naturally occurring amino acid
  misc_feature (201)..(222): Xaa can be any naturally occurring amino acid
  misc_feature (224)..(225): Xaa can be any naturally occurring amino acid
  misc_feature (227)..(232): Xaa can be any naturally occurring amino acid
  misc_feature (234)..(236): Xaa can be any naturally occurring amino acid
  misc_feature (238)..(240): Xaa can be any naturally occurring amino acid
  misc_feature (242)..(243): Xaa can be any naturally occurring amino acid
  misc_feature (245)..(252): Xaa can be any naturally occurring amino acid
  misc_feature (254)..(261): Xaa can be any naturally occurring amino acid
  misc_feature (263)..(263): Xaa can be any naturally occurring amino acid
  misc_feature (265)..(283): Xaa can be any naturally occurring amino acid
  misc_feature (285)..(335): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXGXXXXXXXXXXXXXXXXXXXXXXXXXXXXXXXXXXAXXXXXXLXXXXXEXXXXXXXXXXXXXXXXXXXXXXXXXXXXXXXXXGXXXPXXXXXXGKXXLXXXXXXXXXXXXXXXXXXXXXXTXXTXXXXXXLXXXLXXXRXXGXXXXXXXXEXXXXXXXXAXPXXXXXXXXXXXXXXXXXXXRXXXXXXXXXXXXXXXXXXXXXXXXXXXXXXXXXXXXXXXXXXXXXXXXXXX

SEQ ID NO: 1982 - DNA, 2685 bp, Escherichia coli K12
  CDS (1)..(2685)
atgaataacgaacccttacgtcccgaccccgatcgtctgctggaacaaactgccgcgccgcatcgggggaagctgaaagttttcttcggtgcctgtgcaggcgtcgggaagacctgggcgatgctggcagaagcccagcgactgcgggcgcaagggctggatattgtggttggcgtggtagaaacccacgggcgaaaagataccgccgccatgctggaagggctggctgttctgccgttaaaacgccaggcgtaccgtgggcggcatatcagcgagtttgatctcgatgccgccctcgcccgccgcccggcgctgatcttaatggacgaactggcgcacagtaatgcgccaggttcccgtcatcccaaacgctggcaggatatcgaagaactgctggaagctggcattgatgttttcactaccgtcaacgttcagcatctggaaagtctgaatgatgtggtcagcggcgtcaccggaattcaggtacgggaaaccgtgcccgatccttttttcgatgccgccgacgacgtggtgctggtggacttgcccccggacgatctgcgccagcggctgaaagaaggcaaagtctatattgccgggcaggcggagcgcgccattgaacattttttccgcaaaggtaatctgatcgccctgcgcgaactggcactgcgccgtactgccgatcgcgttgatgagcaaatgcgcgcctggcgggggcatcctggcgaagagaaagtgtggcacacgcgcgacgcgatccttttatgcatcggccataacaccggcagcgaaaaactggtccgcgcagcggcgcggctggcgtcacggctgggtagcgtctggcacgcggtgtatgttgaaacccctgccctgcaccgcttaccggaaaaaaaacgtcgggcaattctcagcgccttacgtctggcgcaggaactgggcgcggagacggcaacactttctgatccagcggaagagaaagcggtagtgcgttatgcccgtgaacataatctcggcaagattattctcggtcgcccggcctcgcgccgctggtggcgtcgggaaacgtttgctgaccgactggcgcgcatcgcccccgatctcgatcaggtgctggtcgcgcttgatgaaccacccgcccgcacgattaacaacgcgccggataaccgctcttttaaagacaagtggcgtgtacaaattcagggatgcgtggttgccgccgcgttatgcgccgttatcaccttaattgccatgcagtggctgatggcgtttgatgccgccaacctggtgatgctgtatctgcttggcgtggtggtggtggcgctattttatggacgctggccttcagtggttgccaccgtcattaatgtagtgagtttcgatctcttttttatcgccccacgcggcacgctcgccgtctctgatgtgcaatatctgctgaccttcgcggtgatgttaaccgtcgggctggtgatcgggaaccttactgctggcgtgcgttatcaggcgcgggtagcccgttaccgcgagcaacgcacacggcacttatatgaaatgtcgaaagctctggcggtgggccgcagtccgcaggatatcgctgccaccagcgaacaatttattgcctccacgtttcatgcccgcagtcaggtgttgttgcccgatgacaacggtaaattgcagccgttaacacatccgcaaggaatgacgccgtgggacgatgccatcgcgcagtggagttttgataaaggcctgcctgcgggcgcgggcaccgacacgttacccggtgtaccgtaccagattttgccgctaaaaagcggcgagaaaacctacgggctggtggtggtggagccggggaatctgcgccagttgatgatcccggaacagcagcgcctgctggagacgtttacgctgttagtcgccaatgcccttgagcggctgacgctaaccgccagcgaagaacaggcgcggatggcaagcgaacgtgaacagatccgcaacgccctgctggcggcgctttcgcatgatttacgcacgccgcttacggtgctgtttggtcaggcagaaatcttaacgctcgatctggcaagcgaaggatcaccccacgcccgccaggccagcgagatccgtcagcatgtgctgaacactacccgactggtgaataatctactggatatggcgcgaattcagtccggcggctttaatttgaagaaagagtggttaacgctggaagaagtagtcggcagcgcgctgcaaatgctggaaccgggtttatcgtcgcccatcaatctttctctgccagaaccgctgaccttaatccacgttgacgggccactctttgaacgggtgctgattaatctgctggagaacgcggtgaaatatgcgggtgcgcaggccgaaattggtatcgatgcccacgttgagggcgaaaatctacaactggatgtctgggataacggccccggtcttccgccaggccaggagcagacgatatttgataagtttgctcgcgggaataaagagtcggcagtaccgggggtagggcttggactggcaatttgtcgggcgatagtggatgtacacgggggcactattaccgcgttcaaccgaccggaaggtggtgcctgttttcgtgttacacttccccagcaaactgcccctgaacttgaagaatttcatgaggatatgtga

SEQ ID NO: 1983 - protein, 894 aa, Escherichia coli K12
MNNEPLRPDPDRLLEQTAAPHRGKLKVFFGACAGVGKTWAMLAEAQRLRAQGLDIVVGVVETHGRKDTAAMLEGLAVLPLKRQAYRGRHISEFDLDAALARRPALILMDELAHSNAPGSRHPKRWQDIEELLEAGIDVFTTVNVQHLESLNDVVSGVTGIQVRETVPDPFFDAADDVVLVDLPPDDLRQRLKEGKVYIAGQAERAIEHFFRKGNLIALRELALRRTADRVDEQMRAWRGHPGEEKVWHTRDAILLCIGHNTGSEKLVRAAARLASRLGSVWHAVYVETPALHRLPEKKRRAILSALRLAQELGAETATLSDPAEEKAVVRYAREHNLGKIILGRPASRRWWRRETFADRLARIAPDLDQVLVALDEPPARTINNAPDNRSFKDKWRVQIQGCVVAAALCAVITLIAMQWLMAFDAANLVMLYLLGVVVVALFYGRWPSVVATVINVVSFDLFFIAPRGTLAVSDVQYLLTFAVMLTVGLVIGNLTAGVRYQARVARYREQRTRHLYEMSKALAVGRSPQDIAATSEQFIASTFHARSQVLLPDDNGKLQPLTHPQGMTPWDDAIAQWSFDKGLPAGAGTDTLPGVPYQILPLKSGEKTYGLVVVEPGNLRQLMIPEQQRLLETFTLLVANALERLTLTASEEQARMASEREQIRNALLAALSHDLRTPLTVLFGQAEILTLDLASEGSPHARQASEIRQHVLNTTRLVNNLLDMARIQSGGFNLKKEWLTLEEVVGSALQMLEPGLSSPINLSLPEPLTLIHVDGPLFERVLINLLENAVKYAGAQAEIGIDAHVEGENLQLDVWDNGPGLPPGQEQTIFDKFARGNKESAVPGVGLGLAICRAIVDVHGGTITAFNRPEGGACFRVTLPQQTAPELEEFHEDM

SEQ ID NO: 1984 - DNA, 2679 bp, Caulobacter crescentus
  CDS (1)..(2679)
atgccggtggacgacccgaaacgaccggaccccgaagcgctcctggccgccgccaacaaggcgcgccgggggcgcctgaaagtgtttctgggcatggcgccgggcgtgggcaagacctacgagatgctgcgcgccgcccgtcgccgcaaggccgagggcgctgatgtgctgatcggggtcgtcgagacccatgggcgacgcgaaaccgaaagcctgctgcgcggcatggacgtgctgccacgtcggccgatcgagcatcgcggccgcgtccagatggagttcgacatcgatgcggcccttgagcgcaagcccaagatcctgctggtcgatgagtacgcccattccaacgccatcggctcgcggcatcccaagcgctggcaggatgtcgaagagctgcttgcggcgggcatcgatgtctggaccacgctgaacgtccagcacctggagagcctggtcgacgtcgtccagcgcatcaccggcgtgcgccagcgcgagacggtgcccgacagcgccctctctcgcgccgacgacatcgagctggtggacatcacgcccgacgagctgcgggagcggatggcggccggcaaggtctatgtgcccgagacggcgcgccttgcggcggacaacttcttcaaggtcgagaacctcacggcgctgcgggaactggcgctgcgccgggcggcccagacggtggacgatcagctgatcgccaccatgcgcgagaagggggtcgaggggccctgggccgccggtgaacggatcctggtgctggtcagcggcgacgccatggccgccaccctggtgcgggccggccggcgcctgtcggacatgatgatggacgccccgtggatcgtcacccatgtcgagcggaccgatcggccgctggccagggatggcgacgcggcgcggctgcgcgaggcctaccgcctggccgagcaactggggggcgcgacggtggccctcagcggtggggacatcgtcgatacggtgatggcctatgcgcggcgtcacaacgtcacccagatcgtgatcggcaagtccgtcgagagccgctggcgggagcttctggagcggtccctggccggggccctgctgcgcgaagcgcgcggcgtcgcggttcacgtcgtcaccgaggccgcgcccgagcgtgagccgagaccgcccgcgccgctccggcccgatcgttggcgcggctatgcggtcggcgccctgttcatcgcagcggccacactggcggcctggggcctggacgtggcgttcaatcgtgtcgacctggggatgatcttcctgacggccgtcctggcggcgggcgtgctgcatggcttgcggcccgcgctggcggcggcgaccgtggcgtttctggtctacaattgtctgttcctggagccgcgctacagtttcgtggtcggctcgcccaccgacttcatcacgctggtggtgttctgggcggtggccctcgcgtctggcggacttgctggccgggtgcgtgagcaggccctcggctcgcaacgtcgcgccgccgctgtcaccacgctgctggccgccagccgcacgttctccgccgccagcggccgcgacgccgtggccaaggcgctggccgaacaggtctccgccgctgcgggggggctcgccgtcgtgcttctgccccagggggacgagatcgcgctcgcgcacgggtcaccggagctggcccctctggacgccgcccagatggccgccgcgcgctgggcctgggacaagggcgaagtcgccggcttcgggacgggcaccttgccgcagagccggtggactttctggccgctggacggtgtccgcgcccggacgggcgtggccggcctggcggcgggcgcagcgccgctgggcgcagaccaggagcgcctcgtcctggcgctgctggaacagggcgccgtggcgctggagcgctcgcaactcgcggccgaggcggtcgagaccgaaacgcttcgccgcgccgatcgcttccgctcggctctgatgaactcggtcagccatgacctgcgcacgccgctatcgacggtgctgggggcctccacgaccctgatcgactatggcgacaagctggccaagcccgtgcgggaggaccttgtcgtcagcatccgggaggaggctgaacggctcaatcgctatgtcgccaacctgctcgacatgacgcgcatcgagggcggcgccctgcgcctgcggaccgactggatcgacgtccgcgatgtcctgaacgccgctgcggaccgggtgtcgcgtcggcttggcggccgcgagctcgcccgggactttccgcgcgagctgtctctgatccaggccgatgcgagcttgctggaacaggtggtcgtcaatgttctggagaatgcgatcgcctacagcccgccagaagcgcgcatcgaaatggccgcctatgaggatcgcgccaacgtggtgatcagcatcgaggacgaggggcgcgggataccgacctccgagctggagcgggtgttcgacaagttccgccgcatggaggagcccagcgaccgcactcagggggcgggcctggggctttcgatcgccaagggcttcatcgacgcgctgggcggacgtatcgccgccgccagcccgattcacgatggaaggggcacgcggattctcatcagcctgcccaagaccgtcacgacgccgcatcacctgctatga

SEQ ID NO: 1985 - protein, 892 aa, Caulobacter crescentus
MPVDDPKRPDPEALLAAANKARRGRLKVFLGMAPGVGKTYEMLRAARRRKAEGADVLIGVVETHGRRETESLLRGMDVLPRRPIEHRGRVQMEFDIDAALERKPKILLVDEYAHSNAIGSRHPKRWQDVEELLAAGIDVWTTLNVQHLESLVDVVQRITGVRQRETVPDSALSRADDIELVDITPDELRERMAAGKVYVPETARLAADNFFKVENLTALRELALRRAAQTVDDQLIATMREKGVEGPWAAGERILVLVSGDAMAATLVRAGRRLSDMMMDAPWIVTHVERTDRPLARDGDAARLREAYRLAEQLGGATVALSGGDIVDTVMAYARRHNVTQIVIGKSVESRWRELLERSLAGALLREARGVAVHVVTEAAPEREPRPPAPLRPDRWRGYAVGALFIAAATLAAWGLDVAFNRVDLGMIFLTAVLAAGVLHGLRPALAAATVAFLVYNCLFLEPRYSFVVGSPTDFITLVVFWAVALASGGLAGRVREQALGSQRRAAAVTTLLAASRTFSAASGRDAVAKALAEQVSAAAGGLAVVLLPQGDEIALAHGSPELAPLDAAQMAAARWAWDKGEVAGFGTGTLPQSRWTFWPLDGVRARTGVAGLAAGAAPLGADQERLVLALLEQGAVALERSQLAAEAVETETLRRADRFRSALMNSVSHDLRTPLSTVLGASTTLIDYGDKLAKPVREDLVVSIREEAERLNRYVANLLDMTRIEGGALRLRTDWIDVRDVLNAAADRVSRRLGGRELARDFPRELSLIQADASLLEQVVVNVLENAIAYSPPEARIEMAAYEDRANVVISIEDEGRGIPTSELERVFDKFRRMEEPSDRTQGAGLGLSIAKGFIDALGGRIAAASPIHDGRGTRILISLPKTVTTPHHLL

SEQ ID NO: 1986 - DNA, 2709 bp, Salmonella enterica subsp. enterica serovar Typhi
  CDS (1)..(2709)
atgaacgacgaacccttgcgtcctgatccggatcgcttgttggaacaaacgcccccgccccaccgggggaagttaaaaattttcttcggcgcctgcgcaggcgtcggaaaaacctgggcgatgctggcgcaagcgcagcggctgcgagcgcaggggctggatgtggtgatcggcgtggtagagacgcacggccgtaaagagaccgccgcgctacttgacgggctgaccattctgccgccaaaacgtcactcgcaccgggggcggcaaattcgcgaatttgacctggatgccgccctcgcccggcgtccggcgctgattttaatggatgagctggcgcacagtaacgcgcctggctcacgccatcctaagcgctggcaggatattgaagagctgctggaagcgggaatcgacgttttcaccaccgtgaacgtacaacatctggaaagtctgaatgatgtggtgagcggcgtcacggggattcaggtgcgcgagaccgtccccgatcccttttttgatgccgctgatgaagtcgtactggtcgatctgccgcccgacgatctgcgccaacggctcaacgaaggtaaagtgtatatcgccggtcaggcggaacgcgctattgaacattttttccgcaagggcaatctgatcgccctccgcgagctggcgctacgccggacagccgatcgcgtggacgatcagatgcgcgcctggcgcgcgcatccgggcgaagaaaaagtatggcatacccgcgatgcgattttactgtgtatcgggcataacactggcagcgaaaaactggtgcgtaccgcggcgcgtctggcctcccggctcggcagcgtctggcacgccgtctatgtcgaaacgccaacgttacaccgcttaccggaaaaacaacggcgggctattttaagcgcgctgcgcctggcgcaggagcttggcgcggaaaccgccaccctgtccgatcccgccgaagagaaagcggtcgtgcgctatgcccgcgagcataatctggggaaaatcgtcatgggccgcccggcgtcgcgacgctggtggcgacgtgacgctttcgccgaccgtcttgccaggcgcgcgccggatctcgatcaggtaatcgtcgcgctggaagagccgccagcgcgcgcgttggcgcaaacgcctgataaccgaccttttaaagagaaatggcgtggacagattcagggctgtctggtcgccgtggcgctttgcgccataaccacgtttatcgctatgcagtggcttgtcaccttcgacgccgccaatctggtgatgctctatttgctgggcgtagtggtgattgcgctgctttacggacgctggccgtcggtggtggcgacggtgattaacgtggcgagtttcgatctcttttttatcgcaccacgcggtacgctcgccgtttcggacgtgcagtatttgctgacctttgccgtgatgctgacggttggtctggtgattggcaatcttactgccggggtgcgctatcaggcgcgcgtcgcccgttatcgggaacagcgtacccgccatttatatgaaatgtctaaagcgctggccgtcgggcgtagcgaacatgatatcgccgcgaccagcgagcggtttatcgcctcgacgtgtcaggcgcgcagccaaattttattacctgatactaacggtaagttgctgcctctcacccaccagcaaggcatgacgccgtgggacgacgcaattgcgcgctggagttttgataaaggccagcctgccggcgcaggcaccgatacccttcctggcgtgccttatcaaatcctgccgctgaaaagcgccgataaaacgtacggtctggctatcgtcgaaccgggtaatttgcgtcagttaatggtgccggagcagcaacgcctgctggaaacattcactctgcttgtcgccaacgcgctggaacgactgacgctgaccgccagcgaagaacaggcgcgtctcgccagcgaagaacaggcgcgtctcgccagcgagcgcgaaagtattcgcaacgctctgctggcggctctgtcgcatgatttacgcacgccgctgacggtattgttcggccaggcggaaattttgacgctggatttagccagcgcaggatcgccccacgcgcgtcaggccagtgaaatccgccagcatattctcaacaccacccggctggtgaataatttgctggatatggcgcgtattcagtccggcgggtttaatcttaaaaaagagtggctgacgctggaagaggtcgtcggtagcgcgttacagatgttagagccgggtttattgcatccgattacattgtcgctgccgcaacagttaacgcttatccatgtcgatggccccttatttgagcgtgtcctgatcaacttgctggaaaacgccgttaagtacgccgggccgcaggccagtatcggcattgatgctgcggttaaggacaatcgtttacaactggatgtctgggataatgggccgggtattcctgcggggcaagaacagaagattttcgataagttcgcccgcggcaacaaagagtccgccgtccccggcgtggggctggggctggcgatttgccatgctatcgtagaggtacacggcggcacgcttaccgcctataatcgaccgcagggcggcgcctgtttccgtgtgacgctgccgcaaggaaagccacctgaacttgacgattttcatgaggatatgtga

SEQ ID NO: 1987 - protein, 902 aa, Salmonella enterica subsp. enterica serovar Typhi
MNDEPLRPDPDRLLEQTPPPHRGKLKIFFGACAGVGKTWAMLAQAQRLRAQGLDVVIGVVETHGRKETAALLDGLTILPPKRHSHRGRQIREFDLDAALARRPALILMDELAHSNAPGSRHPKRWQDIEELLEAGIDVFTTVNVQHLESLNDVVSGVTGIQVRETVPDPFFDAADEVVLVDLPPDDLRQRLNEGKVYIAGQAERAIEHFFRKGNLIALRELALRRTADRVDDQMRAWRAHPGEEKVWHTRDAILLCIGHNTGSEKLVRTAARLASRLGSVWHAVYVETPTLHRLPEKQRRAILSALRLAQELGAETATLSDPAEEKAVVRYAREHNLGKIVMGRPASRRWWRRDAFADRLARRAPDLDQVIVALEEPPARALAQTPDNRPFKEKWRGQIQGCLVAVALCAITTFIAMQWLVTFDAANLVMLYLLGVVVIALLYGRWPSVVATVINVASFDLFFIAPRGTLAVSDVQYLLTFAVMLTVGLVIGNLTAGVRYQARVARYREQRTRHLYEMSKALAVGRSEHDIAATSERFIASTCQARSQILLPDTNGKLLPLTHQQGMTPWDDAIARWSFDKGQPAGAGTDTLPGVPYQILPLKSADKTYGLAIVEPGNLRQLMVPEQQRLLETFTLLVANALERLTLTASEEQARLASEEQARLASERESIRNALLAALSHDLRTPLTVLFGQAEILTLDLASAGSPHARQASEIRQHILNTTRLVNNLLDMARIQSGGFNLKKEWLTLEEVVGSALQMLEPGLLHPITLSLPQQLTLIHVDGPLFERVLINLLENAVKYAGPQASIGIDAAVKDNRLQLDVWDNGPGIPAGQEQKIFDKFARGNKESAVPGVGLGLAICHAIVEVHGGTLTAYNRPQGGACFRVTLPQGKPPELDDFHEDM

SEQ ID NO: 1988 - DNA, 2691 bp, Listeria innocua
  CDS (1)..(2691)
atggagacgaatcgtccaagtccggatgcgctactcgtgaatttgcaagaagaagcagattcatcagtaggtaaattaaaaatatattttggatttgcagcaggtgttgggaaaacttacgccatgttaagtgacgccaaagatcaattagcagcaggtgtggatgtcgtggcgggttatattgaacctcatgcccgcgaggaaacgctgagaatgttagaaggaattccgattatccctcctaaagcaatcaatcataaaaatatcgcgctcaaagaattcgatttggacgaagcgttgaaacgaaaaccggaacttattttggtagacgaactcgcacatacgaatgcatcaggcgtacgcaataagaaacgtttccaagatgtggaagaattgcttcaagcgggaattgatgtatatacgactgtcaatgtgcaacatattgaaagtttaaacgatattgtagaaggcatcaccaaggtagctgttcgcgaaacgattcctgactatgtttttgatgaggcggaccgagttaagttaattgatattgaacccgatgaacttctaaaacgactagaacaaggcaaaatttaccaaccagcgcgcgcaaaaacagcgatgcagaacttcttcactagagaaaatttaaaactcttacgcgaaattgcgatgcgaaaagcggccgaccgaattagtcatgaatacgatcaaacagggatttatccagaaaaacgggcgagtagtaaatggctagtctgtattgggacgtcgccttcgtctgcaaaactcattcgctggacagcgcgcactgccgaggctttccgcgcaccgtggactgccctttatattgaaaatgaagaaaatgattacatgactaaagcggagaaaaaatgtttgcgggaaacgatggaactcgctgaacgacttggtgcggaaattgttacccttgccggacacgacattgcagaaacagtagctgagtacgcccggttgactggtgtgacaaatatcgttgtcgggaaatcgcgtcgccgcatgggtttaaggtctttatttgaagaggattttgaggatcgtctcattacgcaccttgataacgtcgatatgcatattattccctcaagccaaccgcaaactaaaaaacgtcgaatgaaaatacgttttaaaagctttctatcctggcatgatatggcgaaaatgattttactgctagcattggcaacggcgatttgtgtcggtttaagtgaattcggcattggtgatcaaaatgttattatggtatatattttatccgtgttaattatttctcgcgtaacaagtggctatgtttatggcgttatgggttctatcattggcgttatgttatttaatttctttttcacgacgccactttatacgtttaatacaattcaagcgggctatccggtgacgttcggaattatgcttttagttgctcttattacgagtgcgctcactgtccgaattaaaacgcaagctagcctggccgttgagcgagaacgtcgaaccgaagtgctttatgaaatcaataagcggctattagttatccgcaatttaaaaggaattatcgatttaaccaacgaatatattttgcatttatttagccgctccgttattttttattctgcggatcctgctaaaagtaataaagggattttcgtacaagcagaaggaaaagaagatgccagtgcgcttcttagtgcggatgaagaagctgtcgcgcattgggtatttaaaaataaaaagcgggcgggtgccgggacggatacgctaatgggggcatttggttattatatgccagtgatgtcacaaggaaaagtgcttggcgtcattggcgtttcttgctccccagaagatggtccacttacacaagataatcggatctttttacgaatgattagctctcaagtggcactagctttagaacggcaatatttatccgaagaacaacgccaaatcgtcatcgaatcagcaaaagaaaaaatgagaagcaatttacttcgggcgatttcgcatgatttaagaacaccgctaactggtattgttggagcaagttctgccttacttgaaaaagaaactgagttagataaagaaacggaacataatttaattaaaggtattaaagatgactctggctggctcattcggatggttgagaatttactttctgtgacgagaattagtgaaggattggtgagtttggaacgagctccagaagccgtagaagaaattgttggtgaggctgtcggtcgaatcaaaaaacgtttcgcagaccgaacaattcatgtcaaagtaccgcgcgaccttcttatggttccgatggatggcacgttaattgagcaagtccttattaatttaatggaaaatgcgttgcgacatggtggatctgatgcggaagtttgggtgaacgtgacgaaaacgaagaaaagtgcgatttttagtgtgcgtgataacggaaaaggcattccagaaaatcgcttgccagatttatttgatacttttgctgtggaagcgagagaacgttcggatatgtcacgcggattagggcttggtttatcgatttgtatgtcgattattcgagcgcatgacgggactttagaagcgaaaaacaacgaacatggtggggcgacattctggttcactttgccactagacggaggagatggaaaatga

SEQ ID NO: 1989 - protein, 896 aa, Listeria innocua
METNRPSPDALLVNLQEEADSSVGKLKIYFGFAAGVGKTYAMLSDAKDQLAAGVDVVAGYIEPHAREETLRMLEGIPIIPPKAINHKNIALKEFDLDEALKRKPELILVDELAHTNASGVRNKKRFQDVEELLQAGIDVYTTVNVQHIESLNDIVEGITKVAVRETIPDYVFDEADRVKLIDIEPDELLKRLEQGKIYQPARAKTAMQNFFTRENLKLLREIAMRKAADRISHEYDQTGIYPEKRASSKWLVCIGTSPSSAKLIRWTARTAEAFRAPWTALYIENEENDYMTKAEKKCLRETMELAERLGAEIVTLAGHDIAETVAEYARLTGVTNIVVGKSRRRMGLRSLFEEDFEDRLITHLDNVDMHIIPSSQPQTKKRRMKIRFKSFLSWHDMAKMILLLALATAICVGLSEFGIGDQNVIMVYILSVLIISRVTSGYVYGVMGSIIGVMLFNFFFTTPLYTFNTIQAGYPVTFGIMLLVALITSALTVRIKTQASLAVERERRTEVLYEINKRLLVIRNLKGIIDLTNEYILHLFSRSVIFYSADPAKSNKGIFVQAEGKEDASALLSADEEAVAHWVFKNKKRAGAGTDTLMGAFGYYMPVMSQGKVLGVIGVSCSPEDGPLTQDNRIFLRMISSQVALALERQYLSEEQRQIVIESAKEKMRSNLLRAISHDLRTPLTGIVGASSALLEKETELDKETEHNLIKGIKDDSGWLIRMVENLLSVTRISEGLVSLERAPEAVEEIVGEAVGRIKKRFADRTIHVKVPRDLLMVPMDGTLIEQVLINLMENALRHGGSDAEVWVNVTKTKKSAIFSVRDNGKGIPENRLPDLFDTFAVEARERSDMSRGLGLGLSICMSIIRAHDGTLEAKNNEHGGATFWFTLPLDGGDGK

SEQ ID NO: 1990 - DNA, 2727 bp, Yersinia pestis
  CDS (1)..(2727)
atggtggatgcagaaccaacccgtccgaaccccgatagcctgttagccgtggcgaatgaaaaacctcgtggccggttaaaagtcttttttggggcctgcgccggggtaggtaaaacctacgccatgctgcaagaggcgcaacgcttgcgcgctcaagggttagatgtgctggtcggggtggtggaaacgcacgggcgcagtgaaaccgccgccttacttgaagggctaaccgccctccccctgaaacgcatccaccaccgtaaccgccagatacgtgaatttgatttagatgctgcgctggcccgccgtcccgcgctgatcctcatggatgaactggcgcacagtaatgccaatggctcccgccatcccaaacgctggcaagatgtcgaagagctattggatgcaggcattgatgtgctgaccaccgttaatgtgcagcatttagaaagcctgaatgacgtggtcggcggtgtgaccggtattcgggtgcgtgaaaccgtgcccgaccatatgttcgacgaagccagcgaagtggttttagtcgatttaccccccgatgatctgcgccaacgcctcaatgaaggcaaagtgtatatccccggccaagctgagcgcgccatcgaacattttttccgtaaagggaatttaatcgccctacgtgagttggcgctacgccgtacggccgatcgggttgatgatcaaatgcgcgccttccgcgatacccaaggacgtgaacgggtttggcatactcgcgatgccattttgctgtgtatcggccaccacgcgggtaatgaaaagttagtgcgtaccgccgcccggttggccgcccgcttaggctgcatctggcatgcagtctatgttgaaaccccccggttgcacggcctgccagaggctaaacggcgcgctatcctgcgcacccttaaactggcacaagagttaggcgcggaaaccgctaccttatcggaccccagtgaagaacaggcggtattgcgctacgcccgtgaacacaatctggggaaaatcattattggccgccgcaccgagcaacattggaaactgcgaggcagttttgccgatcgcttaggtaagctggggccagatctggatttggtgattattgcactggatgccgatccgccaaccaatgtcgctaaagaaccagactcgcgccccttcaccgaaaaatggcgtatgcagctacggggatgtgtcgccgctatcgccctatgtgcgctgatcaccgtgctatcgttgtggttgatcccccgtttcgatcaagccaatctggtgatggtttacttgttgggcgtggtgattattgccctgttttatggccgctggccttcagtgctggcggcggtgattaatgtcgccagcttcgatctgttttttgtccaaccgcactggtcattagccgttaccgatgtgcaatatttgctgactttcggtgtgatgctgattgtcggtatcgtggtggggaatctgaccgctggggtgcgctatcaggctaaaattgcccgttatcgggaacaacgggccagacatctgtatgaaatgtctcgcagtttaagccgcgctctgacaccggaggatattgccaaaaccagccgccattttctttccagcagttttcaggccaaaaccagcctgctactgccacaggaagagggccatttacagccaataatgcccgatgacgggggcatcctgtccgttgatgatgccattgcccattggagttttaatcagggtgcccctgcaggagcgggcaccgataccctgccgggcgtgccctaccaactgctgccgttgacagcggctcaacagacctacggcgtgttggcgattgaacccgctaacttacgccaactgatggtgccggagcagcaacggctgttgcaaacatttaccagcctgattgccaatgcattggaaaggctacatctggcccgcagtgctgaactggcaaaactggatgctgaacgggagcaattgcgtaattcgctgctggcggcattgtcccatgatttgcgtaccccgctcaccgtgttattcggtcaggcagaaattctgacgctggatctggccgccgaaggttcgcgccatgccccgcaggctaaccaaatccgccagcaggtcttgagcaccacccggttggtgaacaatctgctggatatggcgcgtattcagtctggtggttttaatctacgtaaagagtggcaatcgctggaagagattattggcagcgccctgtatatgctggaaaccaccttaagtcagcatcagatacgcgttgaattgccggatgaaatggtgttgatcaattgcgacgcaagcttgctggagcgggtctttatcaacctcctggaaaatgcccataaatatgcaggtcacgccgccttgttgggtatccgggcggaagtgcaaggcgagtggttaaatgtggacgtgtgggataatggccccggagtcaccatcggtcaggaaaatcttatttttgataagttttcccgcgggaataaagagtctgccattccgggtgttggcttgggtttagccatttgtcgtgccattattgatgtccacggcgggcgtatctgggtggagaagcgtcaagagggcggagccagcttccgttttgttttgccactggaaaaagtgccggaaattgatgccgacaatattgataccaacaatattgatactgaaaataatgatatatcctga

SEQ ID NO: 1991 - protein, 908 aa, Yersinia pestis
MVDAEPTRPNPDSLLAVANEKPRGRLKVFFGACAGVGKTYAMLQEAQRLRAQGLDVLVGVVETHGRSETAALLEGLTALPLKRIHHRNRQIREFDLDAALARRPALILMDELAHSNANGSRHPKRWQDVEELLDAGIDVLTTVNVQHLESLNDVVGGVTGIRVRETVPDHMFDEASEVVLVDLPPDDLRQRLNEGKVYIPGQAERAIEHFFRKGNLIALRELALRRTADRVDDQMRAFRDTQGRERVWHTRDAILLCIGHHAGNEKLVRTAARLAARLGCIWHAVYVETPRLHGLPEAKRRAILRTLKLAQELGAETATLSDPSEEQAVLRYAREHNLGKIIIGRRTEQHWKLRGSFADRLGKLGPDLDLVIIALDADPPTNVAKEPDSRPFTEKWRMQLRGCVAAIALCALITVLSLWLIPRFDQANLVMVYLLGVVIIALFYGRWPSVLAAVINVASFDLFFVQPHWSLAVTDVQYLLTFGVMLIVGIVVGNLTAGVRYQAKIARYREQRARHLYEMSRSLSRALTPEDIAKTSRHFLSSSFQAKTSLLLPQEEGHLQPIMPDDGGILSVDDAIAHWSFNQGAPAGAGTDTLPGVPYQLLPLTAAQQTYGVLAIEPANLRQLMVPEQQRLLQTFTSLIANALERLHLARSAELAKLDAEREQLRNSLLAALSHDLRTPLTVLFGQAEILTLDLAAEGSRHAPQANQIRQQVLSTTRLVNNLLDMARIQSGGFNLRKEWQSLEEIIGSALYMLETTLSQHQIRVELPDEMVLINCDASLLERVFINLLENAHKYAGHAALLGIRAEVQGEWLNVDVWDNGPGVTIGQENLIFDKFSRGNKESAIPGVGLGLAICRAIIDVHGGRIWVEKRQEGGASFRFVLPLEKVPEIDADNIDTNNIDTENNDIS

SEQ ID NO: 1992 - DNA, 2658 bp, Pseudomonas aeruginosa
  CDS (1)..(2658)
atgaccgacaccgcacgcgccgacgcgctgctggccgacctgcccgctgacgggcgcggccgcctgaaagtctttctcggcgcggcgccgggggtgggcaagaccttcgccatgctgcaggccgcccaggcccagttgcgccagggcgtgaaactgcgcgccggggtggtcgagacccactcgcgggcggaaaccgagtccctcctcgcaggcgtgccgcagcagccgctgcgcagcctcgagtatcgagggatgaaactgcaggaaatggacctcgacggtctcctcgccgacccgccggcgctggccctggtcgacgaactggcccacagcaacgttcccggcagccgccacgccaagcgctggcaggacatccaggagttgctggcggcgggaatcgacgtctacacaacggtcaacgtccagcacctggagagcctcaacgaccaggtccgcgacatcaccggcgtgcaggtccgcgagacggtgccggactgggtgttgcaggaggcctacgagatcgtcctcatcgacctgccgccgcgcgagctgctggagcgcctgcgcgagggcaaggtctacgtgccggaacaggcgcgggcggcgatcgatgcgttcttctcgcagaccaacctcaccgcgctgcgtgaactggcgatgcagaccgccgccgcgcgggtcgacgccgacctcaaccaccgctaccgccagcgcggcgaggaagcgccggcgttgcgcgggcggctgctggtgggcatcgacggtgacgaacaggccgaacgcctggtgcgccacgcctgccgggtcgccgaacgtcggcacctgccctggagcgtggtacacgtcgataccggcggcttgcgcggcgagcaggcgcggatgcgcctgcagggtgcgcagcaactggccgagcggctcggcggcgagatcgtcgtgctgcgcgccggcgaggtggcgcggaccctcctgcaacatgcccgcgagcgccgcgccagcctggtcctggttggccagtcgcggcgccgctggtatcgccgggccttcggcggtggtctcgccgggcgtctgctgcgcgacggccagggcctggagatcagtgccctggacagcgaggccgacctgcgcccggcggaaccgcggccacgctatccggtggtgtggaacgactatctgctggcgctgctggcgaccgccctggccagcggcctggcctggatcgtggcgcacctgctggagctgccgaacatctccctggtgttcctgatggcggtgctgctggtggcagtgcgcagcagcctgatgccggcactgctgtgcgcggtggcgtcgttcctggcctatgacttcctgttcatcccgccgcatttttccttcgccatccatcgccacgaagacctgctgagcctggcgttcttcctgttcatggccggcctcaccggcaacctggcggcacgccagcggcgccagctggaggcgctgcgcgatacccaggaggaaaccagcctgctgctggagctgtcgcgcaagctcaccgccgccaccgaccgccaggcggtgctggccgccgccgcccagcagttcgacgactggaaggacgtcgaggtctgcctgctcggtcaggtcaatggcgagtggaagaccgaggccggcgtgcagcggcaactcgccgaccaggaacgggtcgccgcggactgggcctgggcccacgaccagccggccggcctcggtactggcacgctgcccggaggacgctggtggtggtggccgctgtcggcggaagagggaccgctggcactgctcggtgtcgcgccgctggacggccagccgctgagcccgcagcgccggcgcctgctcgccgccctcggccagcctctggcccaggccctggcgcgggctcgcctggccgaggacctggaggccgcgcgcctgcacggcgagaccgagcaactgcgcagcgccttgctcgcctcggtgtcccacgacctgcgcacgccgctgacggccatgcgcggctccatcgacagcctgctggcgctgggtgaggcgatcccgccggcggatcgtcgcgaactgctggaaagcacccgcgacgaggccgagcgactggaccgctatatccagaacctgctcgacatgacccgtctcggccacggtggcctgaagctggcgcgcgactgggtggcgccgggcgacatcgttggcagcgcgctgaaccgcctgcgcgcggtgctggcgccgtaccgggtgcaggcgatcgtggccaacgacctgccgttgctctacgtgcatgcggcgctgatcgagcaggcgctgatcaacgtgctggaaaatgccgcgcgcttctcgccgaaccacggccggttgcgcatcgaggtcagccaggatgccgccgagctgcgtttcgcggtgagcgacgaggggccggggattcccgaggccgagcgggagaagatcttcgacatgttctacaccgctgcccgtggcgaccgcggtggccagggcaccggcctgggcctggcgatctgccagggcatgatcggcgcccacggcgggcgcatcagcgtcggcgaaggcctcgacggtcgcggcaccacgctggtcctgcacctgccgctgcatccgcagccggacctcgggcaactggagggcgacgaatga

SEQ ID NO: 1993 - protein, 885 aa, Pseudomonas aeruginosa
MTDTARADALLADLPADGRGRLKVFLGAAPGVGKTFAMLQAAQAQLRQGVKLRAGVVETHSRAETESLLAGVPQQPLRSLEYRGMKLQEMDLDGLLADPPALALVDELAHSNVPGSRHAKRWQDIQELLAAGIDVYTTVNVQHLESLNDQVRDITGVQVRETVPDWVLQEAYEIVLIDLPPRELLERLREGKVYVPEQARAAIDAFFSQTNLTALRELAMQTAAARVDADLNHRYRQRGEEAPALRGRLLVGIDGDEQAERLVRHACRVAERRHLPWSVVHVDTGGLRGEQARMRLQGAQQLAERLGGEIVVLRAGEVARTLLQHARERRASLVLVGQSRRRWYRRAFGGGLAGRLLRDGQGLEISALDSEADLRPAEPRPRYPVVWNDYLLALLATALASGLAWIVAHLLELPNISLVFLMAVLLVAVRSSLMPALLCAVASFLAYDFLFIPPHFSFAIHRHEDLLSLAFFLFMAGLTGNLAARQRRQLEALRDTQEETSLLLELSRKLTAATDRQAVLAAAAQQFDDWKDVEVCLLGQVNGEWKTEAGVQRQLADQERVAADWAWAHDQPAGLGTGTLPGGRWWWWPLSAEEGPLALLGVAPLDGQPLSPQRRRLLAALGQPLAQALARARLAEDLEAARLHGETEQLRSALLASVSHDLRTPLTAMRGSIDSLLALGEAIPPADRRELLESTRDEAERLDRYIQNLLDMTRLGHGGLKLARDWVAPGDIVGSALNRLRAVLAPYRVQAIVANDLPLLYVHAALIEQALINVLENAARFSPNHGRLRIEVSQDAAELRFAVSDEGPGIPEAEREKIFDMFYTAARGDRGGQGTGLGLAICQGMIGAHGGRISVGEGLDGRGTTLVLHLPLHPQPDLGQLEGDE

SEQ ID NO: 1994 - DNA, 2634 bp, Staphylococcus aureus
  CDS (1)..(2634)
atgtatttaggctatagcccaggggtaggtaaaacgtatgaaatgttatcaaatggtattgatcagtatcaagaaggtgcagatattaaaattggttatatcgaaccccatcaacgccctgaaaccaatgcactggttcaacaattgcctgaaatttcgacctccagccgtaaatttggcagccacacctttcactatatagatgtctctaaaatcatagaagctaatccagatgtggtcttaattgatgaactagcacatacaaacatttcaaaagagcgccatttaaaacgttataaggatatagaagaaattctatcgcatggtatcgatgtctggacaacactcaacatccaacatatcgagagtctaagcggacaaattgcgttaatgacaggtattcaagttacagaacgtgtgcccgaccaattcattacgtcagcagatgcctttgaagttgtggatatttcaccaaatatgttgattcagcgccttaaagcaggaaaagtatataaaaaagaacgcttagaaacagccttttctaatttctttacgtatgaaaatctgacagagctgcgtgaacttacactcagaactgtcgcagatattatgagtcaaaaaggacaacaatataaaactaaacataccgacattacaccgcatattgcggtagctatcagcggcagtatttataacgaacgggtcatacgagaagcaagacgtgctgcctataaagaacatgctaaattcacagctgtgtatattgatgtctttgagacaccgtcagaaagcagaaaacaagatcattatgtccataaaaatctaatgctcgccaaagcgttaggtgcagaaatcaaagtgttgtatgcacaagatattgcgaaagcgttaaccgattggtgtgatctcgcttttgtgacgaagctagtccttggacagtcagaacagccacgttggaaagattactttaaacagtcactcattgaacaaattaatcacgtaccacaccatttcaagttagaaattgtaccgattcattatattcattcagacaaacctacaaatacacctaagcaagctcaaaaatcctctcgtttaactgtagagattatgaagatgcttgtaattcaaacgatctgtgtcttgctcggtatatgggtttacaacttagataaaagcgaatccagtgccattatcttgctgatgttctttatcggtattatcgtgctttctatttggacccaatcctatttaatcggattctttgcgtctatcttaaatgtgtttgtttttaattatttctttacggtgccaagattcactttagaaatgtatcgctttgaatatccgattacgtttgcgaccagtatttttgctagtatctttacgagtgccatcttaaagaatttaaaacatcagcattccttaacagaacggcagttatatcggaccaatattatgctgcaatttaaccagtccattaaagaatcttattcaattgaacgcttattaaatattgctggtgatcagattcatcagctactcaatcaggatgtcacggtattcttaattcaaagtaagaaagtcgctgcttccaactcatttggaaacagaagcatttcaagctcagataagacacatgatgctgagacattgagctgggtcattgaaaatgaaagccgtgccggtaaattaaccgatacctttcctggcagtaaatttttgtgtattcccattggcacaaatccagtcaaaggtgtgatttctatccgcttcaccgacgaaacttacatcgacacctatgacaattcaatattagactctatgttgaacgatattaccctggcaatagagaatgtggatctattaaaacaaaccagacaatccatattgaaagctgaacgagaagccacacgttcaaacttcttgcattcaatttcacatgatattagaacaccactgacttccattatgggcaacttagatatgctgaaataccataacgagcatttaaacgatcaacaacaagcagaactcttaactgcttcttatggcgaagcacaatatctgcataccttagtcacaaatattttatctttgactaagttagaaagctctgacattcaaatacaacgcaccccttatttagtagaagaacttctagaagaatttgaagaaggcctcatacgcagacaccaagcaaatcatgtcattattgaaaatgaggatgacgcttcactcattaatatcgacagtaaattaatactgcaagtgctattcaaccttatcgataatgctttaaagcatgcagaatcacattctgaaataaaactgcacgttcaacatgaaacaaacaaaataaaattcgaaatgatagattgcggaaaaggtattccagaagaagaacgtcaattgatttttaatccctattattcaggagacaactttaaagacaataaaaaagatagtttgggattagggctctatttagtacaactcatcttgaaacaacacaacagtgaattagaatatcaaccgaatacaccacaaggcagtattttttatttttatttgactgttaatccaattgaaatggagggagccatggatgaaaacaacattattggtcgttga

SEQ ID NO: 1995 - protein, 877 aa, Staphylococcus aureus
MYLGYSPGVGKTYEMLSNGIDQYQEGADIKIGYIEPHQRPETNALVQQLPEISTSSRKFGSHTFHYIDVSKIIEANPDVVLIDELAHTNISKERHLKRYKDIEEILSHGIDVWTTLNIQHIESLSGQIALMTGIQVTERVPDQFITSADAFEVVDISPNMLIQRLKAGKVYKKERLETAFSNFFTYENLTELRELTLRTVADIMSQKGQQYKTKHTDITPHIAVAISGSIYNERVIREARRAAYKEHAKFTAVYIDVFETPSESRKQDHYVHKNLMLAKALGAEIKVLYAQDIAKALTDWCDLAFVTKLVLGQSEQPRWKDYFKQSLIEQINHVPHHFKLEIVPIHYIHSDKPTNTPKQAQKSSRLTVEIMKMLVIQTICVLLGIWVYNLDKSESSAIILLMFFIGIIVLSIWTQSYLIGFFASILNVFVFNYFFTVPRFTLEMYRFEYPITFATSIFASIFTSAILKNLKHQHSLTERQLYRTNIMLQFNQSIKESYSIERLLNIAGDQIHQLLNQDVTVFLIQSKKVAASNSFGNRSISSSDKTHDAETLSWVIENESRAGKLTDTFPGSKFLCIPIGTNPVKGVISIRFTDETYIDTYDNSILDSMLNDITLAIENVDLLKQTRQSILKAEREATRSNFLHSISHDIRTPLTSIMGNLDMLKYHNEHLNDQQQAELLTASYGEAQYLHTLVTNILSLTKLESSDIQIQRTPYLVEELLEEFEEGLIRRHQANHVIIENEDDASLINIDSKLILQVLFNLIDNALKHAESHSEIKLHVQHETNKIKFEMIDCGKGIPEEERQLIFNPYYSGDNFKDNKKDSLGLGLYLVQLILKQHNSELEYQPNTPQGSIFYFYLTVNPIEMEGAMDENNIIGR

SEQ ID NO: 1996 - DNA, 2703 bp, Agrobacterium tumefaciens
  CDS (1)..(2703)
atgcctgacgatatcagcgatatgccaagccgaccgtcgcccgatgcgctgctggaaaatgcccagcgcgaggcaagaggccggctgaagatttttctgggcgccgcacccggcgtcggcaagacctatgagatgctgatgtccggccgggcgaagctcgcggatggcgtcgataccgttatcggtgtcgtggaaacccacggccgccgggaaaccgaggcgctggtcgaagggttgagcgtggtcccgcgcaagcgcatcgattatcgcggtcaggtactggaggagatggatatcgatgccatcctcgcccgtcgccccgctctggttctggtcgatgaactcgcccacaccaatgccgccggcagccgccaccccaagcgctatatggatgttcaggaaatcctcgcgcagggcatcaatgtctatacgacgctcaacatccagcatgtcgaaagcctgaatgatgtggtggctcagatcacccgtatccgcgtgcgcgaaacggtgccggacagcatcatcgaccgcgccgacgacgtcgaaatcatcgatatcacccccgatgatctgatcaagcggctgcaggacggcaaggtctacctgccgcgtaccgcccggcgcgccatcgagaattatttctcccggggcaacctgacagcgctgcgcgaactcgcactgcgacgcacggcgcagcgggtggacgagcaattgctcaaccacatgcagtcccatgccatttccggcccgtgggcggcgggggaccgggttctggtctgcctcgaccacggccgtaacgggccgggtcttgtgcgttatgcccgaaggcaggcggaccgactgcgcgcgccgtggacggcgctgcatctcgacacgccgcgttcgcagcaattatcagaggcggagaaggaccggctggcgggcaccatgcggcttgcccagcagcttggcggcgaaacggtaaccctgccagcgcttgacctcacacgcgaaatcatcgcttacgccaatgccaataatttcacccacatcatcatcgggcgcccgcgaaaatcctggtggcagcggatttttcagcgctcgctgacccatgatctgatcgatcacgccggcgatatcagcgtgcacgtcatttccggcgacaagaacgaggaaaagccgggtcaggccgtgaagctcgcaccggcacgatccccacagtccttccggtcctatctcaacagcactttgttcgtcgggttggcgatcatcgtcgggatcgtactcgatcagacgctcgacgttcaaaatcttgcgctcgtcttcctgatggccgttctggctgccgccgtgcgcggggggctcggaccggcgctttatgcatccttgctcggcgcccttgcgttcaatttcttctttctggagccgcgttatacgctgacggtcagttctccggacagccttgtcgccctgctgttctacttcggcgtcgcgctggtcgcttccaatctcacggtcgcggtgcagcggcaggcggcctccgcacgctcgagggcacgcacgactgaagacctctatctgttttcgaaaaagctggctggcacgggaacgctcgatgatgtgttgtgggcagctgcatatcagatggcgtcaatgctgaaggtgagggtcgtcctgctcatgccggaaaacggcgccatcgccgtcaaggcgggttatccgcccgacgacacattggtggatgccgatatcgccgccgcacaatgggcatgggaacataacaaggcggcaggtcgtggcgcggatactttgccgggtgccaaaaggctttatctcccgcttcgcaccggcagcggtgcggtgggtgtggtgggcctggatgacgaccgaagcggaccgcttttgacgccggaacagcagcggctttttgatgcgttggccgaccaggccgcgctggcggtcgaacgtatccagcttgcctcggatgtggatagagcaaggctggcggccgaaacggaccggctgcgcacggcacttctgacctccatttcccacgatcttaaaaccccgcttgccgccattctgggctcggccggaacgctcaaggatttcgccgatgacattccacctgatgcgcgcgccgaactgctgtcgacgatcgtggaggaatccgaacggctgaaccgtttcatctccaatcttctcgatatgacgaggatcgggtcgggcgcgatggagccgaattacgggctgcatttcctcggcgacatggtcggaacggcgctgtcgcgcgccgcgaagatcgttgtccggcatgaggtcgttctcgatatcccctccgacctgccgatgctgaaggtcgatcccgtgcttttcgaacaggtgctgttcaacctgatcgacaatgcggccaaatacgctcccgaacatacgaccattgcgatacgcggctggcggcagggaaagaatatcttcctctcggtcgccgatgagggaccgggcattccgcccgatgatcttgagcgggtcttcgacagtttttaccgggtgcgcaaggttgaccatgtgcaggcgggaacggggctcggtctttccatctgcaaggggttcatcgaggcgatgggtggctcgatccgcgcggaaaacagagcggatcgcggcggagcgcaatttaccataggcctgcccgtcgccgtcgataccccggtgctggatcatgattaa

SEQ ID NO: 1997 - protein, 900 aa, Agrobacterium tumefaciens
MPDDISDMPSRPSPDALLENAQREARGRLKIFLGAAPGVGKTYEMLMSGRAKLADGVDTVIGVVETHGRRETEALVEGLSVVPRKRIDYRGQVLEEMDIDAILARRPALVLVDELAHTNAAGSRHPKRYMDVQEILAQGINVYTTLNIQHVESLNDVVAQITRIRVRETVPDSIIDRADDVEIIDITPDDLIKRLQDGKVYLPRTARRAIENYFSRGNLTALRELALRRTAQRVDEQLLNHMQSHAISGPWAAGDRVLVCLDHGRNGPGLVRYARRQADRLRAPWTALHLDTPRSQQLSEAEKDRLAGTMRLAQQLGGETVTLPALDLTREIIAYANANNFTHIIIGRPRKSWWQRIFQRSLTHDLIDHAGDISVHVISGDKNEEKPGQAVKLAPARSPQSFRSYLNSTLFVGLAIIVGIVLDQTLDVQNLALVFLMAVLAAAVRGGLGPALYASLLGALAFNFFFLEPRYTLTVSSPDSLVALLFYFGVALVASNLTVAVQRQAASARSRARTTEDLYLFSKKLAGTGTLDDVLWAAAYQMASMLKVRVVLLMPENGAIAVKAGYPPDDTLVDADIAAAQWAWEHNKAAGRGADTLPGAKRLYLPLRTGSGAVGVVGLDDDRSGPLLTPEQQRLFDALADQAALAVERIQLASDVDRARLAAETDRLRTALLTSISHDLKTPLAAILGSAGTLKDFADDIPPDARAELLSTIVEESERLNRFISNLLDMTRIGSGAMEPNYGLHFLGDMVGTALSRAAKIVVRHEVVLDIPSDLPMLKVDPVLFEQVLFNLIDNAAKYAPEHTTIAIRGWRQGKNIFLSVADEGPGIPPDDLERVFDSFYRVRKVDHVQAGTGLGLSICKGFIEAMGGSIRAENRADRGGAQFTIGLPVAVDTPVLDHD

SEQ ID NO: 1998 - DNA, 2658 bp, Staphylococcus aureus
  CDS (1)..(2658)
atgtcaaacactgaatcgctaaacataggaaaaaagcgtggatctttaacaatttacatcggttacagtccaggtgttggtaaaacatttgagatgctttcaaatgccattgaactatttcaaagtaacgttgatattaaaataggatatattgaaccgcatcagcgtgatgaaacaaatgcattagctgaacaattacctaaaatcacaaccaattttactaaacatggtagtcatcattttcaatatttagatgtcgaccgcataatcgaagaatcgccgacaatagtacttatcgatgagttagcacatacgaatatttctagagatcgtcatgagaaacgatatatggatattgaagaaattttaaatcatggtatcgatgttcataccactttgaacattcaacatattgaaagtttaagtagtcaaattgaactgatgaccggtgtacatgttaaagaacgtgtacccgactatttcataatgagcgccgatgtattagaagtcgtagatatctcacctgaacaattaattaaacgcttaaaagctggcaaggtatataaaaaggataggctagatgtagcatttagtaatttctttacgtatgcccacctaagcgaactgcgtacattgacgttaagaacagttgccgacttgatgagtgataaagaaaaagtccgacacaaccataaaacgtcactcaaacctcatattgctgtggcaattagtgggagcatttataatgaagcagtaattaaagaggcattccatattgctcaaaaagaacatgcgaagttcactgctatttatatagatgtattcgaaaaaaacaggcaatataaagatagtcaaaagcaagtgcatcaacatctcatgcttgcaaaatcattaggagcaaaagtaaaagtagtttatagccaaaccgttgcattaggattagacgaatggtgtaaaaatcaagatgtaaccaaattaattatcggacaacatattagaaataagtggcgagactttttcaatacacctttaattgaccatttaatgtcctttgaacatagctataaaatcgaaatcgttccaatcaaacaaatacctgttgaattgaaaatgaacaaatcaccctatcgtcctaaaggcaaacgtttcgccatagatatgttaaaaatgattttgattcaaataatttgtgtaatgatgggactgtggatttatcaacttgataagcatgagtctagtacgattattttaatgatttttctcatcggcatcattttattatccatttggacgcggtccttcatcattggctttttagcagcaattattaacgtatttgtttttaattatttttttacggaacctagatatacatttgaagtatatcgctttgactatcctattacatttatcgttagcattttaacaagtattttaacgagtgctttattaaaacaaattaaattccaatactccattactaaaaagcaactttatcgtacagatttattatttcaatttaatgattcgattaaacaaacttatacagttgaaaacttactaataaatgctggataccaaattaatcaattattgcaacaatcaattactatatacgttatcaatcaatcgaaagtaattaaaacaataccattgcaaaaccatatcgataatacgactcaacagcatgaacaagcattaagctgggtaattaaaaatgaaagacaagctggtgcaacaacagatacatttccaggcattaataaatggttgataccaattggcacatctccgattaaaggcattctagccattgattaccaaagttctcaagtgattaatccatatgatgcatcaatattagaatcaatgttaaatgaactttctctcgccgttgaaaatgtgacgttacttaaacaaacgagagaatccatgttacaggctgaacgtcaactgacacattcaaattttttaagatcaatttcgcatgacatacgtacaccgttaacaacaattatgggaaatttagatattttagtatcacatagtaaagatatgtctatcatagaaaaggaacaattacttgtacatagttttcaagaaagtcagtatttatatctattagtgacaaatattttatcattaacaaaattacagtcatcaaatgttcagataaaattgcaaccttatctcgttagtgaattagtagaagaaatcgatatgattttagaacgtcgccatttaaaaaagcgtataactgtatcatcctccgtaaatttacagtttatacacattgacagtaagttgattttacaagctttattcaatttgattgaaaatgcagttaaacacacttctactgacaccaaaatcaatttatctattcgttatgctagctatgaacaaatcgaatttgccgttatagacgaaggacctggaattagtttagaagaacaacaaaagatattcgagcctttttacacaggatcaaataaatattttaaagataaccaaaaagaaagcatgggactaggcttatatttagtacagactatcctacacaaacatcaatcaaacttacaatataaaccgaaccaaccacacggcagtatattctatttcaatatatatacagactttaacgaaggagacgtataa

SEQ ID NO: 1999 - protein, 885 aa, Staphylococcus aureus
MSNTESLNIGKKRGSLTIYIGYSPGVGKTFEMLSNAIELFQSNVDIKIGYIEPHQRDETNALAEQLPKITTNFTKHGSHHFQYLDVDRIIEESPTIVLIDELAHTNISRDRHEKRYMDIEEILNHGIDVHTTLNIQHIESLSSQIELMTGVHVKERVPDYFIMSADVLEVVDISPEQLIKRLKAGKVYKKDRLDVAFSNFFTYAHLSELRTLTLRTVADLMSDKEKVRHNHKTSLKPHIAVAISGSIYNEAVIKEAFHIAQKEHAKFTAIYIDVFEKNRQYKDSQKQVHQHLMLAKSLGAKVKVVYSQTVALGLDEWCKNQDVTKLIIGQHIRNKWRDFFNTPLIDHLMSFEHSYKIEIVPIKQIPVELKMNKSPYRPKGKRFAIDMLKMILIQIICVMMGLWIYQLDKHESSTIILMIFLIGIILLSIWTRSFIIGFLAAIINVFVFNYFFTEPRYTFEVYRFDYPITFIVSILTSILTSALLKQIKFQYSITKKQLYRTDLLFQFNDSIKQTYTVENLLINAGYQINQLLQQSITIYVINQSKVIKTIPLQNHIDNTTQQHEQALSWVIKNERQAGATTDTFPGINKWLIPIGTSPIKGILAIDYQSSQVINPYDASILESMLNELSLAVENVTLLKQTRESMLQAERQLTHSNFLRSISHDIRTPLTTIMGNLDILVSHSKDMSIIEKEQLLVHSFQESQYLYLLVTNILSLTKLQSSNVQIKLQPYLVSELVEEIDMILERRHLKKRITVSSSVNLQFIHIDSKLILQALFNLIENAVKHTSTDTKINLSIRYASYEQIEFAVIDEGPGISLEEQQKIFEPFYTGSNKYFKDNQKESMGLGLYLVQTILHKHQSNLQYKPNQPHGSIFYFNIYTDFNEGDV

SEQ ID NO: 2000 - DNA, 2691 bp, Sinorhizobium meliloti
  CDS (1)..(2691)
atgccccacaatgaccgcgacctgaagagccgccccgatccggacgccctgctggcgctcgccgaacagggcaggagaggcaaactcaccgtctttcttggggccgcacccggtgtcggcaagacctttgcgatgctgacgcgtgcgcggcgcctcaaggaagaaggcggcgatatcgtcatcgggctcgtcgaaacgcatggacgcggcgagaccgctgccctgctcgaggggctcgaagtcctgccgcgtcgccaggtgctgcacaacggacggacgctccacgaattcgacctcgacgcggcgttggctcggcgcccgcgcgtcatcctggtcgacgagctagcccataccaatttcggcgaaagccgccaccccaaacgctaccaggatatagaggagctggtcgatgccggcatagacgtgtggacggcactcaacatccagcacctggaaagcctctcggacgtggttgcgcatattgccggcgtgccggtgcgcgagcgcgtccccgatacggttctcaatcgcgctgacgatgtcctgctggtggacctgccgccggccgaactgatcgagcggttgaaggagggcaaggtctatctgcccgacaacgccaagcgcgccgccgatcgcttcttccgcctgggcaatctgacagcgctgcgcgaactcgcgctgcgccggacggccgaccgggtcgacgaccagatggtcgactatctcaggcagaacgcgatcgagggtccctggggcgccgccgaacggcttctcgtctgcatcggtcccgaccctctatccgagaaggtggtgaggacggcaagccggctcgcttcgagcctgaatgccgactggatggtcgtttccgtcgagcgtgcggaggcggagagcagcggtgcgatgcgacagctcgacgagactttccggctcgccgagcaattgggcgccgagacgcgccgtatcatcggcaacgacttcgtggaagaaattctgaagctcgcaaggcgggaacatgcaacgcaaatcgtcatcggcacgcgccgccactatttcccgctacgcctcttccgccgctccttgccggacgcacttgccgcgcgggcggccggtatcgccatccacctcgtcactgacgggagtgcacccgccgtaaaaccggcggccagacgcagaagcacgcttccggatgggtgggggcggggggttgccatcgcaaccggtacggctgcagccgcgacagcacttggcctgctgatcgagcaattcgtcgtcctgcagaatatctcgcttctcttccttctggctgttctcgtctcggcgacttacgcgggctatgtcgctgcgattgcggccgcgctcatttcgattctcgcctataatttctgcttcatcgaaccggtcggcactttcacggttgccgaaccgcacgaagtctttgccctcttcgtgttcctcgcggcggcgatgcttgccggggggctcgcctcccgcgttcgcgagcaggcgaagacagcgaggcggcgggccgccgcgacgcaggcgctttacgatttttcccgcaagctgtccggtacggcaaatgccgaggacgtgctatgggcggccgtcacgcaaatccacgcgacccttcggcgcaacgcggcgctgctgttgccggaagacggagatgtccgcttgatggcggcttggccgccggatacggagctcggccttaccgacacgatggcggggcgctgggctttcgagaagaaggaggctgccggcaacggtaccggcacgctgccgaacagtcccttccagttcaggccgctgatgagcccgcatggagtcgtcggcgtctttggtttcctccaggaagacaagccgctggaaataaacgaggagcgagcgcttgccgcgatcctcgaccagaccgcgatcgccgtcgacagagcacgtctctcgcgcgagagcctcgaccaggctgcgcagctcgagggcgagaagttcctcgcggcgctgctttcgtccatatcccacgacctcagaacaccgctcgcgacgatcaccggagctgtgacaagtttgcggcaactcggcgagcggatgtcggaggagagccgggacgatctgctcaagtcgatcgaggaggagagcggcagactcacccgcttcgttgccaacctgctcgacatgacccgcatcgaagccggaacggtaaacgccaagcgcgattgggtcgatgtcgccgatgtggtccattcggctgtggagcgtgcgcggaagtacttccccggccgcgtcttcgaaacgagcatcgctccggacttgccgttgatccgcggcgatagcgtgttgcttggtcaagtgatcttcaacctgctcgacaacgctaacaggtttgggggtgacgagccggtcagcatctatgggcggcgggaagaagatgagatcgtgctctcggtgaccgacctcggtaaaggcatcgccccggccgacctcgaccgtgtgttcgacaaattcttccgcaagggaaagccggacggccgttcgctcggcaccgggcttggcctttccatcagcaagggcttcgtcgaggcgatggacgggcggataaaggcggagagcccggcgatgaagcgccgcggcacgcgcatttccatgcggttcccggtggctgaaaccggtatcacggagaaggagcgcggatga

SEQ ID NO: 2001 - protein, 896 aa, Sinorhizobium meliloti
MPHNDRDLKSRPDPDALLALAEQGRRGKLTVFLGAAPGVGKTFAMLTRARRLKEEGGDIVIGLVETHGRGETAALLEGLEVLPRRQVLHNGRTLHEFDLDAALARRPRVILVDELAHTNFGESRHPKRYQDIEELVDAGIDVWTALNIQHLESLSDVVAHIAGVPVRERVPDTVLNRADDVLLVDLPPAELIERLKEGKVYLPDNAKRAADRFFRLGNLTALRELALRRTADRVDDQMVDYLRQNAIEGPWGAAERLLVCIGPDPLSEKVVRTASRLASSLNADWMVVSVERAEAESSGAMRQLDETFRLAEQLGAETRRIIGNDFVEEILKLARREHATQIVIGTRRHYFPLRLFRRSLPDALAARAAGIAIHLVTDGSAPAVKPAARRRSTLPDGWGRGVAIATGTAAAATALGLLIEQFVVLQNISLLFLLAVLVSATYAGYVAAIAAALISILAYNFCFIEPVGTFTVAEPHEVFALFVFLAAAMLAGGLASRVREQAKTARRRAAATQALYDFSRKLSGTANAEDVLWAAVTQIHATLRRNAALLLPEDGDVRLMAAWPPDTELGLTDTMAGRWAFEKKEAAGNGTGTLPNSPFQFRPLMSPHGVVGVFGFLQEDKPLEINEERALAAILDQTAIAVDRARLSRESLDQAAQLEGEKFLAALLSSISHDLRTPLATITGAVTSLRQLGERMSEESRDDLLKSIEEESGRLTRFVANLLDMTRIEAGTVNAKRDWVDVADVVHSAVERARKYFPGRVFETSIAPDLPLIRGDSVLLGQVIFNLLDNANRFGGDEPVSIYGRREEDEIVLSVTDLGKGIAPADLDRVFDKFFRKGKPDGRSLGTGLGLSISKGFVEAMDGRIKAESPAMKRRGTRISMRFPVAETGITEKERG

SEQ ID NO: 2002 - DNA, 2703 bp, Clostridium acetobutylicum
  CDS (1)..(2703)
atggatatcaactacgaaagacctgatccatattatcttttaaacaaaatagataaggaagaaaaaaataagaatagaggcaaattaaaaatcttttttggctatgcagcgggtgtaggtaaaacctatgcaatgcttagagctgctcactatatgaaagaacttggaaaggatatagttatagggtatatagagcctcacgcaaggatggatacaatgtcacttacaaaggggcttccacagataccagtaaaaaatatagattataaaggagttatactaagggaatttgatgtagataaagcgcttttaagaaagcctgaaataattcttgtagatgaattagcgcatactaatgcaaaaagtcaaaggaataaaaaaagatggaaggatatagaggagcttttggatgcaggaattgatgtgtacaccactttaaatgttcagcatatagaaagcttaaatgatatagttgcaaatataactcatgtttcagtaagagaaactattccagacaaggtatttgatgatgcagataaggttgaattaatagatatagaaccagatgagcttttaaagagatttacagacggtaagatatataggaaagagcaggttaaaagggcattcaataatttttttactaagaataatttatatgcattaagagaaattgcccttagaagaactgcggatagagttaattttgaaatagaaattgcaagattatcaaagggtcaaattacagtaatggcaacctcagatcaaatacttgcgtgtataggaacctcaccatcttcggcaagaataataagaactgctgcaaggatggcagaatcctaccattcaaagtggatagcactttatgttgatactggtagaagcttaggtaaagcagataaggaaaccctcaatgcaaattttaatctggtggagcttttaggtggggaacttgttactgttcatggagaaaatgttgcagaccaaataataagatatgcagagcttagaaacactactaaaatagtaataggaaaaaatcataaaagaacaggaactctcctgcatttttatgctaaggatgtagtagataagcttatggattcaaattcttatatagatgtctatatgataccgaattcatcttattatagagatcacaaaaatagtattttatcaaaaataagtattcagcataaaggatcagttaaggatgtattaaaagcaataataattatggcaattactacagatatagctgaactttttagttacatgggctttaaggatgtcaatgttataatgatatttatacttggtgtaataattgtatatatggcaactaaagggcaaattatggggataatatcatccatagcagctgtattagtgttcaattatagatttactgaacctaaaaattcttttatagtttatgataaaagctatcttgttacctttccaataatgatgattgttgcattcataattggaagtcttactaataaggtgcaaaaggaagctcaagattctaatatgagggaaaaaaggactcaaactttgtatatagtaagtggtaagctattgagtgctgttggaacctccgaggttgtgtccataggtataaagtatatatcaagattagttaatagaaatgtaatatgctatttggcagacactagtaataagctttcaacaccatttgtatataaaaaggataaaggagccaaggaagaaatcatcatgagtaaggatgaaaatgctgctgcctactggacctttttaaatggaaaagaatctggatgtggaacaagtactttttatagagcaaaagggtactacattcctataaaaattaaaaataaagtacttggagtaataggtgtatcgtgtccaagtggtcctttaagacctcaaaaaaaggctgtggttgatacagttacaggtcaaatagctattgccctcgatagagagatactttcaaaggaacaagaaaaatctaaagttgaaatagagcgtgaaaggcttagaagcaatctcttaagatcaatctcacatgatttaagaagtccacttgcaggtataaagggagcggcaagtactatacttgaaaatggagaacttatagatgaaaagagaaaacaggagcttataaatggaatatatgaagatactgaatggcttataagattaattgagaatttgcttagtatgacaaagtttgatgaggggaatacaaaaataaaaaaagatgtggagttagtggaagaggttgtttccgaagcagtgcaaagaagctctaaatacttcaaaaatcataagataaaagtaagtgtgccagaagatgttataatggtatcgatggatggaagcttaattgaacaagttataataaatcttttagataatgcttcaaagttctcacctaaaggttctactatagaaattaaggtttacgaaaaaaagaaggatgttgtttttgaaataatagatgaaggacagggtatttcagaggatatacttcctaatatatttgatagattttttacaaatggaagcaaaatatcagattcaaggagaggagtaggacttggactggctatttgtaagtctatagtagaagctcatggaggaaaaatagaggctgttaacaaaggtagtggaggagctatctttaagttcaatattcctaaagagttatag

SEQ ID NO: 2003 - protein, 900 aa, Clostridium acetobutylicum
MDINYERPDPYYLLNKIDKEEKNKNRGKLKIFFGYAAGVGKTYAMLRAAHYMKELGKDIVIGYIEPHARMDTMSLTKGLPQIPVKNIDYKGVILREFDVDKALLRKPEIILVDELAHTNAKSQRNKKRWKDIEELLDAGIDVYTTLNVQHIESLNDIVANITHVSVRETIPDKVFDDADKVELIDIEPDELLKRFTDGKIYRKEQVKRAFNNFFTKNNLYALREIALRRTADRVNFEIEIARLSKGQITVMATSDQILACIGTSPSSARIIRTAARMAESYHSKWIALYVDTGRSLGKADKETLNANFNLVELLGGELVTVHGENVADQIIRYAELRNTTKIVIGKNHKRTGTLLHFYAKDVVDKLMDSNSYIDVYMIPNSSYYRDHKNSILSKISIQHKGSVKDVLKAIIIMAITTDIAELFSYMGFKDVNVIMIFILGVIIVYMATKGQIMGIISSIAAVLVFNYRFTEPKNSFIVYDKSYLVTFPIMMIVAFIIGSLTNKVQKEAQDSNMREKRTQTLYIVSGKLLSAVGTSEVVSIGIKYISRLVNRNVICYLADTSNKLSTPFVYKKDKGAKEEIIMSKDENAAAYWTFLNGKESGCGTSTFYRAKGYYIPIKIKNKVLGVIGVSCPSGPLRPQKKAVVDTVTGQIAIALDREILSKEQEKSKVEIERERLRSNLLRSISHDLRSPLAGIKGAASTILENGELIDEKRKQELINGIYEDTEWLIRLIENLLSMTKFDEGNTKIKKDVELVEEVVSEAVQRSSKYFKNHKIKVSVPEDVIMVSMDGSLIEQVIINLLDNASKFSPKGSTIEIKVYEKKKDVVFEIIDEGQGISEDILPNIFDRFFTNGSKISDSRRGVGLGLAICKSIVEAHGGKIEAVNKGSGGAIFKFNIPKEL

SEQ ID NO: 2004 - DNA, 2583 bp, Mycobacterium tuberculosis
  CDS (1)..(2583)
atgacgttgctcttcgccgatctttgcgcgatctttacgccctaccggtggatgattgagcatgtgaccaccaagcgcgggcagctgcggatctatctgggcgcggcccccggcgtgggcaaaacctacgccatgctcggcgaggcgcaccgcaggctggagcgcggcaccgacgtggtcgccgcggtcgtcgagacacacggacgcaacaagaccgcgaaactgctcgagggcatcgagatgatcccgccgcgctacgtcgaatatcggggtgccaggtttcccgaactcgatgtggaggcagtactgcgacgtcatcctcaggtggtgctggtggacgaactcgcccacaccaacacacctggcagcaagaaccccaagcgctggcaggacgttcaggaaatcctcgacgccggcatcacggtgatctcgacggtcaacatccagcacttggagggcctaaacgatgtcgtggagcaaatcaccggcatcgagcagaaggagaagatccccgacgagatcgtccgcgcggccgatcaggtcgagctggtcgacatcacaccggaagcgttgcggcgcaggcttgctcacggcaacgtctatgcagccgaacgggtcgatgccgcgctgtcgaactacttccgcacgggcaatctgaccgcgctgcgcgagatcgcgttgctgtggctggccgaccaagttgatgcggccctggagaagtaccgcgcagacaaaaagatcaccgccacgtgggaggcgcgggaacgcgtcgtcgtcgccgtgaccggcggcccggagtcggagacgttggtgcgacgggcatcgcggatcgcgtcgaagtccagcgccgagctgatggtggttcacgttatccgtggcgacggcctggcgggggtgtccgcgccgcagctgggcagggtccgcgagctggcgacaagcctcggtgcgaccatgcacaccgtggtcggcgacgacgtgcccaccgcgctgctggacttcgcccgcgagatgaacgccacgcagctcgtcgtcggcacatcgcggcgatcgcgatgggcacgcctgtttgacgaggggatcggcgcccgcaccgtccaggagcccggcggcatcgacgttcacatggtcacccatcccgcggccagccgggcctccgggtggtcgcgggtctccccgcgcgagcggcatatcgcgtcgtggctggccgcgctggtggtgccctcggtgatctgcgccatcacggtggcctggctcgaccgattcatgggcatcggcggcgagagcgcgttgttcttcatcggcgtgctgatcgtggcgttgctgggcggcgtcgcccccgccgcattgtcggccttgctgtcgggcatgctgctgaactactttctgaccgagccccgctacacctggaccatcgccgaaccggacgccgcagtaaccgaattcgtgttgttggcgatggccgttgcggtggcggtgttggtggacggcgcggctagccgaacccgtgaggctcggcgcgcatcccaggaggctgagttgctggccctgtttgccggttcggtgttgcgcggcgcagaccttgccacgctgctgcagcgggtccgcgaaacgtattcccaacgggccgtgaccatgctgcgtgtccggcagggcgcatcgacaggcgaaaccgtcgcgtgcgtcgggacaaacccgtgtcgggacgtcgactccgccgacaccgcaatcgaagtcggcgacgacgagttttggatgctgatggcaggccgcaagttggccgcccgcgaccgccgagtgctgaccgcggtcgcgacacaggccgcgggtctggtgaagcagcgcgagctggcggaagaggccggccaggccgaggccatcgctagggccgatgagctgcgccggtcgctgctgtcggcggtcagccacgacctgcgcaccccgctggcggcggccaaggttgcggtgtccagcttgcgcaccgaagacgtcgctttctcccccgaggataccgccgagctgttggccaccatcgaggagtccatcgaccaactcaccgccctggtcgcaaacctgctcgattcgtcgcggttggctgccggcgtgattcgcccccagctgcgccgggcatacctggaggaagcggtgcaacgggccttggtcagcatcggcaagggcgccaccggtttttaccgatccggcatcgaccgggtcaaggtcgacgtgggagacgccgtggcgatggccgacgccgggttgctggagcgggtgctagccaacctgatcgacaacgcgctgcgatatgcgcccgactgcgtggtccgggtcaacgcgggacgggtgcgtgagcgggtcctgattaatgtcatcgacgagggcccaggggtcccgcgcgggaccgaggagcaactctttgccccgttccagcggccgggggatcacgacaacaccaccggtgtcggtctggggatgtcggtggcacgcggcttcgtcgaggctatgggcggcacgatttcggctaccgataccccgggcggcgggctcacagtggtgatcgatctggcggctcccgaggaccgcccatga

SEQ ID NO: 2005 - protein, 860 aa, Mycobacterium tuberculosis
MTLLFADLCAIFTPYRWMIEHVTTKRGQLRIYLGAAPGVGKTYAMLGEAHRRLERGTDVVAAVVETHGRNKTAKLLEGIEMIPPRYVEYRGARFPELDVEAVLRRHPQVVLVDELAHTNTPGSKNPKRWQDVQEILDAGITVISTVNIQHLEGLNDVVEQITGIEQKEKIPDEIVRAADQVELVDITPEALRRRLAHGNVYAAERVDAALSNYFRTGNLTALREIALLWLADQVDAALEKYRADKKITATWEARERVVVAVTGGPESETLVRRASRIASKSSAELMVVHVIRGDGLAGVSAPQLGRVRELATSLGATMHTVVGDDVPTALLDFAREMNATQLVVGTSRRSRWARLFDEGIGARTVQEPGGIDVHMVTHPAASRASGWSRVSPRERHIASWLAALVVPSVICAITVAWLDRFMGIGGESALFFIGVLIVALLGGVAPAALSALLSGMLLNYFLTEPRYTWTIAEPDAAVTEFVLLAMAVAVAVLVDGAASRTREARRASQEAELLALFAGSVLRGADLATLLQRVRETYSQRAVTMLRVRQGASTGETVACVGTNPCRDVDSADTAIEVGDDEFWMLMAGRKLAARDRRVLTAVATQAAGLVKQRELAEEAGQAEAIARADELRRSLLSAVSHDLRTPLAAAKVAVSSLRTEDVAFSPEDTAELLATIEESIDQLTALVANLLDSSRLAAGVIRPQLRRAYLEEAVQRALVSIGKGATGFYRSGIDRVKVDVGDAVAMADAGLLERVLANLIDNALRYAPDCVVRVNAGRVRERVLINVIDEGPGVPRGTEEQLFAPFQRPGDHDNTTGVGLGMSVARGFVEAMGGTISATDTPGGGLTVVIDLAAPEDRP

SEQ ID NO: 2006 - DNA, 2547 bp, Streptomyces coelicolor
  CDS (1)..(2547)
atgggacgcggcaagcttcggatctacctcggtgcggcaccgggcgtcggcaagacgtacgcgatgctctccgaggcccaccggcgcgtcgaacggggcaccgactgcgtcgtggccctcgtcgagcaccacggcagggcacgcaccgaggtgatgctgcgcggcctggaacaggtgccgcgccgggaggccgagtaccggggcgcggccttcaccgagctggacctggacgcggtactggcccgcgccccccgggtggcgctggtggacgagctggcccacaccaacgtccccggcgtgcgcaacgccaagcgctggcaggacgtcgaggaactcctcgccgccggcatcgacgtcgtctcgaccgtcaacatccagcacctggagtcactcggcgacgtcgtggagtccatcaccggcgtacggcagcgcgagaccgtgccggacgaggtggtgcggcgcgcggaccagatcgaactggtcgacatgtcgccgcaggcgctgcgccgccgcatggcccacggcaacatctaccagtcggacaaggtcgacgcggccctgtccaactacttccgccccggcaatctcaccgccctgcgcgagctggccctgctctgggtcgcggaccgggccgacgagtacctccagcagtaccgcagcgagcaccgggtctcgaagatctggggctcgcgcgaacgcatcgtggtcggcctgaccggcggccccgagggccggacgctgatacggcgggccgcgcgcctcgccgagaaaggcgccggcggcgaggtgctggcggtctacatagcccgcagcgacgggctgacctcggcctctccgaaggagctggcggtccagcgcaccctcgtggaggacctcggcggcaccttccaccacgtgctcggcgaggacataccggccgcgctgctcgacttcgcccgcggcgtcaacgccacccagatcgtcctcggctcctcgcgccgcaaggcctggcagtacgtcttcggacccggcgtcggcgccaccgtcgcccgggagtccggctccgacctggacgtccacatcgtgacccacgaggaggtcgccaaggggcgcgggctgccggtggccaggggcgcgcggctcggccggtcccggatcgtctggggctggttcgcgggcctgggcggcccggtgctgctgacgctgctgctcagcacggtccacctcgggctcgccaacgacgtcctgctctacctggcgctcaccgtcgccgccgccctgctcggcgggctgtacccggcgctcgcctcggccgcggtcgggtcgctgctgctgaactggtacttcacgccgcccgtcaaccggatcaccatcgccgaccccaggaacatgcttgcgctcgccatattcgtgggcgtggcgctctccgtcgcctcggtcgtcgacgtcgcggcccgccgcacccaccaggcggcccggctgcgtgccgagtcggagatcctgtccttcctcgccggtgacgtgctgcgcggcgagaccagcctggagacgctcctggagcgggtgcgcgagaccttcggcatggagtcggccgccctcctggagcgggagggcgacgtggcgccctggacctgtgcgggccgcgccggttccggaccgccggtcgaccgcccggaggacgcggacgtggacatgcccgtcggcgaccacatggccctcgcgctgaccggccgggtcctgcccgccgaggaccgccgggtgctggccgccttcgccgcccaggccgccgtcgtcctggaccgccgccgcctgcgcgaggaggccgaccgggcccgcacgctggccgagggcaaccgcatccgcacggcgctgctggccgccgtcagccacgacctgcgcaccccgctggccgggatcaaggcggcggtgaccagcctcaggtccgacgacgtggcctggtccgaggaggaccgggcggagctgctcgagggcatcgaggagggcgccgaccgcctcgaccacctggtgggcaacctgctcgacatgtcccgcctgcagaccggcaccgtcaccccgctgatccgcgagatcgacgtggacgaggtggcgccgatggcgctcggcggggtccccgagggaagcgcggagctggacatccccgagacgctgcccatggtcgccgtggacgccgggctcctggagcgggcgctggccaacctggtggagaacgccgtcaagtacagtccggacgaccggaccgtcctggtcgccgccagcgccctcgccgaccgcgtcgaggtgcgcgtcgtcgaccgggggccgggagtgccggacgaggccaaggaccgcatcttcgagcccttccagcgctacggcgacgccccgcgcggggccggggtgggactgggcctggccgtggcccgcggtttcgccgaggcgatgggcggcaccctgaacgccgaggacacccccggcggcggcctcaccatggtcctcaccctccgcgcggtgggctcgtccgcgccgacctcccgtcccgcgacagcagaaaggcaggccgccctgtga

SEQ ID NO: 2007 - protein, 848 aa, Streptomyces coelicolor
MGRGKLRIYLGAAPGVGKTYAMLSEAHRRVERGTDCVVALVEHHGRARTEVMLRGLEQVPRREAEYRGAAFTELDLDAVLARAPRVALVDELAHTNVPGVRNAKRWQDVEELLAAGIDVVSTVNIQHLESLGDVVESITGVRQRETVPDEVVRRADQIELVDMSPQALRRRMAHGNIYQSDKVDAALSNYFRPGNLTALRELALLWVADRADEYLQQYRSEHRVSKIWGSRERIVVGLTGGPEGRTLIRRAARLAEKGAGGEVLAVYIARSDGLTSASPKELAVQRTLVEDLGGTFHHVLGEDIPAALLDFARGVNATQIVLGSSRRKAWQYVFGPGVGATVARESGSDLDVHIVTHEEVAKGRGLPVARGARLGRSRIVWGWFAGLGGPVLLTLLLSTVHLGLANDVLLYLALTVAAALLGGLYPALASAAVGSLLLNWYFTPPVNRITIADPRNMLALAIFVGVALSVASVVDVAARRTHQAARLRAESEILSFLAGDVLRGETSLETLLERVRETFGMESAALLEREGDVAPWTCAGRAGSGPPVDRPEDADVDMPVGDHMALALTGRVLPAEDRRVLAAFAAQAAVVLDRRRLREEADRARTLAEGNRIRTALLAAVSHDLRTPLAGIKAAVTSLRSDDVAWSEEDRAELLEGIEEGADRLDHLVGNLLDMSRLQTGTVTPLIREIDVDEVAPMALGGVPEGSAELDIPETLPMVAVDAGLLERALANLVENAVKYSPDDRTVLVAASALADRVEVRVVDRGPGVPDEAKDRIFEPFQRYGDAPRGAGVGLGLAVARGFAEAMGGTLNAEDTPGGGLTMVLTLRAVGSSAPTSRPATAERQAAL

SEQ ID NO: 2008 - DNA, 2694 bp, Photorhabdus luminescens
  CDS (1)..(2694)
atggatcaacacgaaccacagcgccctgaccctgatgaattactgacactggttaatgagaaacagcgcggtaaattaaagatatttttcggtgcctgcgctggcgtcggaaaaacctatgccatgttgcaggaagcgcaaagattgcgtgctcaaggactggatgtggttatcggcgtggtagaaacccatgagcggcaaggaactgccgctttacttgatggtctgccacaactgccactgaagcagatctactaccgacggcgcaaaatcagcgtctttgatcttgatgctgccattgcccgccacccggccatcattttgatggatgagttggcattcagtaatcctcacaccaaccgtcatcccaaacgctggcaagacgttgaagaactgcttgaagctggcatagatgtactgactaccatcaacgttcagcatctggaaagcctcaatgatgttgtgggggatattaccggtatccgggtcagggaaaccattcctgatcatatctttgatcaagcgaatgaaattgtcttagttgatctgcccccggatgatctgcgccagcggctcaatgaaggtaaagtctatattcctagccaggcagaacgtgctattgaacatttttttcgcaaaggtaatttgattgcattgcgggaactggctttgcgccggacggctgatcgggttgatgatcaaatgcgtgctttccgcgacacacaagggcatgaaccggtctggcatacccgtgataatcttctactatgcattggtaacagctcaggtaatgaaaagctcatccgcactgccgctcgccttgcggcccgattaggctgtatctggcatgcaatctacgttgaaaccccaaaactgtaccaactacccgaaggtaaacggcgctccatcttaaaagcgctcagattagcgcatgaattgggggctgaaaccgcgacgctttctgatccaaacaaagaaaaagcggtattacgttatgccagagaacataacctcggcaagattctgataggccgccgctgtacatccaaacagaaactgtttggctggcaatggcgttcaggttttgctgaccgactagggaaactagggccagatttggatctggtgattgtcgcattagaagaacgcagccactgggataaagaacaagacaaccgctctgtgagtgaaaaatggcgagtacagattcagggctgcctgatcgcgattgcgctctgtacacttatcaccttgttctcccgaacgtttttactgacccttgataaagccaatcttgtcacgctttacctgcttggcgtcgtcgtcattgcgctattttacggacgccgaccatcaatctttgctgcttttattaatgtcattagtttcgatatcttctttgtacagcctcattggtctcttgctgttaccgatatgcagtacctgctgacttttagtgtcatgctgatagtgggcgtcgtcgtcggaaacttaacagcaggaatgagatatcaggcgcgaattgcccgttaccgcgaacaacgaacccgcaatctctatgaaatgacccgtgaactgagccgagcgctgaatgaagaagatattgcccgcaccagctaccactttcttactaatggttttcaagctaaaactggcctctttttacccaacgacgatggcaatttatatcaactgacgaccaataatggcggtcacatgctgattgatgatgccattgcaaaatggagttttgataaaaacctgccggccggagcgggaacagatacgctacctagcgtaccttaccaactacagcctatcgccacaccttctcaaacactggcggtattggctattgagccctcctatttgcgccagttactgatccctgaacaacagcgattgctgcaaacatttaccggcctgatcgccaatgcgctggaaagattacaactctcacgccgggcagaatccgccaaattggatacagaaagggaacagttacgtaactcgcttctggcggccctgtctcacgatttacgcacaccgctgaccgtcctattcggacaagcggaaatcctgatgttggatctctctgccgaaggttctccacataccaaacaggtgaatcagatccgccaacaaattctcagcacttcccgtctggttaataacttactggacatggcgcgtatccaatcgggaggcattcagctcaatctggaatggcaatcgctggaagagatcgtcggcagtaccttacgttcgctggaatatgcactcaaccgtcatcccgtcgcggtttccctgccatcggatttactgttgcattgtgatgccagtttactggagcgggtatttatcaacctgttggaaaacgcaattaaatataccgatgaacaaataccattaggtattaaagcgacaacagaaaaaaatcaaattcatattgaagtttgggatgcaggcaaaggcattccgccggaacaagaacagttaattttcgataaattctcccgcgctcgtaaagaatctgctattcccggcgtgggccttggattggcaatttgccgggcaattattgaaattcaccaaggaaagatttgggcgagcaataacgaaaaaggtggagcaagttttcactttgttctaccgttagagaaaccgccagaaattattactgaggagatgtga

SEQ ID NO: 2009 - protein, 897 aa, Photorhabdus luminescens
MDQHEPQRPDPDELLTLVNEKQRGKLKIFFGACAGVGKTYAMLQEAQRLRAQGLDVVIGVVETHERQGTAALLDGLPQLPLKQIYYRRRKISVFDLDAAIARHPAIILMDELAFSNPHTNRHPKRWQDVEELLEAGIDVLTTINVQHLESLNDVVGDITGIRVRETIPDHIFDQANEIVLVDLPPDDLRQRLNEGKVYIPSQAERAIEHFFRKGNLIALRELALRRTADRVDDQMRAFRDTQGHEPVWHTRDNLLLCIGNSSGNEKLIRTAARLAARLGCIWHAIYVETPKLYQLPEGKRRSILKALRLAHELGAETATLSDPNKEKAVLRYAREHNLGKILIGRRCTSKQKLFGWQWRSGFADRLGKLGPDLDLVIVALEERSHWDKEQDNRSVSEKWRVQIQGCLIAIALCTLITLFSRTFLLTLDKANLVTLYLLGVVVIALFYGRRPSIFAAFINVISFDIFFVQPHWSLAVTDMQYLLTFSVMLIVGVVVGNLTAGMRYQARIARYREQRTRNLYEMTRELSRALNEEDIARTSYHFLTNGFQAKTGLFLPNDDGNLYQLTTNNGGHMLIDDAIAKWSFDKNLPAGAGTDTLPSVPYQLQPIATPSQTLAVLAIEPSYLRQLLIPEQQRLLQTFTGLIANALERLQLSRRAESAKLDTEREQLRNSLLAALSHDLRTPLTVLFGQAEILMLDLSAEGSPHTKQVNQIRQQILSTSRLVNNLLDMARIQSGGIQLNLEWQSLEEIVGSTLRSLEYALNRHPVAVSLPSDLLLHCDASLLERVFINLLENAIKYTDEQIPLGIKATTEKNQIHIEVWDAGKGIPPEQEQLIFDKFSRARKESAIPGVGLGLAICRAIIEIHQGKIWASNNEKGGASFHFVLPLEKPPEIITEEM

SEQ ID NO: 2010 - DNA, 2688 bp, Chromobacterium violaceum
  CDS (1)..(2688)
atgaccgatcagcgccccgacccggatgccctgctggacgaactgaaacgcgaagcgctggaagcgcagcgcggacgcctgaagatattcttcggcgcctgcgccggcgtcggcaagacctacgccatgctggccgcagcgcgcgtcaagcgccaggaaggcgtgcgggtgctggtcggcgtggtggaaacccacggccgcaaggaaaccgccgagcagctggaggggctggacatcctgcccctcagccgcatcgagtacaagggccgcgccttgtcggaattcgacatcgacgcggcgctggccgccaaaccccagctgatcctgatcgacgagttcgcccactccaacgcccccggctcgcgccatcccaagcgctggcaggacgtggaggagctgctggccgccggcatcgacgtatacacgacgctgaacgtgcagcatttggagagccttaacgatgtggtcggccagatcaccggcatcatcgtcagggaaacgctgccggaccatgtgttcgacatggccgatgaagtctcgctggtggacctgccgccggacgagctgctgtcccgcctcgcagccggcaaggtctacctgccgcaccaggccgagcgcgcggtcaagaactttttccgcaagggcaatctgctggcgctgcgcgaactggcgctcaggcgcaccgccgaccgggtcgacgcccagatgcgcgcctaccgcgccgaccagtcgatcaagccggtgtggcacgcgcgcgagcggctgctggtctgcgtcggcccaggcccaggcaccgagaagctggtgcgcagcgccaagcgcctggccgccaacctggacgccgattggatcgccgtctacgtggaaacgccgcgcttgcagcggctgcccgaagagcagcgcgcgcggattctgaaagggctgaagctggcgcaggagctgggcgcggaaaccacggtgctgggcggcagctcgctggccgccaccctgctcgcctacgcccgcacccgcaacgtgtccaagctggtggtcggcaagtccaaccgcggctgggccgcgcgcctgtgggaaggctcgctggtcggcgaactcagccgcctgtccggcgacgtcgatgtctacgtggtcgcgcacgaactggaagaagaagccgaccagcggggcaagcgcgtgcccagcctgctgttcagcgatagcgagtccggccacgccgcccgcggctacctggccgccgccgccatctgcttcgccaccaccgagctcaaccacctgctggtgccctacttcgcgctgtccaacgtgatcatggtgcacctgctggcggtggtgctgatcgccacccgctacggccgcgggccgggcgtgctggcatccttcctgtcggtcgcggccttcgactttttcttcgtgccgccgcagctgtcgttcgcggtatccgacacccagtacctgctcaccttcggcgtgatgctggtggtggcgctgatcatcagccagctgaccgcccgcttccgcttcgaggccaccatcgccacctaccgcgagcgccgcacccgcgcgctgtacgacctgggccgcgagctggccagcgcgctgaccgcgtcgcagatcatcgaaaccgcggtcggccggctggagccgctgttccgcgccaaggtgatgctgttcatccccaatagcgaggaccggctgcgcgccgccaccgaaaccggcaacgacgccgacgccggggtcgcgcagtgggtgttcgacaaccagcagcccgccggcctcggcaccaatacgctgccgtccaacgccgcgctttacgtgccgctgaaggccccgatgcgcgtgcgcggcgtgatcgcgctgctgccggaggacgcggttcaccctttcctgccggaacagcagcggctgctggagacctgcgccgcgcagatcgcgctggcgctggagcgagtgcattacgtggaggtggcgcaggacgccatcgtggcgatggagtcagagcgtctccgcaacagcgtgctgtcggtggtgtcgcacgacctgcgcacgccgctgaccaccatgctgggcctggccaatatgctgaacgcccccaccctgccgcccggccggcaaagcgagatcgcccagtccatacaggacgaggcgatacggatgaccaagctggtgaccaacctgctggacatggccaagctgcagtcgggcgtcaagctgaacaaggaatggcagctgctggacgaagtggttggcagcgcggtgcgcgcctgcgagcacagcctgcgccatcacaagctggagctcaagctcagccgcgatctgccggtgctggaatacgacgcggtgctgatagagcgggtgctggtcaacctgctggaaaacgccggcaaatacacgccggccggctcccgcatcgaactggccgcccggcacgatggcgacaaggtgcgcatcaccgtcaccgacgacggccccggcctgcccgccagcatggagcacagggccttcgacaagttcacgcgcggcgcgccggaatcgaccacgcccggcgtcgggctgggcctggccatctgccgcgccatcatcgaaaaccatggcggaacgatagaagccggcaacgcgcagccgcacggcgcccgcttctccttcacgctgccggccggctctccgcccgagctgccgccggaagacgcctga

SEQ ID NO: 2011 - protein, 895 aa, Chromobacterium violaceum
MTDQRPDPDALLDELKREALEAQRGRLKIFFGACAGVGKTYAMLAAARVKRQEGVRVLVGVVETHGRKETAEQLEGLDILPLSRIEYKGRALSEFDIDAALAAKPQLILIDEFAHSNAPGSRHPKRWQDVEELLAAGIDVYTTLNVQHLESLNDVVGQITGIIVRETLPDHVFDMADEVSLVDLPPDELLSRLAAGKVYLPHQAERAVKNFFRKGNLLALRELALRRTADRVDAQMRAYRADQSIKPVWHARERLLVCVGPGPGTEKLVRSAKRLAANLDADWIAVYVETPRLQRLPEEQRARILKGLKLAQELGAETTVLGGSSLAATLLAYARTRNVSKLVVGKSNRGWAARLWEGSLVGELSRLSGDVDVYVVAHELEEEADQRGKRVPSLLFSDSESGHAARGYLAAAAICFATTELNHLLVPYFALSNVIMVHLLAVVLIATRYGRGPGVLASFLSVAAFDFFFVPPQLSFAVSDTQYLLTFGVMLVVALIISQLTARFRFEATIATYRERRTRALYDLGRELASALTASQIIETAVGRLEPLFRAKVMLFIPNSEDRLRAATETGNDADAGVAQWVFDNQQPAGLGTNTLPSNAALYVPLKAPMRVRGVIALLPEDAVHPFLPEQQRLLETCAAQIALALERVHYVEVAQDAIVAMESERLRNSVLSVVSHDLRTPLTTMLGLANMLNAPTLPPGRQSEIAQSIQDEAIRMTKLVTNLLDMAKLQSGVKLNKEWQLLDEVVGSAVRACEHSLRHHKLELKLSRDLPVLEYDAVLIERVLVNLLENAGKYTPAGSRIELAARHDGDKVRITVTDDGPGLPASMEHRAFDKFTRGAPESTTPGVGLGLAICRAIIENHGGTIEAGNAQPHGARFSFTLPAGSPPELPPEDA

SEQ ID NO: 2012 - DNA, 2715 bp, Bordetella pertussis
  CDS (1)..(2715)
atggccgaccccggcaacgaccgcctcgaccccgaccgcctgctccagaccctggagcaggcgcagtccgacgcccggcgcgggcggctgcgcatctacttcggcgcctgcgccggcgtaggcaagacctatgccatgctggccgcggcgcgcgcccaggccgcgcagggcgtggatgtcgtggcggggctggtcgaaacccacggccgcgccgacaccgccgcgctgctcgatacgctgccggccctgcccctgcagacgctcgacttccagggacgccgcctgcgcgaattcgacctgcaggccaccgtggcgcgccggccccgcctgctgctgctcgacgaactggcgcacaccaacgcgcccggggcgcgccacgccaagcgctggcaggacgtcgaggaactgctggcggccggcatcgacgtctggaccaccctcaacgtccagcacctggaaagcctgaacgaggcggtcggcggcatcaccggagtgcgcgtgcgcgaaaccgtgccagactcggtattcgatgccgccgacgagatcatcctggtggacctgtcggccgacgaattgctgcgccgcctgcgcgagggccgggtctatgtgccggaacaggcccgccacgccagccggcacttcttccgcaagggcaatctgatcgccctgcgcgaactggcgctgcgccgcaccgccgaacacgtcgacgacgatgtgcgcgcgtaccgccacgaacgcgcgatcgagccggtctggcgcacgcgcgaggccgtggtcgcctgtatcgacgccgacccgcatgccgagcatgtgctgcgcagcgcgcaccggctggcccagcaactggactgcgagtggcatgccatcaccatcgaggcgccgcgggtcgcgcccctgccgcgcgccggccgggcgcggctggaccaggcgctggcgctggccgagacgctgggcgcgcatgtcgagaccgtggccggcaccgacatggtcgacgccgcgacccgctacatgcgccgccacaacatcaccaaggccgtggtcgggcgcgacgcgtggcgccgccgcggcctgtcgggcctgctggatgccgccctgacgccgggccggctgctgcgccggcgcagcttcgccgatgtcctggcgtcggcctgcccggaagcggacatcgtgagggtcggcgcgccgtcggcggccacggccgcgccacggcgcgacccgcgttcgtggcgcaacgcttccgcgcccgccggccacgccgccgccggcgcctatctgtgggccctggcctattgcgcggcggccaccctggcctcgcgcctggcctttccggttctgcaccagaccaatatcgtcatgatcttcctgctggcggtcgtggcggcggccctgcgccacggacgcgggccggcggcgctggcctcggtggtcagcgtcgcgctgttcgatttcttcttcgtgcagccattggcctcgttcgccgtctcggacgtgcagtacctgctgacgttcgccgtcctgctgacggtcgggctgctgatcggccagctgaccgccggcttgcgccagcaggcccgggccgccgccaggcgcgaggccgatgcgcgcggcctttacgaattcgcgcgggagctgtccgcggccctgcagccggagcaaatcgccggcgcggcctcggcattcctgaacgccgcgttcggcgcccgcggcgccctctacatactgggcctggacgaccggctgcggctggcgcccggcgctggcgacgcggcactcgaacccacgctggcgcaatgggccttcgaccacggccaggcctgcggcgccggcaccgacaccctgtcgaacagccccgtgctgtacctgcccctgcgcgcgcccatgcgggtgcgcggcgtgctggccctgcaccacgccggcccgccgctctacagcgcggcgccggcgcgccgccagctcgacgcctacgccaccctgatcgccatcgccatcgaacggctgcactatgtggaagtcgcccagcaggcgctgctcagtatcgaatccgaacgcctgcgcaacgccctgctggcggcggtctcgcacgatctgcgcacgccgctgaccagcttgctcggcatggccgagaccctgcagcgctcgcccgccgccatgacgccggccgcgctcgaaaccgtggccgccatgcaggaccaggcgcggcgcatgcacgcgctggtcgtcaacctgctggacatggcgcggctgcaaagccacgatgcgccgctgcggcgccaatggcaatcggtcgaggaactggtgggctcggccctggcggccatgaacgccgcgctgcaggatcgccccgtcacggtcgcgccgctttctgccctgccgctggtgaaatgcgatggcatcctgatcgaacgggtgctgtgcaacctgctggaaaatgccgccaaatacacgccgcccggcagtgccatccacatcgacgccctggccgacgcccataccctgcaggtacgggtggccgatgacggggcgggcgtcgcgcaggccgaccgccagcggatcttcgagaaattcgcgcgcggccagcgcgagtcggccccccccccggcgcaggcctcgggctggcggtatgccgcgccatcctggacgcccaccagggccgcatctgggtcgagccggcccggcgcctgcgcggcgcctgcttcgtcttcgcgctgccgctga

SEQ ID NO: 2013 - protein, 904 aa, Bordetella pertussis
MADPGNDRLDPDRLLQTLEQAQSDARRGRLRIYFGACAGVGKTYAMLAAARAQAAQGVDVVAGLVETHGRADTAALLDTLPALPLQTLDFQGRRLREFDLQATVARRPRLLLLDELAHTNAPGARHAKRWQDVEELLAAGIDVWTTLNVQHLESLNEAVGGITGVRVRETVPDSVFDAADEIILVDLSADELLRRLREGRVYVPEQARHASRHFFRKGNLIALRELALRRTAEHVDDDVRAYRHERAIEPVWRTREAVVACIDADPHAEHVLRSAHRLAQQLDCEWHAITIEAPRVAPLPRAGRARLDQALALAETLGAHVETVAGTDMVDAATRYMRRHNITKAVVGRDAWRRRGLSGLLDAALTPGRLLRRRSFADVLASACPEADIVRVGAPSAATAAPRRDPRSWRNASAPAGHAAAGAYLWALAYCAAATLASRLAFPVLHQTNIVMIFLLAVVAAALRHGRGPAALASVVSVALFDFFFVQPLASFAVSDVQYLLTFAVLLTVGLLIGQLTAGLRQQARAAARREADARGLYEFARELSAALQPEQIAGAASAFLNAAFGARGALYILGLDDRLRLAPGAGDAALEPTLAQWAFDHGQACGAGTDTLSNSPVLYLPLRAPMRVRGVLALHHAGPPLYSAAPARRQLDAYATLIAIAIERLHYVEVAQQALLSIESERLRNALLAAVSHDLRTPLTSLLGMAETLQRSPAAMTPAALETVAAMQDQARRMHALVVNLLDMARLQSHDAPLRRQWQSVEELVGSALAAMNAALQDRPVTVAPLSALPLVKCDGILIERVLCNLLENAAKYTPPGSAIHIDALADAHTLQVRVADDGAGVAQADRQRIFEKFARGQRESAPPPAQASGWRYAAPSWTPTRAASGSSRPGACAAPASSSRCR

SEQ ID NO: 2014 - DNA, 2796 bp, Bordetella bronchiseptica
  CDS (1)..(2796)
atgcgtgccgcctgcgcgcgacccttcccgacgcgacacacccaccccatggccgaccccggcaacgaccgcctcgaccccgaccgcctgctccagaccctggagcaggcgcagtccgacgcccggcgcgggcggctgcgcatctacttcggcgcctgcgccggcgtaggcaagacctatgccatgctggccgcggcgcgcgcccaggccgcgcagggcgtggatgtcgtggcggggctggtcgaaacccacggccgcgccgacaccgccgcgctgctcgatacgctgccggccctgcccctgcagacgctcgacttccagggacgccgcctgcgcgaattcgacctgcaggccgccgtggcgcgccggccccgcctgctgctgctcgacgaactggcgcacaccaacgcgcccggggcgcgccacgccaagcgctggcaggacgtcgaggaactgctggcggccggcatcgacgtctggaccaccctcaacgtccagcacctggaaagcctgaacgaggcggtcggcggcatcaccggagtgcgcgtgcgcgaaaccgtgccagactcggtattcgatgccgccgacgagatcatcctggtggacctgtcggccgacgaattgctgcgccgcctgcgcgagggccgggtctatgtgccggaacaggcccgccacgccagccggcacttcttccgcaagggcaatctgatcgccctgcgcgaactggcgctgcgccgcaccgccgaacacgtcgacgacgatgtgcgcgcgtaccgccacgaacgcgcgatcgagccggtctggcgcacgcgcgaggccgtggtcgcctgtatcgacgccgacccgcatgccgagcatgtgctgcgcagcgcgcaccggctggcccagcaactggactgcgagtggcatgccatcaccatcgaggcgccgcgggtcgcgcccctgccgcgcgccggccgggcgcggctggaccaggcgctggcgctggccgagacgctgggcgcgcatgtcgagaccgtggccggcaccgacatggtcgacgccgcgacccgctacatgcgccgccacaacatcaccaaggccgtggtcgggcgcgacgcgtggcgccgccgcggcctgtcgggcctgctggatgccgccctgacgccgggccggctgctgcgccggcgcagcttcgccgatgccctggcgtcggcctgcccggaagcggacatcgtgcgggtcggcgcgccgtcggcggccacagccgcgccacggcgcgacccgcgttcgtggcgcaacgcttccgcgcccgccggccacgccgccgccggcgcctatctgtgggccctggcctattgcgcggcggccaccctggcctcgcgcctggcctttccggttctgcaccagaccaatatcgtcatgatcttcctgctggcggtcgtggcggcggccctgcgccacggacgcgggccggcggcgctggcctcggtggtcagcgtcgcgctgttcgatttcttcttcgtgcagccattggcctcgttcgccgtctcggacgtgcagtacctgctgacgttcgccgtcctgctgacggtcgggctgctgatcggccagctgaccgccggcttgcgccagcaggcccgggccgccgccaggcgcgaggccgatgcgcgcggcctttacgaattcgcgcgggagctgtccgcggccctgcagccggagcaaatcgccggcgcggcctcggcattcctgaacgccgcgttcggcgcccgcggcgccctctacatactgggcctggacgaccggctgcggctggcgcccggcgctggcgacgcggcactcgaacccgcgctggcgcaatgggccttcgaccacggccaggcctgcggcgccggcaccgacaccctgtcgaacagccccgtgctgtacctgcccctgcgcgcgcccatgcgggtgcgcggcgtgctggccctgcaccacgccggcccgccgctctacagcgcggcgccggcgcgccgccagctcgacgcctacgccaccctgatcgccatcgccatcgaacggctgcactatgtggaagtcgcccagcaggcgctgctcagtatcgaatccgaacgcctgcgcaacgccctgctggcggcggtctcgcacgatctgcgcacgccgctgaccagcttgctcggcatggccgagaccctgcagcgctcgcccgccgccatgacgccggccgcgctcgaaaccgtggccgccatgcaggaccaggcgcggcgcatgcacgcgctggtcgtcaacctgctggacatggcgcggctgcaaagccacgatgcgccgctgcggcgccaatggcaatcggtcgaggaactggtgggctcggccctggcggccatgaacgccgcgctgcaggatcgccccgtcacggtcgcgccgctttctgccctgccgctggtggaatgcgatggcatcctgatcgaacgggtgctgtgcaacctgctggaaaatgccgccaaatacacgccgcccggcagtgccatccacatcgacgccctggccgacgcccataccctgcaggtacgggtggccgatgacggggcgggcgtcgcgcaggccgaccgccagcggatcttcgagaaattcgcgcgcggccagcgcgagtcggccacccccggcgcaggcctcgggctggcggtatgccgcgccatcctggacgcccaccagggccgcatctgggtcgagccggcccggcgcctgcgcggcgcctgcttcgtcttcgcgctgccgctgaccccgccgccggccgtgccccccgaacccgcctga

SEQ ID NO: 2015 - protein, 931 aa, Bordetella bronchiseptica
MRAACARPFPTRHTHPMADPGNDRLDPDRLLQTLEQAQSDARRGRLRIYFGACAGVGKTYAMLAAARAQAAQGVDVVAGLVETHGRADTAALLDTLPALPLQTLDFQGRRLREFDLQAAVARRPRLLLLDELAHTNAPGARHAKRWQDVEELLAAGIDVWTTLNVQHLESLNEAVGGITGVRVRETVPDSVFDAADEIILVDLSADELLRRLREGRVYVPEQARHASRHFFRKGNLIALRELALRRTAEHVDDDVRAYRHERAIEPVWRTREAVVACIDADPHAEHVLRSAHRLAQQLDCEWHAITIEAPRVAPLPRAGRARLDQALALAETLGAHVETVAGTDMVDAATRYMRRHNITKAVVGRDAWRRRGLSGLLDAALTPGRLLRRRSFADALASACPEADIVRVGAPSAATAAPRRDPRSWRNASAPAGHAAAGAYLWALAYCAAATLASRLAFPVLHQTNIVMIFLLAVVAAALRHGRGPAALASVVSVALFDFFFVQPLASFAVSDVQYLLTFAVLLTVGLLIGQLTAGLRQQARAAARREADARGLYEFARELSAALQPEQIAGAASAFLNAAFGARGALYILGLDDRLRLAPGAGDAALEPALAQWAFDHGQACGAGTDTLSNSPVLYLPLRAPMRVRGVLALHHAGPPLYSAAPARRQLDAYATLIAIAIERLHYVEVAQQALLSIESERLRNALLAAVSHDLRTPLTSLLGMAETLQRSPAAMTPAALETVAAMQDQARRMHALVVNLLDMARLQSHDAPLRRQWQSVEELVGSALAAMNAALQDRPVTVAPLSALPLVECDGILIERVLCNLLENAAKYTPPGSAIHIDALADAHTLQVRVADDGAGVAQADRQRIFEKFARGQRESATPGAGLGLAVCRAILDAHQGRIWVEPARRLRGACFVFALPLTPPPAVPPEPA

SEQ ID NO: 2016 - DNA, 2556 bp, Streptomyces avermitilis
  CDS (1)..(2556)
atggcacgcggcaagcttcggatctacctcggtgcggcaccgggcgtcggcaagacgtacgccatgctctccgaggcgcaccgccgcgtcgagcgcggcacggactgcgtggtcgccttcgtggaacaccacgggcggccgcgcaccgaggtgatgctgcacggtctggagcaggtcgcgcgcagggagctcgcgtaccgggacaccgtcttcgccgagatggacgtggacgccgtcctgcggcgggcccccgccgtcgctctggtggacgaactcgctcacaccaatgttccgggctcccgcaacgccaaacgctggcaggacgtcgaggagctgctcgcggcgggcatcgacgtcgtgtcgaccgtcaacatccagcacctggagtcgctgggcgacgtcgtggagtcgataaccggcgtacgccagcgcgagaccgttccggacgagatggtgcgccgggccgaccagatcgagctggtcgacatgtcgccgcaggccctgcgccgccgcatggcgcacggcaacatctacaagccggacaaggtcgacgcggccctgtccaactacttccgcccgggcaacctgaccgcgctgcgcgagctggcgctgctgtgggtggccgaccgggtcgacgcgtacctgacggagtaccgcagcgagcaccgggtctcggcgatatggggctcgcgcgagcgcatcgtggtcggactgacgggcggccccgagggccgtacgctgatccggcgcgccgcacgcctcgcggagaagggcgcgggcggcgaggtcatggccgtctacatcgcccgcagcgacgggctgacctccgcctcgcccaaggagctggccgtccagcgcacgctcgtcgaggacctgggcggcaccttccaccacgtcgtcggggacgacataccctccgcgctgctggacttctcgcgcggcgtcaacgccacgcagatcgtgctcggctcctcgcgccgcaaggcctggcagtacatgttcgggccgggcgtcggcgccacggtcgcccgcgagtcgggacccgacctggacgtccacatcgtcacccatgaggaggtcgccaaggggcgcggtctcccggtcgcccggggtgcgcggctcggccggtcgcggatcatctggggctggctggtcggcgtggccgggccggtcgtcctcgcgctgctgctgaacaccgtcgacctcggcctcgccaacgacatgctgctgttcctggcgctgaccgtggcggccgccctgctcggcgggctgctgcccgccctcgcctcggcggccttcgggtcgctgctgctgaactactactacacgccgccgctgcaccggctgacgatcgccgaccccaagaacatcatcgccatcgcgatcttcgtcggtgtcgccgtctccgtggcctccgtggtggacctcgccgcccgccgtacgcatcaggcggcccggctgcgtgccgagtcggagatcctctccttcctcgcgggcagcgtgctgcgcggcgagaccagtctggacgccctgctcgaacgcgtccgcgagaccttcggcatggagtcggtcgccctgctggagcgggagagcgacgtcgcgccgtggacctgcgcgggcagtgtgggcgtgcgtccgctggtcgaccggccggaggacgcggacgtggacatgcccgtgggcgaccacatggccctcgcgctgtccgggcgcgtgctgcccgcctccgaccgccgggtgctcgccgcgttcgccgcccaggccgccgtcgtcctggaccgccagcgccttcagcgcgaggcggaccaggcccgcacgctcgccgagggcaacagcatccgtaccgcgctgctggccgcggtcagccatgacctgcggaccccgctggcggggatcaaggcggccgtgtcctccctgcgctccgacgacgtggcctggtccgaggaggaccgggcggagctcctcgaaggcatcgaggacggcgcggaccgcctcgaccacctggtgggcaacctgctggacatgtcccggctgcagaccgggaccgtgaccccgctgatccgcgagatcgacctcgacgaggtggtgccgatggcgctcggcggagtgcccgaggacagcgtggtgctggacatcccggagagtctgccgatggtggccgtcgaccccggtctgctggagcgctcggtggccaacctcgtcgagaacgcggtcaagtacagcccttcggacgagtcggtcctggtggccgcgagcgccctcgccaaccgggtggaactccgtgtggtggaccgcgggcccggtgtccccgacgaggcgaaggaccgcatcttcgcgcccttccagcgctacggcgacgccccgcgcggtgtcggtgtcggcctgggtctcgcggtggcacgcggcttcgccgaggcgatgggtggcacgctgaacgccgaggacactcccggcggcggcctcaccatggtgctgacggtcggggcggcggtggacagccccgccggccgtcccggcctcgcgcacgcaacagcagaaaggcagaccagatgctga

SEQ ID NO: 2017 - protein, 851 aa, Streptomyces avermitilis
MARGKLRIYLGAAPGVGKTYAMLSEAHRRVERGTDCVVAFVEHHGRPRTEVMLHGLEQVARRELAYRDTVFAEMDVDAVLRRAPAVALVDELAHTNVPGSRNAKRWQDVEELLAAGIDVVSTVNIQHLESLGDVVESITGVRQRETVPDEMVRRADQIELVDMSPQALRRRMAHGNIYKPDKVDAALSNYFRPGNLTALRELALLWVADRVDAYLTEYRSEHRVSAIWGSRERIVVGLTGGPEGRTLIRRAARLAEKGAGGEVMAVYIARSDGLTSASPKELAVQRTLVEDLGGTFHHVVGDDIPSALLDFSRGVNATQIVLGSSRRKAWQYMFGPGVGATVARESGPDLDVHIVTHEEVAKGRGLPVARGARLGRSRIIWGWLVGVAGPVVLALLLNTVDLGLANDMLLFLALTVAAALLGGLLPALASAAFGSLLLNYYYTPPLHRLTIADPKNIIAIAIFVGVAVSVASVVDLAARRTHQAARLRAESEILSFLAGSVLRGETSLDALLERVRETFGMESVALLERESDVAPWTCAGSVGVRPLVDRPEDADVDMPVGDHMALALSGRVLPASDRRVLAAFAAQAAVVLDRQRLQREADQARTLAEGNSIRTALLAAVSHDLRTPLAGIKAAVSSLRSDDVAWSEEDRAELLEGIEDGADRLDHLVGNLLDMSRLQTGTVTPLIREIDLDEVVPMALGGVPEDSVVLDIPESLPMVAVDPGLLERSVANLVENAVKYSPSDESVLVAASALANRVELRVVDRGPGVPDEAKDRIFAPFQRYGDAPRGVGVGLGLAVARGFAEAMGGTLNAEDTPGGGLTMVLTVGAAVDSPAGRPGLAHATAERQTRC

SEQ ID NO: 2018 - DNA, 2553 bp, Enterococcus faecalis
  CDS (1)..(2553)
atgcaatctggcgatggacgccgaggtcgattgcggatattttttggatttgcggctggtgttgggaaaacctacggtatgttgacagaggctcatgaattattgatgatgggaaaacatgttgttgtcggctatatcgaacctcatgatcgtccagataccaatcgattattagaaggattaccgcaaattcctcctaagaatattttttataaacaaatggttttaacagagccggatattgatcaaatcattcaacagaagcccgaaatcgtgttgattgatgaactggctcattccaatgcggaaggttctcgaaatcgtaaacgataccaggatattgatgaactgttgaatgcaggaatcgatgtttttactacggtcaatgttcaacatatcgaaagtttgaatgatatcgttgaagaagttaccggaattgaggtcaaggaaacggtgccggacacttttctacggcaagcgacaataagagtgattgatgtggagcccgatgagctgatcgaacgacttgaacaaggaaaaatatatgcgaatgaaaacgcgaaacgtgccttgaaaaatttttttattccacaaaaattggaccaattacgtggattagcaattcagcgagcgtcggatcatattaatcgaattagtggaaagacaattgggatacaaagtaaattattgacggtggtgaacgatgcctttccaaaaatgaccgaaaaatgtattcgctggacagcacgtttagcgcaaggtctagttgtcgattggacagtgattcaagttcgtacgcaagaaaatacaccaacgaacattcctttagccgataaattaggtgcggaggttattagtattgaagaggatgatagttttgagacgattgtcgagttcgcaaaaatgacgggtgttactgatattattatggggaaaaatctaaggcagccgtggtatgaaaaaatctttattgaagcgtttgatgatcgcttgttaaaacgattgaaagatacggaacttcatttaattcctttcaatgaagaaaagcggtctttattttttaagactcgtaaagtcattgagggtggcggaaaagatttagtgattgcaattggtggtgtttttctagcgacggtcgtgacggaattgatgcaatatatccacgttggcgatcaaaatctgatgcttatttatatttcattcgtattattagtcgctcgaacgacatccggttatttttggagctcattatcctctattttaagtgttttgtcttttaactggttttttgtcgaaccattatattctctgacagtatataaacagggatatccttttactttattgctcatgctagttgttgccctgatgagcagtaatttaatgattcgattaaagaaacaagcagatacttctatgaaaaaagagcaccaaatggaaattttgtacgaattgaacaaacgatatgttttagtggaaagtcgaaaacaaattcttgatatttctgccacttatttatcaagattattggaacgagaagtgattatttttgatcgtcaagtgaagacagagagtgttcattgtatcaacgaaaaaaaatcaatattaaataatgaagacgaagcagctgtagccttttgggcagcaaagaaccaaaaagaagctgggaatggtacagacacactaaatggagctaaaggattctatttgccgattgctgcaggcaggaagacgttggcggtattaggcattgaacgaaatgcagatcttgatttggaaaatgatcagctcaattacttaaaattggtgctgactcaaattgcggtcatcttggaacaaacagaattgaaagatgagaaagagcaagttgagttagaaaatgaacgggaaaaagtccgcagcaatttattacgagccgtatctcatgatctgagaacaccattaactgttatctcagggattgctgaaacattaggcattggaaatgatttaaaagaagagacacagcgaaaattattaaaggatattcaagaagagtcacaatggctgattcggatggttgaaaatcttttatccatcacgcgaatcaacatggatactatgaaggttaataaaactgctgaaccagtagaagaggtcatcgaggctgtttataagcatttgaggaaggtctatccagacggccaagtggatattcacctgccagaagaggtcatttttattcaagcggaccccattttgattgaacaagcgttgtttaatctgatagaaaatgcgtttcgtcatggagaaaatgatctaccagtcaaactaaacgtctatcaggaaaaagaacaaacagtttttgaaattgaaaatcacggcgaaattccattaaaacaatttcaaaagatccaatcaaacttgtccggcacaaatgaagtaccggttgactcaaaaaatggtttaggaatcggattgagtattgtaaaaacaatcgtccatgcgcacaatggtaaaatggaaatgacgataggtaggggcaaaacattggttcgaatttatttgaagtga

SEQ ID NO: 2019 - protein, 850 aa, Enterococcus faecalis
MQSGDGRRGRLRIFFGFAAGVGKTYGMLTEAHELLMMGKHVVVGYIEPHDRPDTNRLLEGLPQIPPKNIFYKQMVLTEPDIDQIIQQKPEIVLIDELAHSNAEGSRNRKRYQDIDELLNAGIDVFTTVNVQHIESLNDIVEEVTGIEVKETVPDTFLRQATIRVIDVEPDELIERLEQGKIYANENAKRALKNFFIPQKLDQLRGLAIQRASDHINRISGKTIGIQSKLLTVVNDAFPKMTEKCIRWTARLAQGLVVDWTVIQVRTQENTPTNIPLADKLGAEVISIEEDDSFETIVEFAKMTGVTDIIMGKNLRQPWYEKIFIEAFDDRLLKRLKDTELHLIPFNEEKRSLFFKTRKVIEGGGKDLVIAIGGVFLATVVTELMQYIHVGDQNLMLIYISFVLLVARTTSGYFWSSLSSILSVLSFNWFFVEPLYSLTVYKQGYPFTLLLMLVVALMSSNLMIRLKKQADTSMKKEHQMEILYELNKRYVLVESRKQILDISATYLSRLLEREVIIFDRQVKTESVHCINEKKSILNNEDEAAVAFWAAKNQKEAGNGTDTLNGAKGFYLPIAAGRKTLAVLGIERNADLDLENDQLNYLKLVLTQIAVILEQTELKDEKEQVELENEREKVRSNLLRAVSHDLRTPLTVISGIAETLGIGNDLKEETQRKLLKDIQEESQWLIRMVENLLSITRINMDTMKVNKTAEPVEEVIEAVYKHLRKVYPDGQVDIHLPEEVIFIQADPILIEQALFNLIENAFRHGENDLPVKLNVYQEKEQTVFEIENHGEIPLKQFQKIQSNLSGTNEVPVDSKNGLGIGLSIVKTIVHAHNGKMEMTIGRGKTLVRIYLK

SEQ ID NO: 2020 - DNA, 2664 bp, Pseudomonas syringae
  CDS (1)..(2664)
atgagtgattccggtcgagctgacgcattgttggcccagttaccccgcgaaggccgtgggcggctgaaagtttttctcggcgcggcgcctggcgtcggcaaaacctacgccatgctccaggcagcccacgcgcagttacgccagggcgtcagggtgatggcgggcgtggtggaaacccacggccgcgcggaaaccgaggcgttgctcaacggcctgccgcaacagcccttgctgcgcaccgaataccgcggcatgaccctcgaagaaatggacctcgacgcgctgctcaaggcggcgccgagcctggtgctggtcgacgaactggcgcacaccaatgcgcccggcagccggcacaccaaacgctggcaggatattcaggaattgctcgcggccggcatcgacgtctataccaccgtcaacgtccagcacctggaaagcctcaatgatcaggtgcgcggcatcaccggcgtgcaggtgcgtgaaacactgcccgattgggtgttgcaggaagccttcgacctggtgctgatcgacctgccgccgcgcgagctgctcgagcgcctgcgcgacggcaaggtctacgtaccggagcaggcgcgcgctgccatcgacgccttcttcacccagaccaacctcaccgcgctgcgcgaaatggccatgcagaccgcagcggcgcaggtcgataacgatctggcgcagggctatcggcaattgggccagtctgccccggcggtgcgcgggcggatgttggtgggcattgatggcgacatgcatgccgagcgtctggtgcgccacgccagccgggtggcccagcgtcgtcatctgccttggagcgcggtgcatgtggatgacgggcaaaccctcgacgagcaatcgcgggcacgcttgcaaaacgcccagcaacttgccgagcgactcggtggtgaagcggtttcgttgcgcgccggggaagttgccagaacgctggtgcagcatgccatcgaacggcgtgccagcgtggtgctggtcgggcaatcgcggcggcactggcgacgccgggtgttcggtggtggcgtcgcggcgcgtttgctgcgcgaagggcacgggctggaaatctcggtgctcgatgacagtgaagagctgcctgatcaaccgccgcgtgcgcgcccggcgcgcgaagtggtgtggttcgactacggcctggctttcgtcgccacgctgatcgccagtctggtggcctggggtgtggcgggggtgctggcgctgcccaatatttccctgatctttctcgccgcggtgctgctggtcgccgtgcgcagcagcatggggccggcgctggcctgtgccggattgtcgtttctggcttacgacttcttgttcataccgccgagtttttccctgaacatccagcgcgaagaggacgtgctgacgctgttgttcttcctgctgatgtcggcgctgaccggcaaactggctgctcgccagcgcaggcaattgcaggcgctgcgtgatactcaggaacagaccagcgagctgctcgacctgtcgcgcaagatgaccgccgccactgaccgcaaagcggtactcaacgccgccgaacagcatttttccggctggaaggagctgtacctgtgcctggtggatcgcgatacgcagggcggcctggtggtcgaaaccggcgggccgctgacgttttcggaagccgaacgggcagcggccgactgggcgtggcagcacgatcaaccggcaggcagcggcaccggtacgctaccttcgggtcgctggtggtggtggccgattaccgcagaagaagggccactggcattgctgggtgtgtgtgcacgggaagggcagtcgtttaccgatcagcacagacggctgctggccgcactgactcagccactcgcccaggccttggcccgtgcgcaactggcgcaggagcttgaggcggcgcgtctgcacggcgaaaccgagcaactgcgcagcgccttgctggcctcggtgtcgcacgacctgcgtaccccgctgacctcgatgcgcggcagtatcgacagcctgctagcgctgggcgaagccattgcgctggaggatcgccgcgagctgctggaaggcactcgtgacgaggctgagcgcctggaccgctatatccagaacctgctggacatgacccgtctgggccatggagcgctgaaactggcgcgcgactgggtgtcgcctgccgatattgtcggcagcgcgctgaaccgcctgcgtgcggtgctgacgccgttgcaggtcagcacgcaggtcaccggcgacttgccgttgctgtatgtccacgcggcgttgatcgagcaggcgctggtcaacgtcctggagaacgcggcacgtttttcacccctcggcgggcgcttgcaagtaacggccggcgtggtcgacagcgagctgttcttctcggtcagtgacgaagggcctggcatccccgaggatgagcgggcgaagattttcgacatgttctacaccgccgctcgcggtgatcgcggcgggcagggcaccgggctcggcctggcaatctgtcagggcatgatcggcgcgcatggcggacggctcacggtcgaggaaggcatcgacgggctgggtacgcgcatcacgttgtttctgccgctacaggcccagcctgacgctgaaatggaggaacccgcttga

SEQ ID NO: 2021 - protein, 887 aa, Pseudomonas syringae
MSDSGRADALLAQLPREGRGRLKVFLGAAPGVGKTYAMLQAAHAQLRQGVRVMAGVVETHGRAETEALLNGLPQQPLLRTEYRGMTLEEMDLDALLKAAPSLVLVDELAHTNAPGSRHTKRWQDIQELLAAGIDVYTTVNVQHLESLNDQVRGITGVQVRETLPDWVLQEAFDLVLIDLPPRELLERLRDGKVYVPEQARAAIDAFFTQTNLTALREMAMQTAAAQVDNDLAQGYRQLGQSAPAVRGRMLVGIDGDMHAERLVRHASRVAQRRHLPWSAVHVDDGQTLDEQSRARLQNAQQLAERLGGEAVSLRAGEVARTLVQHAIERRASVVLVGQSRRHWRRRVFGGGVAARLLREGHGLEISVLDDSEELPDQPPRARPAREVVWFDYGLAFVATLIASLVAWGVAGVLALPNISLIFLAAVLLVAVRSSMGPALACAGLSFLAYDFLFIPPSFSLNIQREEDVLTLLFFLLMSALTGKLAARQRRQLQALRDTQEQTSELLDLSRKMTAATDRKAVLNAAEQHFSGWKELYLCLVDRDTQGGLVVETGGPLTFSEAERAAADWAWQHDQPAGSGTGTLPSGRWWWWPITAEEGPLALLGVCAREGQSFTDQHRRLLAALTQPLAQALARAQLAQELEAARLHGETEQLRSALLASVSHDLRTPLTSMRGSIDSLLALGEAIALEDRRELLEGTRDEAERLDRYIQNLLDMTRLGHGALKLARDWVSPADIVGSALNRLRAVLTPLQVSTQVTGDLPLLYVHAALIEQALVNVLENAARFSPLGGRLQVTAGVVDSELFFSVSDEGPGIPEDERAKIFDMFYTAARGDRGGQGTGLGLAICQGMIGAHGGRLTVEEGIDGLGTRITLFLPLQAQPDAEMEEPA

SEQ ID NO: 2022 - DNA, 2655 bp, Pseudomonas putida
  CDS (1)..(2655)
atgagtgactccgcccgcgccgatgcgctgttggccaacctcccacgcaccggccggggccggctgaaggtgttcctgggcgctgcccccggcgtcggcaagaccttcgccatgctccaggccgcacacgcccagcaacgccagggcgtgcaggtgttggccggggtggtcgaaacccatggccgcgccgaaaccgaagcgttgctcggagggctgcatcagcagcccttgttgcgcagccagtaccgtggcgtcacccttgaggaaatggaccttgacggcctgctgcgtgccgcgccggccttggccctggtggacgaactggcccacacgaacgcccccggcagccgccacgccaaacgctggcaggatgtgcaagaactcttggccgcgggcatcgacgtgtacaccacggtcaacgtccagcacctggaaagcctcaacgacaaggtccgcgacattaccggcgtgcaagtgcgcgagaccctgccggactgggtgctgcaggaagcgttcgagctggtgctgatcgacctgcctccgcgagagctgctcgaacgcctgcgtgaaggcaaggtgtacgtgcccgagcaggcaagggcggccatcgatgcgtatttttcgcaaaccaacctcaccgccctgcgcgagctggccatgcagaccgccgctgctcaggtcgatgccgacctggcccacggctatcgtcagcgcggccaggaggcgccggccttgcgcggccggttgctggtgggcatagacggtgacgaccaggccgaacgcctggtgcgccatgccagccgcgtggcccagcgccgccacctgccctggagcctggtgcatgtggacaacggccgcctgcgtgacgaaaccgcacggcatcgtttgcaagccgcgcagcaactggccgagcgactgggcggggaggtggtactgctgcgtgctggcgaagtggcccgtacgctgatccagcatgctgtcgagcggcgggccagcctggtgctggtcgggcagtcccgcaaccgcctgcgtaggcgtttgttcggcgcgggtgtggcggcgcggctgctgcgcgaaagccgtggcctggaaatcaacgtgctggaccgcgacgtgcagccgccagcgccgcgttcagccgtgcggcgggtgtgggtgtggcgtcattacctgcttgcgctgctggccaccgtgatggctgcgggtctggcctgggcggtgtccagtgtgctcgcgttgcccaatatctcgctggtgttcctggcggcggtgttgctggtcgcggtgcgcagtagcctgggacctgcgctggcttgcgccgcgctgtcgttcctggtctatgacttcctgttcataccgcccaacttctcgttcaccatccagcgcgaagaagacgtgctgacactggtgttctttctgttgatggctgcgcttaccggcaacctggccgcgcgccagcgtcgccagttgcaggcgctgcgcgagacccaggcacagaccagccagttgctcgacctgtctcgccggttgacggtagccaccgaccgccaagccatattcaaggctgccggccagcacctggacgggtggcaggacgcccaggtgtgcttgctggagcgcaacgccgaaggccagttgcaagtggccagcggggaagcctgcaccttcagcgacaccgaacgggcggctgccgattgggcctggcagcatgggcaggccgccggtcacggcagcgataccctgcctaatggccgctggtggtggtggccattggcggtagacgatcagccgctggcgctgctgggtgtgcgcccgcgcaacgggcagccgctcagcgacccacgccggcgcctgctcaccgccctaggccagcccctggcccaggccctggcccgcgcacgcctggctgaacagctggaagccgcacgcctgcacggcgaaaccgagcaactgcgcagcgccctgctggcttccgtatcccatgacttgcgcacgccgttgaccgccatgcgtggcagcatcgacagcctgttggcgttgggcgatgcgatcccggctgaagaccgccgcgagctgctggagggcacccgtaacgaagccgaacgcctcgatcgctacatccagaacctgctggacatgacccgcctgggccatggcggcctcaagctggcccgcgactgggtggccccggcggatatcgtcggcagtgcgctcaaccgcctgcgggtggtgctggcgccgctgcgtgtgcacacggacgtgccgaccgagctgccattgctgttcgtgcatgcggcgttgatcgagcaggcactggtcaacgtgctggaaaacgccgcacgcttttcgccggccaatggtcggcttgagctgcaggtggcggtgcatgacgaccaactgcgcttgaccgtcagcgaccagggccccggcattcctgaagccgaccgcgagaaaatcttcgatatgttctacaccgccgcccgtggcgaccgcggcgggcagggtaccgggctgggcctggctatctgccagggcatgatcggtgcccatggcgggcagattctggtgggcgaaggcattgatggccaaggcaccagcatcactctatgcttgccgctgcctcctcaacctgaagccgaaagcgaaaccccatga

SEQ ID NO: 2023 - protein, 884 aa, Pseudomonas putida
MSDSARADALLANLPRTGRGRLKVFLGAAPGVGKTFAMLQAAHAQQRQGVQVLAGVVETHGRAETEALLGGLHQQPLLRSQYRGVTLEEMDLDGLLRAAPALALVDELAHTNAPGSRHAKRWQDVQELLAAGIDVYTTVNVQHLESLNDKVRDITGVQVRETLPDWVLQEAFELVLIDLPPRELLERLREGKVYVPEQARAAIDAYFSQTNLTALRELAMQTAAAQVDADLAHGYRQRGQEAPALRGRLLVGIDGDDQAERLVRHASRVAQRRHLPWSLVHVDNGRLRDETARHRLQAAQQLAERLGGEVVLLRAGEVARTLIQHAVERRASLVLVGQSRNRLRRRLFGAGVAARLLRESRGLEINVLDRDVQPPAPRSAVRRVWVWRHYLLALLATVMAAGLAWAVSSVLALPNISLVFLAAVLLVAVRSSLGPALACAALSFLVYDFLFIPPNFSFTIQREEDVLTLVFFLLMAALTGNLAARQRRQLQALRETQAQTSQLLDLSRRLTVATDRQAIFKAAGQHLDGWQDAQVCLLERNAEGQLQVASGEACTFSDTERAAADWAWQHGQAAGHGSDTLPNGRWWWWPLAVDDQPLALLGVRPRNGQPLSDPRRRLLTALGQPLAQALARARLAEQLEAARLHGETEQLRSALLASVSHDLRTPLTAMRGSIDSLLALGDAIPAEDRRELLEGTRNEAERLDRYIQNLLDMTRLGHGGLKLARDWVAPADIVGSALNRLRVVLAPLRVHTDVPTELPLLFVHAALIEQALVNVLENAARFSPANGRLELQVAVHDDQLRLTVSDQGPGIPEADREKIFDMFYTAARGDRGGQGTGLGLAICQGMIGAHGGQILVGEGIDGQGTSITLCLPLPPQPEAESETP

SEQ ID NO: 2024 - DNA, 2724 bp, Bradyrhizobium japonicum
  CDS (1)..(2724)
atggtccgagagcgccgcgattccgaacaacgtccgtctcccgaggcactgctggaagccgcgcgccgggaggaaagcgcgagcggcaagctgaagattttcgtcggcgcggccccgggcgtcggcaagacctacgagatgctgcaaagcgcccatgccaagcgcaaggccggcatcgacgtcgtggtcggcttcgtcgagacccatggccgcgccgagaccgaggcgctggtgcgggggctcgaagtcgtcccgcgcaagaggctcgactaccgcggccagacgatcgaggagatggacctcgacgccgtgatcgcgcgccggccgcaaatcgcgctggtcgacgagctcgcccacaccaacgcggccggcagccgccatcccaagcgctatctcgacgtcgaggagctgctctcccacggcatcgacgtctacaccgccgtcaacatccagcacaccgagagcctgaacgacgtcgtcgcccagatcacccatgtccgggtgcgcgagacggtgccggactcggtgttcgaccgcgcggatgcgatcgagctgatcgacctcacgcccgacgacctgatccagcggctcagagaaggcaaggtttacgtccccaggcaggccgagcgggcgctggagcattatttctcgccgggcaatctgaccgcgctgcgcgagctcgctttgcggcggacagccgaacgggtcgacgagcagctcctcacccacatgcaggcgaacgccatcgccggcccctgggccgcgggcgagcgtattctcgtctgcgtcagcgaggatccgcgcgccgccggcctcgtgcgctacaccaagcggctggccgaccggctgcatgcgccgtttaccgcgatttcgatcgagacgcggcgctccctccagctttccgatgacgagcgcgaccggctcgccgacacgctgcggctcgccgaagccttgggcggcgaggcactgacgattcccgcggtcggccgccgcatcgccgacgacgtcgtcaatttcgcgcagggcaacaacgtcacccagatcgtgatcggaaagtcgacgcgctcgcgctggttcgagatcacgcgcggctcggtcgtgcatgacctggtgcgccgtgccggcaatatcacggttcatgtcatcgccggcgacgatgtgccgggcgaggcggcgcccaagaccgcggtgcagaccgcggcgcggacggagccgttcgatccgctgccctatctgaaggcgctcggcatcgtgctgatcggcctcggcgctgccgagctgattcagccgaggttcggcatcgagaacgtggacctcgtgctgctcacggccgtggtggcggtcgcggtccgctatggcctgtggccgtcgctgctcgccaccgtcgcggcctcgctgtcctataatttcttcttcctgccgccgatctacaccttcacgatcaccgatccgaccaacgtcgccgcctttgtcctgttcatggtggtggcgatgatcgtctccaatgtcgccgcgcgcgtgcgcacgcaggccgacaccgcgatcggccggatcaggaccaccgagcagctctatgctttcagccgcaagcttgccggcaccgccacgctcgacgacgtcttgtgggcgacggcctatcagatcgcgctgatgctgaaggtgcgcgtggtgctgttgctgccggaggatgggctgctcacggtgaagtccggctatccgccggaggaccagctcgaccaggcggaccttgccgccgccaactgggcctggagcaatgatcgcccagccggtcgcggctcggacacgctgccgggtgcgaaacggctgttcctgccgatgcgcaccggccgcggcccgatcggggtgatcggcatcgacaacgaccgtaccggcccgttgctgacgccggaccagcgccggctgctggacgcgctggtcgaccagggcgcgctcgcgatcgagcgcgtgctgctggtcgaggacatggaccgcgtcaagcgcaccgtcgaatccgagcggctgcgctcggcactgctgacgtcgatttcgcatgacctcaagacgccgctcgcctccgtgttgggggccgcctccacgatgcgcgatctggcaggtgccttgtccgacaccgagaagcgcgacctgctggccaccgtgatcgacgagtccgagcgactcaaccgtttcatcgccaatctgctcgacatgacgaagctcgaatccggcgccatcgtgcccaacacggcgctgcatgatcttagtgagatcgtcggcagcgcactccggcgggcagccaagatcctcacggcgcacaaggtggagctggtgctggccgccgatctgccgatgctccagctggatgccgtgttgttcgagcaggtgctgttcaacctgctcgacaacgccgcgaagtattcgccggcggagacgacgatctcgatcaagagccagcgcgagcgagatcaagtggtgctccagatcgccgacgaggggagcggtattccgccggacgaggtcgagagcgtgttcgacaagttctatcgcgtgcagaagggcgatcacgttcgtcccggcaccgggctcgggctcgccatttcccgcggcttcgtcgaggcaatgcatggcacgatctcggccgccaaccgcagcgaccggagcggcgcggtcctcaccatccgtttgcccgttccggcacagacccacgcattggataccgccgcatga

SEQ ID NO: 2025 - protein, 907 aa, Bradyrhizobium japonicum
MVRERRDSEQRPSPEALLEAARREESASGKLKIFVGAAPGVGKTYEMLQSAHAKRKAGIDVVVGFVETHGRAETEALVRGLEVVPRKRLDYRGQTIEEMDLDAVIARRPQIALVDELAHTNAAGSRHPKRYLDVEELLSHGIDVYTAVNIQHTESLNDVVAQITHVRVRETVPDSVFDRADAIELIDLTPDDLIQRLREGKVYVPRQAERALEHYFSPGNLTALRELALRRTAERVDEQLLTHMQANAIAGPWAAGERILVCVSEDPRAAGLVRYTKRLADRLHAPFTAISIETRRSLQLSDDERDRLADTLRLAEALGGEALTIPAVGRRIADDVVNFAQGNNVTQIVIGKSTRSRWFEITRGSVVHDLVRRAGNITVHVIAGDDVPGEAAPKTAVQTAARTEPFDPLPYLKALGIVLIGLGAAELIQPRFGIENVDLVLLTAVVAVAVRYGLWPSLLATVAASLSYNFFFLPPIYTFTITDPTNVAAFVLFMVVAMIVSNVAARVRTQADTAIGRIRTTEQLYAFSRKLAGTATLDDVLWATAYQIALMLKVRVVLLLPEDGLLTVKSGYPPEDQLDQADLAAANWAWSNDRPAGRGSDTLPGAKRLFLPMRTGRGPIGVIGIDNDRTGPLLTPDQRRLLDALVDQGALAIERVLLVEDMDRVKRTVESERLRSALLTSISHDLKTPLASVLGAASTMRDLAGALSDTEKRDLLATVIDESERLNRFIANLLDMTKLESGAIVPNTALHDLSEIVGSALRRAAKILTAHKVELVLAADLPMLQLDAVLFEQVLFNLLDNAAKYSPAETTISIKSQRERDQVVLQIADEGSGIPPDEVESVFDKFYRVQKGDHVRPGTGLGLAISRGFVEAMHGTISAANRSDRSGAVLTIRLPVPAQTHALDTAA

SEQ ID NO: 2026 - DNA, 2613 bp, Leptospira interrogans
  CDS (1)..(2613)
atgattaaagatactcgtttagatccggacgagttgcttcgtaagatccaaaaagaagaacaaaaagagatttccggaagactcaaagtgttttttggaatggttgcgggtgtgggcaaaacctacgcgatgttaaacgccgctcgaggacttaaaaaagaaggtgtagatgtagtggtaggttacatagagacacatggccgaaaagaaaccgaagaacttttagaaggtttggaaatactacctagaaaaaagatagaacatagggagatcgaattcgaagagatggatatagattccattctcagacgaaagccggaagtggtgttggtggatgagtttgcacatacaaacattccaggcagcagacacgtaaaacggtatcaggacgtgattgaaattctaaatcatagtattaatgtattcacgactttgaatgttcaacatttagaaagtcaagtggagtctgtagaaaaaaatacttctgtaaaaattagagaaacgattccagattctatattggatatggcagatgaaatcgtattgattgatctttcgccggatgatcttagaaaacgccttcaggaaggcaaggtgtacgtacctgaaaaagcgaacttagcgggagattatttttttaagaaggaaaacttgacctttttgcgtgaaaccgcactcaattacacggcaagacacgtcaatgtagctctggattcagaaaagtttagagaaaaaattttagtgtcgatcggttctaaccctaattcttactctttgttacgttatgcgaaacgacttgcttatgagagaaatggagaattgtttgctatctacaatcaaacgagagaaaatcttaccaaggaaaacttaagtcaactcgagaaaaatctaagttttgccagagaattaggatgtgaaattctttacgcagcagacgaagatactgcggaagcaattttaagaatttccggacaaaagagcataacgcgcgtagtgatagaaaaatctgatacaaattggtggtggagatggaattcaacagcttctaaattggctaggattccttctaatttcgaactttgtttagttccatattcttttatttctggagaagaatccgttttaaatcggtttttaagaacttcttcgggaggaaaacaatacttaacgtctttaactttgatattgttggctacttgtatcagtttatttttggaaccgattgctggctattggagtatttccttactctatttattttttgtttcgggaattggatcttttttttccaaaggacctacggtacttgcaggattattgtccggaattttctgggattttttattcattccacccagatatactttttttatagagaagttggaagacgtacttatgtttggcgcttttctttttatatctatcatcataggaaatgttacttctagattaagacaaaaagaaaaggtattagtcaatcgagaacttcgcttaacaacattatacgaattatctaaagaattgggacatgcaagagacgtacgacgtatatctgaaatcggagcggaatatcttggaaaagtatttcagacggagatagttatacttttagaaaatcaaggaaacatagattttaattcttccagggccggaaatttttttcctgatccaaaagaaactgctgtttctaactgggtgtataaaaataaaattcccgcaggaaaatttacggatacgttatccttatctttaggaacttattttcctatgatcgctccaggtaaagtgataggagtgatcggagtcgttttaaatgaaagattgaacttggatcaagaaaatcttttgcttacgatgggaaatcagatagctcttgcgcttgaaagggaactgttgtctgaagaaaccaggactagatacttggctaatcaatctgaaagactttatacgattatatttaattctttatctcacgaattaaaaacgccactttcttcgatccggggagcggtgactgcattattagagccggagatagaaaattccagggaagctagagtcgaattgttaaacgaaatcaacgaaagtagtatgattctcaatctattattgggaaatttattggacatgagtcgttacgaatctggttttttaaaattgagaatggattggcacgatccatctgatctgattcacgtagtagtaagaagattgaggcaaacggtaaaaaatagtcattgtgtgattcatctaccggaaaatccggtaccaacttggatggattttacattgatggaacaagcgctttttaacgtagtattcaatgcggttcagatttcacccgagggcactccggtttttatagaacttatatgcagaaaagataaaatacaatatattgtagaggacgaggggccaggaattcccaaggaagatcttgaaaagatattcgaaaagttttatagaagtaaaaatagaaatcacgtaggaagtggtctagggctttcgattagcaaatctattgtggaaacacacggaggtactttaaccgcagaaaatagaacaatagtaggggccaggttttgtatcgaaattccgatcaaatcgagttaa

SEQ ID NO: 2027 - protein, 870 aa, Leptospira interrogans
MIKDTRLDPDELLRKIQKEEQKEISGRLKVFFGMVAGVGKTYAMLNAARGLKKEGVDVVVGYIETHGRKETEELLEGLEILPRKKIEHREIEFEEMDIDSILRRKPEVVLVDEFAHTNIPGSRHVKRYQDVIEILNHSINVFTTLNVQHLESQVESVEKNTSVKIRETIPDSILDMADEIVLIDLSPDDLRKRLQEGKVYVPEKANLAGDYFFKKENLTFLRETALNYTARHVNVALDSEKFREKILVSIGSNPNSYSLLRYAKRLAYERNGELFAIYNQTRENLTKENLSQLEKNLSFARELGCEILYAADEDTAEAILRISGQKSITRVVIEKSDTNWWWRWNSTASKLARIPSNFELCLVPYSFISGEESVLNRFLRTSSGGKQYLTSLTLILLATCISLFLEPIAGYWSISLLYLFFVSGIGSFFSKGPTVLAGLLSGIFWDFLFIPPRYTFFIEKLEDVLMFGAFLFISIIIGNVTSRLRQKEKVLVNRELRLTTLYELSKELGHARDVRRISEIGAEYLGKVFQTEIVILLENQGNIDFNSSRAGNFFPDPKETAVSNWVYKNKIPAGKFTDTLSLSLGTYFPMIAPGKVIGVIGVVLNERLNLDQENLLLTMGNQIALALERELLSEETRTRYLANQSERLYTIIFNSLSHELKTPLSSIRGAVTALLEPEIENSREARVELLNEINESSMILNLLLGNLLDMSRYESGFLKLRMDWHDPSDLIHVVVRRLRQTVKNSHCVIHLPENPVPTWMDFTLMEQALFNVVFNAVQISPEGTPVFIELICRKDKIQYIVEDEGPGIPKEDLEKIFEKFYRSKNRNHVGSGLGLSISKSIVETHGGTLTAENRTIVGARFCIEIPIKSS

SEQ ID NO: 2028 - DNA, 2661 bp, Xanthomonas campestris
  CDS (1)..(2661)
atgtctgacgcccgtacccaacaagccgatgccctcatcggcgaactgcagcgcgaacacggcggtcggctgaccgtgttcctgggcgcagcgcctggcgtgggcaagacctacgccatgctctcgcgtgcgcgcgagcggctgcgccagggcgtggatgtggtggccggggtggtggaaacgcacggccgcagcgagaccgccgcgttgctcgatggcgtgccgctgctgccgcgtgtgcaggtgagctaccaggggcatgcgctggaagaactggcgctggatgcgctgctggcgcgcaagccgcagctggcgttgatcgacgagttggcacatcgcaacgtgcccggcagccgccacgagcgccgctggcaggacaccgtggagttgctggacgccggcatcgacgtctacaccaccgtcaatatccagcacctggaaagcctcaacgacatcgtgctgcgcatcaccggcgtgcgcgtgtccgagaccgtgccagatgcggtgttcgaccgcctgcgcgacatcgtgctggtcgacctgccaccgcgtgagctgatcgagcggctgcagcaggggaaggtgtatctgcccgagcaggccagccaggcgctgcaggcgttcttctcgccctccaacctcaccgcgttgcgcgagctggcgatgcagaccgccgccgaccgcgtggacagcgatctgcgcgacacccaggccgcgcgcggtctgccgggcacggcggcgttgcggcggcatgtggtggtggcaatcgacgggcgcggcagctcggattatctggtacgggtggcgcggcggctgtcggaacgccgcgacgcgccatggactgtggtgacggtgcagacacgcaccgtggccgatgccgcctggcaactggagatcgaccgcgcgttcgcgttgacgcgccggctcggcggcgacacggcgctgctgcatggcgccaacgtggccgatgccttgctggatttcgcctcgcaaaacggcgtctccacattggtgttgggccgcactcgcgagcgcccgctggcacgcatgttcaaccgaacgctgacccagcaactgctacagcgcggcgcacattacgaactggtcatcgtcagctcgggcgatgcgcgcgcccgcgcgcgccagcgctggcgtaatccaggccagtggctgcagcgttacgacctggcctatgccgccatcgctgccgccgccgcggtggcggttgcctgggtgatccagcgctggaccgacatcgatgacctgtcgatggtgttcatcgttgcggtggtgctggtggcctcgcgcacgcgcatggccgcggcggtgatcgccgcactgctgagttttgtcgcctacaacttcttcttcatcgaaccgcgtttcaccttgcacatcagtgcgcgccagggcgtggtgacggtatgcctgttcctgatcgccgccctggtggccgggcgcctggcctcgcgcctgcgcagccaggtgctcgccctgcgcgcggccaatgcgcacgccaacgcgctgcaggcgctggcccgccagctcagcaccgcggccgatctgggtcaggtgctggaggccggccggcgtgcgctggccagtgcgctcgatgcagaggtctggctgcggctggaacagtgcgagagcgaggcgcccaccagtttcagtgcactggaccgcaacgccgccgactggacccagcgccacggccagccggccggccgcttcaccgacaccctggccggcgcgcagtggtggtgcctgccggtgcggcatgagcgcggcacgctgggcgtggcggcgttgcgcttccgccagcagctgcaacggccgggcctggagcagcgccgcctggccgaggcgatggtggaagacattggccaggccgcactgcgcacgcgtttggttgccgatctggaaggcgcccgcgtcagcggcgaaaccgaacggctgcgctcggcgttgttgtcatcggtctcgcacgatttgcgctcgccgttggcctcgatgatcggctcggccagcagcctggccgaatatggcgaggcgatggacgccaccgaccgccgcagcctgctggagaccatccagctcgaaggcgagcggctggaccgctatatccagaacctgctcgacatgacccggctcggccataccgggctgaccttgaagcgcgactggatcggcgtggacgagttgatcggctcggccacgcggcggctgcagcgctaccagccgcaggtgcgcctgcagctggacctggcgccggagctgccggcgatctgggtgcatccggcgctggtggagcaggccattttcaacgtgctggaaaacgcagcgaaattctcgccgccgggcgtggcggtgacggtgcaggcccggctgcagagcggcgccttgcagatcgagatcggcgaccagggcccgggcattcccgaagacgagcgcgcgcgtatcttcgacatgttctacagcgtggagcgcggcgatcgcggccgccacggcaccggcctgggtctgaccatctgccagggcatgatcggtgcgcatggcggcagcgtggaggccttggccggcccgcatggtcacggcaccacgatccgcattacgctgccgctgctcgttcctgccgcgtcacctcgccccgatgccgactga

SEQ ID NO: 2029 - protein, 886 aa, Xanthomonas campestris
MSDARTQQADALIGELQREHGGRLTVFLGAAPGVGKTYAMLSRARERLRQGVDVVAGVVETHGRSETAALLDGVPLLPRVQVSYQGHALEELALDALLARKPQLALIDELAHRNVPGSRHERRWQDTVELLDAGIDVYTTVNIQHLESLNDIVLRITGVRVSETVPDAVFDRLRDIVLVDLPPRELIERLQQGKVYLPEQASQALQAFFSPSNLTALRELAMQTAADRVDSDLRDTQAARGLPGTAALRRHVVVAIDGRGSSDYLVRVARRLSERRDAPWTVVTVQTRTVADAAWQLEIDRAFALTRRLGGDTALLHGANVADALLDFASQNGVSTLVLGRTRERPLARMFNRTLTQQLLQRGAHYELVIVSSGDARARARQRWRNPGQWLQRYDLAYAAIAAAAAVAVAWVIQRWTDIDDLSMVFIVAVVLVASRTRMAAAVIAALLSFVAYNFFFIEPRFTLHISARQGVVTVCLFLIAALVAGRLASRLRSQVLALRAANAHANALQALARQLSTAADLGQVLEAGRRALASALDAEVWLRLEQCESEAPTSFSALDRNAADWTQRHGQPAGRFTDTLAGAQWWCLPVRHERGTLGVAALRFRQQLQRPGLEQRRLAEAMVEDIGQAALRTRLVADLEGARVSGETERLRSALLSSVSHDLRSPLASMIGSASSLAEYGEAMDATDRRSLLETIQLEGERLDRYIQNLLDMTRLGHTGLTLKRDWIGVDELIGSATRRLQRYQPQVRLQLDLAPELPAIWVHPALVEQAIFNVLENAAKFSPPGVAVTVQARLQSGALQIEIGDQGPGIPEDERARIFDMFYSVERGDRGRHGTGLGLTICQGMIGAHGGSVEALAGPHGHGTTIRITLPLLVPAASPRPDAD

SEQ ID NO: 2030 - DNA, 2661 bp, Xanthomonas axonopodis
  CDS (1)..(2661)
atgaacgacgcccgcacccagcaagccgatgccctgatcggcgaattacagcgcgaacacggtggtcggttgacggtgttcctgggcgccgcgcccggggtcggcaagacctacgccatgttgtcgcgggcgcgcgagcgcctgcgccagggcatggatgtggtggccggcgtggtggaaacgcacgggcgcagcgaaaccgcggcgttgctggaaggcttgccgctgctgccgcgcgccggcgtgagttaccagggccgcatgctggaagaactcgacctggatgcattgctggcacgcaagccgcggctggccctgatcgacgagctggcgcaccgcaacgtgcccggcagccgccatgagcggcgctggcaagacatcgtggagttgctcgatgccgggatcgacgtctacaccacggtcaacatccagcacctggaaagcctcaacgacatcgtgctgcgcatcaccggcgtgcgcgtgtccgagaccgtgcccgatgccgtgttcgaccgcctgcgcgacatcgtgctggtggacctgccgccacgcgaactgatcgagcgcctgcagcagggcaaggtgtatttgcccgagcaggccacgcaggcattgcaggcgtttttctcgccttccaacctcaccgccttgcgcgagctggcgatgcagaccgctgccgaccgcgtcgacagcgatctgcgcgatacccaggccgcgcgcggcctgcctggcaccgccgcgttgcgacgccgcgtggtggtggccatcgatggccgcggcagctcggattatctggtgcgcgtggcgcggcgtctgtcggagcggcgcgatgcaccgtggacggtggtcaccgtgcagacccgcaccgtgaccgatgcagcctggcagctggaaatcgatcgcgcattcgcgctcgcccatcgcctcggtggcgacaccgcgctgctgcatggcgccaatgtggccgatgccttgctggatttcgcctcgcagaacggcatctccaccctggtgctggggcgcacccgcgagcgcccgctggcgcgcatgttcaaccgcacgctgacccagcaattgctgcaacgtggcgcgcattacgaactggtgatcgtcagctccgccgatgcgcgcgcacgtgcgcgccaacgctggcgcaacccgcgccaatggctgcagcgctacgacatggcgttcgctgcgatcgcggccgctggtgcggtgggggtggcgtggttgctgcagcgctggaccgatatcgatgacctgtcgatggtgttcatcgtcgcagtggtgctggtggcttcgcgcacgcgcatggccgctgcggtggttgccgcattgctgagttttgtcgcctacaacttcttcttcatcgagccgcgtttcaccttgcagatcagcgcgcgccagggcgtggtgacggtgtgcatgttcctgatcgccgcgctggtcgccggccggctggcctcgcgtttgcgcagccaggtcctggccttgcgcgcggccaatgcgcatgccaacgccttgcaggcgctggcccgccagctcagcaccgccgccgatctggggcaggtgctggaagccggccgtcgggcgctgaccactgcgctggatgccgaggtctggctacgcctggagcagcgcgaaagcgacgcacccgccagcttcggtgcgctcgatcgcagcgccgccgattggacccagcgccacggccaaccggccggccgtttcaccgataccttggccggggcgcagtggtggtgcctgccggtgcgccacgagcgcggcaccctgggtgtggccgcgctgcgctttcgacaggcgctgcaacggcccggcctggaacaacgccgcctggccgaagcgatggtggaagacatcggccaggctgcgctgcgcacgcgcctggtcgccgatctggaaggcgcgcgcgtcagtggcgaaaccgagcgcctgcgttctgccttgctctcgtcggtctcgcacgatctacgctcgccgctggcctcgatgatcggctcggccagcagcctggccagctacggcgatgcgatggacgcgcacgaccgccacagtctgctcgacaccatccagctcgaaggcgagcggctggatcgctacatccagaacctgctcgacatgacccggctcggccacaccggcctgaccttgaatcgcgactggatcggcgtcgacgaattgatcggctcggccgcccgccgcctgcagcgctatcagccggaggtgcgcctgcaactggacctggccgccgacctgccggcgatctgggtgcatccggcgctggtggaacaggccatcttcaacgtgctggaaaatgcggcgaaattttcgccagccggcgtgccggtgaccgtgcacgcgcagctgcgtgccggcgcgttgcagatcgacatcggcgaccaggggccgggcattcccgaagacgagcgcgcgcggatcttcgacatgttctacagcgtggagcgcggtgaccgcgggcgcaacggcaccggcttgggtcttgccatctgccagggcatgatcggcgcgcacggcggcagcgtggcggcattggcgggcgcgcatggtcacggcaccaccatccgcattacgctgccgttgctcgttcccgccgcgccacctcgccccgatgccgactga

SEQ ID NO: 2031 - protein, 886 aa, Xanthomonas axonopodis
MNDARTQQADALIGELQREHGGRLTVFLGAAPGVGKTYAMLSRARERLRQGMDVVAGVVETHGRSETAALLEGLPLLPRAGVSYQGRMLEELDLDALLARKPRLALIDELAHRNVPGSRHERRWQDIVELLDAGIDVYTTVNIQHLESLNDIVLRITGVRVSETVPDAVFDRLRDIVLVDLPPRELIERLQQGKVYLPEQATQALQAFFSPSNLTALRELAMQTAADRVDSDLRDTQAARGLPGTAALRRRVVVAIDGRGSSDYLVRVARRLSERRDAPWTVVTVQTRTVTDAAWQLEIDRAFALAHRLGGDTALLHGANVADALLDFASQNGISTLVLGRTRERPLARMFNRTLTQQLLQRGAHYELVIVSSADARARARQRWRNPRQWLQRYDMAFAAIAAAGAVGVAWLLQRWTDIDDLSMVFIVAVVLVASRTRMAAAVVAALLSFVAYNFFFIEPRFTLQISARQGVVTVCMFLIAALVAGRLASRLRSQVLALRAANAHANALQALARQLSTAADLGQVLEAGRRALTTALDAEVWLRLEQRESDAPASFGALDRSAADWTQRHGQPAGRFTDTLAGAQWWCLPVRHERGTLGVAALRFRQALQRPGLEQRRLAEAMVEDIGQAALRTRLVADLEGARVSGETERLRSALLSSVSHDLRSPLASMIGSASSLASYGDAMDAHDRHSLLDTIQLEGERLDRYIQNLLDMTRLGHTGLTLNRDWIGVDELIGSAARRLQRYQPEVRLQLDLAADLPAIWVHPALVEQAIFNVLENAAKFSPAGVPVTVHAQLRAGALQIDIGDQGPGIPEDERARIFDMFYSVERGDRGRNGTGLGLAICQGMIGAHGGSVAALAGAHGHGTTIRITLPLLVPAAPPRPDAD

SEQ ID NO: 2032 - DNA, 2814 bp, Ralstonia solanacearum
  CDS (1)..(2814)
atggacgaaacccgccccaaccccgacaccctcctcgccgagctccaatccggcgaggagaaagccgctcgcggcaagctgcgcatctatttcggcgcgtcggcgggcgtcggcaagacgtacgcgatgctgtcggccgccaaggtcgcgcgggccgagggcatcgatgtggtcgtcgggctggtcgagacccacggccgcgccgagaccgccgcgctggtggagggcctggagcacctgccgccgcgccaggtcgagtatcgcggtcgcaccctgcccgagttcgacctggacgccgcgctggcccgcaagcccgcgctgatcctcgtcgatgagctcgcgcattccaacgtggccggctcgcgtcaccccaagcgctggcaggacatcgaagacctgctcgccgccgggatcgacgtgtggaccacggtcaacgtgcagcatctcgacagcctgaacgaggcggtcggcagcattaccggcatccgcgtgtgggagacggtgccggatgcggttttcgacagcgcggccgaggtgatcctcgtcgacctgcccgccgacgagctgctgcgccgcctggccgagggcaaggtctacctgcccgagcaggcccggcacgcggcgcgcaacttcttccgcaagggcaacctgatcgcgctgcgcgagctggcgctgcgccgcaccgccgaccgcgtcgacgacgacgtgcaggcctatcgccgcgcgcgccgcatcgagaacgtctggcgcacgcgcgagaccatcgtcgcctgcctcgacccgcagggcgacggcgagcaggtgatccgcagcgccgcgcgcctggccgcgcagctcgaatgcgactggcacgcggtggccgtggtgatgccgcacctgcgcgccgccgatgcgcgcgccgagcggctgcacgcgctgctcaagatggccgaggacgccggcgccaggatcgagacgctggccggcaccaacgcggtggaggccatcaccggctatgtccgtcgccacaacatcaccaaggtcgtggtcggccgcccgccggccaggcgctggcgctcggcgcgggccatcgtcgtggcgctgcgcctggcgatcgggctggagcgtcgcctgccgagcggtgattttgccgaggcgctggcgcggcagtgcccggaggtggatgtgatccgcgccgccgccgatccggcgcgcgtgcagttgccgccgcgcgccgccagcatcggccgcgtcgatgtgcgcgacaccgctcagcgcgccgccgccgaggccgagggcacctggctgcgcccggcctacctggccgcctgcgtgtacgtgggcgcggcgacgctgctgtcgagcctggtgcggccggtgttcgatctcgccaacatcgtcatgctgttcctggcggccgtggtggccgtggcgatgcggcacgggcgcgggccggcggcgctggcgtcggtgctgtcggtggcgctgttcgatttcttcttcgtgccgccgcgctactcgttcgccgtcagcgatgtgcaatacctgctgaccttcgcggtgatgctggcggtcggcctgctggtcggccagctgactgcgggcctgcgcgaacaggccgaggcggccgtgcagcgcgaagccgccgcgcgcgcgctgtacgaggcggcccgcgaactgtcggcggcgctgacgctggaccagatcgtcagcatcggcgggcgcttcgtcaacgcgaccttcggcgggcggtgcgcctttttcttcgtcgggcccgacggccgcctgggcgccgcgcaggtggccaggcccgagggcacgcccgatgcgccgtccggcatgcccaacctcgaccgcgtgctggccgactggacctgccagcacggccagccggccggcaccggcacgcatacgctgccctcgggctcggtgctctacttgccgctgaaggcgccgatggccatccgcggcgtgctggcggtcgagcccgagaccttccaggtgctggcccagcccgacaaccgccgccagatcgacgcctgcgccacgctgatcgccatcgccatcgagcgcgtgcactacgtggagatcgcccaggacgccctgttgcgcatcgaatcggagcggctgcgcaattcgctgctggcggcggtgtcgcatgatctgcgcacgccgctgaccgggctggcgggcatggccgagaccctgttgcgcacgcagccgcccctgtcgccgctgcaggccgaggccgccgaggccatcggcgaacaggcgcagcgcatgcgcgcgatggtcaccaacctgctcgacatggccaggctgcagaaccacgacgtcaagctgcggctggagtggcagtcgatcgaggaactggtgggggcggcgctcaaggggacgccgctgcccacgcacgccgtggtggtggatgacctggccgacctgccgttgctgcgctgcgatggcccgctgatggagcgcgtgttgtccaacctgctggagaacgccggcaagttcgcgccggccgggaccgaggtgcgcatctccgccggcgtggtgcacgacgccgcgcacggcgacgagatgtgcgtgcgcgtgcgtgaccacgggcccggcgtgccggccggggcggagcgcgtcatcttcgagaagttcacgcgcggcgacaaggagtccgccacgggtggcgtcgggctgggcctggcggtgtgcgaggcgatcgtcagcgcacacggcgggcggatctgggtcgagacgccggccgacggcggcgcctgcttcgtggtcgcgctgccggccagcgatcagcccgccatggaggacgacatccccgcttga

SEQ ID NO: 2033 - protein, 937 aa, Ralstonia solanacearum
MDETRPNPDTLLAELQSGEEKAARGKLRIYFGASAGVGKTYAMLSAAKVARAEGIDVVVGLVETHGRAETAALVEGLEHLPPRQVEYRGRTLPEFDLDAALARKPALILVDELAHSNVAGSRHPKRWQDIEDLLAAGIDVWTTVNVQHLDSLNEAVGSITGIRVWETVPDAVFDSAAEVILVDLPADELLRRLAEGKVYLPEQARHAARNFFRKGNLIALRELALRRTADRVDDDVQAYRRARRIENVWRTRETIVACLDPQGDGEQVIRSAARLAAQLECDWHAVAVVMPHLRAADARAERLHALLKMAEDAGARIETLAGTNAVEAITGYVRRHNITKVVVGRPPARRWRSARAIVVALRLAIGLERRLPSGDFAEALARQCPEVDVIRAAADPARVQLPPRAASIGRVDVRDTAQRAAAEAEGTWLRPAYLAACVYVGAATLLSSLVRPVFDLANIVMLFLAAVVAVAMRHGRGPAALASVLSVALFDFFFVPPRYSFAVSDVQYLLTFAVMLAVGLLVGQLTAGLREQAEAAVQREAAARALYEAARELSAALTLDQIVSIGGRFVNATFGGRCAFFFVGPDGRLGAAQVARPEGTPDAPSGMPNLDRVLADWTCQHGQPAGTGTHTLPSGSVLYLPLKAPMAIRGVLAVEPETFQVLAQPDNRRQIDACATLIAIAIERVHYVEIAQDALLRIESERLRNSLLAAVSHDLRTPLTGLAGMAETLLRTQPPLSPLQAEAAEAIGEQAQRMRAMVTNLLDMARLQNHDVKLRLEWQSIEELVGAALKGTPLPTHAVVVDDLADLPLLRCDGPLMERVLSNLLENAGKFAPAGTEVRISAGVVHDAAHGDEMCVRVRDHGPGVPAGAERVIFEKFTRGDKESATGGVGLGLAVCEAIVSAHGGRIWVETPADGGACFVVALPASDQPAMEDDIPA

SEQ ID NO: 2034 - DNA, 2667 bp, Listeria innocua
  CDS (1)..(2667)
atgcatataaatggtcacgaaaataacgatatttttaataaacgacgcggtaaacttagaatttactttggctatgcggcaggcgttggcaaaacgtttgctatgctaaacgatgcacaagagctagttaaaaccggagttgaccttgttgtcggctacgtagagcctcatgctcgtccagaaactatgaaacttttaaatggtctggaaaaaatccccactaaacctattttatataaaggtgtaaaactatacgaattcgatttagattcagcacttaagagaaatcctaagttaattattgtagatgagttagcgcacacaaatgcgtatgcttgtagacataaaaagagataccaggatattgaagaattactacaggcagggatagatgtttttactactgttaatgtacaacatatagaaagtctaaatgatattgtggaatcaataacaaacattcatgtacttgagcgtatacccgatgcagtttttgatggggcagatgaaatagaattagtagatattgaaccacaagatttactagatagattaaataaaggcaaaatttatagggaaaagcaggctagacaggcagtactcaatttctttaccaccgataaattaattgccttacgagaaatagcattacgaagaacagctgatcaagtgaagagaattgccgagagtaatatagttaaccctaaaaataattatggaaaagagcatattctagtttgcatttcaccatctcaaggtaatgagaaagtgataagaacagctgctcggatggctgaagccttaaaggggaaattaacagcagtttttgtggaaacacctgaatatgaggaatcttcaatcaaagagcaagaatctttgagaaaaaatttacgacttgcagagcagcttggtgcccaaatatcatcagtttatggagaggatatttctcaacaattggctgaatacgcaaatgttagtcaagcaactaagattattcttgggagatcctcgaaacgaaaaagttggctcaagcctaagttagtcgataaactttctgaacaaatagatagtacagatatttatattattcctgatacgcagcctagcaagacaaaaaaacatttcaaaataaaaaacgaaatgtctttttcggtttcggattctattagaacagtcatcattttattattttgtacaattatcggtattatattcgattacaatcattttagtgtcgtcaatattatcattgtatatatcctaggagttcaagtaaatgcggtaattacaaaggggagagtctatagtattgtatcggctcttttaagtgtgctgatttttaattatttcttcacggagccgcgatatacattgcatgcaattgatcctggatacccggttacttttgttatcatgctcgctgcagcaattattactagtacattaactaaaagaattaaagagcaggcaaggcaagcgtcccaacgagcatatcgaacagagatcttacttgaaacaagccaaaagttacagaaagctagtactgaatcagctcttttaagagaaatcgctatacagataaataagctactagaaaaacctataattatttacccagtaagagtaaataaattagataaacctctaatatttaatgaagataaacgtgataataacgaatcagagtggataagcaaagaggaacgtactgtggcagaatgggtattgaaaaaccaaaaacgagctggagttacaagtaatacctttactaatacaaaatgcttatacttagctgtaagaggaaatggggaagtattggccgtgatcggaattgtcatggacaaagaggcgcctatggataatttcgaaaaaagcatcttaattgctgtactagccgagagcgctctggcattggaaaaagaaaaatttcgggttcaagagcaaattatctcattaagaatgcagcaagagcaggtgcggacgaatttattacgagcaatatcacatgatttgaggacgccattgacaagtatttcaggcaacgcaggtgttctaaaagcaaatagtcatatcttagaagaaaagcaaaagcaaaacttatataacgatatttatgacgactcaatctggttaataaatttagttgaaaatttattgtctattactcgtcttgatgagggtagttcgaatatcaatatgcaaccagatttaatagatgaggtaatttcggaagcacttaggcatatagataggaaaagcatcgaatataatattagtatggagattcaagatgaggatcttattgtaaatattgattctcaattaattatgcaagtaattatcaatattgtggacaatgctatcaagtatacgccaccaggatcgaaaatttgtatcgtagcaaaacaagatatggattcagtttgcgttgaaattaaagataatggagagggtattccagataaagagaaagataaaatttttgatatgttttatacggctaataacattaatgcagatggacggagaggactaggtttgggactttatctttgtatgtctatcattcaagcacatcaaggtgaaatgtatgtcaaagataatattcccaaaggtgctatctttggattggttttaccgattgaggaggtggatttaaatgaataa

SEQ ID NO: 2035 - protein, 888 aa, Listeria innocua
MHINGHENNDIFNKRRGKLRIYFGYAAGVGKTFAMLNDAQELVKTGVDLVVGYVEPHARPETMKLLNGLEKIPTKPILYKGVKLYEFDLDSALKRNPKLIIVDELAHTNAYACRHKKRYQDIEELLQAGIDVFTTVNVQHIESLNDIVESITNIHVLERIPDAVFDGADEIELVDIEPQDLLDRLNKGKIYREKQARQAVLNFFTTDKLIALREIALRRTADQVKRIAESNIVNPKNNYGKEHILVCISPSQGNEKVIRTAARMAEALKGKLTAVFVETPEYEESSIKEQESLRKNLRLAEQLGAQISSVYGEDISQQLAEYANVSQATKIILGRSSKRKSWLKPKLVDKLSEQIDSTDIYIIPDTQPSKTKKHFKIKNEMSFSVSDSIRTVIILLFCTIIGIIFDYNHFSVVNIIIVYILGVQVNAVITKGRVYSIVSALLSVLIFNYFFTEPRYTLHAIDPGYPVTFVIMLAAAIITSTLTKRIKEQARQASQRAYRTEILLETSQKLQKASTESALLREIAIQINKLLEKPIIIYPVRVNKLDKPLIFNEDKRDNNESEWISKEERTVAEWVLKNQKRAGVTSNTFTNTKCLYLAVRGNGEVLAVIGIVMDKEAPMDNFEKSILIAVLAESALALEKEKFRVQEQIISLRMQQEQVRTNLLRAISHDLRTPLTSISGNAGVLKANSHILEEKQKQNLYNDIYDDSIWLINLVENLLSITRLDEGSSNINMQPDLIDEVISEALRHIDRKSIEYNISMEIQDEDLIVNIDSQLIMQVIINIVDNAIKYTPPGSKICIVAKQDMDSVCVEIKDNGEGIPDKEKDKIFDMFYTANNINADGRRGLGLGLYLCMSIIQAHQGEMYVKDNIPKGAIFGLVLPIEEVDLNE

SEQ ID NO: 2036 - DNA, 2724 bp, Rhizobium loti
  CDS (1)..(2724)
atgccggacgacagaagcaacgaaaaccgaccttcccccgacgcgctgctcgagcatgccgagcgggagggacgcggccgtttgcggatattcctcggcgccgcgcccggtgtcggcaagacctacgaaatgctgatgtcgggccgtgccaggctggccgacggcatcgacgtggtgatcggcgtcgtcgagacgcatggccgccgggaaacacaggcgctggtcgagggctatgaggtcatcccccgccgcaaggtcgactacaaggggcgcgtcctcgaggagatggacatcgacgccatccttgcccggcgccccgcactggtcctggtcgacgaactcgcccacaccaacgcgcccggcagccgccaccccaagcgttatctcgacgtccaggagatcctggcgcgcggcatcgacgtctacacgacgctcaacatccagcatgtcgaaagcctgaacgatgtcgtcgcgcagatcacgcgggtcagggtgcgcgagacggttcccgattcgatcatcgaccaggccgacgacgtcgaaatcatcgacctgacgcccgacgacctgatcaagcggctggaagagggaaaggtctatttccccaacacggcgcagcgcgccatcgagaactatttctcgtcgggcaatctgacggcgctgcgcgaactggcgctgcgccgcaccgcccagcgtgtcgacgagcaattgctcaatcacatgcagtcccacgctatccagggtccatgggccgcgggcgagagggtgctcgtctgcgtcgacgcgcgtccaggcggtgcggcccgcatccgctacgcacgcaggctggccgaccggcttcgcgcgccatggacggcgctgcatgtcgatacgccgcgctcggctggcatgtccgaggaagacaaggaccggctcgccgcgctgatgcgccttgccgagcagctcggcgccgaggtgacgaccattcccggccagagcgtcgcgcaggacattgtgcgccatgcgacggcgaacaatttcacccatatcgtggtcggccggccgacccgatcgcgctggcgcgaactgatcgagggctcgctcacctatgatctgatccgcaatgccggcgacatcagtgtccacgtcatttctggaaccgagcgggatgccgaggcggcctcgagaagggtcaaggcggcggccgagcagaagcagttccagatctggccctatctgctcgccaccacctatgtcgcgggctcattggccctcagcgccgtcctcgaccagtttctcgacgttcgcaatctggcgatcgtcttcctcctggcggtgctgacatcggcggtggccggcggcctttggccggcgctctatgcgtgcttcctcagcgcccttgccttcaactatttctttctcgagccgcgctacacgctgacgatccgggaccccgagagcatcgtggcgctcgccgtcttccttgccgtggcggtgatcgccagcaatctcgccgcgcgcatgcagcgccaggccgtcgccgcccgctcgcgggcacgggccaccgaggacatctatctcttctccaagaagctcgccggcgccggcacgctcgacgatgtgctgtgggccaccgccttccagatcgcctcgatgctgaagctgcgcgtggtgttgcttctgcccgaagacggcaccatcaccgtcaaggcaggctatccgcccgacgatacgctggccgaggccgacattgccgccgcccgctgggcctgggaacacaaccgcgccgccgggcgcggcgccgatacgctgcccggcgccaagcgtctctacctgcctttgcggacagggcgcacggcgatcggtgtcatcggcctcgacaatgacaagcaaggcccgctgctgacgcctgagcagcagcgtctgctcgacgcgctggccgaccaggcggcggtggcgatcgagcgcatccaattggtcgccgatgtcgaccgcgccaagcttgctgccgaagccgaccggctgcgctcggccctgctgacctcgatttcgcatgatctgaaaacgccgctctcggccatcatgggagcggccggcacgctcaaggaattcgcgccggatctgcccgagcaggaccgggcggagcttttgtcgacggtgatcgacgaatcggaacggctgaaccgcttcatcgccaatctgctcgacatgaccaagatcgagtccggggcaatggagccgaactatgctctgcattatgtcggcgatattgtcggcacggcgctcaaccgcgcccgcaagatcaccagcgaacacaagatcgaggtcgatattccgcccgacctgccgatgctgaagctcgatcccgtgctgttcgagcaggttctgttcaaccttctcgacaatgcgtcgaaatattcgccgcccggctcgacgatccgcctgcagggatgggccgataatggatccgtcatcgtgcagatcatggatgaggggccgggcattccgtcgcatgatttggaacgtgtgttcgacacgttttaccgggtgcgcaagggcgatcaggtgcgcgccggcaccggccttggcctgtcgatctgccgcggctttgtcgaatcgatgggcggcaccatctcggccgccaaccggaccgaccgccccggtgccgcgttcaccatcaggatgccggtgccgaccgaagcgcccgatcgcggcgaagagaccagcatggatcggccttcatga

SEQ ID NO: 2037 - protein, 907 aa, Rhizobium loti
MPDDRSNENRPSPDALLEHAEREGRGRLRIFLGAAPGVGKTYEMLMSGRARLADGIDVVIGVVETHGRRETQALVEGYEVIPRRKVDYKGRVLEEMDIDAILARRPALVLVDELAHTNAPGSRHPKRYLDVQEILARGIDVYTTLNIQHVESLNDVVAQITRVRVRETVPDSIIDQADDVEIIDLTPDDLIKRLEEGKVYFPNTAQRAIENYFSSGNLTALRELALRRTAQRVDEQLLNHMQSHAIQGPWAAGERVLVCVDARPGGAARIRYARRLADRLRAPWTALHVDTPRSAGMSEEDKDRLAALMRLAEQLGAEVTTIPGQSVAQDIVRHATANNFTHIVVGRPTRSRWRELIEGSLTYDLIRNAGDISVHVISGTERDAEAASRRVKAAAEQKQFQIWPYLLATTYVAGSLALSAVLDQFLDVRNLAIVFLLAVLTSAVAGGLWPALYACFLSALAFNYFFLEPRYTLTIRDPESIVALAVFLAVAVIASNLAARMQRQAVAARSRARATEDIYLFSKKLAGAGTLDDVLWATAFQIASMLKLRVVLLLPEDGTITVKAGYPPDDTLAEADIAAARWAWEHNRAAGRGADTLPGAKRLYLPLRTGRTAIGVIGLDNDKQGPLLTPEQQRLLDALADQAAVAIERIQLVADVDRAKLAAEADRLRSALLTSISHDLKTPLSAIMGAAGTLKEFAPDLPEQDRAELLSTVIDESERLNRFIANLLDMTKIESGAMEPNYALHYVGDIVGTALNRARKITSEHKIEVDIPPDLPMLKLDPVLFEQVLFNLLDNASKYSPPGSTIRLQGWADNGSVIVQIMDEGPGIPSHDLERVFDTFYRVRKGDQVRAGTGLGLSICRGFVESMGGTISAANRTDRPGAAFTIRMPVPTEAPDRGEETSMDRPS

SEQ ID NO: 2038 - DNA, 2565 bp, Rathayibacter rathayi
  CDS (1)..(2565)
atgctcgtgggcgctcgcgttctgctcggggccccccggggcgtcggcaaaacgttcaccatgctcgaggaggcaaagcccctccgcgatgagggcgtggatgttgtggtggccgtcgtggagacgcacggccgcgccggaacagccgccgcccttgtcgggttggaggtggtgccccgcctcaccgtcgagcaccgcggggtggtgctcaccgaaatggatgtcgcgggtgtgatcgtccgtcgcgccccacagctggctctcgtcgacgagttggcgcacactaacgcctcccggcagcgcacagaaaagcggtggcaggatgtggaggcgatcctggatgccggaatcgacgtgatgtcgaccgtgaacatccagcacatcgagtcgctgacggatgtggtacacaaaatcacgggtgccccgcagcgggagacgattccggatgaggtgctgcgggctgcccgggagatcgaagtgatcgacgtgacccctgtcgctgcgggagcgttggcgagtgggttggtgtacccggccgagcggatcgacgccgccctatcgaactattttcggctcggaaacctcaccggcctgcgcgagctggccctgctgtggttggccgacgaggtcgacagtgcgctcaaaaactatcgggctgagcaggggatcgacagcacctgggaaacccgggagcgcgtcgtggtggcgctgacaggaggcccggagggagactctcatccgccgggggccacgcattgccgcccgtgcggccggggtgagctgctcgcggtgcatgtaaccggccaagatgggttcgcgccgccaacccgggggctttggcgtcagcgttccctcgtggagagcctcggcgggagctaccaccaggtgatcggtgacgacattgcgctcgtcgagttcgcgcgcgccgcaaacgccacccaattggtgatcggggtgagccgccggggaagactcgcgcggcgctgtccggtccggggatcggtcgacggtcatcgagagtccggaaacatcgatgtgcatattgtcaatcatgcggccgcgggcgggcggttcaccctgccacggatggctggtggggccctcaccgtgaagcgtcggctgagcggtctggcgctcacgctcatcctgggccccctgatcaccgcggttttggtgacttttcgctcgcccgattcgatcacgagcgatgtgctcacctatcaggtgctggtcgtgctggtcgccctggtcggtggaatttggccggcgttgttggccgcggtgctctctgggatcacactggactactttttggtcgagcctctattcactgtgacagtcgacaaaccgctgcacctcttcgccctcgcgctgtacatcacgatcgccatgatggtgagctatgtggtcgaccaggctgcccgcagaacccgggtcgcacgtcggtcggccgccgagtcggagctgctcgccaccatcgcaggcagtgtgctgcgcggtgacggggcgctgcaatcgttggtcagccgcacgcggaaggtttgggttgaggggtgcgattgctggatgccacgcgtgcggccgatcacgccgacaaggcctcctggagcggacggtcagaccgcggccgatcacgccgtgatttgcgctgacggggagccggcatccgatgatcgtgtggtgctcgtgccggtgggtgaacgtgcaaccctggagttgcatggggccgatttggatgcatccgagcgtcgactgctcgcggtgattgcggcccagatcgatgcggcgcttgaacatgaggcgctcagcgtgacggcccgcgaggtgggcccgctggcggaaaccgatcgggtgcgcacggcgttgctgtccgcggtcagtcatgatttgcggcgcccgtttgacggcggcaaccaaaagggtgggtggcttgcgctccaccgcgatgaccctgtctgccgacgaccgggaggagctgctcgcgaccgccgacgaaagcctgcacacctgtcggtgttggtgaccgatctgctcgatgtgagtcgggtgcaggcgggggtgctcggggtgacggtgcgtcaggtggatgtggaggatgttttgccgcgggcactcgacgagctcggggtcggccccgaccaggtggtgctcgacctggatgccgcggtcggtccggtgctcgccgacccgggcctgctgcagcgggtgctggtcaatttgctcgccaatgcgctgcggttttcccccgagggtgcggtgccgactatcgaccagtcgtttggtgacaccgtgcagattcgggtcaccgatcacgggcccggaatcgccgccgaccgccgcgatgacgtgtttgtgccgtttcagcggctcggagataccgacaattcgaccggactcggcctagggttggcattgtcgaaagggttcacagtgggtatgggcggcgaactcgacaccgaagacacccccggcggcggtctcaccatggtggtcacgctgccggtcgccagcgctgatgcggatgcgaatgcggaccggcccggcgggtcgcgggcttcgctatga

SEQ ID NO: 2039 - protein, 854 aa, Rathayibacter rathayi
MLVGARVLLGAPRGVGKTFTMLEEAKPLRDEGVDVVVAVVETHGRAGTAAALVGLEVVPRLTVEHRGVVLTEMDVAGVIVRRAPQLALVDELAHTNASRQRTEKRWQDVEAILDAGIDVMSTVNIQHIESLTDVVHKITGAPQRETIPDEVLRAAREIEVIDVTPVAAGALASGLVYPAERIDAALSNYFRLGNLTGLRELALLWLADEVDSALKNYRAEQGIDSTWETRERVVVALTGGPEGDSHPPGATHCRPCGRGELLAVHVTGQDGFAPPTRGLWRQRSLVESLGGSYHQVIGDDIALVEFARAANATQLVIGVSRRGRLARRCPVRGSVDGHRESGNIDVHIVNHAAAGGRFTLPRMAGGALTVKRRLSGLALTLILGPLITAVLVTFRSPDSITSDVLTYQVLVVLVALVGGIWPALLAAVLSGITLDYFLVEPLFTVTVDKPLHLFALALYITIAMMVSYVVDQAARRTRVARRSAAESELLATIAGSVLRGDGALQSLVSRTRKVWVEGCDCWMPRVRPITPTRPPGADGQTAADHAVICADGEPASDDRVVLVPVGERATLELHGADLDASERRLLAVIAAQIDAALEHEALSVTAREVGPLAETDRVRTALLSAVSHDLRRPFDGGNQKGGWLALHRDDPVCRRPGGAARDRRRKPAHLSVLVTDLLDVSRVQAGVLGVTVRQVDVEDVLPRALDELGVGPDQVVLDLDAAVGPVLADPGLLQRVLVNLLANALRFSPEGAVPTIDQSFGDTVQIRVTDHGPGIAADRRDDVFVPFQRLGDTDNSTGLGLGLALSKGFTVGMGGELDTEDTPGGGLTMVVTLPVASADADANADRPGGSRASL

SEQ ID NO: 2040 - DNA, 2658 bp, Geobacter sulfurreducens
  CDS (1)..(2658)
atgctgaagctggcccaggccgaagaggccgaggcaaagcgggggaagctgaagatcttcctcggctacgccgccggtgtcggcaagacctacgccatgctgcaggcggcccgggagcgcaggcatgaagggcgcgacgtggtggccgcctacgtggaatcccacggccgaccggaaaccgatgcactcctggaagggctggaaatcctccccgcggcccggatcgagtaccagggggtcatgctcccggagctggatatcgacggggtgctggcccgccggccccagctcgccctggtggacgagctggcccacaccaacgcgccaggctcccggcacgagaagcgctggcaggacgtggaggaactgctggcggccggcatcgacgtcttcaccacggtcaacgtccagcacttcgagagcctcaacgacgtggtggcgcagatcaccggcatcgccgtgcgcgagaccgtgccggaccgcctcctggacctggcggcggagatccggttggtggacatcccgccggaggatctcctgcagcggttgcgcgaagggaaggtctacgtgccggagcaggccgcgtttgccgcggaaaagttcttccgcgccggcaacctgatcgccctgcgggagctatcgctccgccgcgccgcggtccgcgtggacgaagagatgcgggcctacatggaggcgcgggccattccgggcccctggccggcggccgagcggcttctggtgagcatcagcggcagcccgttcagcgagcggctgatccggaccacccgccgcctggcggacgaactgaaggccccctggttcacggtctacgtggagacccccggcaacggcaggcatgagcaggaaaaccggaaacgggtctggaaggatctccgcctggcggaaagcctcggcgcccaggtcgccaccgtcaccgccacgtcggtggcggaggcgctcatcgactacgcccgcaggcacaacgtgaccaggatcgtggtcggcaagccggcaaagccgcgctggcgcgagtttctgcgcctccccctggtcgaccggattatccgcctgagcggcgccatcgatgtgcacgtggtcagctacgagccggccgaggccggaaaggggccggtccttcccgtacggagggggccgatctccttctccggctacctggcgagcctggcactggtcgtcgcggcctccctggcctgcctcctgctccgtcccttcctggcgccgaccaacatggtcatgatctacctgctggcagtggtgctggcggcactgaggctcggcctcaagccggccatcctcacggcctttctgggggtcctggccttcgacttcttcttcattccgccgcacctgacctttgccgtggcagacacccagtacctgatcacctttgtcgccctgttcaccgtgggcgtggtcatcagcaccctggtctccacggtgcgcgaacgggccgaggccgtgcgggaacgggaggagcagaccgcctccctctactatctgagccgcgacctggcagcagccgccgacatcgagaccctcgtggccgccgtgatcaggaacatcggcgagaccctgttcgccagggccgccgtgctccttcccgagggagaccggctcagagtcgccgccgccagcaaggggctcaagcccgacgtcaaggagatggccgtggccgactgggcgttccgcaaccgccagaccgcgggccaggggaccgaaaccctcgcctcggcgggatttctctacctgccgctccagacatcgggctccgtcctcggggtgctgggggtcaggctgaaaaacgatgccgattaccgctccacccaggtccgccgcatgctggacgcattcacctcccagaccgccatggccctcgagcgggtccagctctcccggcaggccgagcaggcccagatcctccaggcccgcgagaacctcgaacgggccctgctcaactccatctcccacgacctgcgtacccccctggtcgccatcaccggcgccctggacaccctgcgcgacaaggtccataccctggccgacgaatcccggctggaactgctcgacaccgcgtgggaagaggcagagcggctgaaccgcttcgtgggcaacctcctcgacatgacccgcctggagtccggggcgatcaaactgaaacgggagctgagcgatgttcaggacttgatcgggtgcgccctggcggccctggagcggcggatcggcgagcgcgggatcgacgtgcgccttgctcccgacctgcccctggtcaggatagacatggtcctgatgacccaggtgctggtcaatctgctcgacaatgcgctgaaatattcgccgcccgacagcggcgtggagataacggcccgggtggacggaggcaggctccgcatcgagatggcagaccgcggcccgggcattcccgagcaggacctgaagcgggtattcgacaagttctaccgcattgcggttcccgaaggggcgcagggaaccgggctggggctttccatctgcaaaggaatcgtcgaggcccacggcggctccatccgggccgagaaccggaccgggggcgggctccgggtgatcgtgaccctgccgctggccggcggggcgaaagagggtgtttcccatgggccatga

SEQ ID NO: 2041 - protein, 885 aa, Geobacter sulfurreducens
MLKLAQAEEAEAKRGKLKIFLGYAAGVGKTYAMLQAARERRHEGRDVVAAYVESHGRPETDALLEGLEILPAARIEYQGVMLPELDIDGVLARRPQLALVDELAHTNAPGSRHEKRWQDVEELLAAGIDVFTTVNVQHFESLNDVVAQITGIAVRETVPDRLLDLAAEIRLVDIPPEDLLQRLREGKVYVPEQAAFAAEKFFRAGNLIALRELSLRRAAVRVDEEMRAYMEARAIPGPWPAAERLLVSISGSPFSERLIRTTRRLADELKAPWFTVYVETPGNGRHEQENRKRVWKDLRLAESLGAQVATVTATSVAEALIDYARRHNVTRIVVGKPAKPRWREFLRLPLVDRIIRLSGAIDVHVVSYEPAEAGKGPVLPVRRGPISFSGYLASLALVVAASLACLLLRPFLAPTNMVMIYLLAVVLAALRLGLKPAILTAFLGVLAFDFFFIPPHLTFAVADTQYLITFVALFTVGVVISTLVSTVRERAEAVREREEQTASLYYLSRDLAAAADIETLVAAVIRNIGETLFARAAVLLPEGDRLRVAAASKGLKPDVKEMAVADWAFRNRQTAGQGTETLASAGFLYLPLQTSGSVLGVLGVRLKNDADYRSTQVRRMLDAFTSQTAMALERVQLSRQAEQAQILQARENLERALLNSISHDLRTPLVAITGALDTLRDKVHTLADESRLELLDTAWEEAERLNRFVGNLLDMTRLESGAIKLKRELSDVQDLIGCALAALERRIGERGIDVRLAPDLPLVRIDMVLMTQVLVNLLDNALKYSPPDSGVEITARVDGGRLRIEMADRGPGIPEQDLKRVFDKFYRIAVPEGAQGTGLGLSICKGIVEAHGGSIRAENRTGGGLRVIVTLPLAGGAKEGVSHGP

SEQ ID NO: 2042 - DNA, 2577 bp, Mycobacterium paratuberculosis
  CDS (1)..(2577)
atgatggttgacgtgaccgacgtccgcgaccaccatcccaagcgcggggaactacgcatctatctgggtgcggccccgggggtgggcaagacgtattccatgctgggtgaggcacatcggcggctggagcgcggcacggatctggtggccggggtggtggagacccacgggcgcgcgaaaaccgctgagctgcttgagggcatcgagatcattccgccgcgctacatcgaataccggggcggccgcttccccgaactcgacgtgccggccgtgctggcccgtcacccccaggtggtgttggtcgacgaactcgcacacaccaacaccccgggcagcaagaaccccaagcggtggcaggacgtcgaggagcttctggacgccgggatcacggtgatctccaccgtcaacgtgcagcacctggaaagcctcaacgacgtcgtcgcccagatcaccggcatcgagcagaaagagaccgtgccggattcggtcgtccgccaggcctcgcaggtcgagctcatcgacatcacaccggaagcgttgcggcgcaggctgtctcatgggaatgtctatgcgccggatcggatcgacgcggcgctgtccaactacttccggcgcggaaacctcaccgcgctaagggaactggtgctgctgtggctggccgaccaggtcgacacggcgctggccaaataccgcgccgagaacaagatcaccgacacgtgggaggcccgcgagcgggtcgtggtggcggtcaccggcggtccggaatcggagacgttggtgcgacgggcgtcgcgcatcgcgtcgaagtccagcgccgaactgatggtggtgcacgtcatccggggcgacgggctggccggcctgtcggaatcgcggatggccaagatccgggagctcgccagcagcctggacgcgtcgctgcacaccatcgtcggcgacgaggtgcccgcggccctgctcgagttcgcccgcgagatgaacgccacccagctggtgatcggcacctcgcggcggtcccgctgggcgcggctgttcgaggaggggatcggcccgcggatcgtcgaattgtccggcaagatcgacgtgcacctggtcacccacgaggaatccaaacgcggcttccgggcgtcctcgctggcgccgcgggagcggcgggtggcgtcctggctggcggcgctgatcgtgccgtcggtcatctgcgcggtcaccgtcacgtggctggacccctacctggacaccggcggcgagagcgcgctgttcttcgtcggggtgctgctggtggggctgctgggaggcattgcgccggcggcactttcggcggtgctgtccgggctgctgctgaactactacctgatcgccccacggcacagcttcaccatcgccgaacccaacagtgccatcaccgaattggtgctgctgctgatcgcggtggcggtcgcggtgctggtcgacttcgcggccaagcgcacccgggaggcccggcgcgcttcccaggaggccgagctgctgacgctgttcgcgggttcggtgctgcgcggcgccgatctggagacgctgctggagcgggtgcgcgagacctacgcccagcggtcggtcagcatgctgcgcgagtcggaggacgcgcgggccggcggcaccaagacccaggtggttgcctgcgtgggccgggatccctgtgtcagcgtcgacgccgcggacaccgcgatcgaggtgggcggccccgattccagcgaatttcagatgctgctggcgggccgcaagctgtccgcgcgggaccgccgggtgctcagcgccgtggcccggcaggcggcggggctgatccggcagcgcgaactcgccgaggaggccagccgcaccgaggcgatcgtgcgggccgacgagctgcgccgctcgctgttgtcggcggtcagccacgacctgcgcaccccgctggcggcggccaaggtggcggtctccagcctgcgtgccgaggatgtcgccttctcccccaccgacaccgcggagttgctggccaccatcgaggagtcgatcgaccagctgaccgcgctggtgggcaacctgctcgattcgtcgcggctggccgccggggcgattcacccggacctgcgccgggtgtatctggaggaggccgtgcaacgcgcgctggtcagcatcggcaagggcgccaccggcttcttccgctccgcgatcgatagggtcaaggtcgatgtgggcgatgccatggtgatggccgacgccgggctgctggagcgggtgctggccaacctgatcgacaacgcgctgcgctacgcgcccaactgtgtggtgcgggtcaacgccgggcaggtcggcgatcgggtgctgatcagcgtcatcgacgaagggcccgggataccgcacggcgccgaggaacagatcttcgaagcgtttcagcggctcggcgatcacgacaacaccaccggggtggggttgggcatgtcggtggcgcgcggcttcgtcgaggcgatgggagggacgatcacggccaccgacactcccggcggcgggctcacggtgatggtggatatggctgcgccgcaatccgaaggcgccgcatga

SEQ ID NO: 2043 - protein, 858 aa, Mycobacterium paratuberculosis
MMVDVTDVRDHHPKRGELRIYLGAAPGVGKTYSMLGEAHRRLERGTDLVAGVVETHGRAKTAELLEGIEIIPPRYIEYRGGRFPELDVPAVLARHPQVVLVDELAHTNTPGSKNPKRWQDVEELLDAGITVISTVNVQHLESLNDVVAQITGIEQKETVPDSVVRQASQVELIDITPEALRRRLSHGNVYAPDRIDAALSNYFRRGNLTALRELVLLWLADQVDTALAKYRAENKITDTWEARERVVVAVTGGPESETLVRRASRIASKSSAELMVVHVIRGDGLAGLSESRMAKIRELASSLDASLHTIVGDEVPAALLEFAREMNATQLVIGTSRRSRWARLFEEGIGPRIVELSGKIDVHLVTHEESKRGFRASSLAPRERRVASWLAALIVPSVICAVTVTWLDPYLDTGGESALFFVGVLLVGLLGGIAPAALSAVLSGLLLNYYLIAPRHSFTIAEPNSAITELVLLLIAVAVAVLVDFAAKRTREARRASQEAELLTLFAGSVLRGADLETLLERVRETYAQRSVSMLRESEDARAGGTKTQVVACVGRDPCVSVDAADTAIEVGGPDSSEFQMLLAGRKLSARDRRVLSAVARQAAGLIRQRELAEEASRTEAIVRADELRRSLLSAVSHDLRTPLAAAKVAVSSLRAEDVAFSPTDTAELLATIEESIDQLTALVGNLLDSSRLAAGAIHPDLRRVYLEEAVQRALVSIGKGATGFFRSAIDRVKVDVGDAMVMADAGLLERVLANLIDNALRYAPNCVVRVNAGQVGDRVLISVIDEGPGIPHGAEEQIFEAFQRLGDHDNTTGVGLGMSVARGFVEAMGGTITATDTPGGGLTVMVDMAAPQSEGAA

SEQ ID NO: 2044 - DNA, 2724 bp, Rhodopseudomonas palustris
  CDS (1)..(2724)
atgcctgatccgcgcgttgagccgccgtcgcgaccctctccggacgccttgcttgaacaggcgaggcggcaggagcccggcacgggccggctcaaggtcttccttggggccgcgcctggcgtcgggaagacttacgccatgctgcagagcgcgcacgcccgcgccaaggccggggtcgatgtggtgatcggctatgccgagacccatggccgtgccgagaccgaggctttgctcgccggcttggagaccgtgccacgccggcgcattccgtacaaagggcaggtcctcgaagagatggacctcgatgcggtgctcgccaggcggccgcagctcgccatcgtcgacgagcttgcccacagcaacgccccgggcagccgccatcctaagcgctatctcgacgtattggagctgttggccaacggcatcgacgtctacaccgcagtcaacattcagcacatcgaaagcctgaacgacgtcgtcgcgcagatcaccacggtccgggtgcgggagaccgtcccggactcggcgttcgagcgggccgatgcgatcgagttggtcgacctgacgccggacgacctgatccagcgtctgaaggaaggcaaggtctatgtgccgaagcaggccgagcgcgcgctggagcactacttctcaccgggcaacctgaccgcactgcgcgaactggcactgcggcggaccgccgagcgggtcgacgagcagctgctgtcgcacatgcaggccaatgcgatccccgggccctgggcggcgggcgagcgcgtcctggtgtgcgtcagtcatgatcagcgctcgcaggggctggtccgctacaccaagcggctcgcggatcggctgcgtgcgccgtggacggcgatcaacatcgagacgcgtcgcagcctgtcgctgaccgagcagcagcgcgatcggcttgccgatacgctgcgtctggccgaggcgctgggcggcgaagcgctggcgatccccggcggcgatcgcagcctggcgcacgacatcctggcgttcgcgcgcgccaacaacattacccagatcgtggtcggcaaggcgccgcgatcgttctggtacgaagctctgcgcggctcgacggtccacgagctggtgcgcggctccggcaacatctcgatccacgtcatgaccggtaccgcggtctcgatcgaggaaagccagaccggttcgctgcgcccggccgagggaacggagccgttcaacccgtggccgtatccgatggcgctggtgctggtcgggatcgggctcggcgtcgccaagctgatcgaaccgttcttcagcatcgagaacgtcgatctggtgtttctcaccgcggtggtcggcgtcgcggtccgctacgggctggggccctcgctgctcgccagcgtcgtcgcgtcgctgtgctacaactttttctttcttccgccggtctacactttcaccatcaccgatccgaccaacatcgtcgcgttcttcttcttcatgttgatcgcgatcctggtctcgaacctcgccgggcgtgttcgcgcccaggcgaccgccgcggcgcagcgggtgcggacgacggagtcgctgtacgccttcagccggaagctcgccggtaccgccgcgctcgacgacgtgctgtgggcgaccgcgtatcagatcgcgctgatgctgaaggtccgggtggtgttgctgctccccgaacagggccgcatcgccgtcaaggccggctatccgccggaagatcagctggatccggccgatctcgcggcggcgaattgggcttgggagaacgatcgagtggcagggcgaggctccgacaccttgcccggtgccaaacgtttgtttctgccgatgcggaccgggcgcggaccgatcggcgtgatcgggatcgatgatgatcgcgccggtgccttgctgacaccggatcagcgccgcctgctcgacgcactgaccgatcagggggcgctggcgatcgagcgggtgcatctggtcgaggacatggatcgggtcaagcgcgatgccgagtccgaccggttgcggcaggcgttgctcacctcgatttcgcacgatctgaagactccgctggccgcggtcctcggcgccgcgacgacgatgcgggatctggcatcgcatctgagcgacgcgcaacggaccgaactcatcggcaccatcgtcgaggaatccgaacgcctcaaccgcttcatcgccaatctgctggacatgaccaagctcgaatccggtgccgtcgtgccaaacagcgcggcgcacgatctcggtgaactggtcggcgccacgctgcggcgcgcgacatcgatcctggcgcagcatacggtcaagctggatctcgggcatgatctgccgctgatcgaggtcgatccggtgctgttcgaacaggcgctgttcaacctgctcgacaacgcagcgaaatacgcgccggccggcagtgccatccagcttcgcgccgcgcagagcggcggtcaggttgagcttcaagtgcgcgacgaaggcgagggcattccgcctgccgaactggaaaccgtgttcgataaattttatcgcgtgcggaaaggcgatcatataaggcccggtactggcctcggactggcgatcgcacgaggtttcatcgaggccatgggcgggcgattgtcggccggcaatcgatccgatcgtagcggtgccgcgatgaccatccgtctccccattgcatcgcgtggcgatgccctgatcagtgcagcgtga

SEQ ID NO: 2045 - protein, 907 aa, Rhodopseudomonas palustris
MPDPRVEPPSRPSPDALLEQARRQEPGTGRLKVFLGAAPGVGKTYAMLQSAHARAKAGVDVVIGYAETHGRAETEALLAGLETVPRRRIPYKGQVLEEMDLDAVLARRPQLAIVDELAHSNAPGSRHPKRYLDVLELLANGIDVYTAVNIQHIESLNDVVAQITTVRVRETVPDSAFERADAIELVDLTPDDLIQRLKEGKVYVPKQAERALEHYFSPGNLTALRELALRRTAERVDEQLLSHMQANAIPGPWAAGERVLVCVSHDQRSQGLVRYTKRLADRLRAPWTAINIETRRSLSLTEQQRDRLADTLRLAEALGGEALAIPGGDRSLAHDILAFARANNITQIVVGKAPRSFWYEALRGSTVHELVRGSGNISIHVMTGTAVSIEESQTGSLRPAEGTEPFNPWPYPMALVLVGIGLGVAKLIEPFFSIENVDLVFLTAVVGVAVRYGLGPSLLASVVASLCYNFFFLPPVYTFTITDPTNIVAFFFFMLIAILVSNLAGRVRAQATAAAQRVRTTESLYAFSRKLAGTAALDDVLWATAYQIALMLKVRVVLLLPEQGRIAVKAGYPPEDQLDPADLAAANWAWENDRVAGRGSDTLPGAKRLFLPMRTGRGPIGVIGIDDDRAGALLTPDQRRLLDALTDQGALAIERVHLVEDMDRVKRDAESDRLRQALLTSISHDLKTPLAAVLGAATTMRDLASHLSDAQRTELIGTIVEESERLNRFIANLLDMTKLESGAVVPNSAAHDLGELVGATLRRATSILAQHTVKLDLGHDLPLIEVDPVLFEQALFNLLDNAAKYAPAGSAIQLRAAQSGGQVELQVRDEGEGIPPAELETVFDKFYRVRKGDHIRPGTGLGLAIARGFIEAMGGRLSAGNRSDRSGAAMTIRLPIASRGDALISAA

SEQ ID NO: 2046 - DNA, 24 bp, Primer
atgaataacgaacccttacgtccc

SEQ ID NO: 2047 - DNA, 28 bp, Primer
ttacatatcctcatgaaattcttcaagt

SEQ ID NO: 2048 - DNA, 723 bp, Escherichia coli; identical to SEQ ID NO: 417
  CDS (1)..(723)

SEQ ID NO: 2049 - protein, 240 aa, Escherichia coli; identical to SEQ ID NO: 418

SEQ ID NO: 2050 - DNA, 723 bp, Listeria innocua; identical to SEQ ID NO: 453
  CDS (1)..(723)

SEQ ID NO: 2051 - protein, 240 aa, Listeria innocua; identical to SEQ ID NO: 454

SEQ ID NO: 2052 - DNA, 798 bp, Yersinia pestis
  CDS (1)..(798)
atgccgggtggaatgggtggaaagggtgtggacagaaaattcatcgagacactgaaaacatactgtgatgatgctaaccggggagggggtccgctctaccagcgtctggagaaaggtttccgcgatctgatcacccgtggtgagctaaaagccggatacgcgattcccagcgaacgcgaactttcggaacgcttgaatctgtccagagtgacagtccggcgtgcgttaagtgaactggctaacgcgcaggttatcgtgcagcgtcgtggagcgagaagtactgtggcgggaagggttgaaaagccgctgtcttcgctgaccagctttagtgaggatatgatttcacgtggctatgagccaggcgcacgctggctacagaaagagcttactcacgcttctccctcggaaattattgcactgaatctgtctccaggtgctctggtgtggcgtctcaagcgcctgcgtaccgtagatgaacacccgatggcagtggagatcgccgtggtgccgcagatgtttattccagagatggatgaactgagggattcgctttattcagtactgcagttgcacgggtttatgcccgcccgcgcgttacagcgtattcgagcagaaccgctgagtcgcgatcacagccaactgttagatatgcctgctcacagcccggcgctgcatgttgagcgccattgctatctggaagatggccgcccgattgaatacacccatacctggtatcggggcgacagttacgattttctggttgaacttcagcgcgacatcacccccggtctgtcatga

SEQ ID NO: 2053 - protein, 265 aa, Yersinia pestis; identical to SEQ ID NO: 452

SEQ ID NO: 2054 - DNA, 744 bp, Salmonella enterica subsp. enterica serovar Typhi
  CDS (1)..(744)
atgaaaacattgagtaaaagttcacacatcccactgtatcaacaggttgtggagtggataagggaaagtatttatagcggagaattggttgaggatgaccggataccttcagagtttcaaatcatggatatgctggaggtgagtcgcggtaccgttaaaaaagcggttgaccaacttgtccgggaaggtgttcttgtgcaagtgcagggtaaaggaactttcgtaaagaaggaaaatgttgcttacccactgggtgaaggtttgctctcctttgctgaagccttagccagccagaagataaacttcacaaccagcgtcataacctcccgactggaacccgctaaccgctttgtagcagagaaactgagtatcaaaccgggacaagatgttttatttcttaaacgccttcgttgtattggcgatgaaaaagtcatgttgattgaaaatcgtatcaacattgatctctgccccggtattattgatgtagattttaccagggagaatttattttcagcaatagaaagattatctgataagaaaataagtttttctgaaagccgttacgcagctaaattaattggtaatgagcgaggccattatcttgatattggtgaagacgcacctgttttgcatttggaacagttggtatttttctctagaggattggccattgattttggtaacgtctggttaaaaggtaataaatattatcttggcactattttacagcgcctggatgcctga

SEQ ID NO: 2055 - protein, 247 aa, Salmonella enterica subsp. enterica serovar Typhi; identical to SEQ ID NO: 460

SEQ ID NO: 2056 - DNA, 714 bp, Listeria innocua; identical to SEQ ID NO: 455
  CDS (1)..(714)

SEQ ID NO: 2057 - protein, 237 aa, Listeria innocua; identical to SEQ ID NO: 456

SEQ ID NO: 2058 - DNA, 723 bp, Listeria monocytogenes; identical to SEQ ID NO: 457
  CDS (1)..(723)

SEQ ID NO: 2059 - protein, 240 aa, Listeria monocytogenes; identical to SEQ ID NO: 458

SEQ ID NO: 2060 - DNA, 729 bp, Listeria monocytogenes; identical to SEQ ID NO: 429
  CDS (1)..(729)

SEQ ID NO: 2061 - protein, 242 aa, Listeria monocytogenes; identical to SEQ ID NO: 430

SEQ ID NO: 2062 - DNA, 729 bp, Listeria innocua
  CDS (1)..(729)
atggctcagaaccagacaaaatatagctttattgctgaagaaatccgcaaaagaattatgaatcacgcctatccgcttaatcaacctattcctgatgagataactttggcgaaagagtttgattgtagtcgaatgacaatgaaaaaggcgcttgaagtacttgtacttgaaggcttactatatcgtaaacgcgggcatggtactttcattatcaaatcggcgctggacgcggaccgtttgcagattcataaccaagaagtaaatggtttcactaaacttttagacggaaaaaaggtcattagcaaagtaattgagtttaaagtcatctttccaacagaagaaattgcggaacgtcttcatatcgaaatggaaacgccaatctatgatattcttcgtgttcggctagtgaaagatgaaccgtatgtgctagaacatacgtatatgccggttggggttatcccaggcattaaccagcaaattttagaaggttcgatttactcatatattcaagacgatttgaacctaaaaattgctagttcgtacaaacaaattcgcgcggataaagcgacactgcttgatcagcaatatctcgactgcgcttctgatgaccccgttgtcgaagtagaacaaaccgtttatttaaacaacggtctcgcgtttgagttttccagatcgcgtcaccgttatgataaattcgtgtttactaccgttaatattgctagacgttga

SEQ ID NO: 2063 - protein, 242 aa, Listeria innocua; identical to SEQ ID NO: 432

SEQ ID NO: 2064 - DNA, 729 bp, Bacillus subtilis; identical to SEQ ID NO: 421
  CDS (1)..(729)

SEQ ID NO: 2065 - protein, 242 aa, Bacillus subtilis; identical to SEQ ID NO: 422

SEQ ID NO: 2066 - DNA, 747 bp, Bacillus halodurans; identical to SEQ ID NO: 445
  CDS (1)..(747)

SEQ ID NO: 2067 - protein, 248 aa, Bacillus halodurans; identical to SEQ ID NO: 446

SEQ ID NO: 2068 - DNA, 723 bp, Bacillus halodurans; identical to SEQ ID NO: 433
  CDS (1)..(723)

SEQ ID NO: 2069 - protein, 240 aa, Bacillus halodurans; identical to SEQ ID NO: 434

SEQ ID NO: 2070 - DNA, 714 bp, Bacillus halodurans; identical to SEQ ID NO: 427
  CDS (1)..(714)

SEQ ID NO: 2071 - protein, 237 aa, Bacillus halodurans; identical to SEQ ID NO: 428

SEQ ID NO: 2072 - DNA, 811 bp, Corynebacterium glutamicum
atgaacaccatgcctgaccaaccgctcaaccaggacggattccctaccgcatccaaaggggtggaacccgacaacctccccgaccgcgttctcgtggacggccttaaaccaaagcatcagcagcttcgtgaaattttggaggaaatctgcaccacccagcttcagcctggggacatgctgcctggtgagcgcatcctggaagaaaagtatggcgtcagccgaattacggttcgtcgggcgattggtgatctggtcgcgtccggcaggttgaagcgagctcgcggcaaaggtaccttcgtggcccactcgccgttgatttcccgcctgcatttggcctcgttttccgcagagatggccgcccagaagctatcggctaccagcaggattttgagttcttcccgcggtcccgccccagatgatattgctgatttctttggtaccgatcgcgcggcccagcacatcacgttgcgccgcctgcgctttggaaatggtcgaccctatgccattgacaacggttggtacaactccgaattcgcacctgacctgctggaaaatgatgtgtacaactccgtgtactccatcctggaccgcgtctatggcgtccccgtcacccaggccgagcaaacggtcaccgccgtagcagccgacgaagacaccgcacggcttctggacgtcacccccggcgccccactccttcgtatccttcgacagtcactttctggcgataagcccgtggaatggtgcgtttccttgtaccgaaccgaccgatattctttaaaaacattggttacacgctccgaagatctcttag

SEQ ID NO: 2073 - protein, 269 aa, Corynebacterium glutamicum; identical to SEQ ID NO: 462

SEQ ID NO: 2074 - DNA, 732 bp, Bacillus subtilis; identical to SEQ ID NO: 425
  CDS (1)..(732)

SEQ ID NO: 2075 - protein, 243 aa, Bacillus subtilis; identical to SEQ ID NO: 426

SEQ ID NO: 2076 - DNA, 744 bp, Caulobacter crescentus
  CDS (1)..(744)
atgacgtttgcggaacgaatcggccgtctcgacgccacgggcgatcacgccccgctgtaccggcagctgcagcgcgcgctgcgcgaagccatccagaagaaggtgctggctccggacgacgcccttcccgccgagcgggacatggcggacgaattcaacatctcgcgcatcaccgttcgcaaggcgctggacggcctggtcagcgagggcctgctgacgcgccgccaaggcgccgggacctttgtcgccgcgcgggtcgagaagagcttctccaagctgtcctcgttcaccgaggacatgatctctcgcggccgcgtcccgcgcagcgagtggatcagccgcagcgagggccaggtgacccccgaggagtcgctgaccctgggcctgtcgcccggaaccccggtctatcggttcgcacggatccgctatgcggacggcgcgccgatggcggtggaatacacaacgatcgcggccttcgccctgccctccaccgaagtggtcggcacatcgctctatgaagcgctggagacgaccggtcaccgcccggtgcgcgcgctccagcggctgcgcgcggtgctgttccaggccgagcaggcggacctgctgggcgtgcccgtcaaggacgccggcctgctgatcgagcggcgaggcttcctgaaggacgggcgggccgtcgaggtcacgcaatcctactaccgcggcgacgcctacgacttcgtcgccgaactgaattccctgtcctga

SEQ ID NO: 2077 - protein, 247 aa, Caulobacter crescentus; identical to SEQ ID NO: 442

SEQ ID NO: 2078 - DNA, 711 bp, Streptococcus pneumoniae
  CDS (1)..(711)
atgaagaaataccaacaattatttaagcaaatccaagaaaccattcaaaacgagacttacgctgtcggagatttccttcctagcgagcacgaccttatggagcaatatcaagtgagtcgtgataccgtccgaaaggccctgtctctcctccaagaggaaggattgatcaaaaagataagagggcaaggttctcaagtcgtcaaagaagaaaccgtcaatttccctgtatccaacctaaccagctaccaagaactagttaaagaacttggactgcgctctaaaaccaacgtggtcagtctggacaagattattattgataaaaaatcctcactgataaccggtttcccagagtttcggatggtttggaaggtggtccgccagcgtgtggtggatgatctggtatccgttctggatacggactatctggatatggaactcatcccaaatctcactcgccaaattgctgagcagtctatctattcttatatagaaaatggcctcaaactccttattgattatgctcagaaggaaatcaccattgaccactcaagcgaccgagacaagattctcatggacattggcaaagacccttatgtcgtttcgattaaatcaaaagtctatctccaagacggacgccaatttcagtttaccgaaagtcgccataagttagagaaatttagatttgtagattttgcaaaacgcaagaaatag

SEQ ID NO: 2079 - protein, 236 aa, Streptococcus pneumoniae; identical to SEQ ID NO: 436

SEQ ID NO: 2080 - DNA, 729 bp, Streptococcus pneumoniae
  CDS (1)..(729)
atgagtacaaaatatttatttatttacaatgagattcgtgaaaagattctttgtaataaatataccatgaacgaacaattgcctgatgaaatgacattagctaaacagtttgcctgtagtcgaatgacgatcaaaaaagctttagacttgttagtttctgagggcttaatttttagaaaacgtgggcagggaacctttgttctctctcgtggcagctcaaaaagaaaattaatcgttccagaaagagatatccggggactgacaaaaatatctgaagatgctcattctacaattgactcgaggattattcacttcaaattagaatttgcaaatgaatttttagcagaaaaactacaggtcgctttgcagagtccagtttataatatttaccgcctgcgtattattgacggtaaaccttatgttctggaacaaacttatatgagtaccgatgttattccaggtattactgaagatattttacaaaaatcgatttacaattacattgaaggaaagttaggattgcatattgccagtgctacaaaaatcttacgagcttcttctagttcagaaaatgagcaacattacttgcagctccttccaacggaaccggtatttgaagtagaacaagtggcttatttggataacggaactccgtttgagtactcgattagtcgtcatcgctatgatttatttgaatttaattcttttgcattacgacattcctcctag

SEQ ID NO: 2081 - protein, 242 aa, Streptococcus pneumoniae; identical to SEQ ID NO: 438

SEQ ID NO: 2082 - DNA, 708 bp, Streptococcus pneumoniae
  CDS (1)..(708)
atgaaaaatatgctacctgcttatatgaaaatccatgatcagataaaaaaggatattgacgagcaccgttgggctattggtgagaggcttcccagtgaaagagatttagctgagcagtttgcggtcagtcgcatgaccctccgccaagccgtatctctattagtcgaagaaggcgtcttagagcgccgtgtaggaagcggcacctttgtttccagtactcgagtacaagaaaagatgcgagggacaaccagttttactgaaattgtcaaatcccaaggtaaagttccctctagccagctcatttcctacaaaaaaaccattcccaatgagcaagaagttgccaagctaggaatttttccaacggacaatattatccgaatggagcgggtccgctatgccgaccaagttcccctagtttatgaagttgcttctattcctgaaaaattcattaaggactttaaaaaagaagaaatcaccagtcatttcttccaaaccttgcaaaaacatggctatcgtatcggtaaatcccaacagaccatctatgctcgccttgctaaagaaaagattgcccactatttggaagttgaaaaaggacatgctattcttggattgacccagatttcctacctagaagatggtactgcttttgaatacgtaaaaagtcaatatgtaggcgaacgctttgaattttatcttgaaaataattag

SEQ ID NO: 2083 - protein, 235 aa, Streptococcus pneumoniae; identical to SEQ ID NO: 450

SEQ ID NO: 2084 - DNA, 717 bp, Escherichia coli; identical to SEQ ID NO: 423
  CDS (1)..(717)

SEQ ID NO: 2085 - protein, 238 aa, Escherichia coli [sequence omitted]

SEQ ID NO: 2086 - DNA, 708 bp, Lactococcus lactis subsp. lactis; identical to SEQ ID NO: 443
  CDS (1)..(708)

SEQ ID NO: 2087 - protein, 235 aa, Lactococcus lactis subsp. lactis; identical to SEQ ID NO: 444

SEQ ID NO: 2088 - DNA, 756 bp, Escherichia coli; identical to SEQ ID NO: 439
  CDS (1)..(756)

SEQ ID NO: 2089 - protein, 251 aa, Escherichia coli; identical to SEQ ID NO: 440

SEQ ID NO: 2090 - DNA, 732 bp, Clostridium acetobutylicum
  CDS (1)..(732)
atgaagatagtatcaaaatcaagtcctcttcctcttcattatcagctcaagatgattttacaggaaatgatcgaaaatgaagaattgcttcctggagatactattcctactgaaagagaactttgtgaaatccagaaaataagtagaatgactgtaaataaagcaattctatcattagtgtctgaaggtattctctatagggagcaaggtaagggaacctttgtagccaaaaaaaaggagaaacaacaactgacaaagctaaagagttttactgaagaaatgagggaaaagggcctaaacataagtacaaaaatactatcctttgaaataaaaactgccacaaaacatataagcaccttattggaacttccacataagaaaatgaaagttatagaaataatacgtcttagattaacagataatgatccctctgcaatagaaactgttgtacttcccttgtatttatttagtgatatgacaaaagaagttattgatgggaaatctctatacaatacctttagagagaaatatggctatgagcctacaaaggcaaaacaaactattgaacctatcatgctaacagactatgaggcaaaattcttaaatcaagtaggtaattccttagcccttctttttcgaagactcacctatagaaaggatggagttcctattgaatacacaaaatcaatatatagaagtgaaaaatataaatatgaagtaatattaacttag

SEQ ID NO: 2091 - protein, 243 aa, Clostridium acetobutylicum; identical to SEQ ID NO: 448

SEQ ID NO: 2092 - DNA, 747 bp, Bordetella parapertussis
  CDS (1)..(747)
atgatgtctgaatcgaaccatgccccgctctatgcccgggtcgaggccgtgctggccgaggcgatcgccgcgggcgaactgccgccgggcagccagttgcccgccgaagacggcctgatcgcgcgcttccaggtcagccgcaccacggtgcgcaaggccatccagaacctggccgagcgtgggctggtcgagatccggcgcggcaagggcaccttcgtggcgcagccgagggtggtgcaggagctcaccgagctcaccggtttcgtggaggacatgcaggccttgggccgcgtgccctcggcgcgcctgctggacgccgagatcgtggccgccggccaggccgtggcgcgccagctggcggtggcgccgggcacgcaggtcatgcgcatccggcgcgtgcgcctggccgatggcgtggccatgtcgctggacgaaacctatctgccgcgcgaaatcggcgaacaggtcgtcacgcacgacctggaggccgagcccatcttcgcgctgctggaacagaaatacgacctgccgctggtcgaggccgaataccggctcgaggccgccatcgccacgcccgaagtggcgcgggccctggcggtgccgcccggcagtccggtcttcctgatcgagcgcacctcgtattgcgcgggccctcggcccatcgactacgaaaagctgtactaccgcggcgacctgatccgcttcgtgacgcggctggcgcggcgcgcgcggcccgtgccggcatga

SEQ ID NO: 2093 - protein, 248 aa, Bordetella parapertussis; identical to SEQ ID NO: 510

SEQ ID NO: 2094 - DNA, 747 bp, Bordetella bronchiseptica
  CDS (1)..(747)
atgatgtctaaatcaaaccatgcgccgctctatgcccgggtcgaggccgtgctggccgaggcgatcgccgcgggcgaactgccgccgggcagccagttgcccgccgaagacggcctgatcgcgcgcttccaggtcagccgcaccacggtgcgcaaggccatccagaacctggccgagcgcgggctggtcgagatccggcgcggcaagggcaccttcgtggcgcagccgagggtggtgcaggagctcaccgagctcaccggtttcgtggaggacatgcaggccttgggccgcgtgccctcggcgcgcctgctggacgccgagatcgtggccgccggccaggccgtggcgcgccagctggcggtggcgccgggcacgcaggtcatgcgcatccggcgcgtgcgcctggccgatggcgtggccatgtcgctggacgaaacctatctgccgcgcgaaatcggcgaacaggtcgtcacgcacgacctggaggccgagcccatcttcgcgctgctggaacagaaatacgacctgccgctggtcgaggccgaataccggctcgaggccgccatcgccacgcccgaagtggcgcgggccctggcggtgccgcccggcagcccggtcttcctgatcgagcgcacctcgtattgcgcgggcccccggcccatcgactacgaaaagctgtactaccgcggcgacctgatccgcttcgtgacgcggctggcgcggcgcgcgcggcccgtgccggcatga

SEQ ID NO: 2095 - protein, 248 aa, Bordetella bronchiseptica; identical to SEQ ID NO: 508

SEQ ID NO: 2096 - DNA, 738 bp, Bacillus cereus; identical to SEQ ID NO: 503
  CDS (1)..(738)

SEQ ID NO: 2097 - protein, 245 aa, Bacillus cereus; identical to SEQ ID NO: 504

SEQ ID NO: 2098 - DNA, 732 bp, Bacillus anthracis
  CDS (1)..(732)
atgaacatcgacaagtattcaccatttccgatctattatcagattcaagagtgggtgaaacagctaattgaggacggcgaatggaagccgggagataaaatcccatctgagaatgaactttgcgataagttcgaagtgagtcgtatgacaatcagacaggcgattaataatttagtggaacaaggttatttatatcggaaacgtggaatcggtacgtttgtccaacttccgaaagtggaacaaaaattgcaaggaatgacaggattcacagaagatatgatttctcgtgggatgaacccaagtagccaattattaagtttccgcctcgttccagctactgcgaaaatagcagaccggctgagaatacaggagggagagtcggtttatgaagtgaggcgtattcgcttagctgacgatgaaccgattgcttttgagacgacatatttgtcgccagctcttgtaaaagatattaacgaagaaatattgcaacaatctttatatgaacatttagagaaaaaactgggcttcaaacttgttagcgctactcaatcaattgaagcttcaattgcaacggataatgaagcggaacatctgcatattcctaaaaaggcgccagtgcttgtcatgcgtcaatggtcatattcagaaggtgaagtaccgttagagtatgtgaaatgtatttatcgtggagatcgttataagtttattacaaacatcgcacgtaacaaataa

SEQ ID NO: 2099 - protein, 243 aa, Bacillus anthracis; identical to SEQ ID NO: 502

SEQ ID NO: 2100 - DNA, 738 bp, Bacillus anthracis; identical to SEQ ID NO: 499
  CDS (1)..(738)

SEQ ID NO: 2101 - protein, 245 aa, Bacillus anthracis; identical to SEQ ID NO: 500

SEQ ID NO: 2102 - DNA, 765 bp, Streptomyces avermitilis
  CDS (1)..(765)
atgagcaccgacgtcagcagtgcggagaacgagggcggggcacccatccgtaccgcgcgtgtgcccaagtactaccgcctgaagaagcacctgctcgacatgacggagacgctgccgcccggcacacccgtgccgcccgagcgcacgctggccgccgagttcgacacctcccgcacgaccgtccgccaggccctccaggagctggtcgtcgagggccgcctggagcgcatccagggcaagggcacgttcgtcgccaagccgaaggtctcccaggcgctgcaactcacctcgtacaccgaggacatgcgcgcccagggtctcgaaccgacctcgcagctcctggacatcggctacatcaccgcggacgacaccctcgccgggctgctcgacatcaccgcgggcggccgcgtgctgcgcatcgagcggctgcgcctggccagcggcgagccgatggccatcgagacgacccatctgtccgccaagcgcttccccgcgctgcgcaggtcgctggtcaagtacacgtcgctctacaccgcgctcgccgaggtctacgacgtccgtctcgccgaggccgaggagaccatcgagacctcgctggccaccccgcgcgaggccggactgctgggcaccgacgtcggcctgcccatgctgatgctctcgcggcactcgctggacaaggacggccggccggtggagtgggtgcggtcggtgtaccgcggggaccgctacaagttcgtggcgagactcaagcgcccccaggactga

SEQ ID NO: 2103 - protein, 254 aa, Streptomyces avermitilis; identical to SEQ ID NO: 498

SEQ ID NO: 2104 - DNA, 756 bp, Enterococcus faecalis
  CDS (25)..(756)
ccagttagggtaaaggagaaagttatggaaaatgcctttaaaaacaaagctttgtatcatcaacttgttgatttgctgcaggaacgaatcgaaacatgcatgattcctcatgacaagttgccctctgaacgtgaattgactgcacaatatggagtgagtcggacgacggtccggttagcgctacaagaactagaaaatagaggttccatctatcgtcgtcatggcaaaggaacatttgtttcagatataaaaaaagaggccgctgatttagctggcgcatatagttttacagaacaaatgaaagggctgggtcgaaaaccacatacccgtatattatccttcgaaaaattggaagcggataaatttatttgtcagcatttgaatctttcgttaggagaggcagtttttaaattaagtcggttgcggattgctgataacgagccattaatggttgaagacacatacttgcctgtgaaatttttcttatcactcacggatcaattactacgtagcaaaccattatatgatctattttcggaagattttaagcaaaccgttcgtttagctgatgaagaattatacgctagcattgcgtcaaaagaagatgccaaattattgatgattccggaaggagcgccagtccttcatttagcacgccagacatataacatgaaaaatgaaattattgaatttacgttgagtgtggcgcgagcagatcaatttcattatcagatacgccatattcggaatagttag

SEQ ID NO: 2105 - protein, 243 aa, Enterococcus faecalis; identical to SEQ ID NO: 496

SEQ ID NO: 2106 - DNA, 708 bp, Enterococcus faecalis
  CDS (1)..(708)
atggttcaaaatataccaatttatattcaaattcacgataaaatcaaagaagatattgaaaaaggtgtctggagtatcggggatcgtttgccctctgagcgagaattagccttgaaatttgatgttagtcgaatgaccttacgccaagccatccagactttagcagacgaagggattttagaacgaaaaattggttcaggaacgtatgtagcacgtaagaaagttcaagaaacaatgacaggtaccactagttttacagaaattaccttgtctcaaaatcgcgttccttctagtcggacggtgtcttattttgtagcgaaacctagttctagtgagatggaaaaattacaactaggtccagaagattcaattttacgaatggaaagaattcgttttgcggatgacattccgatttgttttgaggtggcgagcattccttattcattggtctcgcaatatggcaaatctgaaatcacgaactctttttataaaacacttgaagccaaatctggccacaaaattggccattctaaccaaacaatctctgctgttcaagcatcggaacagatcgcagaatatttagagattaaacgaggcgatgcgattctgcgtgtgcgccaagtatcctattttgaaaacggactaccttttgaatatgttcgtacgcagtatgcaggaagtcgatttgagttttatttagagaagtag

SEQ ID NO: 2107 - protein, 235 aa, Enterococcus faecalis; identical to SEQ ID NO: 494

SEQ ID NO: 2108 - DNA, 675 bp, Shigella flexneri
  CDS (1)..(675)
atgatctacaaaagcattgcggagcggttaagaattcgacttaattccgcggatttcacgctaaacagccttcttcccggtgaaaaaaagctggcggaagagtttgcggtatcgcggatgactatccgtaaagccattgacctgctggtagcgtgggggctggtggtccgccgccacggcagcggcacttacctggtgcgcaaagatgtgctgcatcaaaccgccagcctgaccggactggtggaggtgttaaaacggcagggaaaaacggtcaccagccaggtgctgatttttgaaatcatgcctgcgcctccggccattgccagccagttacggattcaaatcaacgagcagatctacttctcccgtcgcgttcgttttgtggaagggaaaccgctaatgctggaagacagctatatgccggtaaaactgttccgtaacctttcgctgcaacatctggaagggtcgaagtttgaatatattgaacaagagtgcgggattttgattggcggtaattatgaaagcctgatgccggtgctcgccgatagactgctggcgcggcaaatgaaggtagcggaacacacgccactgctgcggatcacctcgttgtcatatagcgagagcggggagtttttgaattattcagtgatgttcagaaatgccagcgaatactag

SEQ ID NO: 2109 - protein, 224 aa, Shigella flexneri; identical to SEQ ID NO: 506

SEQ ID NO: 2110 - DNA, 723 bp, Shigella flexneri; identical to SEQ ID NO: 491
  CDS (1)..(723)

SEQ ID NO: 2111 - protein, 240 aa, Shigella flexneri; identical to SEQ ID NO: 492

SEQ ID NO: 2112 - DNA, 927 bp, Pseudomonas putida
  CDS (1)..(927)
atggcggcgagcattgccacgtccttgttgtgcgggtttgccgagcacaagcataagccacatgcggtcctcccgacacaaggctgtttcgcctaccaaagggcgacaggcggaggattgacagcctgtcaggctcagggaatactctcgaaaaattcatatatatgtttatataacaagacgagagcgagacccatgcacccattgaccggtgatgctcgactgccccgctaccaacaactgcgcgatcacatggttgcgcaaattgccaacaaccgctggcgcccgggggaagcgatcccgaccgaggcagccttggccaccgagttcgacctgtcgatcggtaccgtgcgcaaggccgtcgatgtcctggtggccgaaggcgtgctggagcgccagcagggccgcggcaccttcattcgccgcccacagttccagtcgtcgctgttccgcttcttccgtttcgaggccgccaatggcgagcgcatagtgccggaaagccgcattctctccatcgagtcgctgccggcgccttccgcggtggccgaggcattgggcctggcaggggaggcagaagtgatccgcatcattcgcacacgtctgctcggcgcccagccggtgctggccgaagaaatctggctgccgcgccaaaccttccagccgctgctggacgtggatctgaacagcgagggcccgctgctgtacccgatctacgaagcgctgtgcggtcaggtggtcgcctacgccgaagaaaccctgaccgccgaagcggtcgacgcggtgcatggccgcttgctgcaactgccggccgacagcccggtggtcgtgatcgagcgcctggcccgcgattacgccggcaaacctctggaatggcgccgctcgcgcggccatgcgcagcacttccgctaccgcatcgacattcgttag

SEQ ID NO: 2113 - protein, 308 aa, Pseudomonas putida; identical to SEQ ID NO: 490

SEQ ID NO: 2114 - DNA, 711 bp, Lactobacillus plantarum; identical to SEQ ID NO: 487
  CDS (1)..(711)

SEQ ID NO: 2115 - protein, 236 aa, Lactobacillus plantarum; identical to SEQ ID NO: 488

SEQ ID NO: 2116 - DNA, 699 bp, Streptococcus mutans; identical to SEQ ID NO: 485
  CDS (1)..(699)

SEQ ID NO: 2117 - protein, 232 aa, Streptococcus mutans; identical to SEQ ID NO: 486

SEQ ID NO: 2118 - DNA, 699 bp, Streptococcus agalactiae
  CDS (1)..(699)
atgttaccagcatatattaaaattcacgacgctattaaaaaggaaatcgataaagggacttggaagattgggcagcggttacctagcgaaagagatttagcggatgattatagtgtaagtcgtatgacacttcgccaatcaattacattgttagttgaagaaggtattttggagagacgagttggtagtggcacctatgttgctagtcatcgtgttcaagaaaaaatgcggggaacaactagttttacagaaattgtcaattctcaagggcgtaagccatccagtaaactaatctcatttcaaagaaaactagcaaatgaaaccgaaattcaaaaattaaatttatcacagtcagattatgtggttcgtatggaaagggtacgttatgctgataaggtaccgttggtttatgaggtagcctctataccagagaatttaattaaaggttttgaacaatcagaggttacagaacatttctttaaaaccttaacagagaatggctacgaaattgggaaaagccaacaaactatatatgctagaaatgctagtgaacgtgttgcttcgcatttagaagttaacgcaggccatgctattttggcattgacacaagtttcatactttactgatggtaagccttttgaatatgttcatgggcaatatgttggagatcgttttgagttttatttagagaataactag

SEQ ID NO: 2119 - protein, 232 aa, Streptococcus agalactiae; identical to SEQ ID NO: 484

SEQ ID NO: 2120 - DNA, 747 bp, Oceanobacillus iheyensis; identical to SEQ ID NO: 481
  CDS (1)..(747)

SEQ ID NO: 2121 - protein, 248 aa, Oceanobacillus iheyensis; identical to SEQ ID NO: 482

SEQ ID NO: 2122 - DNA, 756 bp, Escherichia coli O6; identical to SEQ ID NO: 479
  CDS (1)..(756)

SEQ ID NO: 2123 - protein, 251 aa, Escherichia coli O6; identical to SEQ ID NO: 480

SEQ ID NO: 2124 - DNA, 699 bp, Escherichia coli O6; identical to SEQ ID NO: 477
  CDS (1)..(699)

SEQ ID NO: 2125 - protein, 232 aa, Escherichia coli O6; identical to SEQ ID NO: 478

SEQ ID NO: 2126 - DNA, 765 bp, Streptomyces sp
  CDS (1)..(765)
atgagtacggacgtcagcagcgccggggccgacacgagggcgccgggccgccgggaccgcgtgccgaagtactacctcatcaagcagcggctgctgcagatgaccgacgagcgcgcgccgggctccccgatgccggccgagcggctgctcgccgtcgagttcggcacgtcccgcaccaccgtccgcaaggcactgctggaactggtgagcgagggccggctcgaccgcatccagggcaagggcaccttcgtggcccggccgaaggtgtatcggacactccaactgacctcgtacaccgaggacatgcgcgcccaggggctcagccccgcctcgcaggtcctggacatcggatacgtcccggcggacgcggagctggcggcgctgctggaggtggaaccggaggaccgggtcctgcggatcgagcggctgcggctggccggtggcgagccgatggccatcgaggcgacccacctctccgcccgccgcttccccggcctgcggcgcaacctcacccgctacacctctctctacaccacgctcgccgaggtgtacggggtccggcccgcggaggccgacgagaccatcgagacctccccggcgacaccgcgtgaggcgggcctcctcggcacggacgtgggcctgccgatgctgctgctgtcccgccactcgcgggacgagaacggggccccggtggagtgggtacggtcggtgtaccgcggctcccgctacaagttcaccgcgcgactgcggcgaccgcgggggtga

SEQ ID NO: 2127 - protein, 254 aa, Streptomyces sp; identical to SEQ ID NO: 468

SEQ ID NO: 2128 - DNA, 714 bp, Streptococcus mutans
  CDS (1)..(714)
atgaaaaaatatgaaattatttttaaaaaactagaagaagatattctcaaaggacactatcaaatgggtgactatcttccccctgaaatggaacttagccagacctatgccagcagccgagatactgttagaaaggctttacagctcttgactaaggcaggttttattaaaacagtacagggaaggggatcccaaattatcaagcgtgagcgcattaactttcctgtttctcaactaaccagctatcaagaattggttaaacaattgcagatgaatgtcaagacaaatgttattgctattgataaactgattgttgatgagaaactcaccaaactaaccggttttgaaaataaaggtcttgtctggcgcatcacaagacagcgcgtcatagacggcgttgcttccattttagatacggattatttggataaagcattgattcctcatatgaccagagaaatcgctgaacattctatctatgattatcttgaaaatcaacttaagctggacattgcctatgctcaaaagattattaccatagatcaagtatcgcaaaaagataaaattttgcttgatttggattctgaaaatcatgtcgtttcggttaaatctaaagtttatctcagtaatcagcagcaatttcaattcactgaaagccggcacaaactggaaaagttccgttttgttgactttgccagacggcatcgtgattag

SEQ ID NO: 2129 - protein, 237 aa, Streptococcus mutans; identical to SEQ ID NO: 476

SEQ ID NO: 2130 - DNA, 762 bp, Streptomyces griseus
  CDS (1)..(762)
atgggcgccgaaggggcagtacggggggcgagaccggtaccggtacgcgcacagcgcgtaccgaagtactaccggctcaagcgccatctcctcgacatgacggacaccctgccgcccggcacccccgtgccgcccgaacgcaccctggcggccgaattcgacacctcgcgcaccaccgtgccgcaggcgctccaggagctggtcgtggagggccggctggagcgcatccagggcaagggcaccttcgtggccaagccgaaggtctcccaggccctccagctcacctcgtacaccgaggacatgcgtgcccagggactggagccgacgtcccaactgctggacatcggctatgtgacggcggacgacacgctcgccggcctgctggacatctcgacgggcggccgggtgctgcgcatcgagcggctgcggctcgccagcggggagccgatggcgatcgagaccacgcacctttcggccaaacgcttcccggcgctgcgccgttcgctggtgaagtacacctcgctctacaccgcgctcgccgaggtgtacgacgtgcgcctcgccgaggcggaggagaccatcgagacctcgctcgcgacgccgcgcgaggcgggactgctcggcaccgacgtggggctgccgatgctcatgctgtcccgccattcggtggacggccagggcgaacccgtggagtgggtgcgatcggtgtaccggggcgaccggtacaagttcgtggcccgcctgaagcggggcacggactga

SEQ ID NO: 2131 - protein, 253 aa, Streptomyces griseus; identical to SEQ ID NO: 466

SEQ ID NO: 2132 - DNA, 726 bp, Clostridium perfringens; identical to SEQ ID NO: 471
  CDS (1)..(726)

SEQ ID NO: 2133 - protein, 241 aa, Clostridium perfringens; identical to SEQ ID NO: 472

SEQ ID NO: 2134 - DNA, 726 bp, Streptococcus pyogenes; identical to SEQ ID NO: 469
  CDS (1)..(726)

SEQ ID NO: 2135 - protein, 241 aa, Streptococcus pyogenes; identical to SEQ ID NO: 470

SEQ ID NO: 2136 - DNA, 705 bp, Pseudomonas fluorescens; identical to SEQ ID NO: 463
  CDS (1)..(705)

SEQ ID NO: 2137 - protein, 234 aa, Pseudomonas fluorescens; identical to SEQ ID NO: 464

SEQ ID NO: 2138 - DNA, 765 bp, Streptomyces coelicolor
  CDS (1)..(765)
atgagcaccgacgtcagcagtgcggagaacgagggtggggcgaccgtccgtaccgcgcgcgtgcccaagtactaccgtctgaagaagcatctgctcgacatgacccggacccagacgccgggcacaccggtcccgccggagcgcaccctggccgccgagttcgacacctcgcgcacgacggtgcgccaggccctgcaggagctggtggtcgagggccgcctggagcgcatccagggcaagggcaccttcgtcgccaagcccaaggtgtcgcaggcgctgcaactcacctcgtacaccgaggacatgcgggcccagggcctcgaaccgacctctcagctgctggacatcggctacatcaccgccgacgaccggctcgccgggctgctggacatcacggccggcggccgggtgctgcgcatcgagcggctgcgcatggccaacggcgagccgatggccatcgagaccacccacctcagcgcgaagcgcttccccgccctgcgccgctccctggtgaagtacacgtccctctacaccgcgctcgccgaggtgtacgacgtccatctcgccgaggccgaggagaccatcgagacctccctggccaccccgcgcgaggccggtctgctcggcaccgacgtcggcctgcccatgctgatgctctcccggcactcccaggaccgcaccggccagccggtggagtgggtccgctcggtgtaccggggcgaccgctacaagttcgtggcccgcctcaagcggccccaggactag

SEQ ID NO: 2139 - protein, 254 aa, Streptomyces coelicolor; identical to SEQ ID NO: 474

SEQ ID NO: 2140 - DNA, 23 bp, Primer
atgggacacaagcccttataccg

SEQ ID NO: 2141 - DNA, 23 bp, Primer
ttatcgcgatgattttcgctgcg

SEQ ID NO: 2142 - DNA, 750 bp, Escherichia coli K12
  CDS (1)..(750)
atgaattcccgacaacaaactattctacagatggtcattgaccagggtcaggttagcgtaaccgatctggcaaaagccactggagtttctgaagttaccattcgccaggatctcaacacactcgaaaaactgagttacctccgccgtgcacatggctttgctgtttcgcttgatagtgatgacgtcgaaacccgtatgatgagcaactatacgctgaagcgtgaactcgccgagtttgccgcgtcgctggttcaaccgggcgaaaccatctttatcgaaaatggcagcagcaatgccctactcgcccggactctgggcgagcagaagaaaaatgtcactatcatcacggtcagcagctacatcgcgcatttgctgaaagacgcgccttgtgaagttattttgctcggtggcgtgtatcagaaaaaaagcgaaagtatggttggccctttgacacgccagtgcatccaacaggtgcatttcagcaaagcatttattggtattgatggctggcaacctgaaactggatttaccggtcgcgatatgatgcgtaccgatgtggtcaatgccgtgctggaaaaagagtgcgaagcgatagtcctgactgacagctcgaaatttggtgctgtacattcatactccatcggtcccgttgagcgattcaatcgcgtgattaccgattcgaaaatacgcgccagcgatctgatgcatcttgagcacagtaaactcaccattcacgtcgttgacatttaa

SEQ ID NO: 2143 - protein, 249 aa, Escherichia coli K12
MNSRQQTILQMVIDQGQVSVTDLAKATGVSEVTIRQDLNTLEKLSYLRRAHGFAVSLDSDDVETRMMSNYTLKRELAEFAASLVQPGETIFIENGSSNALLARTLGEQKKNVTIITVSSYIAHLLKDAPCEVILLGGVYQKKSESMVGPLTRQCIQQVHFSKAFIGIDGWQPETGFTGRDMMRTDVVNAVLEKECEAIVLTDSSKFGAVHSYSIGPVERFNRVITDSKIRASDLMHLEHSKLTIHVVDI

SEQ ID NO: 2144 - DNA, 756 bp, Pseudomonas aeruginosa
  CDS (1)..(756)
atgaacctgcccccccgacagcaaagcatcatcgaggaggtccgcgagcgcggttacctgagcatcgaggagatggcgcagatgttcgcggtcaccccgcagaccatccgccgcgacatcaaccagctcgccgaacagggactgctgcgccgctaccacggcggtgcggcctacgattcgagcatcgagaacaccgcctacaccatgcgcgccgaccagatgcgcgacgagaagcagcgcatcgccgaagccgtggccagcctggtgccggacaacgcctcgctgttcatcaacatcggcaccaccaccgaggccatcgcccgcgccctgctcaaccaccgcaatctgaagatcatcaccaacaacctgcacgtggccgccaccctcagcgccaaggaagacttcgaagtgctggtcgccggcggcaccgtacgcagcgacggcggcatcgtcggccaggccgcggtggacttcatccagcagttccgcgtcgacttcgccctggtcggcatcagcggcatcgacgaggatggtagcctgctcgacttcgactaccaggaagtgcgcgtatcccaggcgatcatcgacaacgcgcggcaagtgttcctggccgccgactcgagcaagttcgggcgcaacgcggtggtccgcctgggaccgatctcgctggtcaaccgggtcatcagcgacagcccgccgcccgccgccatcgcccgcctgatggcacagcacaaggttcacctggacctggtctga

SEQ ID NO: 2145 - protein, 251 aa, Pseudomonas aeruginosa
MNLPPRQQSIIEEVRERGYLSIEEMAQMFAVTPQTIRRDINQLAEQGLLRRYHGGAAYDSSIENTAYTMRADQMRDEKQRIAEAVASLVPDNASLFINIGTTTEAIARALLNHRNLKIITNNLHVAATLSAKEDFEVLVAGGTVRSDGGIVGQAAVDFIQQFRVDFALVGISGIDEDGSLLDFDYQEVRVSQAIIDNARQVFLAADSSKFGRNAVVRLGPISLVNRVISDSPPPAAIARLMAQHKVHLDLV

SEQ ID NO: 2146 - DNA, 756 bp, Bacillus halodurans
  CDS (1)..(756)
atgcttgtagccgaaaggcatgaaaaaatcattgcgctcgtcactgaaaaagggagcgttcgtgtatcggaattaagtcaattgtttaacgtaactgaggagaccattcgccgtgatttagaaaagcttgaaagcgaacggaagctgcaacgaagccatggcggagcagttagcataaaggaagacacagaggccccatattttgaacgggaaatccgaaatgtaaatgaaaagcaagccgtcgcagctcaagcggtcacatatgtgaccacgaacgatcgaatcattttagatgcgagcacaaccgcttggtatatggcgaaacggttgccagatgtaccgttaacggttttaacgaactcgatgaaagtggcgatggagctagccaaacgagaaaaaataacggtgattacggtaggaggcaccttactacgaaaatcgttatcttttgttggcccccaaacgaatcaaacgcttgaactgtatcatgtgaacaaagcgttcatctcttgccaaggagtgcatgccaagcgggggataagcgactccaacgaaatgcaggcactcgtgaaacagaaaatgatcgatatttccgatcacgtgtttttgctcgccgatcatacgaaatttggaaagcaagccttttcgcgaattacgtcgatggaaacgattgatacgatcattacagattcaaaaactagtgaggaacaaatcagtgactttcaagagttagaaatggacgtgattcgtgcttag

SEQ ID NO: 2147 - protein, 251 aa, Bacillus halodurans
MLVAERHEKIIALVTEKGSVRVSELSQLFNVTEETIRRDLEKLESERKLQRSHGGAVSIKEDTEAPYFEREIRNVNEKQAVAAQAVTYVTTNDRIILDASTTAWYMAKRLPDVPLTVLTNSMKVAMELAKREKITVITVGGTLLRKSLSFVGPQTNQTLELYHVNKAFISCQGVHAKRGISDSNEMQALVKQKMIDISDHVFLLADHTKFGKQAFSRITSMETIDTIITDSKTSEEQISDFQELEMDVIRA

SEQ ID NO: 2148 - DNA, 738 bp, Streptococcus pneumoniae
  CDS (1)..(738)
atgttaaaaacagaacgtaaacaactaattttagaggagttaaatcaacatcatgtagtttctctagaaaaattagttagtttgctagaaacgtcagaatcaacggttcgaagagacttggatgagttggaagcggaaaacaagcttcgtcgtgtgcatggtggagcagaactcccctactccttacaggaagaagaaaccattcaagaaaaatctgtcaaaaaccttcaagaaaagaaattgctggctcagaaagcagcctctctcattaaagaaaaagatgtcatctttatcgatgctggaacaacaactgcttttttgattcatgaattggtcaataagaatgttacagttgtgaccaactccattcaccatgccgctcagttggttgaaaagcagattccaactgtcatggttggaggaaacgtcaagacggcgacagatgctagtatcgggggcgttgctcttaaccagattaaccaattgcactttgaccgtgcctttatcggaataaatggtgttgacgatggctattatacgactcctgatatggaggagggagctgtgaaaagagctattttggagaatgccaagcagacctacgtcttggtggattcgtcaaaaattggacaaacttgctttgccaaggtagccccactcaaacgcgctatcgttatcactagtcaagggcatgagctcttgcaggttattaaggagaaaacggaggtaatagaagta

SEQ ID NO: 2149 - protein, 246 aa, Streptococcus pneumoniae
MLKTERKQLILEELNQHHVVSLEKLVSLLETSESTVRRDLDELEAENKLRRVHGGAELPYSLQEEETIQEKSVKNLQEKKLLAQKAASLIKEKDVIFIDAGTTTAFLIHELVNKNVTVVTNSIHHAAQLVEKQIPTVMVGGNVKTATDASIGGVALNQINQLHFDRAFIGINGVDDGYYTTPDMEEGAVKRAILENAKQTYVLVDSSKIGQTCFAKVAPLKRAIVITSQGHELLQVIKEKTEVIEV

SEQ ID NO: 2150 - DNA, 765 bp, Clostridium acetobutylicum
  CDS (1)..(765)
atgtttgcagaagaaaggcaaaaagaaataaaagctattttagatagagaaggtagtataaaggtaaatgaattatcagtccattttgatgtttcagaagccacaataagaagagatttaaaagaaatggaagatagaaggattctcaaaagaacacatggaggcgcagttccaattgatataactaattttgaggcgtctttcgttgataaaaaagatgagggacaagttgaaaagttggctataggaaagtatgcggctaatatgattaaaaatggggatactataatattagattcaggaacaactactcttgaaatagctaaaaacatagatgcagaagacataacagttataacgaattctattgatatagcatcagaattattaaacagaaaagataaaaaaatcgagctcatagtagctggaggaattttaagacctaatactagagcaatggttgggaatttatgtgagagtgtatttaagaattttagggttgataaagcttttattggagcaaatggaataacttcaatagagggaataacaacaccaaactttactgaagctcaagctaaaaaagcaatgataaatgcagcgaacaaagtaatagtagtcgcggatagttctaagtttgaaaatatttgtttctccatgatttgtaaggcagaatatgctacagcaattgttacaagtggggaattatcagaagaagatataaaagattttaaagatttgggagtacaaataatagtcgcataa

SEQ ID NO: 2151 - protein, 254 aa, Clostridium acetobutylicum
MFAEERQKEIKAILDREGSIKVNELSVHFDVSEATIRRDLKEMEDRRILKRTHGGAVPIDITNFEASFVDKKDEGQVEKLAIGKYAANMIKNGDTIILDSGTTTLEIAKNIDAEDITVITNSIDIASELLNRKDKKIELIVAGGILRPNTRAMVGNLCESVFKNFRVDKAFIGANGITSIEGITTPNFTEAQAKKAMINAANKVIVVADSSKFENICFSMICKAEYATAIVTSGELSEEDIKDFKDLGVQIIVA

SEQ ID NO: 2152 - DNA, 753 bp, Listeria innocua
  CDS (1)..(753)
atgttaaatgcagagcgaaaacaacttattatggagagtattgaaaagcttggtgttattaaattacaagaattagttgaagggctagatacctcggagtcaactattcgtcgtgatttaatcgaattagaggaacaaggattaatcgaacgtgtacacggtggtgcaaaacttgttatttctcataaccaagaaccaagcatgaatgagaaatcattcaaaaacattcaaagtaaaaaagaaatcgcagcatattgcgctagtttagtggaagaaaatgattgtatctatttagatgcaggctccacgacactggaattaattactcacttagcaaatcgaaatattactgtagttacaaatggactaacccatattgaagaactagttcgtcaaaatattgatgcttatcttttaggtggcaaaatgaaagtgcatacaaaagcaattattggcgcagttgccttggataatattaaaaattatcattttgacaaagcttttattggaactaacgctatgcatccggagcatggctatacgacaccagatatggaagaagcatttgtaaaacgtgctgccaaagagcgtgctgatcgcgtttttgttgtagcagaccatacgaaattcaatgaagttaatttttcaaaaatgttttcaatagatgaagctactattgtaacagactatattccttcagaagtaagaaaatcctttatccaaaaaactaaaataatcgaggtagaaaaatga

SEQ ID NO: 2153 - protein, 250 aa, Listeria innocua
MLNAERKQLIMESIEKLGVIKLQELVEGLDTSESTIRRDLIELEEQGLIERVHGGAKLVISHNQEPSMNEKSFKNIQSKKEIAAYCASLVEENDCIYLDAGSTTLELITHLANRNITVVTNGLTHIEELVRQNIDAYLLGGKMKVHTKAIIGAVALDNIKNYHFDKAFIGTNAMHPEHGYTTPDMEEAFVKRAAKERADRVFVVADHTKFNEVNFSKMFSIDEATIVTDYIPSEVRKSFIQKTKIIEVEK

SEQ ID NO: 2154 - DNA, 777 bp, Yersinia pestis
  CDS (1)..(777)
atgaaagcggcaatcgaaaggcgcatggaaatcttcaatatagtaacccagcaagggaaagctcgtgtcgaagatctagccgaaagattcaatgtctcaagtgtcaccattcgtagtgacctgagttttttagagaaaaacgggtacatcgtcagatcgcacggttcggctattccgaacaccggcgttatcgccgagctgactgtccatgaaaagcggcgccgtaattccggcgtgaaatcgctgattggtcaggcggcggcgaagctgattaacagtggtgacaccgtcattctggattcagggacaaccacacgggaaattgcggccaacttgaggtcggtagagaacgtagtggttatgacgaatggtcttgatgtggctatggagttagcatccgctcccggcgtggaagtcctcatctccggtggtgtgttgcgtaagagtgcgatgtctttttctggttctcaagccgaagccagcctgaaaaactttcgttttgacaaagtttttctgggtgttgatggttttgacttgcgagttggtatcaccacatataatgagcaggaagcgagtcttaaccgcctaatgtgtgacatctcggaacaaattattgccgttgctgattcgaccaagtttgggaaacgcagctgccacatgattcgagagtttggtgatatcgatattttggtgacggattcggatattcctgaagagtatgtgcagcgactacgggatatgcgaattgaagtgatcatagctgaaaaagagaaataa

SEQ ID NO: 2155 - protein, 258 aa, Yersinia pestis
MKAAIERRMEIFNIVTQQGKARVEDLAERFNVSSVTIRSDLSFLEKNGYIVRSHGSAIPNTGVIAELTVHEKRRRNSGVKSLIGQAAAKLINSGDTVILDSGTTTREIAANLRSVENVVVMTNGLDVAMELASAPGVEVLISGGVLRKSAMSFSGSQAEASLKNFRFDKVFLGVDGFDLRVGITTYNEQEASLNRLMCDISEQIIAVADSTKFGKRSCHMIREFGDIDILVTDSDIPEEYVQRLRDMRIEVIIAEKEK

SEQ ID NO: 2156 - DNA, 759 bp, Listeria monocytogenes
  CDS (1)..(759)
atgctatctatcgaacgtaaacgcgccattgtccaatatgtcaaaagccgaaaaatagcaaccgttagcgaactagctaaacattttgaagttcacgaagcaaccattcgccgcgatttaacatcacttgaaaaagacaaaaaactaaaaagaacccatggcggagttatgatagaagaaaaagtagtttctgaacctaactggaaaaaacgtagtgaagtgcgctatgaagaaaaacaacgcatcgctacattagcagcaacaatggttaaagacggggacacaatcatcctagacgccggaacaacaaccggtcatatcgcaacagcgttaaaagaccgctccaaattaaccgtaataacaaatgatattaacgtagcttccataatgcgcttttccccgtccaaagtaatcgtgacaggtggagtcatttatccggaaacattcattcttaacggtatgataacgagcggaaccttacagagtattcacgtacataaagccttcgtaaccacaccagctcttgatattgataaagggttaatgcactacgatgaatatctaatcccagcaaaacaacaaatgctccactcagccgatgaagtaatcttagtaacagatcacaccaagttcggtcggatctccttatacaaatacgcagctctagatgaaatatcttctatcatcactggaaaagaaatagatccagtcttgaaagaacaatttgaagaaaaaggaatgcaaatttatacaacataa

SEQ ID NO: 2157 - protein, 252 aa, Listeria monocytogenes
MLSIERKRAIVQYVKSRKIATVSELAKHFEVHEATIRRDLTSLEKDKKLKRTHGGVMIEEKVVSEPNWKKRSEVRYEEKQRIATLAATMVKDGDTIILDAGTTTGHIATALKDRSKLTVITNDINVASIMRFSPSKVIVTGGVIYPETFILNGMITSGTLQSIHVHKAFVTTPALDIDKGLMHYDEYLIPAKQQMLHSADEVILVTDHTKFGRISLYKYAALDEISSIITGKEIDPVLKEQFEEKGMQIYTT

SEQ ID NO: 2158 - DNA, 753 bp, Salmonella enterica subsp. enterica serovar Typhi
  CDS (1)..(753)
atgaactcccgacaacaatcaattttgcaaatggtggttgataaaggccagatgagcgttgctgaactggcgaaaattaccggcgtatctgaagtcacgattcgtcaggatctgaataccctggaaaagcagagctatttacgccgtgcgcacggtttcgccgtttcgcttgagagcgatgacgtagagactcgcatgatgacgaactacacgctaaaacgccgactggcggagttcgccgcctcgctggtcagtccaggggaatccgtttttattgaaaatggcagcagcaatgcgctattggcccggacgctggcggaacaaaaagatgtcacgatcatcaccgtgagcagttatatcgcgcacctgctcaaagagaccccttgcgaagtcattctcctcggtggaatctatcagaaaaaaagtgaaagcatggtagggccgttgacgcgacagtttatccatcaagtgcatttcagcaaagcatttatcggtattgatggctggcaggctgataccggttttaccggacgcgacatgatgcgatcggatgtggttaacgctgttctggaaaaaggctcagaagcgattgtcctcaccgacagctccaaatttggctgtgtgcatccctatcccctgggcccgctctctcgcttccatcgtgtcattacggattccaaaatttccgccagcgatcaaatgcagttagaacatgcggggctgctagtcaatgttattggctcatccgtttaa

SEQ ID NO: 2159 - protein, 250 aa, Salmonella enterica subsp. enterica serovar Typhi
MNSRQQSILQMVVDKGQMSVAELAKITGVSEVTIRQDLNTLEKQSYLRRAHGFAVSLESDDVETRMMTNYTLKRRLAEFAASLVSPGESVFIENGSSNALLARTLAEQKDVTIITVSSYIAHLLKETPCEVILLGGIYQKKSESMVGPLTRQFIHQVHFSKAFIGIDGWQADTGFTGRDMMRSDVVNAVLEKGSEAIVLTDSSKFGCVHPYPLGPLSRFHRVITDSKISASDQMQLEHAGLLVNVIGSSV

SEQ ID NO: 2160 - DNA, 765 bp, Listeria monocytogenes
  CDS (1)..(765)
atgtttccatttgaaagacaaaacaaaataattcatctactagaccaaaatagcaaaataactgtaccagaattaagtcgtatcttggatgtctcgattagtaccatccgaaatgatttatcttcattagaagaaagcgggatgattaaaaaagtacacgggggtgcggtacttttaaaaagcgaagaaaaatttactaattttaatgaccggattattcgcaacatcgaagaaaaagaagcgattgcgaaagaagcggcgactttagtgaaaaataaccaaacaattatccttgatgccagctctacagcacttgcgcttgcaaaagaattacatggattttcaaggctgactgtcattacaagtggactctacacagcaatcgaactaaaagacaacccgaatattagcgttattttaacgggcgggattgtaacgacgaactctttcacactggaagggattcttggcgcaaatttaattgaaaatattcacgccgatttatgttttatgtcagcgaaaggttttacaatggaagaaggcttaactgatttcaacatttatgaaacagaactaaaacgacttcttgctaaacgaaccaacaaattgatcgcacttctggaccatacaaaaatgggcgtaatttccactgcgagcatcacctcggcagaaaatattgatttacttattacagataacaaaataaataaagctttatataaaaaattccaagatgcgggacttccggtcaaagtggcagaataa

SEQ ID NO: 2161 - protein, 254 aa, Listeria monocytogenes
MFPFERQNKIIHLLDQNSKITVPELSRILDVSISTIRNDLSSLEESGMIKKVHGGAVLLKSEEKFTNFNDRIIRNIEEKEAIAKEAATLVKNNQTIILDASSTALALAKELHGFSRLTVITSGLYTAIELKDNPNISVILTGGIVTTNSFTLEGILGANLIENIHADLCFMSAKGFTMEEGLTDFNIYETELKRLLAKRTNKLIALLDHTKMGVISTASITSAENIDLLITDNKINKALYKKFQDAGLPVKVAE

SEQ ID NO: 2162 - DNA, 753 bp, Listeria monocytogenes
  CDS (1)..(753)
atgttaaatgcagagcgtaaacaacttattatggagagtattgagaaacttggtgtaattaaattacaagaactagttgaaggtcttgctacctcagagtcaaccattcgccgcgatttaatcgaattagaagaacaaggattaatccaacgtgtacacggcggggcgaaacttgtaaaacttcacaaccaagaaccaagtatgaatgagaaatcattcaaaaacattcaaagtaaaaaagtaattgctgcatattgtgcaagtctagtggaagaaaatgattgtatctatttagatgcaggatccaccacattagaattaattactcatttagcaaatcgaaatatcacagtagtgacaaatggtttaacccatattgaagagcttgttcgtcaaaatattgatgcttatcttttaggtggcaaaatgaaagtgcatacaaaagcaattattggtgcagttgccttagataatattaaaaattaccatttcgataaagctttcattggtactaatgcgatgcatccggagcatggctatacaacacccgatatggaagaagcatttgtaaaacgtgctgcaaaagaacgtgctgatcgcgtttttgttgtagctgaccatactaaatttaatgaagttaatttttcaaaaatgttttcaatagaagaagcaactattgtaacagactatattccttctgcagtaaaagaatcctttatccaaaaaactaaaataatcgaggtagaaaaatga

SEQ ID NO: 2163 - protein, 250 aa, Listeria monocytogenes
MLNAERKQLIMESIEKLGVIKLQELVEGLATSESTIRRDLIELEEQGLIQRVHGGAKLVKLHNQEPSMNEKSFKNIQSKKVIAAYCASLVEENDCIYLDAGSTTLELITHLANRNITVVTNGLTHIEELVRQNIDAYLLGGKMKVHTKAIIGAVALDNIKNYHFDKAFIGTNAMHPEHGYTTPDMEEAFVKRAAKERADRVFVVADHTKFNEVNFSKMFSIEEATIVTDYIPSAVKESFIQKTKIIEVEK

SEQ ID NO: 2164 - DNA, 756 bp, Bacillus subtilis
  CDS (1)..(756)
atgctaactcctgaacggcatcaattgattattgatcaaatagaaaagcatgatgtggtaaagattcaagagcttataaatctgactaatgcttctgaatcaacaatcagaagagatttatcgacccttgaagaacgcggttttttaaagcgcgttcatggtggagcggccaagctttccgatatcagacttgaacccgatatgcttgaaaaatcatccaaaaaccttcacgataaactgaagattgctgaaaaagctgcttctcttttagaagaaggggattgcatttaccttgatgcaggcacgacgacattgcacatgattgattttatggataaaaccaaagatattgtcgttgtcacaaacggggtaatgcatatcgatgcattaataaggaaagaaatttctttttatctgcttggaggatacgtaaagcacagaacgggcgcgattattggaggcgcttcattggttgccatggaccagtacagatttgacaagagttttctggggacaaacggtgtccatacagaggctggatttacaacgccggaccctgatgaggcccttttaaaacagaaagcgatcaaacaggcaaaacacgcttacgtcttagcagacccttcgaagttcggagaaatttcattttcggcattcgccggaataggcgacgcaacaatcattacgactgacgctgaagagcttacattcgataattaccaagaaaaaactgtcgtaaaggtagtgaaaccatga

SEQ ID NO: 2165 - protein, 251 aa, Bacillus subtilis
MLTPERHQLIIDQIEKHDVVKIQELINLTNASESTIRRDLSTLEERGFLKRVHGGAAKLSDIRLEPDMLEKSSKNLHDKLKIAEKAASLLEEGDCIYLDAGTTTLHMIDFMDKTKDIVVVTNGVMHIDALIRKEISFYLLGGYVKHRTGAIIGGASLVAMDQYRFDKSFLGTNGVHTEAGFTTPDPDEALLKQKAIKQAKHAYVLADPSKFGEISFSAFAGIGDATIITTDAEELTFDNYQEKTVVKVVKP

SEQ ID NO: 2166 - DNA, 756 bp, Bacillus halodurans
  CDS (1)..(756)
atgttaacgatcgaacgtcatgaacaaattgtaaaactagtacaagaaaaagaagttgtaacgattcatgaccttgtcgaatatacgaatgcgtcagagtccacgattcgtcgtgatttgaccgagctagaaaaacagaaaaaattaaagcgtattcatggcggggcttccgtcctaaagaagcgccgtgaagaacctacgatggctgaaaaaacagtcaaaaacaatcacgaaaaaaagaagatcgcggaattagctgcaagcttcgtagaggatggcgattgtctgtttcttgacgcaggaacgacgacgtatgaattaattccttttattaaaactaaaaaaatagtcgttgtcacaaatggacttgacagcatctccgcactgcttgaggcaggggtggaaacgtacgttattggcgggacggtgaagcaaggaacacgggcatttgtaggacgccatgcgattcaaagcttacagacgtttcgatttgataaagcgttccttggcattaacggagtccatttagaggatggcttcacaacgcctgatccgcaagaagcatacgtgaaagaaacagccctttccctttcgcgggaagcctttatgttggtggaccattcaaaatttggagaaacgacatttgcaaccgtagctccgattcatgccgctacgattgtgacgagcagccaagtggagcagcaagtcattcaagcatacgaaactcagacagcagtgaaggtggtgacgctatga

SEQ ID NO: 2167 - protein, 251 aa, Bacillus halodurans
MLTIERHEQIVKLVQEKEVVTIHDLVEYTNASESTIRRDLTELEKQKKLKRIHGGASVLKKRREEPTMAEKTVKNNHEKKKIAELAASFVEDGDCLFLDAGTTTYELIPFIKTKKIVVVTNGLDSISALLEAGVETYVIGGTVKQGTRAFVGRHAIQSLQTFRFDKAFLGINGVHLEDGFTTPDPQEAYVKETALSLSREAFMLVDHSKFGETTFATVAPIHAATIVTSSQVEQQVIQAYETQTAVKVVTL

SEQ ID NO: 2168 - DNA, 756 bp, Bacillus subtilis
  CDS (1)..(756)
atgaaactgatgcggattcaggaaatggaggagtacattttatcgcatggcactgtttccttagatgagctgtgccaggtgttcaatgtctccaaaaacacagtcagacgtgatatcaacaagctaacagaaaagggtgcgattgaaaaagtatacggcggcgtaacatctattgaaaaaaccgcattagttccttttgaaaatcgcaccattcagcaccaggatgaaaaaacaaaaatcgcccattatgcttcccgatttattgaagatcacgatttggtcttcattgattcaggaacgacgacaaagtctattcttgatacgcttgatccagccaaaaatgtcaccatcttaaccaacagtttagacattatcaatgcggcgtcagctttgaagaatatcaacttaatcattatcggaaacaactataagagaaaaacccgctcctttgtcggcatggacgacccggctatgcttgataagtacaatatcaacaaagcctttatgtccgctaccggaacgacgctgactcacggattgaccaattcggatctgctggagtatgaaattaaaaagaggatttcagaaaaagcaaaagaagtgtatctattggctgaccattctaaattcggaaaatcaacgcttctgacgtatgcaccgtttgacaggctgcattgcattgtgacctctcagccattagacgacgagtacacgcagtactgcaatgagcatcaaatcggcattcatctggcctaa

SEQ ID NO: 2169 - protein, 251 aa, Bacillus subtilis
MKLMRIQEMEEYILSHGTVSLDELCQVFNVSKNTVRRDINKLTEKGAIEKVYGGVTSIEKTALVPFENRTIQHQDEKTKIAHYASRFIEDHDLVFIDSGTTTKSILDTLDPAKNVTILTNSLDIINAASALKNINLIIIGNNYKRKTRSFVGMDDPAMLDKYNINKAFMSATGTTLTHGLTNSDLLEYEIKKRISEKAKEVYLLADHSKFGKSTLLTYAPFDRLHCIVTSQPLDDEYTQYCNEHQIGIHLA

SEQ ID NO: 2170 - DNA, 741 bp, Clostridium acetobutylicum
  CDS (1)..(741)
atgaatttaagacaaaataaaatttttaatataatagtaaagagtcccaagattacagtcaaagagctaagtaaattgctttctgtgtcagaggttacaataagaaaagatttgtcttcacttgaggaagaaagattaattaaaagaatacatggtgcagctgaaatttcttcagattctattgaaagtaaaatattatccaaatatgaagaaaagcttaggatagcaaaagaaggaataaaatttgtagacaatggcgacactattttgattgaagcagggtcaactaatgctcttttagcaaaacaaatttcagaggctagaaatgttcatataattacaaattctctttacatagctgaaaatttgaaactcaaggaaaacgttaaaataacgcttataggaggagaactacaaaaggaaggggatgcgcttgttggtcccgttgcaaaggcttgtttaaatgaggtaattgtggataaggcgtttattggaatggatggcttttcaaaggaactgggcttttgctgtagtgatttttttagagctgaaattgcaaaagaaatgtgcagtaaggcaaataaagttatagttctgggggaagcctctaaatttgaaaatgttggagttacacttacagctaagtttaatgaggtttatacggttataactgatacaaagatatcgaaggaaaatatgaatatactgaaggaaaataaagttagaactttagtagtttaa

SEQ ID NO: 2171 - protein, 246 aa, Clostridium acetobutylicum
MNLRQNKIFNIIVKSPKITVKELSKLLSVSEVTIRKDLSSLEEERLIKRIHGAAEISSDSIESKILSKYEEKLRIAKEGIKFVDNGDTILIEAGSTNALLAKQISEARNVHIITNSLYIAENLKLKENVKITLIGGELQKEGDALVGPVAKACLNEVIVDKAFIGMDGFSKELGFCCSDFFRAEIAKEMCSKANKVIVLGEASKFENVGVTLTAKFNEVYTVITDTKISKENMNILKENKVRTLVV

SEQ ID NO: 2172 - DNA, 795 bp, Streptococcus pneumoniae
  CDS (1)..(795)
atgttgttttttgctttttattttggtagaataaaacggaggtgtaaaatgaaaagattggaacaaattattaaattagtatcagaatatgaaaagatcgacgttaatacattatcggaaaaattaaatgtatcgaaagtaacgattagaaaagatttagataaattagagtcaaaaggtttattacacagagagcatggatatgctgtattaaatagtggagatgacttaaatgtacgtttgtcaattaactatgaaattaagagaaaaattgttcaggaagcagtaaaattggtgtcagataatgaaacaataatgatagaatctggatcgacctgtgctttacttgctgaggaaatttgcaagcaaaaaagaaatgttacgattgtaacaaattcattttttatagcaaattttgtgagagcttatgattcatgtcgtattattgttcttggtggagagtttcagaaggattcacaggttactgtgggacctttattaaaagaaatgatacagacttttcatgtgcatcaagcttttgttgggacagatggttacgataaagagatgggctttacaggaaaagatttaatgcgcagtgaggtagttcaatatatttcagcagcgtcggataaagtcattgtactaactgactcaagtaaatttgataaaaggggtacagtaagaagatttgctttaagtcaagtctatgaagtaataacagacgaaaaactttctaaacaaaatatagctacattagaaaatgctgggataatggttaaggtagtttcgtaa

SEQ ID NO: 2173 - protein, 264 aa, Streptococcus pneumoniae
MLFFAFYFGRIKRRCKMKRLEQIIKLVSEYEKIDVNTLSEKLNVSKVTIRKDLDKLESKGLLHREHGYAVLNSGDDLNVRLSINYEIKRKIVQEAVKLVSDNETIMIESGSTCALLAEEICKQKRNVTIVTNSFFIANFVRAYDSCRIIVLGGEFQKDSQVTVGPLLKEMIQTFHVHQAFVGTDGYDKEMGFTGKDLMRSEVVQYISAASDKVIVLTDSSKFDKRGTVRRFALSQVYEVITDEKLSKQNIATLENAGIMVKVVS

SEQ ID NO: 2174 - DNA, 777 bp, Bacillus subtilis
  CDS (1)..(777)
atgctagtagcagaacggcagcaaaaaatagtggaaatagtaaatatgcgttcaagcatccgcgtttccgaattaagtgacattttttcagtcacagaggaaaccattcggcgtgatcttgaaaagcttgaaaaagaacataaactgagccggagccacggaggagcggtcagtattcagcagaaggaatcagaaattcatttttctgaacgggaaatcacgaatgtcatcgaaaaaaaagccatcgctcacgaagcggccaaatatgtaaaaagcggagaccgaatcattctcgatgcaagcacaaccgcttggtacatggcaaaaatactccctgacattgagctcaccgtgattacaaactcaatgaaagcagctattgaactcagcaataaagaaaacatatcagtcatttcaacaggcggcattttgctggaaaaatcattatcatttgccggcccgttagcagagcgttcacttgagacctatcatgtcaataaaacctttctgtcatgtaagggatttgacgtacacaacgggatgagtgattcaaatgagtggcaggcgctgctcaaaaaacggatgatcgaaaggtcggaccagaccattttgatggccgattcaagcaaatgggggaaccgcgagttttcacatatcgcctcgctgcaagatgtcagccgccttattacggattctggacttgatccggcatcggtaaaagctcttgaggacaaaaaggtgaaggtgacagctgttcctctttcgaagagagggtga

SEQ ID NO: 2175 - protein, 258 aa, Bacillus subtilis
MLVAERQQKIVEIVNMRSSIRVSELSDIFSVTEETIRRDLEKLEKEHKLSRSHGGAVSIQQKESEIHFSEREITNVIEKKAIAHEAAKYVKSGDRIILDASTTAWYMAKILPDIELTVITNSMKAAIELSNKENISVISTGGILLEKSLSFAGPLAERSLETYHVNKTFLSCKGFDVHNGMSDSNEWQALLKKRMIERSDQTILMADSSKWGNREFSHIASLQDVSRLITDSGLDPASVKALEDKKVKVTAVPLSKRG

SEQ ID NO: 2176 - DNA, 777 bp, Pseudomonas aeruginosa
  CDS (1)..(777)
atgcgccccgaggaacgccgccgccacattctcgaattgctgcgccagcgcgagcggatctcggtggacgaactggcgcggaccctttccacctctcaggaaaccattcgccgcgacctcgccgcgctggccgaacaaggcctggtcagcaaattccacggaggggccgccctgccgcccagcggcgagcacgagaacgccttccagacgcgaatgaacgagcacgcccaggaaaaacgcgcagtcgcccgctacgccgccggcctgttcgggcccggtgacagcatcttcatcgacaccggcaccaccaccctgctgttcgcccgcgaactggcgcgccagagccatctgacggtgatcaccaactcgctgttgatcgccggcagcgtcggcgcctccggcaaccgtgcattcatgatcggcggcgagtaccgcccggaatccgaacagaacgtcggcgccctggccatcgagcagatcgcccggttcaacgccgagcatgcggtgatcaccgtcggcgcgctgaacggcgatggcgccatggatttttccatcgaggaagccgagatcgcccgtgccatgatcgcccaggcccgccaactgacggttatcgccgactcctcgaagctcggccggcgcgccctgttccaggtcttcccgctgagccggatcaaccgcctggtggtcgaccgcaagcctaccggggaactctgggaggccctgcaacaggcgcgggtggaagtccacgaagcccccctgcgcaccccgcaggcctga

SEQ ID NO: 2177 - protein, 258 aa, Pseudomonas aeruginosa
MRPEERRRHILELLRQRERISVDELARTLSTSQETIRRDLAALAEQGLVSKFHGGAALPPSGEHENAFQTRMNEHAQEKRAVARYAAGLFGPGDSIFIDTGTTTLLFARELARQSHLTVITNSLLIAGSVGASGNRAFMIGGEYRPESEQNVGALAIEQIARFNAEHAVITVGALNGDGAMDFSIEEAEIARAMIAQARQLTVIADSSKLGRRALFQVFPLSRINRLVVDRKPTGELWEALQQARVEVHEAPLRTPQA

SEQ ID NO: 2178 - DNA, 744 bp, Lactococcus lactis subsp. lactis
  CDS (1)..(744)
atgtcccgttctgacgaaatcattcgcattgtgagtgattataaaaaaattgaagtcaatcaactttcacaactccttaatgtttcaaacgtaacgattcgaaaagaccttgataaacttgaagagaaaggaattattaatcgccagcacggttttgctttgattaataatacagatgatatcaattttcgtttagccaaaaactatgatttaaagcgaaaaattgctgtcaaagctgctgaaaatattcttgatggggatacagtaatgattgaatctggttctacttgcgctttgcttgctgaagagttagcctttaatcgaaaaaatgtcactatcatcactaactctgtttttattgccaattatattcgtaaatccgactcggtaaaagtaattttattaggaggagaatatcaaaataattcacaggtcaacgttggacctctgataaaaaaggtggttgatgaattttacgttgataaattatttatcggtattgatggttttgacccggtccgcggttttagaagtaatgatctcgctcgtagtgaagccattcatgtcatggctgctgcggctaaggaagtgattattttaactgatgcttctaaattcaaccaaaatggaactgtcacctgtttttcattccctgaaatttcccaagtttttactgacaagtcaatcaatgcaggaagtcaaaaaattctcgatttgaaaaaaataaaggttactactatctaa

SEQ ID NO: 2179 - protein, 247 aa, Lactococcus lactis subsp. lactis
MSRSDEIIRIVSDYKKIEVNQLSQLLNVSNVTIRKDLDKLEEKGIINRQHGFALINNTDDINFRLAKNYDLKRKIAVKAAENILDGDTVMIESGSTCALLAEELAFNRKNVTIITNSVFIANYIRKSDSVKVILLGGEYQNNSQVNVGPLIKKVVDEFYVDKLFIGIDGFDPVRGFRSNDLARSEAIHVMAAAAKEVIILTDASKFNQNGTVTCFSFPEISQVFTDKSINAGSQKILDLKKIKVTTI

SEQ ID NO: 2180 - DNA, 750 bp, Haemophilus influenzae
  CDS (1)..(750)
atgaattatcgtgatgaattaattttacaatgggtaaatcaacaaggaaaagccagtgtaatagaacttgcacagcattgtgatatttcggtggaaaccattcgtcgcgatttgaacaaattagcgaacaaaggcttattgcaccgaacccacggaggagcagtgagtaataaaaccaaagatttaggttcatttttccaaactcgaaaacatattaatgcaacagctaaacgacatattgcccaaaaagccttggatttgctatatgaaaatgccgttataggtttagatgcaagctcaacaagttggtattttgcttatttaatgcccgatattccttgtacagtagtaaccaattcaatgtttaacattaatgccctagttaataaatccaatgttaaaactattgttactggcggagtttattcagcaaaatatgaagcattttacggtcccttatctgagtacttattacaacgattacatattaatttttcagtgttttcttgttcaggaattgataaaaacggtaatatctgggaatcaaacgagctgaatgcctctttaaaacgaaaaatgatggaagcttcagaacgtgcttatttgttaattgattcttctaaatttgaaaaaacaagtttgattcaacttgccgatttaagcaaaattaataccattttttctgatcggtcacttcccgataacttacaaaaatattgtgagcaacacgatataatgaccgttttataa

SEQ ID NO: 2181 - protein, 249 aa, Haemophilus influenzae
MNYRDELILQWVNQQGKASVIELAQHCDISVETIRRDLNKLANKGLLHRTHGGAVSNKTKDLGSFFQTRKHINATAKRHIAQKALDLLYENAVIGLDASSTSWYFAYLMPDIPCTVVTNSMFNINALVNKSNVKTIVTGGVYSAKYEAFYGPLSEYLLQRLHINFSVFSCSGIDKNGNIWESNELNASLKRKMMEASERAYLLIDSSKFEKTSLIQLADLSKINTIFSDRSLPDNLQKYCEQHDIMTVL

SEQ ID NO: 2182 - DNA, 759 bp, Thermotoga maritima
  CDS (1)..(759)
atgaaagaggaaagattgaaggaaatcctcgatatcgttgacagaaacggtttcatcagcatgaaggatcttcaggaacaactcggcgtttcgatgatcaccgtgagaagagacgtggcagaactggtgaaaaggaatttggtaaaaaaagtacatggtggcataaggaaggtgaattattttgaaaaggaaacagacttcatgaaacggctctcaataaacagagaagcaaaggaaaaaattgcccaacttgcgttgaacttcgttgaagatggagacattatctttctggacgcaagcaccactgcgcatatctttgccaaacacctggcctcgtctcaaaagtccgttcatgtcatcacaaacaacctgctcactgcaatggagctctcgaagaactccgatataagcgttgttctgctcacaggaaaggtgaatccggagaacctggctgtggaaggctctctgacgatagagtgtggaaaaaaattctctgtgaaaaaagcctttgtctcctgtagaggagtgactgcggaagaaggaacctacgaaataaacaccatggaaatgggaataaaaggaattttcgtggaaagagcggaagagatcttcgtactcgctgacttcagcaaaataggaaaaagatcgctggcacatctgatacccgcagaaaaaatcgatcatctcatcaccgacagaaaacctccagaaaatcaatatgaaatattcagggaaaaaggtgtggaaattgtttattga

SEQ ID NO: 2183 - protein, 252 aa, Thermotoga maritima
MKEERLKEILDIVDRNGFISMKDLQEQLGVSMITVRRDVAELVKRNLVKKVHGGIRKVNYFEKETDFMKRLSINREAKEKIAQLALNFVEDGDIIFLDASTTAHIFAKHLASSQKSVHVITNNLLTAMELSKNSDISVVLLTGKVNPENLAVEGSLTIECGKKFSVKKAFVSCRGVTAEEGTYEINTMEMGIKGIFVERAEEIFVLADFSKIGKRSLAHLIPAEKIDHLITDRKPPENQYEIFREKGVEIVY

SEQ ID NO: 2184 - DNA, 780 bp, Bacillus halodurans
  CDS (1)..(780)
atgctatctgtcgaacgtcacgaaaaaattctagaatggttagaaaagaataaagcggtcaaagtgtcagatttaagcagagaactccaagtaagtgaaaagacgattcgcatcgaccttgtccatttagaaaagaaaggtttgctgaaacggatacacgggggagctgtgcctcttgatgacgaggggcgaatttttccgattaacgaacgacaatcgaagcacaacttagcgaagcaggcgattgctggtgaagcaatcaagcgaattcaaccaaatgaaacgattcttatggatggaggaagcacgacccttgcagttgcaaagcaattaggggcgtttccagtcacgatcattacgaatgatgtaaggattgctgcggaattgatctctaaagagaaagtacaattaatggtccttggtggaacacgtatcgggacttcatcttcactctttagcccagagtcttccgagctcttaaagcgtattcgcgtcaatcgcttattttttggagcaaccggtatttcaattgagcacggattgactgtgcttaacagcctgcatgtggaatggaaaaagcaagtacttcgctgcgctgaacgggttactcttctcgttgactcgaccaagttcgaaaaggttggattaattcagtttgccaccatcgaagaggtcgatgaaatcattacggatatgaacctagattcagccattaagaaaagattagagactttaggcagaacgattttttatgcaccgatagagcaaaagaatgattga

SEQ ID NO: 2185 - protein, 259 aa, Bacillus halodurans
MLSVERHEKILEWLEKNKAVKVSDLSRELQVSEKTIRIDLVHLEKKGLLKRIHGGAVPLDDEGRIFPINERQSKHNLAKQAIAGEAIKRIQPNETILMDGGSTTLAVAKQLGAFPVTIITNDVRIAAELISKEKVQLMVLGGTRIGTSSSLFSPESSELLKRIRVNRLFFGATGISIEHGLTVLNSLHVEWKKQVLRCAERVTLLVDSTKFEKVGLIQFATIEEVDEIITDMNLDSAIKKRLETLGRTIFYAPIEQKND

SEQ ID NO: 2186 - DNA, 795 bp, Vibrio vulnificus
  CDS (1)..(795)
atgaggcagaggcatcagggagacaaagtgaaacagattccaagacaccaacaaattatcgagatggtgaaaaaacaaggctacgtgagcaccgacgagctagtcgagaagttcaatgtcagcccacaaacgattcgccgcgatctgaatgagcttgccgatgcaaacaaaattcgccgctaccatggtggtgcgaccatcccactgagttcagagaacacctcttactccacgcgtaaaaaagaacatttcactgaaaaagatttgattgccgaagagttggtgcagcacattcccgatggagccacgctgtttattgatatcggcaccacaccagaagcggtcgccaaagcactgaacaaaaaccacaagcaactgcgcgttgtcaccaacaacatcaacgttgccagtattttgctgagcaatcctgagattaaagtgattctcgccggtggcgaagttcgcaaccgtgatggcggtatcgtcggtgaagcaacactcgatttcatcaagcagttccgtttggacttcggcattctaggcatcagtggcatcgattacgatggctcactgctcgatttcgactaccatgaagtgcgcgtgaaacaagctatcatcgaaaacagtcgcagcgtgtatctggccgtagaccacagtaaatttggccgcaatgcgatggttaagctggggaatatttcgcaaatcaatatgctgatcaccaatgaacagccaccagaagagatcacggctattttgaaagaacagcagatcccttgcgttgtcgcaggcgaataa

SEQ ID NO: 2187 - protein, 264 aa, Vibrio vulnificus
MRQRHQGDKVKQIPRHQQIIEMVKKQGYVSTDELVEKFNVSPQTIRRDLNELADANKIRRYHGGATIPLSSENTSYSTRKKEHFTEKDLIAEELVQHIPDGATLFIDIGTTPEAVAKALNKNHKQLRVVTNNINVASILLSNPEIKVILAGGEVRNRDGGIVGEATLDFIKQFRLDFGILGISGIDYDGSLLDFDYHEVRVKQAIIENSRSVYLAVDHSKFGRNAMVKLGNISQINMLITNEQPPEEITAILKEQQIPCVVAGE

SEQ ID NO: 2188 - DNA, 768 bp, Photorhabdus luminescens
  CDS (1)..(768)
atgcttccatcagagcgtagggactttatttatcgctatgtacacgaatatcggacaatttctatcagtacactggttaaactgatgaatgtctcacatatgacagtacggcgggatatccacactctggaggaagaaggaaaagtcgttagtgtcagtggcggtgtgcaacttagtgatgttttacgtcaggaattgccttggaatgaaaaagcccagcttaatcatcgccataagcgggaaattggtcaatatgcagtctctatggttgaagatggacaagtggtctatcttgatgctggcaccaccacgtttgaaattgccagagtcttggctgagcgttttaacctcactatcatcacgaacgatttttccattacccaatatctgatgaacaaaccccaattaaatctgttccataccggggggcaggtagataagagaaatcattcctgtgttggccctatcgccgccatgctgcttcgcaatctaaatgtggatattgcctttattagcaccagttcatgggatctagagcatggtgtctccacgccacatgaagaaaaagtattagtcaaacaggcagtattggaaatcgcccgccgtcgtgttttggtatctgatagcagtaaatatggcaaatacggcatgtttcgggtctgcccgcttgcaagtttggatgatattgtctgtgacagccagcttccgccgaaagtgcagcaacaattacgagaacacaacctggtattacatactgtcagcgtataa

SEQ ID NO: 2189 - protein, 255 aa, Photorhabdus luminescens
MLPSERRDFIYRYVHEYRTISISTLVKLMNVSHMTVRRDIHTLEEEGKVVSVSGGVQLSDVLRQELPWNEKAQLNHRHKREIGQYAVSMVEDGQVVYLDAGTTTFEIARVLAERFNLTIITNDFSITQYLMNKPQLNLFHTGGQVDKRNHSCVGPIAAMLLRNLNVDIAFISTSSWDLEHGVSTPHEEKVLVKQAVLEIARRRVLVSDSSKYGKYGMFRVCPLASLDDIVCDSQLPPKVQQQLREHNLVLHTVSV

SEQ ID NO: 2190 - DNA, 774 bp, Photorhabdus luminescens
  CDS (1)..(774)
atggctgtggataccgtaaaaagacgtgaacagattatcgacttgctgtgccatgagggcagcgtgcgtgttgaacatttgagcacccgttttggggtttccagcgtcactatccgtaatgacctgcgttatctggaacaaaaaggttgtgcattgcgttcctatggcggtgccatgttgaatcagcaattcgcctttgatcgtcccttgcaagataaaggccggatcaatcgtgatgtgaaatcgcgcattgcggctagggcggcacagtttgttcaggatggtgatgctctgatccttgattccggctcgacgactacgcaaatcgcgccatttcttaaagagcggcgtgatctggtcgtcatgactaacgcgttgaatatcgcctatgaactggcggggtttgaccggatggaggtgatggtgcttggcgggagtgtacgccagaactcctactcgctttatggtccggcggcggaacagcaattgcgtcaatatcgctttgacaccctatttcttggcgtcgatggttttgatctggaagcagggataaccacgccacatcccggtgaagcccaccttaatcgcgtaatgtgtgaggtggcgcatgaaattatcgcggtggcggatgccagtaaatttgggcgcagaagcttttgcctgatccgtcaggccggacagattcatcggctgattactgacagtcggatccctgataactacaggcgggcattaattgaactcggcgtggatgtggttattgccgacgaatag

SEQ ID NO: 2191 - protein, 257 aa, Photorhabdus luminescens
MAVDTVKRREQIIDLLCHEGSVRVEHLSTRFGVSSVTIRNDLRYLEQKGCALRSYGGAMLNQQFAFDRPLQDKGRINRDVKSRIAARAAQFVQDGDALILDSGSTTTQIAPFLKERRDLVVMTNALNIAYELAGFDRMEVMVLGGSVRQNSYSLYGPAAEQQLRQYRFDTLFLGVDGFDLEAGITTPHPGEAHLNRVMCEVAHEIIAVADASKFGRRSFCLIRQAGQIHRLITDSRIPDNYRRALIELGVDVVIADE

SEQ ID NO: 2192 - DNA, 780 bp, Shigella flexneri
  CDS (1)..(780)
atgacgatgaattcattcgagcgaaggaataagatcatccaattagtgaatgaacagggaaccgtgcttgttcaggatctggcgggagtatttgctgcctcggaagcgacaatccgtgccgatttgcgctttctcgaacaaaaaggcgtggttacgcgctttcatggcggtgcggcgaaaataatgtccggtaatagtgaaaccgagacccaggaagtcgggtttaaagagcgatttcagctcgccagcgcgccaaaaaacagaatagcgcaggcggcagtcaaaatgatccatgaagggatgaccgttattctcgacagcggaagtaccacaatgcttatcgccgaaggattaatgaccgctaaaaatatcacggtgattaccaacagtctcccggcagcgtttgccctttccgaaaataaagacattactctggtcgtctgtggtggcacggtccgccataaaacgcgctcgatgcatggttccattgccgagcgttcattgcaggatattaatgccgatttaatgtttgtcggtgctgatggtattgatgcggttaatggtattacgacctttaatgaaggttattcgattagcgaggcgatggtcaccgccgcaaataaagtgattgccgttctcgattcatcgaaatttaatcgtcgcggttttaatcaggtactgccaatcgaaaaaattgacattattgttaccgatgatgctgtgtcagaggtggataaattggcattgcagaagacacgggtaaaattaattacggtgtag

SEQ ID NO: 2193 - protein, 259 aa, Shigella flexneri
MTMNSFERRNKIIQLVNEQGTVLVQDLAGVFAASEATIRADLRFLEQKGVVTRFHGGAAKIMSGNSETETQEVGFKERFQLASAPKNRIAQAAVKMIHEGMTVILDSGSTTMLIAEGLMTAKNITVITNSLPAAFALSENKDITLVVCGGTVRHKTRSMHGSIAERSLQDINADLMFVGADGIDAVNGITTFNEGYSISEAMVTAANKVIAVLDSSKFNRRGFNQVLPIEKIDIIVTDDAVSEVDKLALQKTRVKLITV

SEQ ID NO: 2194 - DNA, 906 bp, Rhodopirellula baltica
  CDS (1)..(906)
atgaccaccgacgaacgtcgagatcgattgcgtgatttggtcaaagaccgcggattcgcggctttgggcgaactggcgtcgcaattgtcggtcagcgaatcgacgatccgtcgtgatttggaaatgctggaagaagccggtttggctcgccgcacccacggcggtgtctattggacgggcgactccgacacgatcagcgtcttcgaatcccgtaacgacgatttttgggctgcgaaacaatcgatcggccgagccgcgtcggaattgatcgccgaccacgacaccattttgctggatggcggtagcacggtttacgaattggctcgcctgatcatccatcggccactccaagtcgtgacgaattcgctgccggtcgcgcatttgctttccaccagcgattcaatcgacttggtcatgatcggcggctgcgttcgcggtcgcacctcggtcacgatcggtcctctggccgattcgcaactggcaaacatccacgtcaccaccgctttcttgtcggtcgccggcgtttcgcctcgcggatttttcaacagcgacatgatgctggtggaaagcgaaaaggcgatgctcgcatcggccgagcgaggcatcgtgctggccgaccacagcaagttcgggaaaaccagtttgagccggatttgcgaattgcatcagatggacacggttgtcacggacgacgggctggattctgacgcgaaagcgtggctggaatccgccggtgtccaactacgcttggcccagtccccgttgactcaatcgcagtcggcccagtcatcgatggcccaggcatcaacgccccagtcaccgcagaaaacatcggcgccggctccgaccgcgtccccatcgaactcctcccccacccactccttgaacaacgcgaatctctcatga

SEQ ID NO: 2195 - protein, 301 aa, Rhodopirellula baltica
MTTDERRDRLRDLVKDRGFAALGELASQLSVSESTIRRDLEMLEEAGLARRTHGGVYWTGDSDTISVFESRNDDFWAAKQSIGRAASELIADHDTILLDGGSTVYELARLIIHRPLQVVTNSLPVAHLLSTSDSIDLVMIGGCVRGRTSVTIGPLADSQLANIHVTTAFLSVAGVSPRGFFNSDMMLVESEKAMLASAERGIVLADHSKFGKTSLSRICELHQMDTVVTDDGLDSDAKAWLESAGVQLRLAQSPLTQSQSAQSSMAQASTPQSPQKTSAPAPTASPSNSSPTHSLNNANLS

SEQ ID NO: 2196 - DNA, 789 bp, Bordetella pertussis
  CDS (1)..(789)
atgaccctcaatcccagacaaagcgccctggtcgaactggttcgcacccagggctcggccaccatcgaagcgctggcgcgccatttcgacgtcaccctgcagaccgtgcggcgcgacgtcaacctgctttccgaagccggcatgctgtcgcgctttcatggcggcgtgcggatcgagtcgtcgaccatcgagaacatcgcctaccgcaagcgccaggggctgcacgccgagggcaagcgccgcatcgccgaggcggtggcccgcgcggtgcccgacggctgttcgctgctgatcaacatcggcacgaccaccgaggccatcgcgcgcgccctgctgcgccatcgcggcctgcgcgtcatcaccaacaacctgcacgtggccgacatcctgtccgacaacccggattgcgaagtcatcgtagccggcggcgtggtgcgttcgcgcgaccgcggcatcgtcggcgaggccacgctggacttcatccgccagttcaaggtcgacatcggcctgatcggcatatccggcatcgaggccgacggcaccttgcgcgactacgactttcgcgaggtgcgcgtggcgcgcgccatcatcgaacaatcgcgcgaggtctggctggccgccgatagcagcaaattccagcgccaggccatggtcgagctggtgcacgtctcgcgcatccaccgcttcttcaccgacacccagccgcaagagccgctggcccaggtgctgcaggacgccggcgtgcgctgcgacgtcgccgcgcagtcggcaggcgccgccgcggcctga

SEQ ID NO: 2197 - protein, 262 aa, Bordetella pertussis
MTLNPRQSALVELVRTQGSATIEALARHFDVTLQTVRRDVNLLSEAGMLSRFHGGVRIESSTIENIAYRKRQGLHAEGKRRIAEAVARAVPDGCSLLINIGTTTEAIARALLRHRGLRVITNNLHVADILSDNPDCEVIVAGGVVRSRDRGIVGEATLDFIRQFKVDIGLIGISGIEADGTLRDYDFREVRVARAIIEQSREVWLAADSSKFQRQAMVELVHVSRIHRFFTDTQPQEPLAQVLQDAGVRCDVAAQSAGAAAA

SEQ ID NO: 2198 - DNA, 783 bp, Bacillus cereus
  CDS (1)..(783)
atgtctgtagtaggagaagaaagaaagcgaaccattcttgaaaaggtagaatttaaagggaaagtaaaggtctcagaattagcgagagaatttgctgtatcaacagaaacgattcgtcgatatttagaagaattagatcgtgaaaagaagctgaaaaaagtgtatggtggagctgttcaacttccaggcgctggagtagaggcaccaatgttagaaagagaaatgctacatatagaagagaagaaaagaattggttataaagcagcgacatttgtagaagatggtgatgtcattgcaattgatgatggaagtacaccgcttcagatggttccataccttgttcatcgtaagaacttaacaattgtaacaagttcatttccagtcgcaacacaattaatttcttctattaataaaaagatgtttcatggtgaagttttatttataggtggaaaagtatctccaaagcattcgcgtgtatcagggtctatttctcagcaagtcatacagcaattccattttcataaagcgtttgtttcgattgatgggttattacctagttttggagtttccagctttgaattagagaaagcgaaattgtcagaggcgatgatgaaattagctgagaaaacatatattttatgtgatcatacgaaggtaggcgtgaaagggaattatcgtatagcagcaatttcgcgtattcaacacgtaatttgtgataaaaaaatgccatatagctttgaagaagaacttatgaagcataatattcagtggacagtttgttaa

SEQ ID NO: 2199 - protein, 260 aa, Bacillus cereus
MSVVGEERKRTILEKVEFKGKVKVSELAREFAVSTETIRRYLEELDREKKLKKVYGGAVQLPGAGVEAPMLEREMLHIEEKKRIGYKAATFVEDGDVIAIDDGSTPLQMVPYLVHRKNLTIVTSSFPVATQLISSINKKMFHGEVLFIGGKVSPKHSRVSGSISQQVIQQFHFHKAFVSIDGLLPSFGVSSFELEKAKLSEAMMKLAEKTYILCDHTKVGVKGNYRIAAISRIQHVICDKKMPYSFEEELMKHNIQWTVC

SEQ ID NO: 2200 - DNA, 783 bp, Bacillus anthracis
  CDS (1)..(783)
atgtctgtagtaggtgaagaaagaaagcgaaccattcttgagaaggtagagtttaaagggaaagtaaaagtttcagaattagcgagagagtttgctgtatcaacggagacgattcgccgttatttagaagaattggatcgtgaaaagaagttgaagaaagtgtatggtggagccgtccaacttccgggagctgggatagaggcaccaatgttagagcgagagatgctgcatatagaagagaagaagagaattgggtataaagcagcaacgtttgtggaagatggagatgtgattgcaattgatgacggaagtacaccacttcaaatggtaccctatcttgttcatcgtaaaaatttaacgattgtaacaagttcatttccagtagcgacacaattaatttcttctattaataaaaagatgtttcacggtgaagttttatttattggtgggaaagtatctccaaagcattcacgcgtatcaggatctatttcgcagcaagtcatccagcaattccattttcataaagcatttgtttcgattgatggattattacctagttttggagtttctagttttgaattggaaaaggcgaaactgtcagaagcgatgatgaaattagcggaaaaaacatatattctatgtgatcatacaaaggtaggcgtaaaagggaattatcgaatagcagcattctcccgtattcagcatgttatttgtgataaaaaaatgccctatagttttgaagaggaagttaaaaagcataatattcaatggacaatttgttaa

SEQ ID NO: 2201 - protein, 260 aa, Bacillus anthracis
MSVVGEERKRTILEKVEFKGKVKVSELAREFAVSTETIRRYLEELDREKKLKKVYGGAVQLPGAGIEAPMLEREMLHIEEKKRIGYKAATFVEDGDVIAIDDGSTPLQMVPYLVHRKNLTIVTSSFPVATQLISSINKKMFHGEVLFIGGKVSPKHSRVSGSISQQVIQQFHFHKAFVSIDGLLPSFGVSSFELEKAKLSEAMMKLAEKTYILCDHTKVGVKGNYRIAAFSRIQHVICDKKMPYSFEEEVKKHNIQWTIC

SEQ ID NO: 2202 - DNA, 753 bp, Bacillus anthracis
  CDS (1)..(753)
atgttaactcctgaacgtcatcaaatgatattgcaacttgtaaaagagcagaaggttgttaaattacagcaattagtggaaagaacagcgagctctgaatcaacaattcgtcgtgatttagcgcaattggaaaaacaacggttattaaaaagagttcacggtggtgcggctgttttaacaggaaaaggacaggagccgacgatggttgaaaaatcatccaaaaacattcagataaaacaacaaattgcgaagtatgcggctagcgttgtggaacaaggtgatttcatttatttagatgcaggaagtacaacatttgaaatgattccatttttaataaataaagatgttactgtcgttacgaatggacttatgcatattgaagctttagttgaaaataatattcgtgcctatttactaggcggaatgatgaagagtaggacgaaagctttaatcggtgctatggcacaggaaagtatgcagaagtatcgttttgataaatgttttttaggagcgaatggtgtacatgaacagcttggttttacaacaccagatccggaagaggcgcttttaaagcaaatggcattaacattagcaaatgaaggatatttcttaattgatgaaagtaagttttcggaagttgcgtttgcgaaaattgccaatgttgaagaggcaaatattattacaaaccatttagaaattgatttagaaaaatataaaagacaaaccaatgtaattgaggctgataaacaatga

SEQ ID NO: 2203 - protein, 250 aa, Bacillus anthracis
MLTPERHQMILQLVKEQKVVKLQQLVERTASSESTIRRDLAQLEKQRLLKRVHGGAAVLTGKGQEPTMVEKSSKNIQIKQQIAKYAASVVEQGDFIYLDAGSTTFEMIPFLINKDVTVVTNGLMHIEALVENNIRAYLLGGMMKSRTKALIGAMAQESMQKYRFDKCFLGANGVHEQLGFTTPDPEEALLKQMALTLANEGYFLIDESKFSEVAFAKIANVEEANIITNHLEIDLEKYKRQTNVIEADKQ

SEQ ID NO: 2204 - DNA, 927 bp, Streptomyces avermitilis
  CDS (1)..(927)
atggtgcgagcgaatggggccgtgtcgctccgtgagctcgcccgcgtcgtccagacctccgaagtgaccgtacggcgggacgtgcgcgcactggaggcagaaggactcctcgaccgccggcacggcggtgcggtattgccgggcgggttcacgcgggagtccggctttccgcagaagtcacatctcgcgaccgccgagaagacggccatcgccgatctcgccgcgagtctcgtcgaagagggcgaggccatcgtggtgggggcggggaccacgacgcaggagctggcccgccggctcgcgcgggtgcccgggctcaccgtcgtcaccaactcgctgctggtggcccaggcgttggcccatgccaaccgggtggaggtcgtgatgaccggcggcactctgcgcggctccaactacgcactggtcggcagcggagccgagcagtccctgcaaggactgcgcgtgtcccgggccttcctctccgggagcggcctcaccgccgagcgcggcctgtccacctccaacatgctgtcggcgtccgtcgaccgcgcgctggtgcaggccgccgccgaggtcgtcgtgctcgccgaccacaccaagctcggcaccgacacgatgttccagaccgtgccgaccgatgtcatcacgcgcctggtcacggacgaaccgcccgcccacgacgaccgcgcggccaccgaactccaggccctcgccgaccagggcgtgcagatcgcggtcgccgggtcggcggcgggcgcgggaggcggcgatacggtcccggcggggcgtcagtcacgccgggacatgccgctccccggtccgcgccgcggccaggtcccgggcgccgggccgcagctgcgcagcaccacggccctgggcgagcagcagccgggagagcgggcgcgggtcgcggacctgcggcgccgctga

SEQ ID NO: 2205 - protein, 308 aa, Streptomyces avermitilis
MVRANGAVSLRELARVVQTSEVTVRRDVRALEAEGLLDRRHGGAVLPGGFTRESGFPQKSHLATAEKTAIADLAASLVEEGEAIVVGAGTTTQELARRLARVPGLTVVTNSLLVAQALAHANRVEVVMTGGTLRGSNYALVGSGAEQSLQGLRVSRAFLSGSGLTAERGLSTSNMLSASVDRALVQAAAEVVVLADHTKLGTDTMFQTVPTDVITRLVTDEPPAHDDRAATELQALADQGVQIAVAGSAAGAGGGDTVPAGRQSRRDMPLPGPRRGQVPGAGPQLRSTTALGEQQPGERARVADLRRR

SEQ ID NO: 2206 - DNA, 825 bp, Shigella flexneri
  CDS (1)..(825)
atgagtaataccgacgcttcaggtgagaagcgagtgacaggcaccagcgagcgacgagaacagatcattcagcgtctgcgacagcaagggagtgtgcaggttaacgatctgtcggcattgtatggcgtatctactgtgacgatccgcaatgatctggcgtttctggaaaagcaggggatcgctgtgcgtgcctatggtggcgcgttgatctgcgatagcacgacgccgtcagtcgagccatcagtggaagataaaagcgcactgaacaccgcgatgaaacgcagcgttgcgaaagctgccgttgagttgattcagccaggtcatcgggtgatcctcgattccgggaccaccacttttgagattgctcgtctgatgcgcaagtacactgacgtaattgcgatgaccaacggtatgaacgtggctaatgcgttgctggaagcggaaggcgttgagctgctgatgaccggcgggcatttgcgccgtcagtcgcaatctttttacggcgatcaggctgagcaatcgctgcaaaattaccacttcgatatgctgtttcttggtgtagatgcgatcgatctggagcgcggcgtcagcacacataatgaagatgaagcccgtttaagccgtcggatgtgcgaagttgcggaacggatcatcgtggtcaccgattccagtaaattcaatcgttccagtttacataagatcattgatactcaacgtatcgacatgatcattgttgatgaaggcattcctgcggatagtctggaaggactgcgaaaggctggggttgaagtgattctggtcggggatcacgcgtcttcgctgtga

SEQ ID NO: 2207 - protein, 274 aa, Shigella flexneri
MSNTDASGEKRVTGTSERREQIIQRLRQQGSVQVNDLSALYGVSTVTIRNDLAFLEKQGIAVRAYGGALICDSTTPSVEPSVEDKSALNTAMKRSVAKAAVELIQPGHRVILDSGTTTFEIARLMRKYTDVIAMTNGMNVANALLEAEGVELLMTGGHLRRQSQSFYGDQAEQSLQNYHFDMLFLGVDAIDLERGVSTHNEDEARLSRRMCEVAERIIVVTDSSKFNRSSLHKIIDTQRIDMIIVDEGIPADSLEGLRKAGVEVILVGDHASSL

SEQ ID NO: 2208 - DNA, 750 bp, Shigella flexneri
  CDS (1)..(750)
atgaattcccgacaacaaactattctacagatggtcattgaccagggtcaggttagcgtaaccgatctggcaaaagccactggagtttctgaagttaccattcgccaggatctcaacaccctcgaaaaactgagttacctccgccgtgcacatggctttgcagtttcgcttgatagtgatgacgtcgaaacccgtatgatgagcaactatacgctgaagcgtgaactcgccgagtttgccgcgtcactggttcaaccgggcgaaaccatctttatcgaaaatggcagcagcaatgccctgctcgcccggactctgggggagcagaagaaaaatgtcactatcatcacggtcagcagctacatcgcgcatttgctgaaagacgcgccttgtgaagtcattttgctcggtggcgtgtaccagaaaaaaagcgaaagtatggttggccctttgacacgccagtgcatccagcaggtacatttcagcaaagcatttattggtattgatggctggcaacctgaaactggattcaccggtcgcgatatgatgcgcaccgatgtggtcaatgccgtgctggaaaaagagtccccagcgatagtcctgactgacagctcgaaatttggtgctgtacattcatactccatcggtcccgttgagcgattcaatcgcgtgattaccgattcgaaaatacgcgccagcgatctgatgcatcttgagcacagtaaactcaccgttcacgtcgttgacatttaa

SEQ ID NO: 2209 - protein, 249 aa, Shigella flexneri
MNSRQQTILQMVIDQGQVSVTDLAKATGVSEVTIRQDLNTLEKLSYLRRAHGFAVSLDSDDVETRMMSNYTLKRELAEFAASLVQPGETIFIENGSSNALLARTLGEQKKNVTIITVSSYIAHLLKDAPCEVILLGGVYQKKSESMVGPLTRQCIQQVHFSKAFIGIDGWQPETGFTGRDMMRTDVVNAVLEKESPAIVLTDSSKFGAVHSYSIGPVERFNRVITDSKIRASDLMHLEHSKLTVHVVDI

SEQ ID NO: 2210 - DNA, 741 bp, Vibrio parahaemolyticus
  CDS (1)..(741)
atgaacccaagacaaaatgaaatcctgcaattagtgaatgaccgtaaacgcgttcaagtcacggagctttctgacatcatcggcgtgtcgggcgtgaccatcaggcaggatttgaattttcttgagcaacagggctacttaaagcgagttcacggcgctgctaccgcactgcaaagtgatgatatagatacccgcttagaagtgcgttttgatattaaacaaacacttgctaacaaagccgcggatttggtcgcaccgaatgagacagtgctgattgaagggggcagtgcaaatgcgctattggctcgtacgttagccgagcgtggcgacgtgactatcattacgccatcggcctacattgcgcatcttatccgcaatacatcggccaacattatcttgttgggtggcgtgtatcagcaccaaggcgaaagcctcgttggcccgctcaccaaactctgtattgaaaacattcatttcagcactgctttcttaggtattgacggatttcaccaagacacaggttttactagccgagacatgatgcgtgccgacattgcagaggccattctggcaaagaaaagacgcaatatcgtcctgacggattccagcaagtttggtcagatttatccttcgtcgattggcaagacaaacgaaatctcagtgttgttaactgacaaagccgctccgaaaagcgacctcgaacagttgaaaaaactcggcgttgaagtggtgttgggttaa

SEQ ID NO: 2211 - protein, 246 aa, Vibrio parahaemolyticus
MNPRQNEILQLVNDRKRVQVTELSDIIGVSGVTIRQDLNFLEQQGYLKRVHGAATALQSDDIDTRLEVRFDIKQTLANKAADLVAPNETVLIEGGSANALLARTLAERGDVTIITPSAYIAHLIRNTSANIILLGGVYQHQGESLVGPLTKLCIENIHFSTAFLGIDGFHQDTGFTSRDMMRADIAEAILAKKRRNIVLTDSSKFGQIYPSSIGKTNEISVLLTDKAAPKSDLEQLKKLGVEVVLG

SEQ ID NO: 2212 - DNA, 792 bp, Vibrio parahaemolyticus
  CDS (1)..(792)
atgaagcaaatacctagacaccagcagattgttgaactggtgaaaaaacaaggctatgtcagcacggatgagttggtagaaagattcaatgtcagcccacaaaccatccgacgcgatctcaacgaactcgcagacgacaacaaaattcgtcgttatcacggtggtgcaaccatccctctcagttctgaaaacacatcttacaacacgcgtaaagcgcttaacttcaatgaaaaagatgtcattgcagaagaggtggtgaaacacattcctgacggcgcgacgctatttattgatatcggcacaacaccagaagccgtcgcacgtgcgctcactaagagccacaagcagctacgcgtcgtcaccaacaacatcaacgtggcaaccattctcttccctaacccagagatcaaggtcatcttagcaggtggtgaagtccgcagccgcgatggcggtatcgtaggcgaagcaacgctcgatttcgtgaaacagttccgtctcgattttggcattctcggcatcagtggcatcgattttgatggttccctattggactttgattaccacgaagtacgcgtgaagcaagcgatcatcgacaacagccgcagcgtatttctcgccgtcgaccacaccaagtttggtcgcaatgccatggtgaaactgggcaacatcgcgcaactgaacatgatatttactaacaaacagccaccagaagaaattctcgcgatcttaaaagacgccgcaattcccctcgaagtggtcgaagcgaatgtaacatcagcagacgccgaatag

SEQ ID NO: 2213 - protein, 263 aa, Vibrio parahaemolyticus
MKQIPRHQQIVELVKKQGYVSTDELVERFNVSPQTIRRDLNELADDNKIRRYHGGATIPLSSENTSYNTRKALNFNEKDVIAEEVVKHIPDGATLFIDIGTTPEAVARALTKSHKQLRVVTNNINVATILFPNPEIKVILAGGEVRSRDGGIVGEATLDFVKQFRLDFGILGISGIDFDGSLLDFDYHEVRVKQAIIDNSRSVFLAVDHTKFGRNAMVKLGNIAQLNMIFTNKQPPEEILAILKDAAIPLEVVEANVTSADAE

SEQ ID NO: 2214 - DNA, 762 bp, Vibrio parahaemolyticus
  CDS (1)..(762)
atgtcgaaacgaaacactcaactgagaagacacgcgatttccaacatggtaaatgagctaggagaagtcagtgttgatgaactggctcaaaagttcgaaacctcagaagtcacgattagaaaggacttagcttctctagaaaaaaatggacaacttttacgccgatacggtggtgcgattgccatccctacggaagttattcatgaagaactaagctctaatgtttcgactcgaaagttaagtttggcgaaagctgcggcatcattgattcgcgaccataatcgaatcgtgatagacagcggtagcacgaccgctgcgctgattcagcaactgaacgacaaacgtggcttggtggtcatgaccaactcgttgcacgtcgccaatgcccttaacgaactagagagtgaacccactctgctaatgacaggcggaacttgggatacgcactctgaatcctttcaaggcaaagtagccgaatctgtattacgagcttacgactttgaccagctgtttattggtgcggatggcatcgatttggagcgcggaaccacaacatttaatgagttggttggcttaagtaaggtgatggcagaagtctctcgtgaagtcatcgttatgatcgagtccgaaaaaatcggtcgtaagatccctaacttagagctcgcttggcatcaaattgatgtgctggtcaccgatgcggatatccaaccagagcacaaagtacagattgaacaacatggcgtgaaagtcatttgcgcctaa

SEQ ID NO: 2215 - protein, 253 aa, Vibrio parahaemolyticus
MSKRNTQLRRHAISNMVNELGEVSVDELAQKFETSEVTIRKDLASLEKNGQLLRRYGGAIAIPTEVIHEELSSNVSTRKLSLAKAAASLIRDHNRIVIDSGSTTAALIQQLNDKRGLVVMTNSLHVANALNELESEPTLLMTGGTWDTHSESFQGKVAESVLRAYDFDQLFIGADGIDLERGTTTFNELVGLSKVMAEVSREVIVMIESEKIGRKIPNLELAWHQIDVLVTDADIQPEHKVQIEQHGVKVICA

SEQ ID NO: 2216 - DNA, 756 bp, Lactobacillus plantarum
  CDS (1)..(756)
atgaatcaacgcaatgaacaattattagaaatcgtcaatcaacgaaaaaaagtcgaagtgaatgagttagcaagcttacttgaggtctcaaaagtgactatccgtaaggaccttactgaattagaaaatcgtggtctattgcaacggcaacatggttttgcaattattaataatccaaacaatctgaactttcgacttgctcaaaattacgacattaaacataaaattgcggaagccgccgcaactctagttcaagataatgagaccatcatgatcgaatcaggatcaacttgtgcacttttagccgaagaactaggaaaaagtgggaaacacgtgacaattattacaatttcatttttcatcgctaattacgtacgtaactacgacaatattacagtctacactttaggcggacaataccaatccgatgcccaagtggcagttggaccactaacaaaaacgatgctagctaactttcacaccgaaaagctttttttaggtattgacggtttcgatcgtaactacggcttttatggtaatgatattatgcgcactgatacggtccatgccatggctgataacgccgacaagacttgtatcttaacagattcaagtaaatttgaattaaccagtactgttcaccaattgccattccagcaagttgatacagtgattaccgacaaccagctttcaaaagaggctcatcgcgtactcaattttcaacaaatcaaagtccagactgttgcgactcattaa

SEQ ID NO: 2217 - protein, 251 aa, Lactobacillus plantarum
MNQRNEQLLEIVNQRKKVEVNELASLLEVSKVTIRKDLTELENRGLLQRQHGFAIINNPNNLNFRLAQNYDIKHKIAEAAATLVQDNETIMIESGSTCALLAEELGKSGKHVTIITISFFIANYVRNYDNITVYTLGGQYQSDAQVAVGPLTKTMLANFHTEKLFLGIDGFDRNYGFYGNDIMRTDTVHAMADNADKTCILTDSSKFELTSTVHQLPFQQVDTVITDNQLSKEAHRVLNFQQIKVQTVATH

SEQ ID NO: 2218 - DNA, 771 bp, Vibrio vulnificus
  CDS (1)..(771)
atgacatccaacgagcgccgcgacgcgattcttaaacatattcagcaacatcaaagtggttcggtgaacgactttgcggtgaagtatcaggtttctgaagtgacgattcgtaatgatctcaatattctagagaaaaaaggctgtgttacgcgctgctatggtggggcgatgatcaacgcccaatttgcctttgataagccgctacaggataaaaagcagatcaatcaagacatcaaaagcttgttaggccaatacgccgcttctttggtggaagatggcgataccttgattttggattccggttcaaccacggagcaaattgcttttcatttgacggaaaaacagcacctaaaagtgatgaccaatgccatcaacattgcctaccacttagccaaccgcgacaacatcgaagtgattgtcacaggtggtttaatgcgcaaaaactcctattccttacatggcgaatcgggtgaggcattgctggggcaatttcgcttcaacaaactgttcttaggggttgatggttttgacaaactggcgggggtgacaacgccgcattctggcgaagccagcattaaccgcagaatggttgaggcagcacaaatggttattgcggttaccgattcaagcaaatttgatcggcaaagtttttgtctcattgcgcgcccagagcaactggatatgctgatcaccgacagtggcatccccgaagattaccaccgagaactcaccgaaatgggggtggatgttcgccttgtagacctgctttaa

SEQ ID NO: 2219 - protein, 256 aa, Vibrio vulnificus
MTSNERRDAILKHIQQHQSGSVNDFAVKYQVSEVTIRNDLNILEKKGCVTRCYGGAMINAQFAFDKPLQDKKQINQDIKSLLGQYAASLVEDGDTLILDSGSTTEQIAFHLTEKQHLKVMTNAINIAYHLANRDNIEVIVTGGLMRKNSYSLHGESGEALLGQFRFNKLFLGVDGFDKLAGVTTPHSGEASINRRMVEAAQMVIAVTDSSKFDRQSFCLIARPEQLDMLITDSGIPEDYHRELTEMGVDVRLVDLL

SEQ ID NO: 2220 - DNA, 789 bp, Vibrio vulnificus
  CDS (1)..(789)
atgaccagtgcagagcgtagacaacgaattatgtctcacatccgacaacacggcagtggcaaagtcgacgattttgctttggcgtttaatgtgtcggcagtcaccatccgtcatgatctcaatctcttggaaaaagagggatgcgttttccgctgttatggtggcgccaatctcaatcccaactttgctttcgaccagccgctgtatcgcaaagatcaaatcaatcgcgatatcaaacagatgattgcttatgccgccgcgcaactgatcggggatggtgaggcgatcattttggactccggctccaccatcgctttgatgcctcagcaccttacccagaaaaaattggtggtgatgaccaatgccctcaacaccgcctaccaactgagtcacaacgacaacgtggaactgcacgtcattggcggcagtctgcgccgtgcttcttgctcgctgacagggcatcacggtgagcagcagatccgcacttacctgttcgacaaattgtttttaggtgtggatggctttgatctgcaagcgggcattaccacgccggacaaccacgaagcgcaagtgaaccgcgcgatgtgcgatgtggcgagacaagtgattgcggtgaccgactcgagcaaatttggccgcaaaagcttttgcatgatccgcgctgccaaccaaatcgatgtgctggtgacggacagccacattcctcatgccacccatgaagcgcttctagcgatgggggttgaagtgattctcgccgaccaaatggcgccaaaccgtaagttgaactag

SEQ ID NO: 2221 - protein, 262 aa, Vibrio vulnificus
MTSAERRQRIMSHIRQHGSGKVDDFALAFNVSAVTIRHDLNLLEKEGCVFRCYGGANLNPNFAFDQPLYRKDQINRDIKQMIAYAAAQLIGDGEAIILDSGSTIALMPQHLTQKKLVVMTNALNTAYQLSHNDNVELHVIGGSLRRASCSLTGHHGEQQIRTYLFDKLFLGVDGFDLQAGITTPDNHEAQVNRAMCDVARQVIAVTDSSKFGRKSFCMIRAANQIDVLVTDSHIPHATHEALLAMGVEVILADQMAPNRKLN

SEQ ID NO: 2222 - DNA, 747 bp, Streptococcus mutans
  CDS (1)..(747)
atgaaacgtttagatgagattattaacttagtttctcaggagaaaaaaatagatgttaataccttatctgaaaaattaggcgtatcgaaagtaactattcgtaaagatttagataaattggaaagcaaaggattgctgcatcgtgagcacggttatgcagtattaaatagtggtgatgacttaaatgtcaggctttcttacaactataatatcaaaaagcgtattgctgcaaaggcagttgaattggtacgtgacaatgaaaccattatgattgaatcaggttcaacctgtgctttgttagcggaagctatttgtcaaagtagacgcaatgtcaaaattattaccaattcttgttttattgcaacttacattcgaaagtatgattcttgtcaagtgattttacttggtggtaattatcaacctaattctgaagtaactgttggccccttgctaaaagaaatgcttaagctgtttcatgttgaaaagttgtttgtaggaacagatggctttgacgatgagctagggtttatgggaaaagacatgatgcgatgtgaagttgttcaatatatggctgaatctgctgatgaattggttgtcttaacagattcaagtaaatttgctaagcgtagtttggtcaatcaatttactttgagtcaagtttcgcaagtcataacagattctgccatttcagaagcaagacgtgagcatttaatagctaatcatattaatctaaaattggtcaattaa

SEQ ID NO: 2223 - protein, 248 aa, Streptococcus mutans
MKRLDEIINLVSQEKKIDVNTLSEKLGVSKVTIRKDLDKLESKGLLHREHGYAVLNSGDDLNVRLSYNYNIKKRIAAKAVELVRDNETIMIESGSTCALLAEAICQSRRNVKIITNSCFIATYIRKYDSCQVILLGGNYQPNSEVTVGPLLKEMLKLFHVEKLFVGTDGFDDELGFMGKDMMRCEVVQYMAESADELVVLTDSSKFAKRSLVNQFTLSQVSQVITDSAISEARREHLIANHINLKLVN

SEQ ID NO: 2224 - DNA, 753 bp, Streptococcus agalactiae
  CDS (1)..(753)
atgaatagattagaaaatattattagtttagtatcccagtaccaaaaaatagatgttaatacactctcggagttgttgcaagtttctaaagtaacgatacgtaaagatttagataaactagaaggcaaagggcttttgcatagagagcacggttatgcagttttaaacagtggggatgaccttaatgttaggttatcttttaaccataaaactaaaaaagaaattgctgccttagctgcaaatatggtgtctgacaatgacactatcttaatagaatcaggctctacttgtgctcttttagcagaaaatatctgtcagacaaagcgaaatgtcactattttgaccaactcttgctttattgctaactatttacgagagtatgattcatgccaaattgtcttacttggtggtgagtatcaatcaagttcacaggttacggtaggtcctctcttgaaaaagatgatttcactttttcatgtctcgttagcttttgttgggactgatggttttgatccaaaactaggatttatgggtagagatttaatgcgttctgaagttgcacaagagatggcgaatgctgccgatgaagtcattattttaacagattctagtaagtttaatcagactgcattggtggaacagcttccgttgtcaactgtatcacaagttattacagataaacatccaaattcggaaattgctaatttgttccaagaagcagagattaccattcaatctttattacaagtacca

SEQ ID NO: 2225 - protein, 251 aa, Streptococcus agalactiae
MNRLENIISLVSQYQKIDVNTLSELLQVSKVTIRKDLDKLEGKGLLHREHGYAVLNSGDDLNVRLSFNHKTKKEIAALAANMVSDNDTILIESGSTCALLAENICQTKRNVTILTNSCFIANYLREYDSCQIVLLGGEYQSSSQVTVGPLLKKMISLFHVSLAFVGTDGFDPKLGFMGRDLMRSEVAQEMANAADEVIILTDSSKFNQTALVEQLPLSTVSQVITDKHPNSEIANLFQEAEITIQSLLQVP

SEQ ID NO: 2226 - DNA, 771 bp, Shewanella oneidensis
  CDS (1)..(771)
atgaataaacgaaatacacagcaacgacgccacagcattatcagcattctgaatgaacagggtgaagtgagtgtcgatgagttgtcattacgtttcgaaacctctgaagtcaccattcgtaaagatctggccgaacttgaaaaaaccggattactgctgcgccgctatggcggtgctgtggctattcctgatgaagtcacgcaacagttttctgccaagattgcgcctaacaagttatccattgctaaagctgccgcgcagctcattaaagatcacaatcgcatcattatcgatagcggtaccaccacctctggcttgattgctgaactaaaccaaaagcgtgggctggtggtgatgaccaatgccctgcatttggctaatgcgattcacgagcttgaaaacgagccaaccttattgatgaccggtggaacttgggacccgcattctgaatcctttcaaggccaagtcgccgagcaagtattacgctcctacaacttcgaccaactgtttatcggtgccgacggtatcgatttagcccgtggcaccaccacctttaatgagctgacaggtttaagtaaggtgatggctgaggtttcccgcgaagttatcgtaatggtggattcggacaaaattggcaagcggatccctaatttagaattgccatggtcgaaaattagcgtgttagtcaccgatgcgcgcatcgaagagagcgcccttaagcaaattaccgagcaaggcgtcaaagtcatcttagcgccctactcgccttag

SEQ ID NO: 2227 - protein, 256 aa, Shewanella oneidensis
MNKRNTQQRRHSIISILNEQGEVSVDELSLRFETSEVTIRKDLAELEKTGLLLRRYGGAVAIPDEVTQQFSAKIAPNKLSIAKAAAQLIKDHNRIIIDSGTTTSGLIAELNQKRGLVVMTNALHLANAIHELENEPTLLMTGGTWDPHSESFQGQVAEQVLRSYNFDQLFIGADGIDLARGTTTFNELTGLSKVMAEVSREVIVMVDSDKIGKRIPNLELPWSKISVLVTDARIEESALKQITEQGVKVILAPYSP

SEQ ID NO: 2228 - DNA, 747 bp, Streptococcus pyogenes
  CDS (1)..(747)
atgaatcgattagaacgtattattcaactggtttcccagaagaaaaaaatagatgttaacagtttatcagagcaattagaagtttcgaaagtaaccattcgaaaagaccttgataagcttgaaagtaagggcttgttgcgacgggaacatggctatgcggtgctaaacagtggcgatgacctcaatgtacgcttgtcctacaattacaacattaagcgacggattgcagaaaaagcagctgaattggtgcaagacaacgataccattatgattgaatctggctcaacctgtgcccttttggcagaagtgctttgccagaccaaacgaaatattaaaatcattaccaattcgtgcttcattgccaactacattcgtcaatatagtagctgtcaaatcattttactgggcggttattaccagcccaattcagaggtgactgttggtcctttattgaaagaaatgatatccctttttcatgtcaatcgtgtctttgttggaacagacggttttaacaaagatcttggctttatgggcaaggacatgatgcgctcagaaggggtgcgttacatggcagatgctgctgaggaagtggtgattttgaccgattccagcaagttttcaaaaaccagtctggtacaccagttgtcattagctgatgtcaatcgcgtcattacagaccaagcactagacaagcaaacacaagagttattaagtgctagtggtcttgttcttgattttgtttcttag

SEQ ID NO: 2229 - protein, 248 aa, Streptococcus pyogenes
MNRLERIIQLVSQKKKIDVNSLSEQLEVSKVTIRKDLDKLESKGLLRREHGYAVLNSGDDLNVRLSYNYNIKRRIAEKAAELVQDNDTIMIESGSTCALLAEVLCQTKRNIKIITNSCFIANYIRQYSSCQIILLGGYYQPNSEVTVGPLLKEMISLFHVNRVFVGTDGFNKDLGFMGKDMMRSEGVRYMADAAEEVVILTDSSKFSKTSLVHQLSLADVNRVITDQALDKQTQELLSASGLVLDFVS

SEQ ID NO: 2230 - DNA, 771 bp, Streptococcus pyogenes
  CDS (1)..(771)
atgttaaaaagagaaagacttctaaaaattaccgaaatagtcaatgagcaaggtattgttactgtgaatgatattattcagactttaaacgtttctgatatgacagttcgtagagacttagatgaactggaaaaagccggcaaattgatccgcatccatggaggtgcacaaagcattaccatgcctaataaaaaagagcggtcaaatattgaaaaacaaaccgttcaaacaaaggaaaaatgggaactagcttcatatgcgacacaactagtcaatgatggtgaaacaatctttattggtccaggaacaactttagaatgtttcgctgagcaattaaaaaatcgtcagattcgcattgtgaccaatagcctccctgtctttaacatccttcaggacagcgaaaccattgacctgattcttatcggcggtgaataccgatctattacaggagcttttgtagggtcccttgccagtcaaaatatctcatccttaaaatttgccaaggcttttattagctgtaatggtatttataaaaacgatattgcaacttatagcgaaactgaaggagagattcaaaagctagcttttaataattctattgaaaaatacctcttggtagataaccaaaaattcaatgcctacgacttcttcattttttaccatttaaacaacattgatgctgttgttacagattcgcaaataactgaggacgttatcgaacgttatagtcagttcacgcaattattagtagcccacgaaaacaagaagtaa

SEQ ID NO: 2231 - protein, 256 aa, Streptococcus pyogenes
MLKRERLLKITEIVNEQGIVTVNDIIQTLNVSDMTVRRDLDELEKAGKLIRIHGGAQSITMPNKKERSNIEKQTVQTKEKWELASYATQLVNDGETIFIGPGTTLECFAEQLKNRQIRIVTNSLPVFNILQDSETIDLILIGGEYRSITGAFVGSLASQNISSLKFAKAFISCNGIYKNDIATYSETEGEIQKLAFNNSIEKYLLVDNQKFNAYDFFIFYHLNNIDAVVTDSQITEDVIERYSQFTQLLVAHENKK

SEQ ID NO: 2232 - DNA, 807 bp, Thermoanaerobacter tengcongensis
  CDS (1)..(807)
atgtttggagaggaaaggcgcttaaagattgcagagattataagtaaggataaaagtatcagtgtttctgagcttagcaaactctttaatgtttctgagtctacaataagaagagatttgcatgtgctggaggaaaagggtttcatacagaggactcacggtggagctattttaaagactggaactcactatgagccagccttttttgaaaaggaagaggtggagcttgaggcaaagagaaagataggtagaattgctgcatctctcattgaagaaggggatactattcttttggattcaggtactactactctggaaattgcgagaaatttaaaaaatatgaggcttactgttgtcaccaattctcctttaattgcaattgagctttcaaagtatgaagatattgaattaatcgtcacaggcggcatacagaggtggaggactaaagctttagttggccctattgcagagatggtaataaggcagtttaaagtggataaggcctttattgggacgaatgccatatcttttgaggatggacttatgactcctgatttgattgaggcaaatactaaaaagacgatgatagaggtagcaagcgaagtatatgtagtggcagaccacactaagtttggcaaaaaatcttttgtaaaatttgcagatctaaaagacattacggcaataataactgatgatgagatagattatgaggttgtgaaaaagtatgaacaggcaaatgtagagatactaaattttgaaagggatgaagatgatgataacaacagtgacagcaaatccagcaattga

SEQ ID NO: 2233 - protein, 268 aa, Thermoanaerobacter tengcongensis
MFGEERRLKIAEIISKDKSISVSELSKLFNVSESTIRRDLHVLEEKGFIQRTHGGAILKTGTHYEPAFFEKEEVELEAKRKIGRIAASLIEEGDTILLDSGTTTLEIARNLKNMRLTVVTNSPLIAIELSKYEDIELIVTGGIQRWRTKALVGPIAEMVIRQFKVDKAFIGTNAISFEDGLMTPDLIEANTKKTMIEVASEVYVVADHTKFGKKSFVKFADLKDITAIITDDEIDYEVVKKYEQANVEILNFERDEDDDNNSDSKSSN

SEQ ID NO: 2234 - DNA, 774 bp, Klebsiella oxytoca
  CDS (1)..(774)
atgaactcatttgagcgaaggaacaaaatcgtcgaaatggttaatgcgcagggtagcgtattggtactggacctttcgaatctctttggcatctccgaagtgactattcgggccgatctccgtttgctggaggaaaaggggttactcacccgctttcatggcggcgccgcaaggcctggcagtaatttgaccgaaggagataatctggaagtggtacttgaagaccgttatcagctggccagcgatccgaaaaagcggatcgctcaggcggcggtagcgatgattagcgaaggcatgacggtgatcctggatagcggcagcactactctgctgattgccgaggcgctggtacgtatgaccaatattacggtaattaccaacagtctgcccgcggcgtttacgctatcagaaaacaaagatatcacgctggtcgtgtgcggtggcaccgtgcgccataaaacgcactcgatgcacggcaccatcgctgaacgctcgcttcagggtatcagtgccgatttgatgttcgtcggcgcggacggtatcgacaccaccaacggcatcacgaccttcaacgaaggctactccatcagcggcgtcatggccgccgcggcgcataaggtggtagcagtgctggatgccagcaaatttaatcgtcgcgggttcaaccaggttctgccgatggagaaaataaactgcgtcattaccgacagcggaataaacgatgagtatcggaaggcattaaaaagtacccggattgagttacacatcgtatag

SEQ ID NO: 2235 - protein, 257 aa, Klebsiella oxytoca
MNSFERRNKIVEMVNAQGSVLVLDLSNLFGISEVTIRADLRLLEEKGLLTRFHGGAARPGSNLTEGDNLEVVLEDRYQLASDPKKRIAQAAVAMISEGMTVILDSGSTTLLIAEALVRMTNITVITNSLPAAFTLSENKDITLVVCGGTVRHKTHSMHGTIAERSLQGISADLMFVGADGIDTTNGITTFNEGYSISGVMAAAAHKVVAVLDASKFNRRGFNQVLPMEKINCVITDSGINDEYRKALKSTRIELHIV

SEQ ID NO: 2236 - DNA, 747 bp, Clostridium perfringens
  CDS (1)..(747)
atgttaagtgaaaaaagacatgagataatattaaacttattaaaactaaagggttttgttagtctaactgaattgcttgaagctactgaaagctctgaatcaactataagaagagatttaagttatttagaatctataaatctattaaaaagagttcacggtggtgctaaatcattggctaatgtctcaaaagaattaagttacaacgagaaatcatccaaaagcattcacgaaaaaagagctatagcaaaatatgcagcttctttaatagaagatggcgattgtatttttgtagatgcaggcactacaacatatgaattaatcgattacttagagggaaaagatatacttgttgtaagtaatggcttatctcatatagatacattaatccaaaaaaatattaagtgctatgtaataggtggaaatattaaaatttctacaaaagcaataactggatgtgatgcattaatgtgtctttcaaaatttagattcgataaatgctttattggagctaatggagttcatcatacctatggacttactactccagatactgaagaagcaatattaaaggaatgcgcaataaataattctagaaaagcttatgtattagctgacgactctaaatttggagagatttcaacaataaaattctctgatattaacaaatgtgtaataataacaaacgaaaaacctaaagataatacatatgataaaaaaactgatataaaggtggttgatatttaa

SEQ ID NO: 2237 - protein, 248 aa, Clostridium perfringens
MLSEKRHEIILNLLKLKGFVSLTELLEATESSESTIRRDLSYLESINLLKRVHGGAKSLANVSKELSYNEKSSKSIHEKRAIAKYAASLIEDGDCIFVDAGTTTYELIDYLEGKDILVVSNGLSHIDTLIQKNIKCYVIGGNIKISTKAITGCDALMCLSKFRFDKCFIGANGVHHTYGLTTPDTEEAILKECAINNSRKAYVLADDSKFGEISTIKFSDINKCVIITNEKPKDNTYDKKTDIKVVDI

SEQ ID NO: 2238 - DNA, 774 bp, Salmonella typhimurium
  CDS (1)..(774)
atgaactcatttgagcgaagaaataaaattgtcgacctgattaatacgcaaggcagcgtgctggtgatggacctttcaaatacctttggtatttctgaagtgactatccgtgctgacctgcgtctgctggaagagaaaggccttgtcacccgttttcatggcggcgcggcaaaaccgggaagtcatctggcggaaggcgacaatcaggaagtcattctggaagatcggtatcaactcgccagcgatccgaaaaagcggattgcccaggcggctgcggcaatggttgaagaaggaatgaccatcattctggatagcgggagcacaacattactgattgcggaagcgctcgcgcgaaaaagcaatattacggtgatcactaacagcttgcctgccgcttttacgctatcagaaaataaagatctcacgctggtggtctgcggcggtacggtacggcataaaacccactcaatgcacggcacgattgcggaacgatcgctacacggcatcagcgccgatttaatgtttgtcggggcggatggcattgatgcgacaaacggtattaccacgtttaacgaaggttattccattagcggcgtcatggcggcggcggcacacaaagttatcgcggtactggacgcgaccaaatttaaccgtcgcggctttaaccaggtattgccgatggacaagatcgactgtgtgataaccgatgacaccatcagcaaacaggataaagcggcattagcgaaaacaggcgtggaattaatgatcgtctaa

SEQ ID NO: 2239 - protein, 257 aa, Salmonella typhimurium
MNSFERRNKIVDLINTQGSVLVMDLSNTFGISEVTIRADLRLLEEKGLVTRFHGGAAKPGSHLAEGDNQEVILEDRYQLASDPKKRIAQAAAAMVEEGMTIILDSGSTTLLIAEALARKSNITVITNSLPAAFTLSENKDLTLVVCGGTVRHKTHSMHGTIAERSLHGISADLMFVGADGIDATNGITTFNEGYSISGVMAAAAHKVIAVLDATKFNRRGFNQVLPMDKIDCVITDDTISKQDKAALAKTGVELMIV

SEQ ID NO: 2240 - DNA, 711 bp, Streptococcus pyogenes
  CDS (1)..(711)
atggcaaagatcactgaagaaaactatgtttctttagaggatttaatgcaattactcaactcctctgagtctactatccgtagagatctaggagagttggagcaagaaggacggctacatcgtgttcatggaggtgctgaactttttcactctttacaagaggaactttcgaaccaagaaaagtctgtcaaaaacagtcatattaaaaaagctattgcgcaaagagcctctcagcttatctatgacaacgatgtgatctttattgatgctgggacaacgactgaatttttattaccttttttacaagctaaaaatttaactgtagttactaattctattcatcatgctgctagattagttgaactctctattgagacgattattgtagggggttatgtcaaacaaacgaccgatgccagtattggtaacgtagctttggaacagattaggcagatgaattttgacaaggcatttcttggaatgaatggtgttgatgattcttacctgacgactcctgatatggaagaagcagttattaaaaaagcggttctgtcaaatgcaaaattagcttacattttagtagatggcactaaaattggtcaggtatcgtttgtaaaagtagctcctattaatgatgtgactattattacattaggaggatcagcaagtattcttaaacaaataaaggaaaaggcaaaggtgattgaatta

SEQ ID NO: 2241 - protein, 237 aa, Streptococcus pyogenes
MAKITEENYVSLEDLMQLLNSSESTIRRDLGELEQEGRLHRVHGGAELFHSLQEELSNQEKSVKNSHIKKAIAQRASQLIYDNDVIFIDAGTTTEFLLPFLQAKNLTVVTNSIHHAARLVELSIETIIVGGYVKQTTDASIGNVALEQIRQMNFDKAFLGMNGVDDSYLTTPDMEEAVIKKAVLSNAKLAYILVDGTKIGQVSFVKVAPINDVTIITLGGSASILKQIKEKAKVIEL

SEQ ID NO: 2242 - DNA, 954 bp, Streptomyces coelicolor
  CDS (1)..(954)
atggtgcgagcgaacggggccgtgtcgctccgtgagctcgcccgcgtcgtccagacctccgaagtgaccgtacggcgggacgtgcgcgcactggaggcagaaggactcctcgaccgccggcacggcggtgcggtactgccgggcgggttcacgcgagagtccggctttccgcagaaatcccatctcgcgaccgcggagaagacggccatcgccgatctcgccgcgggcctcgtcgaagagggcgaagccatcgtggtgggggcgggtaccacgacgcaggagctggcacgccggctcgcgcgggtgcccggtctgaccgtcgtcaccaattccttgctggtggcccaggccctcgcccatgccaaccgggtcgaggtggtgatgaccggaggcacgctcagggggtccaactacgccctggtggggtcgggggccgagcagtccctccaggggctgcgggtctccaaggccttcctgtccgggagcgggctgaccgccgagcgggggctgtccacctccaacatgctgtcggcgtccgtcgaccgggcgctggtccaggccgccgccgaggtcgtcgtcctcgccgaccactccaagctgggtacggacaccatgttccagaccgtgcccaccgatgtcatcacccgtctggtcaccgacgagtcgccgggccacgacgaccgcgccgccaccgagctccaggccctggccgaccagggcgtgcagatcgccgtggccggggcgtcggggggtggtacggcgaacggtaccggggcttcgggggccccggggggtgattccgtggggcgtcagcagcgtcgggacgtgccgcttccggggccgcgccgtcaggttccgggtgccgcgggcgcggggttgcggtctgccaccgccctgggtgagcaggggggcggggcggagcgggcgcgcgtcgccgacatgcgtcgccggtag

SEQ ID NO: 2243 - protein, 317 aa, Streptomyces coelicolor
MVRANGAVSLRELARVVQTSEVTVRRDVRALEAEGLLDRRHGGAVLPGGFTRESGFPQKSHLATAEKTAIADLAAGLVEEGEAIVVGAGTTTQELARRLARVPGLTVVTNSLLVAQALAHANRVEVVMTGGTLRGSNYALVGSGAEQSLQGLRVSKAFLSGSGLTAERGLSTSNMLSASVDRALVQAAAEVVVLADHSKLGTDTMFQTVPTDVITRLVTDESPGHDDRAATELQALADQGVQIAVAGASGGGTANGTGASGAPGGDSVGRQQRRDVPLPGPRRQVPGAAGAGLRSATALGEQGGGAERARVADMRRR

SEQ ID NO: 2244 - DNA, 825 bp, Streptomyces coelicolor
  CDS (1)..(825)
atgagtgagaatccgaacctcctcgcggagcagcggcgcgccctgatcctcgacgaggtgcgccgccggggcggggtccgggtcaacgagctgacccgcaagctcggcgtgtcggacatgacggtccgccgcgacctggacgcgctctcccggcagggtgtgctggagaaggtgcacggcggcgcggtcccggtggccgaggcgagcacgcacgagccgggattcgaggccaagtcgggtctggagccgaccgccaaggaggacatcgcgcgggccgcggcggagctggtcgcgccgggtgccgcgatcgccctgtcgggcggtacgacgacgtacgcgctggcgcaccggctggtggacgtgccggatctgacggtggtcaccaactcggtgcgggtggccgacgtgttccacgtggcgcagcgtacttcgggggcgcggcagggcggggcgacggtggtgctcaccggcggtgtgcgcacgccctccgactcgctggtgggcccggtcgccgaccaggcgatcgcgacgctccacttcgacgcgctgttcctgggtgtgcacggaatatcggccgaggccggcctgtccacgccgaacctcgcggaggccgagacgaaccggcggctcgtgcagtcggcacggcgtgtcgtggtggtagcggaccacaccaagtggggtgtcgtgggcctgagttcgttcgccgcgctggagcaggtggacacgctcgtcaccgactccggcctgtcggcggatgcccgcgcggaggtcgccgaacacctcgggctggtcgtggcgggcgagccggagcccgaggccgactga

SEQ ID NO: 2245 - protein, 274 aa, Streptomyces coelicolor
MSENPNLLAEQRRALILDEVRRRGGVRVNELTRKLGVSDMTVRRDLDALSRQGVLEKVHGGAVPVAEASTHEPGFEAKSGLEPTAKEDIARAAAELVAPGAAIALSGGTTTYALAHRLVDVPDLTVVTNSVRVADVFHVAQRTSGARQGGATVVLTGGVRTPSDSLVGPVADQAIATLHFDALFLGVHGISAEAGLSTPNLAEAETNRRLVQSARRVVVVADHTKWGVVGLSSFAALEQVDTLVTDSGLSADARAEVAEHLGLVVAGEPEPEAD

SEQ ID NO: 2246 - DNA, 804 bp, Corynebacterium diphtheriae
  CDS (1)..(804)
atggctaccgtagaagaagtaaatctgcgccaagcaaccatcgtttcgctcaccaatgaaacaggacgatcaagtgtaacgcagctagctcagcaatttgatgttacgcctgaaaccatcagacgcgacctgaaaagtctcgagcaacaggggctccttcgacgtgttcatgggggagctgtttccggtagtcccaaacttaacgtcgatgtgttcgctgtagacgatgacgatgatctgccaattcatcaatcgcagcgacgcaagcaaagcatcgctttaactgccctatcgcttattcctggccctgaagcatcaatctttatagatgccggttcaactaccgaaacttttgccaacgttttagcccgtacatacttaggacaaaattggctcgtcgttactacttcgccgaacgtcgcaagaacgttgagtagtgccggcgtccctgatgtcatcatggtcggcggttttgtaaaggcacgcacccaggcaattgttggcccccacgccatagaaacgttgcactctatgagggcagatatcgcctttttaggaactaacgggattgacccacacaaaggttttacaacttcagatgagcgtgaagccaaggtgaagcacgagatgatcgcccacgcccaaacatctgtcattctctgtgattccggaaaaatcgggcacagttctgcggtcagttttgcgcagcttgccgatgttgactttgttgttactgatcgcaactctcctcctcagctttcccgccagctcggcgaacccaatttacaagtggtgatcccgtga

SEQ ID NO: 2247 - protein, 267 aa, Corynebacterium diphtheriae
MATVEEVNLRQATIVSLTNETGRSSVTQLAQQFDVTPETIRRDLKSLEQQGLLRRVHGGAVSGSPKLNVDVFAVDDDDDLPIHQSQRRKQSIALTALSLIPGPEASIFIDAGSTTETFANVLARTYLGQNWLVVTTSPNVARTLSSAGVPDVIMVGGFVKARTQAIVGPHAIETLHSMRADIAFLGTNGIDPHKGFTTSDEREAKVKHEMIAHAQTSVILCDSGKIGHSSAVSFAQLADVDFVVTDRNSPPQLSRQLGEPNLQVVIP

SEQ ID NO: 2248 - DNA, 777 bp, Photobacterium profundum
  CDS (1)..(777)
atgaaaagtgctgtcgaaagacgtatggaaatcgttagcctagttaaccgtgatggtaaagctcgtgttgaggatcttgctgcacaatttaatgtctctagtgtcaccattcgcagtgaccttagttttctggaaaaaaatggctatgtggttcgttcacacggtgcggcaattccaaattctggggtaatagcagagctgactgttcatgagaaacgccgtcaaaatgccggtattaagtctcttattggtcaggcggcagcgaaactgattgaaagtggtgacacggttattctggattcgggtactacaacgcgagaaatcgcgtctagtttgaaagcactagatgatgtagtggtaatgaccaacggtctagatgtagcaatggagttggcatcagcacctggaattgaggttttgatgtctggcggtgtacttcgtaaaggtgcactttctttttctggctcgcaagctgaaagcagcttaaaaaactaccgatttgataaggtatttttaggtgtagacggttttgatttgcgagcaggtatcaccacacacagcgaacaagaggcaagcctcaatcgcttgatgtgtgaaatttctgaacaggttattgcagttgtcgattctaccaagtttggtaaacgtagctgtcacatgattcgagagtttggaaatattgatatcttggtaacagattctgatattcctgaagactatttacagggtcttcgtgaaatgaaagttgacgttattattgttgaaaaaggaaattaa

SEQ ID NO: 2249 - protein, 258 aa, Photobacterium profundum
MKSAVERRMEIVSLVNRDGKARVEDLAAQFNVSSVTIRSDLSFLEKNGYVVRSHGAAIPNSGVIAELTVHEKRRQNAGIKSLIGQAAAKLIESGDTVILDSGTTTREIASSLKALDDVVVMTNGLDVAMELASAPGIEVLMSGGVLRKGALSFSGSQAESSLKNYRFDKVFLGVDGFDLRAGITTHSEQEASLNRLMCEISEQVIAVVDSTKFGKRSCHMIREFGNIDILVTDSDIPEDYLQGLREMKVDVIIVEKGN

SEQ ID NO: 2250 - DNA, 795 bp, Photobacterium profundum
  CDS (1)..(795)
atgtgcattactgaatctaatattaaaaagataaccgcaaagcaaagacgtgaggaaatacttgctcacattagaacgcacaacaaaggagacgtgaacaaacttgctcaaaaatataaagtatcaacggtaactattcgtaatgatcttaattatttagaaaagaaaggttgtgtgacacgctgttatggtggagctttactgaatgatctatttacctttgaccaggcactaaatgacaagaaaaaaattaatagcaatataaaagcacgtcttggtgcctacgcggcatcattaattaaccatggtgatactgtgatcctcgattcaggatctacaacagaacaaattgcttaccatctgcaagacaaacgtcaacttacaataatgacaaacggtattaatatcgcttatcagttggctagccagcccgatattgacgttatggtcacgggtggcactatacgtagaaagtcctactcactccacggtagtaatggcgaagaactacttactggttttcgttttaataaactgtttattggtgttgacggattcgatatcaatactggtatcacaacgcctcatcaaggcgaagccgacataaaccgaaaaatggttgaagccgctcaaacaattattgccttaactgactcttctaaatttggccgtcaaagcttttgcttaatcgctcgtccacatcagctcaacatactgatcaccgacagtggtattccaccacattatcacactgagcttatccaaatgggtgttgatgttcgcatcatcgattaa

SEQ ID NO: 2251 - protein, 264 aa, Photobacterium profundum
MCITESNIKKITAKQRREEILAHIRTHNKGDVNKLAQKYKVSTVTIRNDLNYLEKKGCVTRCYGGALLNDLFTFDQALNDKKKINSNIKARLGAYAASLINHGDTVILDSGSTTEQIAYHLQDKRQLTIMTNGINIAYQLASQPDIDVMVTGGTIRRKSYSLHGSNGEELLTGFRFNKLFIGVDGFDINTGITTPHQGEADINRKMVEAAQTIIALTDSSKFGRQSFCLIARPHQLNILITDSGIPPHYHTELIQMGVDVRIID

SEQ ID NO: 2252 - DNA, 25 bp, Primer
atgaattcccgacaacaaactattc

SEQ ID NO: 2253 - DNA, 23 bp, Primer
ttaaatgtcaacgacgtgaatgg

SEQ ID NO: 2254 - DNA, 792 bp, Escherichia coli; identical to SEQ ID NO: 1849
  CDS (1)..(792)

SEQ ID NO: 2255 - protein, 263 aa, Escherichia coli; identical to SEQ ID NO: 1850

SEQ ID NO: 2256 - DNA, 756 bp, Bacillus halodurans; identical to SEQ ID NO: 1851
  CDS (1)..(756)

SEQ ID NO: 2257 - protein, 251 aa, Bacillus halodurans; identical to SEQ ID NO: 1852

SEQ ID NO: 2258 - DNA, 792 bp, Yersinia pestis; identical to SEQ ID NO: 1853
  CDS (1)..(792)

SEQ ID NO: 2259 - protein, 263 aa, Yersinia pestis; identical to SEQ ID NO: 1854

SEQ ID NO: 2260 - DNA, 792 bp, Salmonella enterica subsp. enterica serovar Typhi; identical to SEQ ID NO: 1855
  CDS (1)..(792)

SEQ ID NO: 2261 - protein, 263 aa, Salmonella enterica subsp. enterica serovar Typhi; identical to SEQ ID NO: 1856

SEQ ID NO: 2262 - DNA, 741 bp, Bacillus subtilis; identical to SEQ ID NO: 1857
  CDS (1)..(741)

SEQ ID NO: 2263 - protein, 246 aa, Bacillus subtilis; identical to SEQ ID NO: 1858

SEQ ID NO: 2264 - DNA, 897 bp, Agrobacterium tumefaciens; identical to SEQ ID NO: 1859
  CDS (1)..(897)

SEQ ID NO: 2265 - protein, 298 aa, Agrobacterium tumefaciens; identical to SEQ ID NO: 1860

SEQ ID NO: 2266 - DNA, 741 bp, Thermotoga maritima; identical to SEQ ID NO: 1861
  CDS (1)..(741)

SEQ ID NO: 2267 - protein, 246 aa, Thermotoga maritima; identical to SEQ ID NO: 1862

SEQ ID NO: 2268 - DNA, 822 bp, Sinorhizobium meliloti; identical to SEQ ID NO: 1863
  CDS (1)..(822)

SEQ ID NO: 2269 - protein, 273 aa, Sinorhizobium meliloti; identical to SEQ ID NO: 1864

SEQ ID NO: 2270 - DNA, 783 bp, Escherichia coli; identical to SEQ ID NO: 1865
  CDS (1)..(783)

SEQ ID NO: 2271 - protein, 260 aa, Escherichia coli; identical to SEQ ID NO: 1866

SEQ ID NO: 2272 - DNA, 816 bp, Escherichia coli; identical to SEQ ID NO: 1867
  CDS (1)..(816)

SEQ ID NO: 2273 - protein, 271 aa, Escherichia coli; identical to SEQ ID NO: 1868

SEQ ID NO: 2274 - DNA, 759 bp, Escherichia coli; identical to SEQ ID NO: 1869
  CDS (1)..(759)

SEQ ID NO: 2275 - protein, 252 aa, Escherichia coli; identical to SEQ ID NO: 1870

SEQ ID NO: 2276 - DNA, 804 bp, Deinococcus radiodurans; identical to SEQ ID NO: 1871
  CDS (1)..(804)

SEQ ID NO: 2277 - protein, 267 aa, Deinococcus radiodurans; identical to SEQ ID NO: 1872

SEQ ID NO: 2278 - DNA, 765 bp, Streptomyces coelicolor; identical to SEQ ID NO: 1873
  CDS (1)..(765)

SEQ ID NO: 2279 - protein, 254 aa, Streptomyces coelicolor; identical to SEQ ID NO: 1874

SEQ ID NO: 2280 - DNA, 849 bp, Escherichia coli; identical to SEQ ID NO: 1875
  CDS (1)..(849)

SEQ ID NO: 2281 - protein, 282 aa, Escherichia coli; identical to SEQ ID NO: 1876

SEQ ID NO: 2282 - DNA, 792 bp, Escherichia coli; identical to SEQ ID NO: 1877
  CDS (1)..(789)

SEQ ID NO: 2283 - protein, 262 aa, Escherichia coli; identical to SEQ ID NO: 1878

SEQ ID NO: 2284 - DNA, 771 bp, Rhodococcus opacus (Nocardia opaca); identical to SEQ ID NO: 1879
  CDS (1)..(771)

SEQ ID NO: 2285 - protein, 256 aa, Rhodococcus opacus (Nocardia opaca); identical to SEQ ID NO: 1880

SEQ ID NO: 2286 - DNA, 819 bp, Erwinia chrysanthemi; identical to SEQ ID NO: 1881
  CDS (1)..(819)

SEQ ID NO: 2287 - protein, 272 aa, Erwinia chrysanthemi; identical to SEQ ID NO: 1882

SEQ ID NO: 2288 - DNA, 795 bp, Bordetella pertussis; identical to SEQ ID NO: 1883
  CDS (1)..(795)

SEQ ID NO: 2289 - protein, 264 aa, Bordetella pertussis; identical to SEQ ID NO: 1884

SEQ ID NO: 2290 - DNA, 741 bp, Bordetella pertussis; identical to SEQ ID NO: 1885
  CDS (1)..(741)

SEQ ID NO: 2291 - protein, 246 aa, Bordetella pertussis; identical to SEQ ID NO: 1886

SEQ ID NO: 2292 - DNA, 744 bp, Bordetella bronchiseptica (Alcaligenes bronchisepticus); identical to SEQ ID NO: 1887
  CDS (1)..(744)

SEQ ID NO: 2293 - protein, 247 aa, Bordetella bronchiseptica (Alcaligenes bronchisepticus); identical to SEQ ID NO: 1888

SEQ ID NO: 2294 - DNA, 753 bp, Bacillus cereus (strain ATCC 14579 / DSM 31); identical to SEQ ID NO: 1889
  CDS (1)..(753)

SEQ ID NO: 2295 - protein, 250 aa, Bacillus cereus (strain ATCC 14579 / DSM 31); identical to SEQ ID NO: 1890

SEQ ID NO: 2296 - DNA, 798 bp, Vibrio parahaemolyticus; identical to SEQ ID NO: 1891
  CDS (1)..(798)

SEQ ID NO: 2297 - protein, 265 aa, Vibrio parahaemolyticus; identical to SEQ ID NO: 1892

SEQ ID NO: 2298 - DNA, 876 bp, Pseudomonas putida (strain KT2440); identical to SEQ ID NO: 1893
  CDS (1)..(876)

SEQ ID NO: 2299 - protein, 291 aa, Pseudomonas putida (strain KT2440); identical to SEQ ID NO: 1894

SEQ ID NO: 2300 - DNA, 834 bp, Bradyrhizobium japonicum; identical to SEQ ID NO: 1895
  CDS (1)..(834)

SEQ ID NO: 2301 - protein, 277 aa, Bradyrhizobium japonicum; identical to SEQ ID NO: 1896

SEQ ID NO: 2302 - DNA, 783 bp, Vibrio vulnificus; identical to SEQ ID NO: 1897
  CDS (1)..(783)

SEQ ID NO: 2303 - protein, 260 aa, Vibrio vulnificus; identical to SEQ ID NO: 1898

SEQ ID NO: 2304 - DNA, 774 bp, Oceanobacillus iheyensis; identical to SEQ ID NO: 1899
  CDS (1)..(774)

SEQ ID NO: 2305 - protein, 257 aa, Oceanobacillus iheyensis; identical to SEQ ID NO: 1900

SEQ ID NO: 2306 - DNA, 747 bp, Oceanobacillus iheyensis; identical to SEQ ID NO: 1901
  CDS (1)..(747)

SEQ ID NO: 2307 - protein, 248 aa, Oceanobacillus iheyensis; identical to SEQ ID NO: 1902

SEQ ID NO: 2308 - DNA, 783 bp, Escherichia coli O6; identical to SEQ ID NO: 1903
  CDS (1)..(783)

SEQ ID NO: 2309 - protein, 260 aa, Escherichia coli O6; identical to SEQ ID NO: 1904

SEQ ID NO: 2310 - DNA, 792 bp, Pectobacterium atrosepticum; identical to SEQ ID NO: 1905
  CDS (1)..(792)

SEQ ID NO: 2311 - protein, 263 aa, Pectobacterium atrosepticum; identical to SEQ ID NO: 1906

SEQ ID NO: 2312 - DNA, 756 bp, Salmonella typhimurium; identical to SEQ ID NO: 1907
  CDS (1)..(756)

SEQ ID NO: 2313 - protein, 251 aa, Salmonella typhimurium; identical to SEQ ID NO: 1908

SEQ ID NO: 2314 - DNA, 855 bp, Rhizobium meliloti (Sinorhizobium meliloti); identical to SEQ ID NO: 1909
  CDS (1)..(855)

SEQ ID NO: 2315 - protein, 284 aa, Rhizobium meliloti (Sinorhizobium meliloti); identical to SEQ ID NO: 1910

SEQ ID NO: 2316 - DNA, 810 bp, Rhizobium loti (Mesorhizobium loti); identical to SEQ ID NO: 1911
  CDS (1)..(810)

SEQ ID NO: 2317 - protein, 269 aa, Rhizobium loti (Mesorhizobium loti); identical to SEQ ID NO: 1912

SEQ ID NO: 2318 - DNA, 822 bp, Rhizobium loti (Mesorhizobium loti); identical to SEQ ID NO: 1913
  CDS (1)..(822)

SEQ ID NO: 2319 - protein, 273 aa, Rhizobium loti (Mesorhizobium loti); identical to SEQ ID NO: 1914

SEQ ID NO: 2320 - DNA, 810 bp, Pasteurella multocida; identical to SEQ ID NO: 1915
  CDS (1)..(810)

SEQ ID NO: 2321 - protein, 269 aa, Pasteurella multocida; identical to SEQ ID NO: 1916

SEQ ID NO: 2322 - DNA, 774 bp, Streptomyces coelicolor; identical to SEQ ID NO: 1917
  CDS (1)..(774)

SEQ ID NO: 2323 - protein, 257 aa, Streptomyces coelicolor; identical to SEQ ID NO: 1918

SEQ ID NO: 2324 - DNA, 876 bp, Pseudomonas putida; identical to SEQ ID NO: 1919
  CDS (1)..(876)

SEQ ID NO: 2325 - protein, 291 aa, Pseudomonas putida; identical to SEQ ID NO: 1920

SEQ ID NO: 2326 - DNA, 789 bp, Erwinia carotovora; identical to SEQ ID NO: 1921
  CDS (1)..(789)

SEQ ID NO: 2327 - protein, 262 aa, Erwinia carotovora; identical to SEQ ID NO: 1922

SEQ ID NO: 2328 - DNA, 825 bp, Escherichia coli; identical to SEQ ID NO: 1923
  CDS (1)..(825)

SEQ ID NO: 2329 - protein, 274 aa, Escherichia coli; identical to SEQ ID NO: 1924

SEQ ID NO: 2330 - DNA, 918 bp, Erwinia chrysanthemi; identical to SEQ ID NO: 1925
  CDS (1)..(918)

SEQ ID NO: 2331 - protein, 305 aa, Erwinia chrysanthemi; identical to SEQ ID NO: 1926

SEQ ID NO: 2332 - DNA, 876 bp, Pseudomonas putida; identical to SEQ ID NO: 1927
  CDS (1)..(876)

SEQ ID NO: 2333 - protein, 291 aa, Pseudomonas putida; identical to SEQ ID NO: 1928

SEQ ID NO: 2334 - DNA, 807 bp, Mycobacterium vanbaalenii; identical to SEQ ID NO: 1929
  CDS (1)..(807)

SEQ ID NO: 2335 - protein, 268 aa, Mycobacterium vanbaalenii; identical to SEQ ID NO: 1930

SEQ ID NO: 2336 - DNA, 798 bp, uncultured bacterium 582; identical to SEQ ID NO: 1931
  CDS (1)..(798)

SEQ ID NO: 2337 - protein, 265 aa, uncultured bacterium 582; identical to SEQ ID NO: 1932

SEQ ID NO: 2338 - DNA, 816 bp, Mycobacterium paratuberculosis; identical to SEQ ID NO: 1933
  CDS (1)..(816)

SEQ ID NO: 2339 - protein, 271 aa, Mycobacterium paratuberculosis; identical to SEQ ID NO: 1934

SEQ ID NO: 2340 - DNA, 753 bp, Bacillus cereus (strain ATCC 10987); identical to SEQ ID NO: 1935
  CDS (1)..(753)

SEQ ID NO: 2341 - protein, 250 aa, Bacillus cereus (strain ATCC 10987); identical to SEQ ID NO: 1936

SEQ ID NO: 2342 - DNA, 825 bp, Thermus thermophilus (strain HB27 / ATCC BAA-163 / DSM 7039); identical to SEQ ID NO: 1937
  CDS (1)..(825)

SEQ ID NO: 2343 - protein, 274 aa, Thermus thermophilus (strain HB27 / ATCC BAA-163 / DSM 7039); identical to SEQ ID NO: 1938

SEQ ID NO: 2344 - DNA, 756 bp, Rhodopseudomonas palustris; identical to SEQ ID NO: 1939
  CDS (1)..(756)

SEQ ID NO: 2345 - protein, 251 aa, Rhodopseudomonas palustris; identical to SEQ ID NO: 1940

SEQ ID NO: 2346 - DNA, 24 bp, Primer
atggctaacgcagatctggataaa

SEQ ID NO: 2347 - DNA, 25 bp, Primer
ttagaacggatagtcgtgataaccc

SEQ ID NO: 2348 - DNA, 1224 bp, Escherichia coli; identical to SEQ ID NO: 1403
  CDS (285)..(1166)

SEQ ID NO: 2349 - protein, 293 aa, Escherichia coli; identical to SEQ ID NO: 514

SEQ ID NO: 2350 - DNA, 882 bp, Yersinia pestis; identical to SEQ ID NO: 525
  CDS (1)..(882)

SEQ ID NO: 2351 - protein, 293 aa, Yersinia pestis; identical to SEQ ID NO: 526

SEQ ID NO: 2352 - DNA, 882 bp, Salmonella typhimurium; identical to SEQ ID NO: 1407
  CDS (1)..(882)

SEQ ID NO: 2353 - protein, 293 aa, Salmonella typhimurium; identical to SEQ ID NO: 524

SEQ ID NO: 2354 - DNA, 882 bp, Escherichia coli; identical to SEQ ID NO: 519
  CDS (1)..(882)

SEQ ID NO: 2355 - protein, 293 aa, Escherichia coli; identical to SEQ ID NO: 520

SEQ ID NO: 2356 - DNA, 864 bp, Vibrio cholerae; identical to SEQ ID NO: 531
  CDS (1)..(864)

SEQ ID NO: 2357 - protein, 287 aa, Vibrio cholerae; identical to SEQ ID NO: 532

SEQ ID NO: 2358 - DNA, 879 bp, Buchnera aphidicola str. APS (Acyrthosiphon pisum); identical to SEQ ID NO: 1413
  CDS (1)..(879)

SEQ ID NO: 2359 - protein, 292 aa, Buchnera aphidicola str. APS (Acyrthosiphon pisum); identical to SEQ ID NO: 528

SEQ ID NO: 2360 - DNA, 852 bp, Haemophilus influenzae; identical to SEQ ID NO: 533
  CDS (1)..(852)

SEQ ID NO: 2361 - protein, 283 aa, Haemophilus influenzae; identical to SEQ ID NO: 534

SEQ ID NO: 2362 - DNA, 879 bp, Buchnera aphidicola str. Sg (Schizaphis graminum); identical to SEQ ID NO: 537
  CDS (1)..(879)

SEQ ID NO: 2363 - protein, 292 aa, Buchnera aphidicola str. Sg (Schizaphis graminum); identical to SEQ ID NO: 538

SEQ ID NO: 2364 - DNA, 861 bp, Pasteurella multocida; identical to SEQ ID NO: 535
  CDS (1)..(861)

SEQ ID NO: 2365 - protein, 286 aa, Pasteurella multocida; identical to SEQ ID NO: 536

SEQ ID NO: 2366 - DNA, 882 bp, Escherichia coli; identical to SEQ ID NO: 1421
  CDS (1)..(882): r means g or a

SEQ ID NO: 2367 - protein, 293 aa, Escherichia coli; identical to SEQ ID NO: 1422
  misc_feature (288)..(288): Xaa can be Ala or Thr

SEQ ID NO: 2368 - DNA, 870 bp, Haemophilus ducreyi; identical to SEQ ID NO: 539
  CDS (1)..(870)

SEQ ID NO: 2369 - protein, 289 aa, Haemophilus ducreyi; identical to SEQ ID NO: 540

SEQ ID NO: 2370 - DNA, 777 bp, Vibrio vulnificus; identical to SEQ ID NO: 1425
  CDS (1)..(777)

SEQ ID NO: 2371 - protein, 258 aa, Vibrio vulnificus; identical to SEQ ID NO: 530

SEQ ID NO: 2372 - DNA, 879 bp, Xanthomonas axonopodis (pv. citri); identical to SEQ ID NO: 543
  CDS (1)..(879)

SEQ ID NO: 2373 - protein, 292 aa, Xanthomonas axonopodis (pv. citri); identical to SEQ ID NO: 544

SEQ ID NO: 2374 - DNA, 879 bp, Xanthomonas campestris (pv. campestris); identical to SEQ ID NO: 541
  CDS (1)..(879)

SEQ ID NO: 2375 - protein, 292 aa, Xanthomonas campestris (pv. campestris); identical to SEQ ID NO: 542

SEQ ID NO: 2376 - DNA, 22 bp, Primer
atgatgcgaatcgcgctcttcc

SEQ ID NO: 2377 - DNA, 24 bp, Primer
ttacttcaggtattcacccgtacg

SEQ ID NO: 2378 - DNA, 1476 bp, Escherichia coli K12
  CDS (1)..(1476)
atggcggtaacgcaaacagcccaggcctgtgacctggtcattttcggcgcgaaaggcgaccttgcgcgtcgtaaattgctgccttccctgtatcaactggaaaaagccggtcagctcaacccggacacccggattatcggcgtagggcgtgctgactgggataaagcggcatataccaaagttgtccgcgaggcgctcgaaactttcatgaaagaaaccattgatgaaggtttatgggacaccctgagtgcacgtctggatttttgtaatctcgatgtcaatgacactgctgcattcagccgtctcggcgcgatgctggatcaaaaaaatcgtatcaccattaactactttgccatgccgcccagcacttttggcgcaatttgcaaagggcttggcgaggcaaaactgaatgctaaaccggcacgcgtagtcatggagaaaccgctggggacgtcgctggcgacctcgcaggaaatcaatgatcaggttggcgaatacttcgaggagtgccaggtttaccgtatcgaccactatcttggtaaagaaacggtgctgaacctgttggcgctgcgttttgctaactccctgtttgtgaataactgggacaatcgcaccattgatcatgttgagattaccgtggcagaagaagtggggatcgaagggcgctggggctattttgataaagccggtcagatgcgcgacatgatccagaaccacctgctgcaaattctttgcatgattgcgatgtctccgccgtctgacctgagcgcagacagcatccgcgatgaaaaagtgaaagtactgaagtctctgcgccgcatcgaccgctccaacgtacgcgaaaaaaccgtacgcgggcaatatactgcgggcttcgcccagggcaaaaaagtgccgggatatctggaagaagagggcgcgaacaagagcagcaatacagaaactttcgtggcgatccgcgtcgacattgataactggcgctgggccggtgtgccattctacctgcgtactggtaaacgtctgccgaccaaatgttctgaagtcgtggtctatttcaaaacacctgaactgaatctgtttaaagaatcgtggcaggatctgccgcagaataaactgactatccgtctgcaacctgatgaaggcgtggatatccaggtactgaataaagttcctggccttgaccacaaacataacctgcaaatcaccaagctggatctgagctattcagaaacctttaatcagacgcatctggcggatgcctatgaacgtttgctgctggaaaccatgcgtggtattcaggcactgtttgtacgtcgcgacgaagtggaagaagcctggaaatgggtagactccattactgaggcgtgggcgatggacaatgatgcgccgaaaccgtatcaggccggaacctggggacccgttgcctcggtggcgatgattacccgtgatggtcgttcctggaatgagtttgagtaa

SEQ ID NO: 2379 - protein, 491 aa, Escherichia coli K12
MAVTQTAQACDLVIFGAKGDLARRKLLPSLYQLEKAGQLNPDTRIIGVGRADWDKAAYTKVVREALETFMKETIDEGLWDTLSARLDFCNLDVNDTAAFSRLGAMLDQKNRITINYFAMPPSTFGAICKGLGEAKLNAKPARVVMEKPLGTSLATSQEINDQVGEYFEECQVYRIDHYLGKETVLNLLALRFANSLFVNNWDNRTIDHVEITVAEEVGIEGRWGYFDKAGQMRDMIQNHLLQILCMIAMSPPSDLSADSIRDEKVKVLKSLRRIDRSNVREKTVRGQYTAGFAQGKKVPGYLEEEGANKSSNTETFVAIRVDIDNWRWAGVPFYLRTGKRLPTKCSEVVVYFKTPELNLFKESWQDLPQNKLTIRLQPDEGVDIQVLNKVPGLDHKHNLQITKLDLSYSETFNQTHLADAYERLLLETMRGIQALFVRRDEVEEAWKWVDSITEAWAMDNDAPKPYQAGTWGPVASVAMITRDGRSWNEFE

SEQ ID NO: 2380 - DNA, 1957 bp, Leuconostoc mesenteroides
  CDS (206)..(1666)
tatctaaaagctacttcatttgttgtactcctcatttgcttttttattattgtgtaacgaacaggtgataaggtcaagtgcaaaatttcacgacagatatccaattttagatgataaacgtttaaaaaacgctgaaaacggttactttttccgctattttgcgctataatgaaaagtgaatttaactaaaaataaggggtacatcatggtttcagaaatcaagacgttagtaactttctttggtggcactggtgacttggccaagcgtaagctttacccatcagttttcaatctttataaaaaaggctacttgcaaaagcattttgccattgttggaacggcccgtcaagccctcaatgatgacgaattcaaacaattggttcgtgattcaattaaagatttcactgacgatcaagcacaagctgaggcgttcatcgaacatttctcataccgtgcacacgacgtaacagatgctgcttcatacgctgttttaaaagaggcgattgaagaagctgccgacaaatttgatatcgatggcaaccgcattttctatatgtcagttgcgccacgtttctttggtacaattgccaaatatcttaagtcagaaggcctactagctgacactggttacaaccgtttgatgattgaaaagcctttcggtacatcatatgacacagctgccgaactccaaaatgacttggaaaacgcatttgatgataaccaactattccgtattgaccactaccttggtaaggaaatggttcaaaacattgctgcccttcgctttggtaacccaattttcgatgctgcttggaacaaggattacatcaagaacgttcaagtaacattgtcagaagtcttgggtgtcgaagaacgtgccggctactatgacacagccggtgcattgcttgacatgattcaaaaccacaccatgcaaattgttggttggttagccatggaaaaaccagaatcattcactgacaaagacattcgtgccgctaaaaacgcagcctttaatgctttgaagatctatgatgaagcagaagttaacaaatactttgttcgtgcacaatatggtgccggtgattcagctgacttcaagccataccttgaagaattagacgtacctgctgattctaaaaacaataccttcatcgccggcgaattgcaatttgatttgccacgttgggagggtgtcccattctatgtccgttcaggtaagcgcttagctgctaaacagacacgggttgatatcgtctttaaggctggcacgtttaactttggttcagaacaagaagcacaagaagctgtcttgtcaattatcattgatccaaagggtgctatcgaattgaagttgaacgccaagtcagttgaagatgctttcaacacacgtacaattgacttaggttggactgtatctgacgaagataagaagaacacgccagaaccatacgaacgtatgattcacgacactatgaatggtgatggctctaacttcgctgactggaatggcgtttcaatcgcttggaagttcgttgatgctatttcagccgtttataccgcagataaagcaccacttgaaacttacaagtcgggctcaatgggtcctgaagcatccgataaattattggctgccaatggtgatgcttgggtgtttaaaggttaattaaagccccaaaaaaacgatcgattgtgatcgtttttttattgcccaatttacacagtttcatcaagaatccgttttgtttcacgaaaaacagccgctaagtttttgtactgatccgcatgcagcacaacagtaacaaagtgatgctttttgtacgtaaagaacccaacaaatgacacaccagatttaacagaaacacctaatttaccacccgtgacctgatattttgtctgactaaaatagttattcattagtgaaaaaatttgacgcttgagttgtgccattgaaagt

SEQ ID NO: 2381 - protein, 486 aa, Leuconostoc mesenteroides
MVSEIKTLVTFFGGTGDLAKRKLYPSVFNLYKKGYLQKHFAIVGTARQALNDDEFKQLVRDSIKDFTDDQAQAEAFIEHFSYRAHDVTDAASYAVLKEAIEEAADKFDIDGNRIFYMSVAPRFFGTIAKYLKSEGLLADTGYNRLMIEKPFGTSYDTAAELQNDLENAFDDNQLFRIDHYLGKEMVQNIAALRFGNPIFDAAWNKDYIKNVQVTLSEVLGVEERAGYYDTAGALLDMIQNHTMQIVGWLAMEKPESFTDKDIRAAKNAAFNALKIYDEAEVNKYFVRAQYGAGDSADFKPYLEELDVPADSKNNTFIAGELQFDLPRWEGVPFYVRSGKRLAAKQTRVDIVFKAGTFNFGSEQEAQEAVLSIIIDPKGAIELKLNAKSVEDAFNTRTIDLGWTVSDEDKKNTPEPYERMIHDTMNGDGSNFADWNGVSIAWKFVDAISAVYTADKAPLETYKSGSMGPEASDKLLAANGDAWVFKG

SEQ ID NO: 2382 - DNA, 2110 bp, Drosophila melanogaster
  CDS (370)..(1944)
cattggcagtgcttgcttgggcgtttgtttgctgcggcggttcgcgccgcgcttcagtcagtcagggaacgatcgtgcttatcttcattactactaccgcttccaccgaggcttcgcgactccgtacccgtactcgctttgttttacgtttgcgctactagttagtgaatccgacgacgacgacctgcgcgtgcgattaaagcgccgcaactctttgtaattacacagccagagccgcagaggttgctcaaaatccagcgactggagaaatcgtatatcgagttggaaatccgaatcgaaaggcttgcgtatacatagttgtcacacttttgcttttaaacagaaaaatccattcacattcgggtcaagatggcaacgcaaaaggaagatcacaccgccctggatctcataatcaagtcactcaagtcgcctacaatggtctgcgagggaacccactttgacggcaagattccgcacacgttcgtcatctttggggcgtcgggcgatctggccaagaagaagatctaccccacgctctggtggctctaccgcgatgacctgctgcccaagccgaccaagttctgcggctatgcccgttccatgctgaccgtcgatagcatcaaggagcagtgtctgccgtacatgaaggtccagccgcacgagcagaagaagtacgaggagttctgggccctcaatgagtacgtgtccggcagatatgacggacgcactggcttcgagctgcttaaccagcagctggagattatggagaacaagaacaaggccaaccgcatcttctatctggccctgccgcccagcgtcttcgaggaggtgactgtcaacatcaagcagatctgcatgtcggtctgcggttggaaccgcgtgattatcgagaagcctttcggccgggatgacgcctcctcgcaggcgctgagcgaccatctggccggtctgttccaggaggatcagctgtaccgcatcgatcactacctgggcaaggagatggtgcagaacctgatgaccatacgcttcggcaacaagatcctcagctcgacgtggaaccgcgagaacatcgcctccgtgctgatcacgttcaaggagcccttcggcacgcagggtcgtggcggctacttcgacgagttcggcatcatacgcgacgtgatgcagaaccatctgctgcagatcctctcgctggtggccatggagaagccggtgagctgccacccggacgacattcgtgacgagaaggtcaaggtgctgaagagcatcgaggccctgacgctggatgacatggtgctgggccagtacctgggcaatccgcagggtacaaacgatgatgcgcgcacgggctacgtggaggaccccaccgttagcaacgattcgaacacgcccacctacgccctcggcgtgctcaagatcaacaacgagcgctggcagggagtgcccttcatcctgcgctgcggcaaggcgctgaacgagcgcaaggcggaggtgcgtatccagtaccaggacgtgcccggcgacatcttcgagggcaatacgaagcgcaacgagctggtcatccgcgtccagccgggcgaggccctgtactttaagatgatgaccaagagccccggcatcacgttcgacatcgaggagacggagctggacctcacctacgagcaccgctacaaggactcctacctgccggacgcgtacgagcgtctcatcctcgacgtcttctgcggctcccagatgcacttcgtccgctcggacgagctgcgcgaggcgtggcgcatatttacgcccattctgcaccagatcgagaaggagcacattcggccaatcacctaccagtacggatcgcgcggtcccaaggaggcggaccgcaagtgcgaggagaacaatttcaagtactccggctcctacaagtggcacggcggcaaggcggccacgtccaatcactgagcgtttggagcacaccaatccccgggctgggttcgcaggatactcctctctgtccgcacgtacatgtacatacatacatatatatgtatatatacatatatgcattctttggttatttgtaattcggtctgtacaagatttttttttattaaatatacaaaatagt

SEQ ID NO: 2383 - protein, 524 aa, Drosophila melanogaster
MATQKEDHTALDLIIKSLKSPTMVCEGTHFDGKIPHTFVIFGASGDLAKKKIYPTLWWLYRDDLLPKPTKFCGYARSMLTVDSIKEQCLPYMKVQPHEQKKYEEFWALNEYVSGRYDGRTGFELLNQQLEIMENKNKANRIFYLALPPSVFEEVTVNIKQICMSVCGWNRVIIEKPFGRDDASSQALSDHLAGLFQEDQLYRIDHYLGKEMVQNLMTIRFGNKILSSTWNRENIASVLITFKEPFGTQGRGGYFDEFGIIRDVMQNHLLQILSLVAMEKPVSCHPDDIRDEKVKVLKSIEALTLDDMVLGQYLGNPQGTNDDARTGYVEDPTVSNDSNTPTYALGVLKINNERWQGVPFILRCGKALNERKAEVRIQYQDVPGDIFEGNTKRNELVIRVQPGEALYFKMMTKSPGITFDIEETELDLTYEHRYKDSYLPDAYERLILDVFCGSQMHFVRSDELREAWRIFTPILHQIEKEHIRPITYQYGSRGPKEADRKCEENNFKYSGSYKWHGGKAATSNH

SEQ ID NO: 2384 - DNA, 1593 bp, Fugu rubripes (Japanese pufferfish)
  CDS (1)..(1593)
atgatgattattttatttaactgttttttttgtgcctctttcagagaagatggccaacatcccactgtctcgctcggaggtgtttggggagctgcgaaggagctccacgaagacaaagagttccatcaatcagacgttcatgttttcatcatcatgggcgcatcgggagatctggccaagaagaaaatctacccaactctgtggtggttgttcagagacggccttctacctgagcagacatattttgtgggttttgctcgctctgctctgaccgtggatgctattcgaacatcttgcatgccttacctgaaggtgacagaaacagaatcggaccggctgtcggccttcttcagcaggaactcgtacatcagcgggaattacaccgccgggggctccttctccgagctcaacgcacacatcatgtctctgcctggggcgtccgacgcaaaccgcctcttctacctggcactgcctcccaccatctaccacagcgttactgagaacatcaagcacttctgtatgagcgccaaaggctggaacagggtgattgtagagaaaccgttcggacacgatctgcagagctccgaagagctgtccactcacctctcctcgctcttcactgaagaccagatctaccgaatagatcactacctcggcaaggaaatggtccagaacctaatggtgctcaggttcgggaaccgcatctttgggccaatctggaacagggacaacgtagcctgtgtggttcttacctttaaggagccgttcggcactcaggggagaggcggctattttgatgatttcggaatcatacgtgatgtgatgcagaaccacatgcttcagatgctctgtttggttgccatggagaaaccagcatccactaactcggatgacgtcagagatgaaaaggtgaaggtgttgaagtgcatcgttccagcgtccatgtcagatgtggtgctgggacagtatgtgggggacccagagggggagggagatgctaaactgggttatctcgatgatcccaccgttcccaaagggtcaactcaggccacctttgccacggttgtcctctacgtacacaacgaacgctgggatggggttcctttcatccttcgctgtggaaaagctctgaatgagaggaaggccgaggtgaggctgcagttcacagacgtgccgggggacattttccgtaatcagtgttacaggaacgagctcgtggtgcgcgtgcagcctaacgaggccatctacgccaagatgatgagcaagaaacctggtgtgtacttcaccccagaggaaactgagctggacctcacctacaagagcagatacaaggatgtgaaacttccggacgcctatgaacgtctcatcctggatgtcttctgtgggagtcagatgcactttgtcgcgagtgatgaattaagggaggcgtggcggatcttcacccctcttcttcatcagatagagaaggagaagcctaaacctattccttataaatatggcagtcgtggaccagcagaagcagacgagctcgagaagagagtcgggtttcgctatgaaggcacatacaagtgggtcaacccacacagactgtga

SEQ ID NO: 2385 - protein, 530 aa, Fugu rubripes (Japanese pufferfish)
MMIILFNCFFCASFREDGQHPTVSLGGVWGAAKELHEDKEFHQSDVHVFIIMGASGDLAKKKIYPTLWWLFRDGLLPEQTYFVGFARSALTVDAIRTSCMPYLKVTETESDRLSAFFSRNSYISGNYTAGGSFSELNAHIMSLPGASDANRLFYLALPPTIYHSVTENIKHFCMSAKGWNRVIVEKPFGHDLQSSEELSTHLSSLFTEDQIYRIDHYLGKEMVQNLMVLRFGNRIFGPIWNRDNVACVVLTFKEPFGTQGRGGYFDDFGIIRDVMQNHMLQMLCLVAMEKPASTNSDDVRDEKVKVLKCIVPASMSDVVLGQYVGDPEGEGDAKLGYLDDPTVPKGSTQATFATVVLYVHNERWDGVPFILRCGKALNERKAEVRLQFTDVPGDIFRNQCYRNELVVRVQPNEAIYAKMMSKKPGVYFTPEETELDLTYKSRYKDVKLPDAYERLILDVFCGSQMHFVASDELREAWRIFTPLLHQIEKEKPKPIPYKYGSRGPAEADELEKRVGFRYEGTYKWVNPHRL

SEQ ID NO: 2386 - DNA, 1506 bp, Vibrio cholerae
  CDS (1)..(1506)
atgatggtaatacctgaaaacagcagcatcgtaattttcggtgcttcgggagatttgacgtaccgtaagcttattcctgcgttgtatcacctctatgccagtcagcaactgcctaaatcgtttgcgattttaggtgtgagccgtaccgagtacagtgacgagtcttaccgcgagaagctaaagcgctcactgcaagagctggaaaaaacagaacctgccgctctcgaagccttcatgcagcatgtgcattatcaagcgctgaacacctcagaagtagctgattatcagcacttagcgacccgccttgatacactggctaacgattatcagtttgagcagcgtaatacgctgttttatctcgcaactccaccaagcttgtatggcgtgatcccagcttgccttgcggcacatggcctcaacgatgagagccaaggctggaagcgtctgatcatcgaaaaaccttttggttacgatctgcaatctgcacaagatctggatgtggaaatccaccaccacttcaaagagcatcagatctaccgtatcgaccactaccttggtaaagaaaccgtgcaaaacctgctggtgttccgctttgccaacggcatgtttgagccactgtggaaccgtaactttattgattacgtggaaatcacaggcgcagaattcctaggtgtggaagagcgcggcggttattacgatggttctggcgcggtgcgcgatatgttccaaaaccacctgctgcaagtgctggctatggtgggcatggagccgcctgcggcgatcaacgcggattccattcgtaacgaagtgaacaaggtactgcaaagcctacaaccgctttctgaatctgatctgcgcaacaatctggtgctcggtcaatacaccgaatcggaagtgcgtgggcaatttttacccagctaccgtaatgagccgggcgtggcggcggattcacgcaccgaaacttacgtcgcgctaaaaatgttcatcaataactggcgttggaatggtgtgccattctatgtgcgcagcggtaaacgtttaccaacgcgtgtcaccgaagtggtcattcacttcaaacgtacaccgcatcctgtctttgggcaaaatgcgccagagaacaagctgatcatccgtattcagcctgatgaaggcattctgatgagcttcggcttgaaagagcccggcgcaggtttcaaagccaaagaagtgtcgatgaatttccactacgcctcacttgagcagatcaaaatgctgaccgcttatgagcgtttgctgctggatgcactcaatggtgacgcgacactgtttgcccgtactgatgctgtagaagcttgttggaagtttgtgcagccgatcctcgatttcaaacaagatccgcaatcgctgtatggctacgcctgtggcacttggggcccgaaagagtcggatgacttgctgcgccgtgacggccgtgagtggcgcttcccttgtaaaaacctcactaacacggattactgcgaattatga

SEQ ID NO: 2387 - protein, 501 aa, Vibrio cholerae
MMVIPENSSIVIFGASGDLTYRKLIPALYHLYASQQLPKSFAILGVSRTEYSDESYREKLKRSLQELEKTEPAALEAFMQHVHYQALNTSEVADYQHLATRLDTLANDYQFEQRNTLFYLATPPSLYGVIPACLAAHGLNDESQGWKRLIIEKPFGYDLQSAQDLDVEIHHHFKEHQIYRIDHYLGKETVQNLLVFRFANGMFEPLWNRNFIDYVEITGAEFLGVEERGGYYDGSGAVRDMFQNHLLQVLAMVGMEPPAAINADSIRNEVNKVLQSLQPLSESDLRNNLVLGQYTESEVRGQFLPSYRNEPGVAADSRTETYVALKMFINNWRWNGVPFYVRSGKRLPTRVTEVVIHFKRTPHPVFGQNAPENKLIIRIQPDEGILMSFGLKEPGAGFKAKEVSMNFHYASLEQIKMLTAYERLLLDALNGDATLFARTDAVEACWKFVQPILDFKQDPQSLYGYACGTWGPKESDDLLRRDGREWRFPCKNLTNTDYCEL

SEQ ID NO: 2388 - DNA, 1476 bp, Pseudomonas aeruginosa
  CDS (7)..(1476)
caacaaatgcctgatgtccgcgttctgccttgcacgttagcgctgttcggtgcgctgggcgatctcgccttgcgcaagctgttcccggcgctctaccaactcgatcgtgagaacctgctgcaccgcgatacccgcgtcctggccctggcccgtgacgaaggcgctcccgccgaacacctggcgacgctggagcagcgcctgcgcctggcagtgccggcgaaggagtgggacgacgtggtctggcagcgtttccgcgaacgcctcgactacctgagcatggacttcctcgacccgcaggcctatgtcggcttgcgcgaggcggtggatgacgaactgccgctggtcgcctacttcgccacgccggcctcggtgttcggcggcatctgcgagaacctcgccgccgccggtctcgccgagcgcacccgggtggtgctggagaagcccatcggtcatgacctggagtcgtcccgcgaggtcaacgaggcagtcgcccggttcttcccggaaagccgcatctaccggatcgaccattacctgggcaaggagacggtgcagaacctgatcgccctgcgcttcgccaacagcctcttcgagacccagtggaaccagaaccacatctcccacgtggagatcaccgtggccgagaaggtcggcatcgaaggccgctggggctacttcgaccaggccgggcaactgcgcgacatggtgcagaaccacctgctgcaactgctctgcctgatcgccatggatccgcccagcgacctttcggcggacagcattcgcgacgagaaggtcaaggtcctccgcgccctcgagccgattcccgcagaacaactggcttcgcgcgtggtgcgtgggcagtacaccgccggtttcagcgacggcaaggcagtgccgggctacctggaggaggaacatgcgaatcgcgacagcgacgcggaaaccttcgtcgccctgcgcgtggacatccgcaactggcgctggtcgggcgtgccgttctacctgcgcaccggcaagcgcatgccgcagaagctgtcgcagatcgtcatccacttcaaggagccgccgcactacatcttcgctcccgagcagcgttcgctgatcagcaaccggctgatcatccgcctgcagccggacgaaggtatctccctgcaagtgatgaccaaggaccagggcctgggcaagggcatgcaattgcgtaccggcccgctgcaactgagtttttccgagacctaccacgcggcgcggattcccgatgcctacgagcgtctgctgctggaggtcacccagggcaaccagtacctgttcgtgcgcaaggacgaggtggagttcgcctggaagtggtgcgaccagctgatcgctggctgggaacgcctgagcgaagcgcccaagccgtatccggctgggagttgggggccggtggcctcggtggccctggtggcccgcgatgggaggagttggtatggcgatttctga

SEQ ID NO: 2389 - protein, 489 aa, Pseudomonas aeruginosa
MPDVRVLPCTLALFGALGDLALRKLFPALYQLDRENLLHRDTRVLALARDEGAPAEHLATLEQRLRLAVPAKEWDDVVWQRFRERLDYLSMDFLDPQAYVGLREAVDDELPLVAYFATPASVFGGICENLAAAGLAERTRVVLEKPIGHDLESSREVNEAVARFFPESRIYRIDHYLGKETVQNLIALRFANSLFETQWNQNHISHVEITVAEKVGIEGRWGYFDQAGQLRDMVQNHLLQLLCLIAMDPPSDLSADSIRDEKVKVLRALEPIPAEQLASRVVRGQYTAGFSDGKAVPGYLEEEHANRDSDAETFVALRVDIRNWRWSGVPFYLRTGKRMPQKLSQIVIHFKEPPHYIFAPEQRSLISNRLIIRLQPDEGISLQVMTKDQGLGKGMQLRTGPLQLSFSETYHAARIPDAYERLLLEVTQGNQYLFVRKDEVEFAWKWCDQLIAGWERLSEAPKPYPAGSWGPVASVALVARDGRSWYGDF

SEQ ID NO: 2390 - DNA, 1485 bp, Staphylococcus aureus
  CDS (1)..(1485)
atgagtactaaaaacaaacacatcccatgtttaatcacaatctttggtgcaactggtgacttaagccatcgtaagttgtttccatcaatattccatctctaccaacaagacaatttagatgaacatattgccatcatcggtattggacgtcgtgacattactaatgatgatttccgtaatcaagtaaaatcatcaattcaaaagcacgtaaaagatacaaacaaaattgacgcgtttatggaacatgtcttctatcatagacatgatgttagtaatgaagaaagctatcaagaattactagattttagtaatgaattagatagccaatttgaattaaaaggtaatcgactattctatttagcaatggcaccacaattctttggcgttatttctgattatctaaaatcttctggtcttactgatacaaaaggatttaaacgccttgttatcgaaaaaccattcggtagtgatttaaaatcagccgaagcattaaacaatcaaattcgtaaatcatttaaagaagaagaaatttatcgtattgaccactatttaggaaaagacatggttcaaaatatcgaggtattacgttttgcgaatgcgatgtttgaaccattatggaataacaaatatatttcaaacatccaagttacatcttctgaaatactaggtgttgaagatcgtggtggttattatgaatcaagtggcgcgctaaaagatatggtgcaaaaccacatgttacaaatggttgcattattagctatggaagcacctattagtttaaatagtgaagatatccgtgctgagaaagtaaaagtacttaaatcactgcgtcatttccaatctgaagatgttaaaaagaactttgttcgtggtcaatatggcgaaggctatatcgatggtaaacaagttaaagcataccgtgatgaagatcgcgttgcagatgactctaacacacctacctttgtttcaggtaaattaacaattgataactttagatgggctggtgtaccattctatattcgtactggtaaacgtatgaaatctaaaacaattcaagttgtcgttgaatttaaagaagtaccaatgaacttatactatgaaactgataaactgttagattcaaacctattagtaatcaatatccaacctaatgaaggtgtatctttacatctaaatgctaagaaaaatacacaaggtatcgaaacagaacctgtccaattgtcttactcaatgagcgctcaagataaaatgaatactgtagatgcatatgaaaatctattatttgattgtcttaaaggtgatgccactaacttcacgcactgggaagaattaaaatcaacatggaaatttgttgatgcaattcaagatgaatggaatatggttgatccagaattccctaactatgaatcaggtactaatggtccattagaaagtgatttactacttgctcgtgatggtaaccattggtgggacgatattcaatga

SEQ ID NO: 2391 - protein, 494 aa, Staphylococcus aureus
MSTKNKHIPCLITIFGATGDLSHRKLFPSIFHLYQQDNLDEHIAIIGIGRRDITNDDFRNQVKSSIQKHVKDTNKIDAFMEHVFYHRHDVSNEESYQELLDFSNELDSQFELKGNRLFYLAMAPQFFGVISDYLKSSGLTDTKGFKRLVIEKPFGSDLKSAEALNNQIRKSFKEEEIYRIDHYLGKDMVQNIEVLRFANAMFEPLWNNKYISNIQVTSSEILGVEDRGGYYESSGALKDMVQNHMLQMVALLAMEAPISLNSEDIRAEKVKVLKSLRHFQSEDVKKNFVRGQYGEGYIDGKQVKAYRDEDRVADDSNTPTFVSGKLTIDNFRWAGVPFYIRTGKRMKSKTIQVVVEFKEVPMNLYYETDKLLDSNLLVINIQPNEGVSLHLNAKKNTQGIETEPVQLSYSMSAQDKMNTVDAYENLLFDCLKGDATNFTHWEELKSTWKFVDAIQDEWNMVDPEFPNYESGTNGPLESDLLLARDGNHWWDDIQ

SEQ ID NO: 2392 - DNA, 1488 bp, Streptococcus pneumoniae
  CDS (1)..(1488)
atgtcatctaaggttattgttacaattttcggtgcgagtggagacctggctaaacgcaagctctacccttccctttttagactatataaatccggcaatctttccaagcactttgccgttattggaactgcccgtagaccttggagtaaggaatattttgaatctgtagttgtcgagtccatccttgatttggcagatagtaccgagcaagcccaagaatttgctagccacttctactatcaaagccatgatgtcaatgattcggaacattatattgctttgcgtcaattacaagctgagcttaatgaaaaataccaagctgaacacaataagctcttcttcttgtctatggcacctcagttctttggaaccattgccaaacacctcaaatctgaaaacattgtcgatggcaaaggttttgagcgcttgatcgttgaaaaaccatttggtacagattacgcaactgcaaacaagttgaatgacgaactcctagcaacatttgacgaagaacaaattttccgtatcgaccattatcttggtaaggaaatgatccaaagcatctttgcagttcgctttgcaaacttgatttttgaaaacgtttggaacaaggattttatcgacaatgttcaaattacctttgcggagcgcttgggtgtagaagaacgtggtggctactatgaccaatccggtgccctccgtgacatggtccaaaaccacactctacaacttctttcgctcctcgccatggacaaaccagcaagcttcacaaaagacgagattcgtgctgaaaagattaaggtctttaaaaacctctatcatccaactgatgaagaactcaaagaacactttatccgtgggcaataccgctctggtaagattgatggcatgaaatacatctcttatcgtagcgagccaaatgtgaatccagaatcaacaactgaaacctttacatctggtgccttctttgtagacagcgatcgattccgtggtgttcctttctttttccgtacaggtaaacgactgactgaaaaaggaactcatgtcaacatcgtctttaaacaaatggattctatctttggagaaccacttgctccaaatattttgaccatctatattcaaccaacagaaggcttctctcttagcctaaatgggaagcaagtaggagaagaatttaacttggctcctaactcacttgattaccgtacagatgcgactgcaactggtgcttctccagaaccatacgaaaaattgatttatgatgtcctaaataacaactcaactaactttagccactgggatgaagtttgtgcgtcatggaagttgattgaccgtattgaaaagctctgggctgaaaatggtgccccacttcatgactataaagctggaagcatgggacctcaagccagctttgacctacttgaaaaattcggtgccaaatggacttggcaaccagatatcacctatcgtcaagatggtcgcttagaataa

SEQ ID NO: 2393 - protein, 495 aa, Streptococcus pneumoniae
MSSKVIVTIFGASGDLAKRKLYPSLFRLYKSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATANKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVCASWKLIDRIEKLWAENGAPLHDYKAGSMGPQASFDLLEKFGAKWTWQPDITYRQDGRLE

SEQ ID NO: 2394 - DNA, 1476 bp, Salmonella enterica subsp. enterica serovar Typhi
  CDS (1)..(1476)
atggcggtaacgcaaacagcccaggcatgtgacctggtcattttcggcgcgaaaggcgacctggcgcgccggaaactgctgccttccctgtatcagcttgagaaagccggccagatccatccggatacccggatcattggggtggggcgcgcggactgggataaagaagcttatacccacgttgtgcgtgaggcgctggaaaccttcatgaaggaaaaaattgatgaaggcttgtgggatacgctgagcggccgtctggatttttgtaatcttgacgttaacgatacgcctgcgttcagtcgcctgggcgatatgctggatcaaaaaaaccgcaccaccattaactattttgcgatgccgcccagcacgtttggcgctatttgcaaagggttaggggaggctaaactcaacgccaaaccggcgcgtgtcgtgatggagaaaccgttgggtacttcgctggcgacctcgcgtgagattaacgatcgggtcggcgaatactttgaagagtgccaagtatatcgtatcgaccactatctgggcaaagaaacggttctcaacctgctggcgctgcgttttgccaactcgttattcgttaataactgggataaccgcactatcgatcacgttgagattaccgtagcggaagaggtggggattgaagggcgctggggatattttgaccaggccggtcagatgcgcgatatgatccagaaccacttgctgcaaattctctgcatgattgccatgtcaccgccgtctgacctgagcgccgacagtattcgcgatgaaaaagtaaaagtgttgaaatcgttgcgccgtattgatcgctccaacgtgcgtgaaaaaacggttcgtggtcaatacaccgcgggctttgcgcagggtcaaaaggtgccgggctatctggaagaagagggcgcgaataaaagcagcaacaccgaaactttcgtcgcgatccgcgtcgacatcgataactggcgttgggcgggcgtgccattctatctgcgcaccggcaagcgtctgccaactaagtgctctgaagtcgtggtttatttcaagacgcctgaactgaatctctttaaagagtcctggcaagacctgccgcagaacaaattgacgattcgcctgcagccggatgaaggcgtagatattcaggtacttaacaaagtaccgaggctggatcataagcataatctgcaaatcacgaagcttgatctgagctactccgagacctttaatcagacgcacctggcggatgcatatgagcgcctgctgctggaaacgatgcgtggcattcaggcgctgtttgtccgccgtgacgaagtggaagaagcctggaagtgggtggactccattaccgaagcatgggcgatggacaacgacgcgccgaagccgtatcaggcgggcacctggggaccggtagcgtccgtggcgatgattacccgtgacggtcgttcgtggaatgagtttgagtaa

SEQ ID NO: 2395 - protein, 491 aa, Salmonella enterica subsp. enterica serovar Typhi
MAVTQTAQACDLVIFGAKGDLARRKLLPSLYQLEKAGQIHPDTRIIGVGRADWDKEAYTHVVREALETFMKEKIDEGLWDTLSGRLDFCNLDVNDTPAFSRLGDMLDQKNRTTINYFAMPPSTFGAICKGLGEAKLNAKPARVVMEKPLGTSLATSREINDRVGEYFEECQVYRIDHYLGKETVLNLLALRFANSLFVNNWDNRTIDHVEITVAEEVGIEGRWGYFDQAGQMRDMIQNHLLQILCMIAMSPPSDLSADSIRDEKVKVLKSLRRIDRSNVREKTVRGQYTAGFAQGQKVPGYLEEEGANKSSNTETFVAIRVDIDNWRWAGVPFYLRTGKRLPTKCSEVVVYFKTPELNLFKESWQDLPQNKLTIRLQPDEGVDIQVLNKVPRLDHKHNLQITKLDLSYSETFNQTHLADAYERLLLETMRGIQALFVRRDEVEEAWKWVDSITEAWAMDNDAPKPYQAGTWGPVASVAMITRDGRSWNEFE

SEQ ID NO: 2396 - DNA, 1476 bp, Listeria monocytogenes
  CDS (1)..(1476)
atgacagatgagttagaacaaaaagcactgattactatttttggcggtacgggagatttggcaaatcgcaaactttacccttcgctatatcatttgtacagtaagggatctcttggcgacaattttgctgttattggaacggctcgtcgtgaatggagtaacgatttcttccgtgataaagtaaaagagtctatcaaagacattgacggttctgaaaaagacgcagatgcatttgcttctcacttctactatcaatctcatgatgtgacaaataaagaatcttatctaactttaaaagatttgtctgatgaattagatgcaaaatacgaattagatggcaatcgccttttctatcttgcaatggcgccaaatttctttggaactatcgcaagtcgcattaaatctgaaggctttgttgatacagacggtttccatcgtttaattatcgaaaaaccattcggccatgatttagctagtgcggaagaattaaacaattcacttcgtcaagctttcaaggaagatgaaatttatcgtattgaccattatttaggaaaagaaatgatccaaaatatttcggttattcgttttgcaaattctattattgaatcgctttggaataatcgttacatcgataatattcaagttactttaacagaggtacttggagtcgaagatcgtggacgctattacgatgaaagtggcgcacttcgagacatggttcaaaatcatatcttacaaatcgtttctttacttgcaatggagccaccgattaacttatctactcgcgagattcgtcatgaaaaagttcgcgcgcttcgttctttacgcgtttttgaaggaaaagaagtgcatcaaagctttatccgtggtcaatatggtcccggtgaagtggatggtaaagagttaaaaggttatcgtcaagaagataatgtggatccccattccaatacggaaacatttgttgcagccaaacttgaaatcgataatttccgctgggctggcgtaccattttacattcgcactggtaaacgtcttgcgaagaaaacaacgcaaattgcgattcagtttaaagatgtcccactaaacttattcgggcaacaacaatcacttggtggtaatgtgcttgttattcatatccaaccggacgaaggtattacacttcatttgaacgtaaaagaacctggtcaaggtatggttacgatgccagtcaacttgaattatattcattcctctccagacggcatgaacacacctgaggcttacgaaaaattgattctagactgtcttcgcggtgacgcgacttacttctctcactgggatgaagtatcgctatcatggaactttatcgaccatatagcagatgtttggacaaatacgaaagatcatttcccgaactacaaatccggttcaatggggccaaaagaagcagacgacctcattcaacgtgacggattccagtggttcccgatcgattaa

SEQ ID NO: 2397 - protein, 491 aa, Listeria monocytogenes
MTDELEQKALITIFGGTGDLANRKLYPSLYHLYSKGSLGDNFAVIGTARREWSNDFFRDKVKESIKDIDGSEKDADAFASHFYYQSHDVTNKESYLTLKDLSDELDAKYELDGNRLFYLAMAPNFFGTIASRIKSEGFVDTDGFHRLIIEKPFGHDLASAEELNNSLRQAFKEDEIYRIDHYLGKEMIQNISVIRFANSIIESLWNNRYIDNIQVTLTEVLGVEDRGRYYDESGALRDMVQNHILQIVSLLAMEPPINLSTREIRHEKVRALRSLRVFEGKEVHQSFIRGQYGPGEVDGKELKGYRQEDNVDPHSNTETFVAAKLEIDNFRWAGVPFYIRTGKRLAKKTTQIAIQFKDVPLNLFGQQQSLGGNVLVIHIQPDEGITLHLNVKEPGQGMVTMPVNLNYIHSSPDGMNTPEAYEKLILDCLRGDATYFSHWDEVSLSWNFIDHIADVWTNTKDHFPNYKSGSMGPKEADDLIQRDGFQWFPID

SEQ ID NO: 2398 - DNA, 1530 bp, Nostoc sp. PCC 7120
  CDS (1)..(1530)
atggttagtctcctagaaaatcccttgcgcgttggtctgcaacaacaagggatgcccgaaccccaaattatagtcatctttggcgcttctggtgatcttacctggcgcaaactcgtcccagcactttacaaattgcggcgggaacgacgcattcccccagaaactaccattgttggtgtagcccgtcgggaatggagccacgaatacttccgcgaacaaatgcaaaagggcatggaagaggctcatagcagtgtcgaacttggagaactgtggcaagatttctctcaaggtctgttctactgccctggagacatagataacccggaaagttatcaaaaactgaagaatttgttaagcgaattagacgagaaacgaggtacacggggcaaccggatgttttacctctccgtcgcccctaacttcttccctgaagctatcaagcaactagggggagcaggaatgttagacgacccatacaaacatcgtctagtaattgaaaaaccatttggtagagatttggcatcagcccaaagcctgaacgcagtagtgcagaagtattgtaaagaacaccaagtctaccgcatcgaccactacttgggtaaagaaacagttcaaaacttactggtattccgcttcgccaatgccatttttgaacccctgtggaatcgtcagtttgttgaccacgtacaaattaccgtggcagaaaccgtaggcgtggaagaccgggctggttattacgaaaaagccggcgcactgcgggatatgttgcagaaccacctgatgcagctttattgcctgacagcaatggaagcaccaaactcaatggatgccgatagcatccgtacagaaaaagtcaaagtgttacaagctactcgcctggctgacgtacacaacctatcacgttcagcaatacgcggacaatacagcgctggttggatgaaaggtcaacaagttcctgggtatcggacagaaccaggagttgacccaaattcctccacccctacttatgtaggtatgaagtttttagttgacaactggcgttggcaaggtgttcctttctacctgcgtactggcaaacggatgccgaagaaagtcagtgagatttctatccacttccgcgatgtgccttctcggatgttccaatctgccgcgcaacaaagaaacgccaacattttagctatgcggattcagccaaatgaaggaatttccttgcgttttgatgtgaaaatgccaggagccgaattccgtacccgttccgtagatatggatttcagctatggttcctttgggattgaagctacttccgacgcttacgatcgcctattcttagattgtatgatgggcgaccaaacattattcaccagagccgacgaagtagaagcagcttggcaggtagtcacccccgccctttctgtttgggactcacccgccgaccccgccaccattccccagtacgaagccggaacctgggaaccagcagaagcagaatttctgattaaccaagatggtcgtcgctggcgcagactgtag

SEQ ID NO: 2399 - protein, 509 aa, Nostoc sp. PCC 7120
MVSLLENPLRVGLQQQGMPEPQIIVIFGASGDLTWRKLVPALYKLRRERRIPPETTIVGVARREWSHEYFREQMQKGMEEAHSSVELGELWQDFSQGLFYCPGDIDNPESYQKLKNLLSELDEKRGTRGNRMFYLSVAPNFFPEAIKQLGGAGMLDDPYKHRLVIEKPFGRDLASAQSLNAVVQKYCKEHQVYRIDHYLGKETVQNLLVFRFANAIFEPLWNRQFVDHVQITVAETVGVEDRAGYYEKAGALRDMLQNHLMQLYCLTAMEAPNSMDADSIRTEKVKVLQATRLADVHNLSRSAIRGQYSAGWMKGQQVPGYRTEPGVDPNSSTPTYVGMKFLVDNWRWQGVPFYLRTGKRMPKKVSEISIHFRDVPSRMFQSAAQQRNANILAMRIQPNEGISLRFDVKMPGAEFRTRSVDMDFSYGSFGIEATSDAYDRLFLDCMMGDQTLFTRADEVEAAWQVVTPALSVWDSPADPATIPQYEAGTWEPAEAEFLINQDGRRWRRL

SEQ ID NO: 2400 - DNA, 1386 bp, Agrobacterium tumefaciens
  CDS (1)..(1386)
atgaaagcatcagccacggacagacagcgatcggacgtgctggtggtgttcggcgccacgggtgatcttgcctataagatgatctttccctctctctacgccatggtgaaacgcggcgcgctgcaaacgcccatcatcggagtcgctttcgacgattggccgcgtgagcagctgatagcgcgggcgcgcgatgcggtcgccaaccatttggacaagatcgatgaagccgtcttcgaaaaattcgccgcacagctgacctatgtctccggcgattatcgcaacgaagcgacattcgaaaagctgcgcacggcgcttggcgggcaccagcatccgctttattatctcgccattccgccttccctgttcgaaaccgtggtaaccggcctcaacagggcgggcatcgccgcttcggcccggctgatggtggagaaaccctttggccgtgaccttgcctccgccgaagccttaaatgaagcgttgcacgcggttttcgcagaggatgctattttccgcatcgaccatttcctgggcaaggaagccatccagaaccttctttattttcgttttgccaatgcctttctagagcccgtgtggaatcgcgaccacgttgagagcgtgcagatcaccatggccgaagatttcggcatcagggggcgcggcaagttttatgacgaagtcggatgtatccgcgatgtgatccagaaccatctgatcaatgtgctgttgctgctggccatggagccgccagccaccagcgcctcggatgatctcgtcgatgaaaaagtgcagatactgaaagccatgccgccgctcacccgcgatgatgtggtgcgcggacagttcagaggttatctggacgagccgggtgtcgcctcggcgtccaaccgggaaaccttcgccgccgcccgctttcgcgtcgccacctggcgctggaatggcgtgcctttcttcatccggtccggcaagaacctgccggcgcatgcaaccgaagtcgtggtccgcttcaagcggccgccaattgcgctctttggcgatgtcgagacaacgcccgccaattatgtgcgcttccgtctgggcccggatatcgcgatcggaatcggtgcgcgtcgcaaggcagctggcgatggcatgcgcggcgaggccgtagaactcggcgcggtcgatgacggtatcggtgacatggcgccttatgagcggctgatcggcgatgcgatggccggcgagcgtcagctctttacccgccaggatgcggcggaactggcctggaagatcgtggagcctatcctcgatgatcccgccgtgccgcctgtctatgaggtgggaagctggggcccggcggaaatggcagggtttggcccgccaggcggatgggttgatcccgaataa

SEQ ID NO: 2401 - protein, 461 aa, Agrobacterium tumefaciens
MKASATDRQRSDVLVVFGATGDLAYKMIFPSLYAMVKRGALQTPIIGVAFDDWPREQLIARARDAVANHLDKIDEAVFEKFAAQLTYVSGDYRNEATFEKLRTALGGHQHPLYYLAIPPSLFETVVTGLNRAGIAASARLMVEKPFGRDLASAEALNEALHAVFAEDAIFRIDHFLGKEAIQNLLYFRFANAFLEPVWNRDHVESVQITMAEDFGIRGRGKFYDEVGCIRDVIQNHLINVLLLLAMEPPATSASDDLVDEKVQILKAMPPLTRDDVVRGQFRGYLDEPGVASASNRETFAAARFRVATWRWNGVPFFIRSGKNLPAHATEVVVRFKRPPIALFGDVETTPANYVRFRLGPDIAIGIGARRKAAGDGMRGEAVELGAVDDGIGDMAPYERLIGDAMAGERQLFTRQDAAELAWKIVEPILDDPAVPPVYEVGSWGPAEMAGFGPPGGWVDPE

SEQ ID NO: 2402 - DNA, 1476 bp, Brucella melitensis
  CDS (1)..(1476)
atgaccagtcagacaattccggtagatcccttcgactgcatcgtttttggtggcaccggcgatcttgccgagcgcaagcttattccggcgctttatcagcgccagcgcgcaggccagctttccgaccccacacgcatcatcggcgcctcgcgcagccagatgaccgacgacgaatatcgcaccttcgccggcaatgcgatcaaggaacatgtgaaaccggaagaggtggatcaggccgaagttgaaatcttcctcaagcggctgcactatgtggcggtggacgccaagtccgacgagggctgggatgcgctgaagaccctgatcggcaagaagccggaaaagatccgagccttttatctggccgtcagcccgaccctgttcggcgatatcgccacgcggctcaaggcgcatggcctcatcacgcgcgatacgcgcatcgtcgtggaaaagccgattggccgcgatctcgattccgccaaggcgctcaacgacacgctgggcagtgtgttccgcgaagaccagattttccgcatagaccactatctcggcaaggaaacggtgcagaacctgatggcgctgcgctttgccaatgcgctctacgagccgctgtggaactccgcccatatcgaccatgtgcagatcacggtggcggaagccgtgggccttgaaggccgcgcaggctattacgacaaggcgggcgcgctgcgcgacatggtgcagaaccacattctccagcttctctgccttgttgccatggaaccgccatcctcgattgaggccgacgccgtacacgacgagaaggtaaaggttctgcgctccctgcagccgatctccacgcataatgtcgaggaactgacggtccgcggacaatatcgcgcgggcgcttccgcaggcgggccggtcaagggctatctggaagaccttgaaagcgacaccagcaatacggaaacattcgtggcgctgaaggcggaaatcgccaactggcgctgggcgggtgtgccgttctatctgcgcaccggcaagcgccttgccacgcgtgtttcggaaatcgtcatcacgttcaagcccattccgcattccatctttggcgaaagcgcgggcaaggtgattgccaatcagcttgtcatccgcctgcaaccggacgaaggcgtgaagcaatggctgatgatcaaggatcccggtccgggtggaatgcgcctgcgccacatgccgctcgacatgagctttgcggaatccttcgaggatcgcaacccggatgcctatgagcgcctcatcatggatgtggtgcgcggcaaccagaccctgttcatgcgccgcgacgaagtggaagcggcctggcgctggatcgacccgatccttcaggcatgggagttcaacagccagcccgtgcagggctatacggctggcacatgggggccttcgtcctccatcgcgctcattgagcgcgatggccgcacctggcacgaaagcctctaa

SEQ ID NO: 2403 - protein, 491 aa, Brucella melitensis
MTSQTIPVDPFDCIVFGGTGDLAERKLIPALYQRQRAGQLSDPTRIIGASRSQMTDDEYRTFAGNAIKEHVKPEEVDQAEVEIFLKRLHYVAVDAKSDEGWDALKTLIGKKPEKIRAFYLAVSPTLFGDIATRLKAHGLITRDTRIVVEKPIGRDLDSAKALNDTLGSVFREDQIFRIDHYLGKETVQNLMALRFANALYEPLWNSAHIDHVQITVAEAVGLEGRAGYYDKAGALRDMVQNHILQLLCLVAMEPPSSIEADAVHDEKVKVLRSLQPISTHNVEELTVRGQYRAGASAGGPVKGYLEDLESDTSNTETFVALKAEIANWRWAGVPFYLRTGKRLATRVSEIVITFKPIPHSIFGESAGKVIANQLVIRLQPDEGVKQWLMIKDPGPGGMRLRHMPLDMSFAESFEDRNPDAYERLIMDVVRGNQTLFMRRDEVEAAWRWIDPILQAWEFNSQPVQGYTAGTWGPSSSIALIERDGRTWHESL

SEQ ID NO: 2404 - DNA, 1458 bp, Zymomonas mobilis
  CDS (1)..(1458)
atgacaaataccgtttcgacgatgatattgtttggctcgactggcgacctttcacagcgtatgctgttgccgtcgctttatggtcttgatgccgatggtttgcttgcagatgatctgcgtatcgtctgcacctctcgtagcgaatacgacacagatggtttccgtgattttgcagaaaaagctttagatcgctttgtcgcttctgaccggttaaatgatgacgctaaagctaaattccttaacaagcttttctacgcgacggtcgatattacggatccgacccaattcggaaaattagctgacctttgtggcccggtcgaaaaaggtatcgccatttatctttcgactgcgccttctttgtttgaaggggcaatcgctggcctgaaacaggctggtctggctggtccaacttctcgcctggcgcttgaaaaacctttaggtcaagatcttgcttcttccgatcatattaatgatgcggttttgaaagttttctctgaaaagcaagtttatcgtattgaccattatctgggtaaagaaacggttcagaatcttctgaccctgcgttttggtaatgctttgtttgaaccgctttggaattcaaaaggcattgaccacgttcagatcagcgttgctgaaacggttggtcttgaaggtcgtatcggttatttcgacggttctggcagcttgcgcgatatggttcaaagccatatccttcagttggtcgctttggttgcaatggaaccaccggctcatatggaagccaacgctgttcgtgacgaaaaggtaaaagttttccgcgctctgcgtccgatcaataacgacaccgtctttacgcataccgttaccggtcaatatggtgccggtgtttctggtggtaaagaagttgccggttacattgacgaactgggtcagccttccgataccgaaacctttgttgctatcaaagcgcatgttgataactggcgttggcagggtgttccgttctatatccgcactggtaagcgtttacctgcacgtcgttctgaaatcgtggttcagtttaaacctgttccgcattcgattttctcttcttcaggtggtatcttgcagccgaacaagctgcgtattgtcttacagcctgatgaaaccatccagatttctatgatggtgaaagaaccgggtcttgaccgtaacggtgcgcatatgcgtgaagtttggctggatctttccctcacggatgtgtttaaagaccgtaaacgtcgtatcgcttatgaacgcctgatgcttgatcttatcgaaggcgatgctactttatttgtgcgtcgtgacgaagttgaggcgcagtgggtttggattgacggaattcgtgaaggctggaaagccaacagtatgaagccaaaaacctatgtctctggtacatgggggccttcaactgctatagctctggccgaacgtgatggagtaacttggtatgactga

SEQ ID NO: 2405 - protein, 485 aa, Zymomonas mobilis
MTNTVSTMILFGSTGDLSQRMLLPSLYGLDADGLLADDLRIVCTSRSEYDTDGFRDFAEKALDRFVASDRLNDDAKAKFLNKLFYATVDITDPTQFGKLADLCGPVEKGIAIYLSTAPSLFEGAIAGLKQAGLAGPTSRLALEKPLGQDLASSDHINDAVLKVFSEKQVYRIDHYLGKETVQNLLTLRFGNALFEPLWNSKGIDHVQISVAETVGLEGRIGYFDGSGSLRDMVQSHILQLVALVAMEPPAHMEANAVRDEKVKVFRALRPINNDTVFTHTVTGQYGAGVSGGKEVAGYIDELGQPSDTETFVAIKAHVDNWRWQGVPFYIRTGKRLPARRSEIVVQFKPVPHSIFSSSGGILQPNKLRIVLQPDETIQISMMVKEPGLDRNGAHMREVWLDLSLTDVFKDRKRRIAYERLMLDLIEGDATLFVRRDEVEAQWVWIDGIREGWKANSMKPKTYVSGTWGPSTAIALAERDGVTWYD

SEQ ID NO: 2406 - DNA, 1470 bp, Bacillus subtilis
  CDS (1)..(1470)
atgaaaacaaaccaacaaccaaaagcagtaattgtcatattcggtgcaactggagatttagcaaaacgaaaattgtatccgtctattcaccgtttatatcaaaacggacaaatcggagaagagtttgcagtggtaggagttggaagaagaccttggtctaatgaggatcttcgccaaactgttaaaacatccatttcctcatctgcagataagcatatagatgatttcacgtctcatttttactatcacccgtttgacgtgacaaaccctggttcttatcaagagctaaacgtattgcttaaccagctggaagatacatatcaaattcctaacaacagaatgttctacttggcaatggctcctgaattcttcggaacgattgcaaaaacattaaaatcagagggtgtaacagctacaaccggctggtcccgccttgtcatcgaaaaaccgttcggccatgatctgccaagcgcacaggcattgaataaagaaatccgcgaagcatttacggaagatcaaatttacagaatcgaccattatctaggcaaacaaatggttcagaacattgaagtgattcgatttgccaatgcgattttcgaaccgctttggacaaaccgctacatttcaaacattcaaatcacatctagcgaatcactaggcgttgaagaccgcgcaagatattacgaaaaatcaggcgcccttcgcgacatggtgcaaaaccatattatgcagatggttgcccttcttgcaatggagccgcctatcaaattgaacacagaagaaatccgcagcgagaaagtgaaggtgctgagagcactgcgtcctattgcaaaagacgaagtggatgaatactttgtgcgcggacaatatcatgctggtgaaattgacggtgtaccggttcctgcttatacagatgaagataatgtcgctcctgactccaatacagaaacctttgttgccggcaagctcttgatcgacaacttcagatgggctggtgttccattctacatcagaaccggaaaacgaatgagagaaaagtccacaaaaattgtcgttcaatttaaggacattccgatgaacctgtactacggtaatgaaaacaacatgaatccgaacttgcttgtcattcatattcagcctgacgaaggcattacgctttacttaaatgctaaaaagcttggcggagcagcacacgcacagccaatcaaactcgattattgcagcaattgcaatgacgagttgaacacccctgaagcatatgaaaaactaattcacgactgtcttcttggcgatgcaacaaactttgcacactgggatgaagttgccctttcttggagctttgtcgactctatttctgaaacatgggcagcaaacaaaaccttatctcctaactacgaatcaggctcaatgggaccgaaagaatctgatgatcttttggtgaaagacggcttacactggtggaacatataa

SEQ ID NO: 2407 - protein, 489 aa, Bacillus subtilis
MKTNQQPKAVIVIFGATGDLAKRKLYPSIHRLYQNGQIGEEFAVVGVGRRPWSNEDLRQTVKTSISSSADKHIDDFTSHFYYHPFDVTNPGSYQELNVLLNQLEDTYQIPNNRMFYLAMAPEFFGTIAKTLKSEGVTATTGWSRLVIEKPFGHDLPSAQALNKEIREAFTEDQIYRIDHYLGKQMVQNIEVIRFANAIFEPLWTNRYISNIQITSSESLGVEDRARYYEKSGALRDMVQNHIMQMVALLAMEPPIKLNTEEIRSEKVKVLRALRPIAKDEVDEYFVRGQYHAGEIDGVPVPAYTDEDNVAPDSNTETFVAGKLLIDNFRWAGVPFYIRTGKRMREKSTKIVVQFKDIPMNLYYGNENNMNPNLLVIHIQPDEGITLYLNAKKLGGAAHAQPIKLDYCSNCNDELNTPEAYEKLIHDCLLGDATNFAHWDEVALSWSFVDSISETWAANKTLSPNYESGSMGPKESDDLLVKDGLHWWNI

SEQ ID NO: 2408 - DNA, 1401 bp, Mycobacterium tuberculosis
  CDS (1)..(1401)
atggttgacggcggaggtggcgcgtcagatctgttggtgatcttcggaattaccggtgacctggcccgcaagatgaccttccgcgcgttgtatcggctcgagcgccaccagttgctggactgccccatcctgggtgtggccagtgacgacatgtccgtcgggcagttggtcaagtgggctcgcgagtccatcggtcgtaccgaaaagatcgacgatgcggtgttcgaccggttggcgggccggttgtcctacctgcacggtgacgtcaccgacagccagctctacgattcgctggccgaactgattggctcggcctgtcggccgctgtattacctggaaatgccgccggcgctgttcgcgccgattgtcgaaaatctcgcgaacgtgcggctgttggagcgcgcacgcgttgccgtggaaaagccgttcggccacgacctggcctccgcgctcgaactcaacgcccggctgcgagcggtgttgggcgaagaccaaatcctgcgtgtggaccactttctgggcaagcagcccgtcgtcgagctggagtacctgaggttcgccaatcaggcgttagccgagctctgggatcgcaacagcatctccgagatccacatcaccatggccgaggacttcggggtggaggaccgcggcaagttttacgacgccgtcggtgccctgcgtgacgtggtgcaaaaccatctgctgcaggtgctggcgctggtgacgatggaaccgccggtcggttccagcgccgatgacctcaacgacaagaaggccgaggtcttccgggcgatggcgccgctggatcccgatcggtgcgtgcgtgggcagtacctcggctacaccgaagttgcgggcgtagcaagcgattcggcgaccgaaacgtatgtcgcgctgcgaaccgagatcgacaactggcgctgggccggggtgccgatcttcgtgcgggccggaaaagagctgcccgcgaaggtcaccgaagtacggctatttctacgccgagttccggcattggcctttctgcccaaccgccgaccggccgagcccaaccagattgtgctgcgtatcgaccccgatccgggtatgcgactgcagatttcggcccacaccgacgactcgtggcgagatatccacctggactcctcgttcgcggtggacctcggtgaaccgatacgaccctatgagcggctgctgtatgccggattggtcggcgatcaccagttgttcgcccgcgaggacagcatcgagcagacgtggcggatcgtgcagccgctgctcgacaacccgggtgaaatccatcggtacgatcgcggttcctggggtccggaagccgcgcagtcgttgctgcgcggtcaccgcggttggcagtcgccgtggctgccccgcggcacggacgcatga

SEQ ID NO: 2409 - protein, 466 aa, Mycobacterium tuberculosis
MVDGGGGASDLLVIFGITGDLARKMTFRALYRLERHQLLDCPILGVASDDMSVGQLVKWARESIGRTEKIDDAVFDRLAGRLSYLHGDVTDSQLYDSLAELIGSACRPLYYLEMPPALFAPIVENLANVRLLERARVAVEKPFGHDLASALELNARLRAVLGEDQILRVDHFLGKQPVVELEYLRFANQALAELWDRNSISEIHITMAEDFGVEDRGKFYDAVGALRDVVQNHLLQVLALVTMEPPVGSSADDLNDKKAEVFRAMAPLDPDRCVRGQYLGYTEVAGVASDSATETYVALRTEIDNWRWAGVPIFVRAGKELPAKVTEVRLFLRRVPALAFLPNRRPAEPNQIVLRIDPDPGMRLQISAHTDDSWRDIHLDSSFAVDLGEPIRPYERLLYAGLVGDHQLFAREDSIEQTWRIVQPLLDNPGEIHRYDRGSWGPEAAQSLLRGHRGWQSPWLPRGTDA

SEQ ID NO: 2410 - DNA, 1545 bp, Mycobacterium tuberculosis
  CDS (1)..(1545)
atgaaaccggcccacgccgcggcgtcgtggcgcaacccgctacgagacaagcgggacaagcgattacccagaatcgccggcccgtgcggcatggtgattttcggcgtcaccggcgacctggcccgcaagaaggtgatgccggccgtctacgatttggccaaccgcggcctgctgccgcccacattctcgctggtggggtttgcccgccgagactggagcacccaggatttcggtcaagtggtgtacaacgccgtccaagagcactgccgaacaccgtttcggcaacagaactgggaccggctggccgagggattccgttttgtgccaggcactttcgacgacgacgacgcgttcgcccaactcgccgagacgctggagaagctcgacgccgagcgcggcaccggcggcaaccacgccttctacctggcgatcccgcccaaatccttcccggtggtgtgtgagcagctgcacaagtccggcctggcccgcccgcaaggcgaccggtggagccgagtcgtgatagagaagccgttcggccacgacctggccagcgcacgcgagctgaacaaggcggtcaacgcggtcttcccggaggaagcggtcttccgcatcgaccactacctgggcaaagagacggtgcagaacatcctggcgctgcggttcgccaaccagctgttcgacccgatctggaatgcgcactacgtcgaccacgtacagatcaccatggccgaagacatcggcctgggcgggcgcgcgggctattacgacggcatcggcgcggcccgcgatgtcatccagaaccatctcatgcagctgctggcgctgaccgcgatggaggagccggtcagcttccacccggcagcgttgcaggccgagaagatcaaggtgctctcggccacccgccttgccgagccactcgaccagaccaccagccgcggccagtacgccgccggctggcaaggcggggagaaggtggttgggctgctcgacgaggaggggttcgccgaggactccaccaccgaaaccttcgccgctatcaccctggaagtcgatacgcgccggtgggccggcgtgccgttctatctgcgaacgggaaaacgattgggccgccgggtgaccgagatcgctctggtcttcaggcgggcgccgcatctgccgttcgacgccaccatgaccgacgagctgggcaccaacgcgatggtcatccgcgtgcagcccgacgaaggtgtcacattgcggttcggctccaaggtgccgggcaccgccatggaagtccgcgacgtcaacatggacttctcctacggctcggcattcgccgaagattcaccggaggcctacgagcggctcatcctcgacgtcctgctcggcgagccctcgctgtttccggtcaacgcggaggtcgaactggcgtgggagatcctcgatccagcgttggaacattgggcggcacacgggacgcccgacgcctacgaggcaggtacctggggtccggaatcatccttggagatgctgcgccgcaccggccgggaatggcggcggccatga

SEQ ID NO: 2411 - protein, 514 aa, Mycobacterium tuberculosis
MKPAHAAASWRNPLRDKRDKRLPRIAGPCGMVIFGVTGDLARKKVMPAVYDLANRGLLPPTFSLVGFARRDWSTQDFGQVVYNAVQEHCRTPFRQQNWDRLAEGFRFVPGTFDDDDAFAQLAETLEKLDAERGTGGNHAFYLAIPPKSFPVVCEQLHKSGLARPQGDRWSRVVIEKPFGHDLASARELNKAVNAVFPEEAVFRIDHYLGKETVQNILALRFANQLFDPIWNAHYVDHVQITMAEDIGLGGRAGYYDGIGAARDVIQNHLMQLLALTAMEEPVSFHPAALQAEKIKVLSATRLAEPLDQTTSRGQYAAGWQGGEKVVGLLDEEGFAEDSTTETFAAITLEVDTRRWAGVPFYLRTGKRLGRRVTEIALVFRRAPHLPFDATMTDELGTNAMVIRVQPDEGVTLRFGSKVPGTAMEVRDVNMDFSYGSAFAEDSPEAYERLILDVLLGEPSLFPVNAEVELAWEILDPALEHWAAHGTPDAYEAGTWGPESSLEMLRRTGREWRRP

SEQ ID NO: 2412 - DNA, 1320 bp, Chlamydia trachomatis
  CDS (1)..(1320)
atgaagcttgccgttcagcatttctctcactcatcggaaatagatattcgagtttgggaaagtctggaaaatagaatcttttaccaccaagctaatttttctgatgccgaaggctactctgttctgaaagcttatttggagcaactagatcaacaatatggaacacaagggaatcgtcttttttatttatcaacaccaccagattatttccaggaaatcatccgcaatttaaatcggcatcagctattctatcatgaacaaggagcacaacagccttggtctcggctaattatagaaaagccttttggagttaatttagaaacagctcgagagcttcaacaatgcattgatgccaatattgatgaagagtcggtttatcgaatagaccattatttaggaaaagaaacggttcaaaacattctgactattcgttttgctaatactctctttgagtcttgctggaattctcagtacatagatcatgtgcaaatcagcgttagcgaatcaattggtataggatctcgagggaatttcttcgaaaagtcgggcatgctacgagacatggtacagaatcatttgacgcagctgctatgtctactgactatggaacctccttctgaatttttttccgaagaaataaaaaaagaaaaaattaaaattctaaagaaaattcttcctatccgcgaagaagatgctgttcgtggccagtatggtgaagggattgtgcaagatgtttcagttctgggctatcgggaggaagaaaatgtcgatccgaattcttcagtagaaacctacgttgcgttaaaattatttatcgacaatcctcgctggaaaggggttcccttttacttacaagcagggaaacgtcttcctaaaagaacaacagatatcgctgtgatctttaaaaaatccagctacaatttattcaatgcagagaattgtcctttgtgtccgttagagaatgatttacttattattcgtattcaaccggatgaaggtgttgcgttacaatttaactgcaaggttccaggaacaaataagctcgtacgtcctgtaaaaatggacttccgttacgacagctattttaatactgttactcccgaagcttatgaacggttactgtgcgactgtatccttggggacagaacgctattcactagcaatgaagaagtcttagcatcttgggaactattttctcctctattagaaaaatggtctcaagtacgccctatattccctaactatatggctggatctttacgtcctcaagaagctgatgaactattatctagagatggaaaagcttggcggccctattaa

SEQ ID NO: 2413 - protein, 439 aa, Chlamydia trachomatis
MKLAVQHFSHSSEIDIRVWESLENRIFYHQANFSDAEGYSVLKAYLEQLDQQYGTQGNRLFYLSTPPDYFQEIIRNLNRHQLFYHEQGAQQPWSRLIIEKPFGVNLETARELQQCIDANIDEESVYRIDHYLGKETVQNILTIRFANTLFESCWNSQYIDHVQISVSESIGIGSRGNFFEKSGMLRDMVQNHLTQLLCLLTMEPPSEFFSEEIKKEKIKILKKILPIREEDAVRGQYGEGIVQDVSVLGYREEENVDPNSSVETYVALKLFIDNPRWKGVPFYLQAGKRLPKRTTDIAVIFKKSSYNLFNAENCPLCPLENDLLIIRIQPDEGVALQFNCKVPGTNKLVRPVKMDFRYDSYFNTVTPEAYERLLCDCILGDRTLFTSNEEVLASWELFSPLLEKWSQVRPIFPNYMAGSLRPQEADELLSRDGKAWRPY

SEQ ID NO: 2414 - DNA, 1773 bp, Deinococcus radiodurans
  CDS (1)..(1773)
atgaccgaccggccccgtcccaaaaagagcagtccgaaaaagagtggccccgagaaggccctcgccaaggaaagtgccgcgcagggcgaggcggccaaggcgacccggcaggccactcagcagaccgaggcggccaagaaggtcggtgtggcccagcccggcgctccggcgcagtcccgcaaagcggcccgcaagtcacgccagcgggtgcccaagcacgccggggacaatgcccccaaaagcgacgcgcccggcgccgacggccagaatccctttcgcaccgccatgcgccgcagccgcgcgcccgaacctgccacgctggtgattttcggcgcgaccggcgaccttgcccggcgcaagttgctgcccgccgtgttcggcctgtggcaagacggcctgctcggcagcgcgttcaacatcgtcggcgtgggccggcaggaaatggacgacgagcagttcaaggactacgccatagacgccctgaagacctccaaggaaaccgacgaaatcaaggaaggcagcctggaaaagttccgcgagctgctctactacgaatacggcgaattcggcgaggacgaggtgtacgacaaggtccgcagtgaactcgaccgcgccgagaccgcccgtggcggcggcaagaacgcgctgttttacctctccaccccgccgagcctcttcgagccgatttcgagcggcctggggcggcagggcctgcaagacgagacggaaggctggcggcgcatcgtcatcgaaaaacccttcgggcgcgacctgcaatcggcccgcgaactcaacgacgccattcaccgcgtctgggacgagtcgcaggtgtaccgcatcgaccattatctcggtaaggagacggtgcagaacctgatggcgatccgtttcgggaacgccattttcgagccgctgtggaaccgggggtttgtcgaccacgtgcagatcacggcgtccgaggacctggggctggagggccgcgccgggtactacgaggaagcgggcatcgtgcgcgacatgctgcaaaaccacctgatgcagctttttaccctgaccgccatggaagcgccctcggcgttcgaggccgacgccatccgcgacgagaaggtcaaggtgctgcgggccgtcaagcgcattccggcggaccgggtgcccgaagtcgccgtgcgcgggcagtacggccccggcgccctcgacggccagaccgtgcccggctacaagcaggagccggacgtaaagcgcggcagccgcacgcccacctacgtcgccgtcaagctcgaggtggacaactggcgctggcagggcgtgccgtttttcctgcgcaccggcaagcgcttgcccaagaaagtcaccgaaatcgccgtggtgttcaagcgcccgccgctgggcctctttcccggcggactggagcgcaacgtgctggccttccgcattcagcccgacgaaggcgtgagcctgaagttctcctccaaatcgccggggcaagagatggtgctgcgcgaggtcgtgatggatttccgttacgacgccttcggggcacagctcgaaagcccctactcgcgcttgctgctcgacgcgatgctcggcgacgccaccctctttccccgcgaggacgaggtggaccacgcctggcaaatcgtctcgggcatcttgcaggcctgggaaggcgcggacgcggcggcccccaaattccccaactacgcggcgggcacctggggccccgacgccgccgatgagctgctcggccccggacggcgctggaggcggctgtga

SEQ ID NO: 2415 - protein, 590 aa, Deinococcus radiodurans
MTDRPRPKKSSPKKSGPEKALAKESAAQGEAAKATRQATQQTEAAKKVGVAQPGAPAQSRKAARKSRQRVPKHAGDNAPKSDAPGADGQNPFRTAMRRSRAPEPATLVIFGATGDLARRKLLPAVFGLWQDGLLGSAFNIVGVGRQEMDDEQFKDYAIDALKTSKETDEIKEGSLEKFRELLYYEYGEFGEDEVYDKVRSELDRAETARGGGKNALFYLSTPPSLFEPISSGLGRQGLQDETEGWRRIVIEKPFGRDLQSARELNDAIHRVWDESQVYRIDHYLGKETVQNLMAIRFGNAIFEPLWNRGFVDHVQITASEDLGLEGRAGYYEEAGIVRDMLQNHLMQLFTLTAMEAPSAFEADAIRDEKVKVLRAVKRIPADRVPEVAVRGQYGPGALDGQTVPGYKQEPDVKRGSRTPTYVAVKLEVDNWRWQGVPFFLRTGKRLPKKVTEIAVVFKRPPLGLFPGGLERNVLAFRIQPDEGVSLKFSSKSPGQEMVLREVVMDFRYDAFGAQLESPYSRLLLDAMLGDATLFPREDEVDHAWQIVSGILQAWEGADAAAPKFPNYAAGTWGPDAADELLGPGRRWRRL

SEQ ID NO: 2416 - DNA, 1467 bp, Pseudomonas aeruginosa
  CDS (1)..(1467)
atgagtacaccagccactccaacgtcctgcgacatcctggtcttcggcggtaccggcgacctggccctgcacaagctgctgccggcgctctatcgcctgcaccgggaggaccgcctgccggccgatacacggatcttcgccctcgcccgcagcgcgctggacaacgccgccttcctcgccctcgccgagcgcaacgtccgcgcggtggtggcgcgcagcgagttcgccgccgaacaatggaaaggcttcgccgcgcgcctcgactacctggccatggacgcctcgcagagcgccgacttcggccgtctcgcgcggcacctgaagagcagcgagggccgggtgctggtgcactacctggcgacctcgccgagcctgttcgcgccgatcgcgcagaacctctccatcgccggcctcgccgggccgcaagcgcgcatcgtgctggaaaaaccgctgggccattcgctggactcggcgagggcgatcaaccagtccatcggccgggtgttcgacgagtcgcgggtgttccgcatcgaccactacctgggcaaggaaaccgtgcagaacctgatggccctgcgcttcgccaatgcgttgttcgagccggtctggcgcgcggcgcacatcgaccatgtgcagatcagcgtcaacgagacccttggcgtggagaaccgtggcggctactacgaccacgccggggcgatgcgcgacatggtgcagaaccatctgctccagttgctctgcctggtggcgatggaggcgccggtgcgtttcgacgccgaggctgtgcgcaacgagaagctcaaggtgctgcaggcgctgaagccgatctccgggctcgacgtgcaggacaagacggtacgcggccagtacgccgccggcaggatcggcggccaggaggtgccggcgtactacttcgagaagaacgtcgacaacgacagcgataccgagaccttcgtcgcgctccaggccgaggtcgagaactggcgctgggccggggtgccgttctacctgcgcaccggcaagcgcatggcgcgcaagtgctcggaaatcgtcatccagttcaagccggtgccgcacagcctgatcgacggcggcggcgggccggccaaccgcctgtggataaggttgcagccggaggagcggatcagcgtgcaactgatggccaagaccccgggcaagggcatgcaactggaaccggtggagctggacctcaacctggccgaggccctcagccgcaacaagcggcgctgggacgcctacgaacgcctgctgctggacgtgatcgagggcgactcgacgctgttcatgcgccgcgacgaggtagaggccgcctggggctgggtcgacccgatcctcgccggctggcgcgagcactaccagagcccgcggccctacccggccggcagcaacggcccggaacaggcgcaactgctgctggaactgcagggtcgacgctggctggaatga

SEQ ID NO: 2417 - protein, 488 aa, Pseudomonas aeruginosa
MSTPATPTSCDILVFGGTGDLALHKLLPALYRLHREDRLPADTRIFALARSALDNAAFLALAERNVRAVVARSEFAAEQWKGFAARLDYLAMDASQSADFGRLARHLKSSEGRVLVHYLATSPSLFAPIAQNLSIAGLAGPQARIVLEKPLGHSLDSARAINQSIGRVFDESRVFRIDHYLGKETVQNLMALRFANALFEPVWRAAHIDHVQISVNETLGVENRGGYYDHAGAMRDMVQNHLLQLLCLVAMEAPVRFDAEAVRNEKLKVLQALKPISGLDVQDKTVRGQYAAGRIGGQEVPAYYFEKNVDNDSDTETFVALQAEVENWRWAGVPFYLRTGKRMARKCSEIVIQFKPVPHSLIDGGGGPANRLWIRLQPEERISVQLMAKTPGKGMQLEPVELDLNLAEALSRNKRRWDAYERLLLDVIEGDSTLFMRRDEVEAAWGWVDPILAGWREHYQSPRPYPAGSNGPEQAQLLLELQGRRWLE

SEQ ID NO: 2418 - DNA, 1422 bp, Caulobacter crescentus
  CDS (1)..(1422)
atggtgctgctgggcggagcgggcgatttggccctccggatgctgctgccttctctgtatttcctggagctcgaccgactgctgccgcacgatctgcggatcattggcgtcgcccgggccgaccatgacgcggccagctacaaggcgctggtccgcgagcaactgggcaagcgcgcgacagtggaggaggcggtttggaatcgcctcgccgcgcgcctcgactacgtgcctgcgaacatcaccagtgaggaagacaccaagaagctggccgaacggatcggtgcgcatggcacgctggtcatcttcttctcgctgtcgcccagcctctacggcccggcttgccaggctttgcaggccgccggcctgacggggcccaacacgcgcttgatcctcgaaaagccgcttggccgcgatctcgaaagctccaaggccaccaacgccgccgtcgccgctgtggtcgacgagagccaagtgttccgcatcgaccactatctgggcaaggaaaccgtccagaacctgacggccctgcgcttcgccaacgtgctgttcgagcccctgtgggatcgcaacacgatcgaccatgtgcagatcaccatcgccgagaccgaaaaggtcggcgaccgctggccctactacgacgaatacggcgcgctgcgggacatggtgcagaaccacatgctgcaactgctgtgtctggtcgccatggaagcgccctcaggcttcgatcccgatgcggtgcgcgacgagaaggtcaaggtgctgcgctccctgcggcccttcaccaaggagaccgtggcccacgacaccgtgcgtggccagtacgtcgccggtgtggtcgagggcggcgcgcgcgctggctatgtcgaggaagtgggcaagcccaccaagaccgagactttcgtggccatgaaggtcgcgatcgacaactggcgttgggacggcgtgccgttcttcctgcgcaccggcaagaacctgccggaccgccgcacccagatcgtcgtccagttcaagcctttgccgcacaacatcttcggtccggcgaccgatggcgagctgtgcgccaaccgcctagtcatcgacctgcagccggacgaagacatctcgctgacgatcatgaacaagcgtccgggtctctcggacgagggcatgcgactgcagtcgctgccgctgtcgctgtcgtttggccagaccggcgggcgccgtcgcatcgcttacgaaaagctgttcgtcgacgccttccgcggcgaccgtacgctgttcgtgcgtcgcgatgaggtcgagcaggcctggcgcttcatcgacggcgtctcggcggcctgggaagaggccagtatcgaaccggcgcactatgcggcgggcacctggggaccgcagtccgcccagggcctgatctcgcccggcggccgagcctggaaggcctga

SEQ ID NO: 2419 - protein, 473 aa, Caulobacter crescentus
MVLLGGAGDLALRMLLPSLYFLELDRLLPHDLRIIGVARADHDAASYKALVREQLGKRATVEEAVWNRLAARLDYVPANITSEEDTKKLAERIGAHGTLVIFFSLSPSLYGPACQALQAAGLTGPNTRLILEKPLGRDLESSKATNAAVAAVVDESQVFRIDHYLGKETVQNLTALRFANVLFEPLWDRNTIDHVQITIAETEKVGDRWPYYDEYGALRDMVQNHMLQLLCLVAMEAPSGFDPDAVRDEKVKVLRSLRPFTKETVAHDTVRGQYVAGVVEGGARAGYVEEVGKPTKTETFVAMKVAIDNWRWDGVPFFLRTGKNLPDRRTQIVVQFKPLPHNIFGPATDGELCANRLVIDLQPDEDISLTIMNKRPGLSDEGMRLQSLPLSLSFGQTGGRRRIAYEKLFVDAFRGDRTLFVRRDEVEQAWRFIDGVSAAWEEASIEPAHYAAGTWGPQSAQGLISPGGRAWKA

SEQ ID NO: 2420 - DNA, 1512 bp, Agrobacterium tumefaciens
  CDS (1)..(1512)
atgatgccccaacctttgaagatcgagagaatcgatatgagcagtcagatcattcctgttgaaccttttgattgtgtcgttttcggcggcacgggcgatcttgccgagcgcaagcttctgccggccctttatcaccggcaggtcgaaggccagttcacggagccgacccgcatcatcggcgcgtcgcgttcggtcatgacccatgaggaatatcgcaaattcgcgcaggacgccctgaaggaacacctgaaggccggcgaatatgacgatgcgcaggtgaccctgttcctcaaccggcttttctacgtgcccgtcgatgccaagtccggcaatggctgggacgtgctgaagaaactgctcgatgagggcaaggaacgcatccgcgcgttttatctggccgtcgcacccggcattttcggcgacatcgccgacaagatccgtgagcacaagctgatcacccgctcgacccgcatcgtcgttgaaaagccgatcggccgggatctcgcatccgcgcaggaactgaacgacaccatcggtcacgtcttcaaggaagagcagatcttccgcatcgaccactatctcggcaaggagacggtgcagaacctgatggcgctgcgtttcgccaatgcgctttacgagccgctgtggaattccgcccatatcgaccacgttcagatcaccgttgccgaagcggtgggtcttgaaggtcgcgccggttattacgacaaggccggtgcgctgcgcgacatggtgcagaaccacattctccagctgctttgcctcgttgccatggagccgcccgcttccatgaaatcggaggcagtgcgcgacgaaaagctcaaggtactgcgctcgctgaagccaatcgataccagcaatgtcgaaaagctgacggtacgcggccagtaccgcgccggcgcttccgcaggcggccccgtcaagggttatctggaagagctggaaggcggcgtttccaacaccgaaaccttcgtcgccatcaaggctgaaatcgccaactggcgctgggccggcgttcccttctacatccgcaccggcaaacgcctcgcgacccgtgtttcggaaatcgtcgtcaccttcaagcagatcccgcactcgatcttcgacgatgcggctggcaagatcgaagccaacaagctggtcattcgcctgcagccggatgaaggcgtcaagcagtcgctcctcatcaaggatcccggtccaggcggcatgcgcctgcgtcaggtctcgctggacatgagctttgccgaagccttcaacgtgcgcagccccgatgcctatgagcggctgttgatggacaccattcgttccaaccagacattgttcatgcgccgcgacgaggtcgaggccgcgtgggactggatcgaccccatcttgaagagctgggaagagctgggacagagcgtacagggttacactgccggcacctggggcccgagcggttcgatcgcactgatcgagcgcgacggccgcacctggcacgatgccgactga

SEQ ID NO: 2421 - protein, 503 aa, Agrobacterium tumefaciens
MMPQPLKIERIDMSSQIIPVEPFDCVVFGGTGDLAERKLLPALYHRQVEGQFTEPTRIIGASRSVMTHEEYRKFAQDALKEHLKAGEYDDAQVTLFLNRLFYVPVDAKSGNGWDVLKKLLDEGKERIRAFYLAVAPGIFGDIADKIREHKLITRSTRIVVEKPIGRDLASAQELNDTIGHVFKEEQIFRIDHYLGKETVQNLMALRFANALYEPLWNSAHIDHVQITVAEAVGLEGRAGYYDKAGALRDMVQNHILQLLCLVAMEPPASMKSEAVRDEKLKVLRSLKPIDTSNVEKLTVRGQYRAGASAGGPVKGYLEELEGGVSNTETFVAIKAEIANWRWAGVPFYIRTGKRLATRVSEIVVTFKQIPHSIFDDAAGKIEANKLVIRLQPDEGVKQSLLIKDPGPGGMRLRQVSLDMSFAEAFNVRSPDAYERLLMDTIRSNQTLFMRRDEVEAAWDWIDPILKSWEELGQSVQGYTAGTWGPSGSIALIERDGRTWHDAD

SEQ ID NO: 2422 - DNA, 1437 bp, Borrelia burgdorferi (Lyme disease spirochete)
  CDS (1)..(1437)
atgaaagaaagaagtgtttctaattttgatattgtaatttttggggttaccgggaatttgtctagaaaaaagcttattccttcactttttaatttatttaaaaataaatgtattagcaattttagggttattggtttttctcgtaagatttttacagataaagaatttagattgtatattaaagattctttatggcaggaagagaccgattcgttgattgagatttttttaaatttttttgtttatgtatttggcgattttaatgaaaaggagtcttataaaaatttatttaaatttttagatagaagtcgagaaacgatatattatctttcgacgtctcctgcattttatggacctataattaatcatttgaaaaagtattttttaagcgaaaaattgactttgtcaaaaatagttcttgagaagccttttggctctagtcttgagacagcaaaaaaattaaatagtttgctttattctgcttttaaagaagatcaaatttatagaatagatcactatttgggtaaagaaacggttcaaaatatttttacatttagattcggcaattctatttttgaaaatatttggaataatcgttatgtagattttgttcagattacggtagcagaagaattaggtcttgatggaagagtagagtattacgattctgttggcgctttgaaggatatggttcaaaatcatattttacaattgttaagccttgttgcaatggagtctcctattaaatttgattctgagtttattcatgatgaaaaagtaaaagttttaaaaagtttgaggaaaattagcaaagaagatattaagaattacattgttaagggtcaatatataggctcacaagttcaaggggtttttaaaaaaggctataaagatgaaacagaatttttgggaaattcaaataccgaaacttatttagctatgaaagtgtttattaataattggcgttggtctggggttcctttttatcttagaactgggaaaggtcttgctaggaaattttcagaaatatatattcaatttaaaaaaccgagctttactctttttaacaatagttctgttgatttttctaatgctttgatatttagaattcagccaagggatggaattgaaatcaaattcaataccaagaagcccggatataattatgaaattcaaactgctaatatggagttttcatatcacggagcatttaaaagattgtttgatgaggcttatgagcgtttattgttagacgcttttttaggagatggtactttatatgcgacaagtgatgagattgaaagttcttgggaatttgtttcagatattgcaaataaatgggcagatattgaaatttgtaattatttttatggctctgaaggaccaaaagagatagactctattttagaaaaagatcatttttggcgtaaaatttaa

SEQ ID NO: 2423 - protein, 478 aa, Borrelia burgdorferi (Lyme disease spirochete)
MKERSVSNFDIVIFGVTGNLSRKKLIPSLFNLFKNKCISNFRVIGFSRKIFTDKEFRLYIKDSLWQEETDSLIEIFLNFFVYVFGDFNEKESYKNLFKFLDRSRETIYYLSTSPAFYGPIINHLKKYFLSEKLTLSKIVLEKPFGSSLETAKKLNSLLYSAFKEDQIYRIDHYLGKETVQNIFTFRFGNSIFENIWNNRYVDFVQITVAEELGLDGRVEYYDSVGALKDMVQNHILQLLSLVAMESPIKFDSEFIHDEKVKVLKSLRKISKEDIKNYIVKGQYIGSQVQGVFKKGYKDETEFLGNSNTETYLAMKVFINNWRWSGVPFYLRTGKGLARKFSEIYIQFKKPSFTLFNNSSVDFSNALIFRIQPRDGIEIKFNTKKPGYNYEIQTANMEFSYHGAFKRLFDEAYERLLLDAFLGDGTLYATSDEIESSWEFVSDIANKWADIEICNYFYGSEGPKEIDSILEKDHFWRKI

SEQ ID NO: 2424 - DNA, 1548 bp, Treponema pallidum subsp. pallidum (syphilis spirochete)
  CDS (1)..(1548)
atggggaaaatcagtggcagcggcacggtcgcgccgcacatcctggttatctttggcgcttcaggcgaccttgccgcgcggaagcttatcccctcgctttgggatctctttgagcaagagctcctgccccgtacattcggtatactcggcgcagggcgtacggctctgtctacagagtcttttcgcgcacggcttgcagaggcggtcacaaagcatgcagtgcgcacaccgcacgacccggcgcgcctcaccgaattcctgcagaagatccactacttctcgttcgatcccaccgactctgtcgcctttgccgactttgccacgtacgtgcgcaccctcgaccagtcgctgcacaccgagggcaactttatcttctatcttgccactccccctagcctgtacgaaactatccccacgcagcttgctatgcaccacttgaaccgggaacagggtaattttcgcagggtagttattgaaaaaccctttggctacaacctagaaaccgcgcagcaccttaatgcgagcttgcgtgcccactttcaggaaaaccaaacctatcgcatcgatcactatctgggtaaggaaacggtccaaaacatcctggtcactcgctttgccaatccccttttcgagcccacatggaaccggacccatatcgattacgttgaaattactgcaagcgaatcactaggtgtcgaaaaccgcggcggttactacgaccagtccggtgcattgcgcgatatgatccaaaaccacttgttactcctcttgggtattatcgcgatggaggcgcccgccgtcgtgagttcaagtcgtctacgggatgaaatcgtaaaggtctttgactgcctgcgccctatgggagaacgcgacgtcatgcagcatacggtgcgtgcccaatacgtcgccggcaagatacgcggtgtagccgtccccggctaccttgaggagtcaggcgttgaccctcgctcgtgcactgaaacctttgccgcactcaagtgctacatcgacaattggcggtggatggacgttcccttctacctgcggacgggtaagcgtttgcccacgggcgtcactgaggtgatcgtccattaccgaacgctccccatcgcgcttttcgagcacatcgaacgcccgtgcgcacgcgagggcaacgcgcttgtcattcgcattcaacccgacgaaggaattcagcttaaaatcgacctcaaagagcccggcgcggggttcaagactattcccgtcagtgttgattttcagtattcggctcttacctattcgcacttacccagcgcgtatgagcggctattgcttgactgcatgaatggagacaacacgctctaccatcgagatgacgcggtggagtctgcatggcgcttcatagatcctattcttgccgcatggaaatcaaacaagagtcctctacttacgtaccctgcaggaagctggggtccgaaggctgcagacgacctgatcaaagggagtgctccacggtggcatcacccctcttctacgctgctcagcgatgattttgcctgccgactctag

SEQ ID NO: 2425 - protein, 515 aa, Treponema pallidum subsp. pallidum (syphilis spirochete)
MGKISGSGTVAPHILVIFGASGDLAARKLIPSLWDLFEQELLPRTFGILGAGRTALSTESFRARLAEAVTKHAVRTPHDPARLTEFLQKIHYFSFDPTDSVAFADFATYVRTLDQSLHTEGNFIFYLATPPSLYETIPTQLAMHHLNREQGNFRRVVIEKPFGYNLETAQHLNASLRAHFQENQTYRIDHYLGKETVQNILVTRFANPLFEPTWNRTHIDYVEITASESLGVENRGGYYDQSGALRDMIQNHLLLLLGIIAMEAPAVVSSSRLRDEIVKVFDCLRPMGERDVMQHTVRAQYVAGKIRGVAVPGYLEESGVDPRSCTETFAALKCYIDNWRWMDVPFYLRTGKRLPTGVTEVIVHYRTLPIALFEHIERPCAREGNALVIRIQPDEGIQLKIDLKEPGAGFKTIPVSVDFQYSALTYSHLPSAYERLLLDCMNGDNTLYHRDDAVESAWRFIDPILAAWKSNKSPLLTYPAGSWGPKAADDLIKGSAPRWHHPSSTLLSDDFACRL

SEQ ID NO: 2426 - DNA, 1278 bp, Helicobacter pylori
  CDS (1)..(1278)
atgttagattttgatttggttctttttggcgcgactggggatttagccatgcgaaagctctttgtttcgctctatgaaatttatactcattatggttttaaaaacgattctaggattatcgcatcggggcgtaaggagctatccaatgaagaatttttaacactcctttgtgagaaaacacaactgcattcaagagaaaagggtagggaatttttagcccatatcagttatttgtgcgttcgtttggataaccctaaagactttgaagaattgagtaaaatcgctacaaaaaataaacccttgattttctacttttctatctcgcctagtttttttgcaacgaccgcccaacatttggccaaaaacgcgctcaatcacgccaacacacgcttgattttagaaaagcctttagggcatgatttaaagacatgtaaagagattttccaaagcattagcgttttttttaaagaagaacaaatctttagaatcgatcattatttagggaaaaagggcgttcaaaatatccttgaattgcgcctgaataaccctattttaaatattttatgggatcaaatcagcgcagttgaaatctgcgtgtatgagactttgggggtggaagaaagaggcgaattttacgataaaatcggggctttaagggatatggttcaaaaccatctcttgcaagttttatcccttatcgctacagatttacccaacaatttaaaggatttgaggaaagaaaaaatcaaagttttaaaaaccttacaaccccctaaagattttaaaaaacaggttattcgggcccaatatcaaggctatagagatgaaaataaggtccataaagagagccagacagagacttttgttgctattaaagcctttttggatacgcccaaatttaaaggcgtgcctttctaccttaagcacgctaaaaaaatgccccacaaccaagcgagcgtgaaaatccattttaacgcggtcaatacgctagaatttttcctctctcaagataaaatcaccctcaccctaaaagatcatcaaaacccccttattttagaaacccataacaaacaagaatttttacggccctacgctaaattgctctatgatgcgatacaaaataaccacaataatttcgcccaccagttggaattagaagcgtcatgggtttttattgacacgctcatagagggttttatgaataacgccacgcccttatattcctatgaaagccaccatctaaacgaatcagaatttttaaaaccactctatcaataa

SEQ ID NO: 2427 - protein, 425 aa, Helicobacter pylori
MLDFDLVLFGATGDLAMRKLFVSLYEIYTHYGFKNDSRIIASGRKELSNEEFLTLLCEKTQLHSREKGREFLAHISYLCVRLDNPKDFEELSKIATKNKPLIFYFSISPSFFATTAQHLAKNALNHANTRLILEKPLGHDLKTCKEIFQSISVFFKEEQIFRIDHYLGKKGVQNILELRLNNPILNILWDQISAVEICVYETLGVEERGEFYDKIGALRDMVQNHLLQVLSLIATDLPNNLKDLRKEKIKVLKTLQPPKDFKKQVIRAQYQGYRDENKVHKESQTETFVAIKAFLDTPKFKGVPFYLKHAKKMPHNQASVKIHFNAVNTLEFFLSQDKITLTLKDHQNPLILETHNKQEFLRPYAKLLYDAIQNNHNNFAHQLELEASWVFIDTLIEGFMNNATPLYSYESHHLNESEFLKPLYQ

SEQ ID NO: 2428 - DNA, 1446 bp, Neisseria meningitidis
  CDS (1)..(1446)
atgagtacacaaacaaattttgatttggtgttgttcggtgcgaccggcgatttggcaatgcgcaaacttttgccctgcctgtatcaggcgcacgtggccggtttgcttcatcccgaaggtcgtattttgggtgtgagccgcagcgaattggataccgaaggttttctggcgaaggtggaaaccagttccaaaatccatgtgaaagaaaatttttccgatgaggcttgggcatcgtttgtcgaacgtctcgcatatctcaaagtcgatgttacgcagccggacgattttgctgctttgggcgatttggtcaaagcgcgcaagaatactgaaaatgtcgtgatctacctctcaactgcgccgaaattctttgcgcaagcctgcgagaaccttgctgcgatcggtttgaatgccgacaacgtgcgcgtggttttggaaaaaccgttgggtacggacttggcttcttcccaacaaatcaatactgatgttgcgcgttatttcaaagaagggcaaatttaccgcatcgaccactaccttggcaaagaaagcctgcaaaacctgcttgcgctgcgttttgccaatgtaatgttcgagccgctgtggaacaataaatatatcgaaagcgtgcagttgaccatcgccgaacagctcggtgtggaagagcgcggtgagttttacgacattaccggcgcgttgcgcgatatggtgcaaaaccatttgatgcagatgttgtgcatgactgcgatggaagcccccgccagcttggatgccgacgcggtgcgcgatgaaaaagtcaaagtcatcaagtcattgaagccgctgaccgtcgaatctgtcaatgaaaacgtcgtgcgcggacaatataccgccgccaaaggcatgaacggctatcttgaagaaatcaacgttctgcaagacagctttaccgaaacctacgtcgccattaaagccgaaatcgaaaacgaacgctggaagggcgttcccttctacctgcgtaccggcaagcgcatggcgggcaaagtggcggaaatcgttttgaacttcaaagatttgaacagccatatttttgaaggcagccgcaccgcgcccaaccggctcgttatcgagttgcaaccatatgaatccgtgcgcctctatacgcagatgaaaaccccgggggcaggaaataaggtcgaaaccgtgccgctggcaaccgatttgggcaaggcattggaaagccgccgcgcggaagcttacgagcgcctgctgctggatgtgattaacggcaaactcgctttgtttaaccgccgcgacgaacttgaagccgcgtgggaatatgtgatgccgattttggaaaactggacaaataacaccacgccgccgcacggctacggcgcacactcgtgggggcctgaagccgcgcgcgaactattggcgcgcgacggacacaagtggcacgaagagcagtaa

SEQ ID NO: 2429 - protein, 481 aa, Neisseria meningitidis
MSTQTNFDLVLFGATGDLAMRKLLPCLYQAHVAGLLHPEGRILGVSRSELDTEGFLAKVETSSKIHVKENFSDEAWASFVERLAYLKVDVTQPDDFAALGDLVKARKNTENVVIYLSTAPKFFAQACENLAAIGLNADNVRVVLEKPLGTDLASSQQINTDVARYFKEGQIYRIDHYLGKESLQNLLALRFANVMFEPLWNNKYIESVQLTIAEQLGVEERGEFYDITGALRDMVQNHLMQMLCMTAMEAPASLDADAVRDEKVKVIKSLKPLTVESVNENVVRGQYTAAKGMNGYLEEINVLQDSFTETYVAIKAEIENERWKGVPFYLRTGKRMAGKVAEIVLNFKDLNSHIFEGSRTAPNRLVIELQPYESVRLYTQMKTPGAGNKVETVPLATDLGKALESRRAEAYERLLLDVINGKLALFNRRDELEAAWEYVMPILENWTNNTTPPHGYGAHSWGPEAARELLARDGHKWHEEQ

SEQ ID NO: 2430 - DNA, 1296 bp, Aquifex aeolicus
  CDS (1)..(1296)
atgagttcgggagacacagagttaagaaaaaggattgaatttataatcttcggcggaaccggggatctgagcagaaataaattaattcccgcaatcctgaaactgaaagacaaaatagatttaaagaagatttacattttaggcaggaataggaaaaagtttgaagaaataaaagaaaagtttaaggatttttcagagttattcgtgttcgtagaattcctcgcggagagggaagagagttataaaaatatatcaagtattttaggaaaagaatctttaaaagttttttaccttgcggtacctcccgacctattcaaggaaattctagaaaacgtaggaaaatacctgaactttccagaaaaacgtattgttattgaaaaacctttcggcctcagcttaaagcacgcaaaggacttaaacaaaataatttccgtttatttcaaagaagaagaaatcttcagaatagatcactacctcggaaagccgcaggttcaaaatatactcgcctttaagttctcaaattacgtgttttccgaagtcttaaacaagtgtcttgtagagaaggtggaggtaattgcccttgaagaggtgggagtagagggcagaaaagcttattacgagaaagtgggagtcataagggacatgctacagaatcacatgttgctcctctcctctttaatcgttatgagactccctccaagggcggaggacttccactttgagctgaagaacgccttaaagcgtgccgagtttgagtccgagagcttgatactcggaaagtacaaaagttatcaaggaaaagctcccacttttgcccttgtaaaactccactttgacgacgagcgtttcaccggagtgcctttcgtactcgccacgggaaaaaagttaaagaaaaaattgacgagggtgtgcatccactttaagaacttcccgaaggagattgaacggcttctcggctgcgttcctgagagaaatttactcgtttttgaactctatccagagcaggaagtttcctttagggtaaacgttatatctccacttggctttttgaggtgtacggaaagtattaactggagagtttccctcaaagacgttctgggagaaattcccgaagcttacgagtccctccttctggacgtcataaggggagacaagacgctctttctggacgcagaggagacggagatactctgggaaaaaacagaacctctattgaaaaaagaaaaggaagttttgacttacgatgacagagtccttattccagaatttgcagaggatttcatttcctgcctttga

SEQ ID NO: 2431 - protein, 431 aa, Aquifex aeolicus
MSSGDTELRKRIEFIIFGGTGDLSRNKLIPAILKLKDKIDLKKIYILGRNRKKFEEIKEKFKDFSELFVFVEFLAEREESYKNISSILGKESLKVFYLAVPPDLFKEILENVGKYLNFPEKRIVIEKPFGLSLKHAKDLNKIISVYFKEEEIFRIDHYLGKPQVQNILAFKFSNYVFSEVLNKCLVEKVEVIALEEVGVEGRKAYYEKVGVIRDMLQNHMLLLSSLIVMRLPPRAEDFHFELKNALKRAEFESESLILGKYKSYQGKAPTFALVKLHFDDERFTGVPFVLATGKKLKKKLTRVCIHFKNFPKEIERLLGCVPERNLLVFELYPEQEVSFRVNVISPLGFLRCTESINWRVSLKDVLGEIPEAYESLLLDVIRGDKTLFLDAEETEILWEKTEPLLKKEKEVLTYDDRVLIPEFAEDFISCL

SEQ ID NO: 2432 - DNA, 1491 bp, Thermotoga maritima
  CDS (1)..(1491)
atgaagtgcagtctgggattggagaaatgtccggatgataccctccggtgttttccaaagatcgaacaacctttcggaattgtgatcttcggtgcttctggtgacctcacaaaaagaaagctcattcccgctttgaacaggttgttcgaggcaggtattctgcccgaacgctttttcgttctcggtgcggcacgaacgaaaatggacgataagaaattcagatccagattcgatgccaaccctgattttttggaacattgcagttacatcagcgtggattatcaggatcctgagagcttcaaacagttgaaaaacaccatcgagactctcataaaaaggatcgattccagcaatctggtcttctatctcgctgttcctccggatctttacatccctattctggaaaacctctcgaaaactggattgaacgaaaaacctgcgcgcgttgtgatcgaaaaaccgttcgggaaagacctggaatcggccagaagactggaagacactcttcagaaatacttccaggaagatcagattttcagaatcgatcattaccttggaaaagaaaccgttcagaacatactggtgttcaggtttgccaacttcatattcgaggaaatctggaacaacaagttcgtggatcacgttcagatcacgatggccgaagacataggtgttgaacacagggcaggatacttcgaaaacgtgggactcctcagggatatcttccagaaccacatgcttcagatcctcgcactgatcgccatggaacctccttcttctttcaatggagagaatttcagaaacgagcgggtgaagcttctcagatcgatcagaccgttccctgtggaggaactggaaagctggatcgtcagaggccagtatggaagaggggttgtgaacggaaaagaagtgccggcttacagagaggaaccgggtgtggccaaagactccaacgtggaaaccttcgttgccatgaaactcttcatagacaactggagatggagcggtgtacccttctatctgaggtccgggaagagactccccaagaaaataaccgaggttgctgttgttttcaagaagattcctcattcgatctttgccggtgtaccttctgatgaactggagccgaacacgatagttttcaccttgcagccaaacgagggaatctctcttgagtttcaggtgaaaaggccctgtcccggcatgtttccacagcttctcagtatggacttcagatacgaggattactttggagtgaaactgcccgacgcttacgaaagactccttctggacgtgatacttggagatcctacacttttcatgagaagagacgacctcgaagtttcctgggaacttctcgatcccgttctcaaagcctgggaaaacgatcccgttcgcttttcaccttatgtgtatccggcgggaacgtggggaccgagagaagccgatctactcatagaaagggacggtagaaaatggagaaaactgtga

SEQ ID NO: 2433 - protein, 496 aa, Thermotoga maritima
MKCSLGLEKCPDDTLRCFPKIEQPFGIVIFGASGDLTKRKLIPALNRLFEAGILPERFFVLGAARTKMDDKKFRSRFDANPDFLEHCSYISVDYQDPESFKQLKNTIETLIKRIDSSNLVFYLAVPPDLYIPILENLSKTGLNEKPARVVIEKPFGKDLESARRLEDTLQKYFQEDQIFRIDHYLGKETVQNILVFRFANFIFEEIWNNKFVDHVQITMAEDIGVEHRAGYFENVGLLRDIFQNHMLQILALIAMEPPSSFNGENFRNERVKLLRSIRPFPVEELESWIVRGQYGRGVVNGKEVPAYREEPGVAKDSNVETFVAMKLFIDNWRWSGVPFYLRSGKRLPKKITEVAVVFKKIPHSIFAGVPSDELEPNTIVFTLQPNEGISLEFQVKRPCPGMFPQLLSMDFRYEDYFGVKLPDAYERLLLDVILGDPTLFMRRDDLEVSWELLDPVLKAWENDPVRFSPYVYPAGTWGPREADLLIERDGRKWRKL

SEQ ID NO: 2434 - DNA, 1518 bp, Saccharomyces cerevisiae
  CDS (1)..(1518)
atgagtgaaggccccgtcaaattcgaaaaaaataccgtcatatctgtctttggtgcgtcaggtgatctggcaaagaagaagacttttcccgccttatttgggcttttcagagaaggttaccttgatccatctaccaagatcttcggttatgcccggtccaaattgtccatggaggaggacctgaagtcccgtgtcctaccccacttgaaaaaacctcacggtgaagccgatgactctaaggtcgaacagttcttcaagatggtcagctacatttcgggaaattacgacacagatgaaggcttcgacgaattaagaacgcagatcgagaaattcgagaaaagtgccaacgtcgatgtcccacaccgtctcttctatctggccttgccgccaagcgtttttttgacggtggccaagcagatcaagagtcgtgtgtacgcagagaatggcatcacccgtgtaatcgtagagaaacctttcggccacgacctggcctctgccagggagctgcaaaaaaacctggggcccctctttaaagaagaagagttgtacagaattgaccattacttgggtaaagagttggtcaagaatcttttagtcttgaggttcggtaaccagtttttgaatgcctcgtggaatagagacaacattcaaagcgttcagatttcgtttaaagagaggttcggcaccgaaggccgtggcggctatttcgactctataggcataatcagagacgtgatgcagaaccatctgttacaaatcatgactctcttgactatggaaagaccggtgtcttttgacccggaatctattcgtgacgaaaaggttaaggttctaaaggccgtggcccccatcgacacggacgacgtcctcttgggccagtacggtaaatctgaggacgggtctaagcccgcctacgtggatgatgacactgtagacaaggactctaaatgtgtcacttttgcagcaatgactttcaacatcgaaaacgagcgttgggagggcgtccccatcatgatgcgtgccggtaaggctttgaatgagtccaaggtggagatcagactgcagtacaaagcggtcgcatcgggtgtcttcaaagacattccaaataacgaactggtcatcagagtgcagcccgatgccgctgtgtacctaaagtttaatgctaagacccctggtctgtcaaatgctacccaagtcacagatctgaatctaacttacgcaagcaggtaccaagacttttggattccagaggcttacgaggtgttgataagagacgccctactgggtgaccattccaactttgtcagagatgacgaattggatatcagttggggcatattcaccccattactgaagcacatagagcgtccggacggtccaacaccggaaatttacccctacggatcaagaggtccaaagggattgaaggaatatatgcaaaaacacaagtatgttatgcccgaaaagcacccttacgcttggcccgtgactaagccagaagatacgaaggataattag

SEQ ID NO: 2435 - protein, 505 aa, Saccharomyces cerevisiae
MSEGPVKFEKNTVISVFGASGDLAKKKTFPALFGLFREGYLDPSTKIFGYARSKLSMEEDLKSRVLPHLKKPHGEADDSKVEQFFKMVSYISGNYDTDEGFDELRTQIEKFEKSANVDVPHRLFYLALPPSVFLTVAKQIKSRVYAENGITRVIVEKPFGHDLASARELQKNLGPLFKEEELYRIDHYLGKELVKNLLVLRFGNQFLNASWNRDNIQSVQISFKERFGTEGRGGYFDSIGIIRDVMQNHLLQIMTLLTMERPVSFDPESIRDEKVKVLKAVAPIDTDDVLLGQYGKSEDGSKPAYVDDDTVDKDSKCVTFAAMTFNIENERWEGVPIMMRAGKALNESKVEIRLQYKAVASGVFKDIPNNELVIRVQPDAAVYLKFNAKTPGLSNATQVTDLNLTYASRYQDFWIPEAYEVLIRDALLGDHSNFVRDDELDISWGIFTPLLKHIERPDGPTPEIYPYGSRGPKGLKEYMQKHKYVMPEKHPYAWPVTKPEDTKDN

SEQ ID NO: 2436 - DNA, 1494 bp, Kluyveromyces marxianus var. lactis, Candida sphaerica
  CDS (1)..(1494)
atggctactcagtttgacgagaacactgtgatcactatttttggtgcttcaggtgatttatcaaagaagaaaacgtttcctgcattattcgggttatatcgtgaaggatatttgaatccaactacaaaaattattgggtatgcgcgttccaagttgagcaacgaggatttaagagaaaaggtaaagccatttttaaagaaacctaacggagctaaggatgatgctaaagtcaatgaatttttatcgatggtttcttaccatgctggtccgtatgattctgatgaaggttacttggagttgaaaaagattatcgaagagtttgaggctgaaaaaaaggtcgatgaacctcatagactcttttacttagccttgcctcctagtattttcattgacgtgtgttcgaaactaaaggaaaacctatacacagaatctggaattcaaagggttattgtggaaaagccttttggtcacgatctacagtctgctactgaattacaggagaagttggcgccattgttttccgaggacgaattgttcagaattgatcattatttgggtaaagagatggtaaaaaatctattgttgatgagattcggtaacactttcttgaacgccgcttggaacaaagaaaatatacaatctgttcaggtggttttcaaggaaccatttggaactgaaggtcgtggtggttacttcgattcaattggtattataagagatgtgatgcagaatcatttgctacaagtgttaactctattgacgatggaaagaccagtatctttcgacccagaatctgtacgtgacgaaaaggtcaaggttttgaaagcattctctccaattgatcatgacgatatattgataggccaatacggaagatctgtggatggtagcaagcctagctacctagatgatgaaactgtcaaagaggactccaagtgtgtcacctttgcagcaatcggattcaaaattgcaaatgaacgttgggatggagttcccatcgttatgagagcaggaaaagcgttgaacgaaggtaaagtagaaatcagaatccagttcagaagagttgcatctggcatgttcactgatattcctaataatgaattggttattagaattcaaccaaatgaagccatctacttgaagtgtaatgccaaaacacctggtcttgcgaatgaaaaccaaaccacagaactagacttgacttactcagagagatacaaaaactattggattcctgaagcatatgaatctttgataagagatgcccttttaggagatcattcaaatttcgtcagagacgatgaattagacgtaagctggaagctatttactccattgcttaattacttggaaggaccagatggacctcaaccaaagatctatccatatggctgtagaagccctgacggactcgttgagtttttagcagaccatggttacaccttttccaaaccaggatcctaccaatggcctgtcaccactcctaaaatgtaa

SEQ ID NO: 2437 - protein, 497 aa, Kluyveromyces marxianus var. lactis, Candida sphaerica
MATQFDENTVITIFGASGDLSKKKTFPALFGLYREGYLNPTTKIIGYARSKLSNEDLREKVKPFLKKPNGAKDDAKVNEFLSMVSYHAGPYDSDEGYLELKKIIEEFEAEKKVDEPHRLFYLALPPSIFIDVCSKLKENLYTESGIQRVIVEKPFGHDLQSATELQEKLAPLFSEDELFRIDHYLGKEMVKNLLLMRFGNTFLNAAWNKENIQSVQVVFKEPFGTEGRGGYFDSIGIIRDVMQNHLLQVLTLLTMERPVSFDPESVRDEKVKVLKAFSPIDHDDILIGQYGRSVDGSKPSYLDDETVKEDSKCVTFAAIGFKIANERWDGVPIVMRAGKALNEGKVEIRIQFRRVASGMFTDIPNNELVIRIQPNEAIYLKCNAKTPGLANENQTTELDLTYSERYKNYWIPEAYESLIRDALLGDHSNFVRDDELDVSWKLFTPLLNYLEGPDGPQPKIYPYGCRSPDGLVEFLADHGYTFSKPGSYQWPVTTPKM

SEQ ID NO: 2438 - DNA, 2813 bp, Erwinia chrysanthemi
  CDS (322)..(1797)
atcgatgcggattttgtgaaatatactacgagcccgtaacggttggcagaggtcgacacaacaagtcatcagctttttttgtcagaatatgacgtgtgtctaacctttcaaaatagtaactggcctgtcagaaacgatgggaaatttctcttttaggcagatgccagacccgttttcttcatcggcacaataggttctgaggccttgtagtatcggaatcagccgataatgtggttttcttacgggtttactggtttgtgtcaaaaagagtacattattaatgtaataaaattacagcgtcgtgcaatgaggagattgaaaatggcggtaacgtcaacagcccaggcgtgtgacctggttattttcggtgcaaagggcgaccttgcgcgccgcaaattgctgccttcactgtatcaactggaaaaagcaggccatattcatccggaaacccgcattatcggcgtgggacgggcggagtgggaccgagacgcctatatcaaagtggtgcgcgaagcgctggaaacctttctcaaggagccgctcgacccggcattgtggacaaccctgagcaatcggctcgacttttgcaaccttgatgtggaagacaccgagggattcaaacggttgggtacgatgctcgatcagcaaaatcgcaccaccatcaattatttcgccatgccgccgagcaccttcggcgctatctgccgcggtctggggcaggccggcctgaacaaggagccggcacgcgtggtgatggaaaaaccgctgggcaccaatctggcgtcgtcacgggtgatcaacaatcaggtagcggagtttttcaacgaatgtcaggtctaccgcatcgaccactatctcggcaaggaaaccgtgctgaacctgctggcactgcgtttcgccaactccctgttcgccaacaactgggataaccgcactatcgatcacgtgcagattaccgtggcggaagaggtgggtattgaagggcgctgggggtatttcgatcaggccgggcaaatgcgcgacatgatccagaaccacctgttgcagattctgaccatgattgccatgtcgccgccggcggatctgagcaccgatcgcattcgtgatgaaaaggtgaaagtcctgcgttcgctgcgccgtatcgatcgttccaatgtgcatgaagtgacggtccgtgggcagtacaccagcggttttgtgcagggcaagaaagtgccgggctacctggaagaagaaggggccaacaagaccagtaataccgaaaccttcgtggccattcgcgtcgatatcgacgactggcgctggtccggcgtgccgttttatctgcgcaccggcaagcgtctgccgtcaaaatgttcggaagtggtggtctactttaaaaacccggcgctcaacctgttccatgattcctatcagcagttgccgcagaataagctgatcatccgcctgcagccggacgaaggggtagaaattcagattctgaacaagattccggggctggaccacaaacatcggttgcagaccaccaagctcgacctgagcttctcggaaacttttaaccagcaacatctggcggacgcctatgagcgcctgttgctggaaaccatgcgtggtattcaggcgctgttcgtgcgccgcgacgaagtggaagaagcctggaaatgggtggattccattatggatgcctgggcaatggacaatgattcccccaaaccttatcaggccgggacctgggggccggtcgcgtccgtcgccatgattacccgcgatgggcgttcctggaacgaagtggaataagcggttttgccccgtcggcaggcgggcgaagccgttagcgttttttagctgacggtgcggtcggacgtccgtgggtaaccgcggatccctgtggcaggggcgcgccagatcattaatcgatgcccgttgggcatgactggagattaccctcgatgaaaaactggaaaaccagtgcggaacagattctgacagccggtccggttgttcctgtgattgtgattaacaaactggaacacgcggtaccgatggcgaaagccctggtagcgggtggcgtgcgtgtgctggagctgacgctgcgtaccgagtgtgcggtagaggcgattcgcctgatcgcgcaggaagtgccggatgctatcgtcggcgccggtacggtcaccaacccgcaacagctggcggaagtgaccgcagccggtgcgcagtttgccatcagccccggcctgaccgagccgctgctgaaagccgcaacggaaggcactattccattgatcccagggatcagcaccgtatccgaactgatgctggggatggattacggtttgcgcgagtttaaatttttcccggcggaagctaacggcggggtaaaagcgctgcaggcgattgccggtccgttcggcaagattcgtttctgcccgaccggtgggatctcactgaagaattaccgcgactacctggcgctgaagagcgtgctgtgcgtcggcggctcctggctggtgccggccgatgcgctggaaagcggcgattacgatcgcatcacggcgttggcgcgtgaagctgttgccggcgcgacagcctgatcgacgttttaccttattctttctcaagcccgctttcgcgggcttttttgtgctcggtaggcgagccgacaaaccgcgttgtgcctgtttaagcgacatcggtcgtcacaacaaaccgctgtctggaaaccgttgtctggataccattgtctggcgtacgattctggcgttatcgggagagaattcaggctcatgccggcgcatgagcctgatatgacctca

SEQ ID NO: 2439 - protein, 491 aa, Erwinia chrysanthemi
MAVTSTAQACDLVIFGAKGDLARRKLLPSLYQLEKAGHIHPETRIIGVGRAEWDRDAYIKVVREALETFLKEPLDPALWTTLSNRLDFCNLDVEDTEGFKRLGTMLDQQNRTTINYFAMPPSTFGAICRGLGQAGLNKEPARVVMEKPLGTNLASSRVINNQVAEFFNECQVYRIDHYLGKETVLNLLALRFANSLFANNWDNRTIDHVQITVAEEVGIEGRWGYFDQAGQMRDMIQNHLLQILTMIAMSPPADLSTDRIRDEKVKVLRSLRRIDRSNVHEVTVRGQYTSGFVQGKKVPGYLEEEGANKTSNTETFVAIRVDIDDWRWSGVPFYLRTGKRLPSKCSEVVVYFKNPALNLFHDSYQQLPQNKLIIRLQPDEGVEIQILNKIPGLDHKHRLQTTKLDLSFSETFNQQHLADAYERLLLETMRGIQALFVRRDEVEEAWKWVDSIMDAWAMDNDSPKPYQAGTWGPVASVAMITRDGRSWNEVE

SEQ ID NO: 2440 - DNA, 1645 bp, Aspergillus niger
  CDS (68)..(1600)
cttccctcctccaccgaatctctcacctttccttcccatctcgtggttgttcacacatcagtaaaacatggccagcacaatagcacgcactgaggaacgccagaatgctggcaccatggagctcaaagatgacactgtcatcatagtactgggtgcctccggagatcttgcaaagaagaagaccttcccggcccttttcggcctttatcgcaacaagttcctccccaagggaatcaagatcgtcggatatgcccggacaaacatggaccatgaggagtacctgaggcgtgtgcgctcatacatcaagacccctaccaaggaaatcgaagagcagctggacagcttctgccagttctgcacctacatttccggtcaatatgacaaggatgactcgttcatcaacctcaacaagcacctcgaggagattgagaagggccagaaggagcagaacagaatctactacatggccctcccccccagcgttttcaccaccgtttccgaccaacttaagcgcaactgctaccccaagaacggcgttgcccgtatcatcgtagagaagcctttcggcaaggaccttcagagctcgcgcgatctccaaaaagccctggagcctaactggaaggaagaggagatcttccgtatcgaccactacctgggtaaggagatggtcaagaacatccttatcatgcgcttcggaaacgaattcttcaacgccacctggaaccgtcaccacatcgataacgttcagatcacattcaaggagcccttcggcactgagggacgtggtggttacttcgatgaattcggcatcatccgtgatgtcatgcagaaccaccttctccaggtgttgacgctgctcgctatggagcgccccatttccttctccgccgaggacatccgtgacgagaaggttcgtgtcctccgtgcgatggacgccattgagcccaagaacgtcattattggccagtacggaaagtctctggatggcagcaagcccgcctacaaggaggacgagaccgttccccaggattcccgctgccccaccttctgcgctatggtcgcctacatcaagaacgagaggtgggacggtgttcctttcatcatgaaggctggcaaggccttgaacgagcagaagaccgagatccgtatccagttccgtgacgttacctccggaattttcaaggacatccctcgcaacgagctcgttatccgcgtccagcccaacgagtccgtgtacatcaagatgaactccaagctgcctggcctgtccatgcagacggttgtgactgagctcgacctcacctaccgccgccgcttctccgacctcaagatccccgaagcctacgagtctctgatcctggatgctctgaagggcgaccactccaacttcgtccgtgacgatgagctggatgccagctggaggatcttcacccctctcctgcactacctggatgacaacaaggagatcatccccatggaatacccctacggctcccgcggacccgccgtccttgatgacttcaccgcgtccttcggctacaagttcagcgatgctgctggctaccagtggcccttgacttccacccccaaccgtctgtaaataagggcggtcggcaggttatgacggatgaggatgaaaaaaaaa

SEQ ID NO: 2441 - protein, 510 aa, Aspergillus niger
MASTIARTEERQNAGTMELKDDTVIIVLGASGDLAKKKTFPALFGLYRNKFLPKGIKIVGYARTNMDHEEYLRRVRSYIKTPTKEIEEQLDSFCQFCTYISGQYDKDDSFINLNKHLEEIEKGQKEQNRIYYMALPPSVFTTVSDQLKRNCYPKNGVARIIVEKPFGKDLQSSRDLQKALEPNWKEEEIFRIDHYLGKEMVKNILIMRFGNEFFNATWNRHHIDNVQITFKEPFGTEGRGGYFDEFGIIRDVMQNHLLQVLTLLAMERPISFSAEDIRDEKVRVLRAMDAIEPKNVIIGQYGKSLDGSKPAYKEDETVPQDSRCPTFCAMVAYIKNERWDGVPFIMKAGKALNEQKTEIRIQFRDVTSGIFKDIPRNELVIRVQPNESVYIKMNSKLPGLSMQTVVTELDLTYRRRFSDLKIPEAYESLILDALKGDHSNFVRDDELDASWRIFTPLLHYLDDNKEIIPMEYPYGSRGPAVLDDFTASFGYKFSDAAGYQWPLTSTPNRL

SEQ ID NO: 2442 - DNA, 1785 bp, Medicago sativa (alfalfa)
  CDS (38)..(1585)
ccaccagatataattaagtagatcagagtagaagaagatgggaacaaatgaatggcatgtagaaagaagagatagcataggtactgaatctcctgtagcaagagaggtacttgaaactggcacactctctattgttgtgcttggtgcttctggtgatcttgccaagaagaagacttttcctgcactttttcacttatataaacaggaattgttgccacctgatgaagttcacatttttggctatgcaaggtcaaagatctccgatgatgaattgagaaacaaattgcgtagctatcttgttccagagaaaggtgcttctcctaaacagttagatgatgtatcaaagtttttacaattggttaaatatgtaagtggcccttatgattctgaagatggatttcgcttgttggataaagagatttcagagcatgaatatttgaaaaatagtaaagagggttcatctcggaggcttttctatcttgcacttcctccttcagtgtatccatccgtttgcaagatgatcaaaacttgttgcatgaataaatctgatcttggtggatggacacgcgttgttgttgagaaaccctttggtagggatctagaatctgcagaagaactcagtactcagattggagagttatttgaagaaccacagatttatcgtattgatcactatttaggaaaggaactagtgcaaaacatgttagtacttcgttttgcaaatcggttcttcttgcctctgtggaaccacaaccacattgacaatgtgcagatagtatttagagaggattttggaactgatggtcgtggtggatattttgaccaatatggaattatccgagatatcattccaaaccatctgttgcaggttctttgcttgattgctatggaaaaacccgtttctctcaagcctgagcacattcgagatgagaaagtgaaggttcttgaatcagtactccctattagagatgatgaagttgttcttggacaatatgaaggctatacagatgacccaactgtaccggacgattcaaacaccccgacttttgcaactactattctgcggatacacaatgaaagatgggaaggtgttcctttcattgtgaaagcagggaaggccctaaattctaggaaggcagagattcgggttcaattcaaggatgttcctggtgacattttcaggagtaaaaagcaagggagaaacgagtttgttatccgcctacaaccttcagaagctatttacatgaagcttacggtcaagcaacctggactggaaatgtctgcagttcaaagtgaactagacttgtcatatgggcaacgatatcaagggataaccattccagaggcttatgagcgtctaattctcgacacaattagaggtgatcaacaacattttgttcgcagagacgaattaaaggcatcatggcaaatattcacaccacttttacacaaaattgatagaggggagttgaagccggttccttacaacccgggaagtagaggtcctgcagaagcagatgagttattagaaaaagctggatatgttcaaacacccggttatatatggattcctcctaccttatagagtgaccaaatttcataataaaacaaggattaggattatcaggagcttataaataagtcttcaataagcttgtgaaattttcgttataatctctctcattttggggtgtatatcaagcatttaagcgcgtgtttgacacagtttgtgtaatagatttggctctgaatgaaaataaacgggaattgtttctttttgtttta

SEQ ID NO: 2443 - protein, 515 aa, Medicago sativa (alfalfa)
MGTNEWHVERRDSIGTESPVAREVLETGTLSIVVLGASGDLAKKKTFPALFHLYKQELLPPDEVHIFGYARSKISDDELRNKLRSYLVPEKGASPKQLDDVSKFLQLVKYVSGPYDSEDGFRLLDKEISEHEYLKNSKEGSSRRLFYLALPPSVYPSVCKMIKTCCMNKSDLGGWTRVVVEKPFGRDLESAEELSTQIGELFEEPQIYRIDHYLGKELVQNMLVLRFANRFFLPLWNHNHIDNVQIVFREDFGTDGRGGYFDQYGIIRDIIPNHLLQVLCLIAMEKPVSLKPEHIRDEKVKVLESVLPIRDDEVVLGQYEGYTDDPTVPDDSNTPTFATTILRIHNERWEGVPFIVKAGKALNSRKAEIRVQFKDVPGDIFRSKKQGRNEFVIRLQPSEAIYMKLTVKQPGLEMSAVQSELDLSYGQRYQGITIPEAYERLILDTIRGDQQHFVRRDELKASWQIFTPLLHKIDRGELKPVPYNPGSRGPAEADELLEKAGYVQTPGYIWIPPTL

SEQ ID NO: 2444 - DNA, 1689 bp, Solanum tuberosum (potato)
  CDS (46)..(1581)
gatcacaactcacaaggctgaattgagttcaagctggttgtcaagatggcggcatcatggtgtattgagaaaaggggttctattaggaatgactcttttagagacaatgataatatacctgaaactgggtgtctttctattattgttcttggtgcttctggtgatcttgccaagaagaaaacttttcctgctctcttcaacctctaccgccagggatttcttcaatccaatgaagttcacatttttggctacgcaaggacaaaaatttctgatgatgacttgagaagccgtatccgtgggtatctttctcaggggaaagaaaatgaaggagaagtatcagagtttctgcaactgattaaatacgtcagtggttcttatgattctgctgagggatttacgtcactggataaggcaatatctgagcacgaattctcaaaaaatagcacagaaggatcatccagaagactcttctattttgctcttcctccatcagtatatccctctgtttgcagaatgataaaaagttattgtatgaacaaatctgatcttggtggttggacacggactgttgttgagaagcccttcggcaaggatttagcttcatctgaacaactaagttcccagatcggagaactatttgacgaaccccaaatttatcgcattgaccattatttggggaaggagttggttcagaatttgttggtgctgcgttttgcaaatcgcttctttttgccgctctggaatcgtgacaacattgataatatacagattgtctttagagaggactttggaactgagggccgcggtggatattttgatgaatatgggattatacgtgacattattcagaaccatctattgcaggtcctttgccttgttgccatggagaagcctgtttctcagaagcccgaacacattcgggacgagaaagttaaggttcttcaatcaatgcttccaattgaagatgaagaggttgttcttggacaatatgaaggctataaggatgatccaacggttcctaacaactcaaatactcctacttttgctactatggttttacgcatacacaatgaaagatgggaaggtgtcccctttataatgaaggctggaaaagcactaaattcaagaaaggcagaaatacgagtgcagtttaaggatgttcctggtgatatatttagatgtcaaaagcaggggagaaatgagtttgtgatacgcctccaaccttcagaagccatgtacatgaagcttacggtcaagaaacctgggcttgaaatgtcaactgttcaaagtgaattagacctgtcgtatgggcagcgttaccaaggggtcgtcattccagaggcttatgaacgtctgattctcgacacaataagaggggatcagcagcattttgtgcgtagggatgagctcaaggcggcttgggagatttttacccctcttttgcatagaattgacaatggagaggtgaagccaattccatacaagccaggcagcagaggccctgctgaagcagatgagttgttgcaaaatgccggttacgttcaaactcatggctatatatggatccctcccacactataagtttggaaaagtattgcagatgagtgttaccttgtcacttttgccatgtagtaccctgcctatgtgcaaacttattgagaagtaacaaatagtccgtgtatcacaaat

SEQ ID NO: 2445 - protein, 511 aa, Solanum tuberosum (potato)
MAASWCIEKRGSIRNDSFRDNDNIPETGCLSIIVLGASGDLAKKKTFPALFNLYRQGFLQSNEVHIFGYARTKISDDDLRSRIRGYLSQGKENEGEVSEFLQLIKYVSGSYDSAEGFTSLDKAISEHEFSKNSTEGSSRRLFYFALPPSVYPSVCRMIKSYCMNKSDLGGWTRTVVEKPFGKDLASSEQLSSQIGELFDEPQIYRIDHYLGKELVQNLLVLRFANRFFLPLWNRDNIDNIQIVFREDFGTEGRGGYFDEYGIIRDIIQNHLLQVLCLVAMEKPVSQKPEHIRDEKVKVLQSMLPIEDEEVVLGQYEGYKDDPTVPNNSNTPTFATMVLRIHNERWEGVPFIMKAGKALNSRKAEIRVQFKDVPGDIFRCQKQGRNEFVIRLQPSEAMYMKLTVKKPGLEMSTVQSELDLSYGQRYQGVVIPEAYERLILDTIRGDQQHFVRRDELKAAWEIFTPLLHRIDNGEVKPIPYKPGSRGPAEADELLQNAGYVQTHGYIWIPPTL

SEQ ID NO: 2446 - DNA, 1530 bp, Synechocystis sp
  CDS (1)..(1530)
atggtaacgctactcgaaaatcccttccgcactggactccgtcaagaacgcactccagaacccctcattttgaccatttttggtgcatccggggaccttacccaacggaaattggtgccagccatctaccaaatgaaacgagagcgccgcttgcctccagagttaacggtggtcggttttgcgagaagggactggagccacgaccattttcgtgagcagatgcgtaagggcatcgaagaattttccaccggcattggcagtgaagacctgtggaatgagtttgcccagggtttattctactgctctggcaatatggatgacccagaaagctatctcaaattgaaaaacttcctgggggaattggatgaaaaacgtaacaccagaggcaatcgagtcttttatttagctgtttcccccaacttctttcccccgggtattaaacaattgggggcagcgggtatgctgagtgacccggttaaaagtcgcattgtgatcgaaaagccctttggtcgggatttgagttcagcccaaagcttgaaccgggtagtgcagagtgtctgcaaagaaaatcaggtgtatcgcatcgatcattacctgggcaaagaaacggtgcaaaatctgatggtgttccgctttgccaacgctatttttgagccactgtggaaccgtcagtttgttgatcatgtgcaaattaccgtagcagaaacggtaggggtagaagaacgagccggttattacgaatccgccggggctttacgagatatggtgcagaatcacctcatgcaactgttttgtctcaccgccatggacccccccaatgccattgacgcggacagcattcgcaacgaaaaggttaaagtgttgcaggctacccgtttagcggatattaataatttggaaaatgccggtatccggggccaatataaagctggttggatgggaggcaaaccagtgccgggttatcgagaagaaccgggggtagatccaagttccaccactcctacctttgcggccctcaaactgatggtggataactggcgttggcagggggtgcccttctatctacgcacgggtaagcgcatgcctaaaaaagtgagtgaaatcgcaattcaattccggcaagtacctctgttaatttttcaatcggtggcccaccaagctaatcccaatgtgttgagtctaagaattcagcccaacgaaggcatttccctgcgttttgaggcaaaaatgcccggttcagaactgcgtacccgcactgtagatatggattttagttatggttcatcctttggagtggccgcagcggatgcctatcaccgccttttattagattgtatgttgggagaccaaaccctgttcacaagagccgacgaggtagaagaagcttggcgagtagtaactccggtgttgtcggcttgggatgcccccagtgatcctctttccatgcccttgtacgaagctggaacctgggaaccagcggaggcagaatggttaattaataaagatggccgtcgctggcgccgactttag

SEQ ID NO: 2447 - protein, 509 aa, Synechocystis sp
MVTLLENPFRTGLRQERTPEPLILTIFGASGDLTQRKLVPAIYQMKRERRLPPELTVVGFARRDWSHDHFREQMRKGIEEFSTGIGSEDLWNEFAQGLFYCSGNMDDPESYLKLKNFLGELDEKRNTRGNRVFYLAVSPNFFPPGIKQLGAAGMLSDPVKSRIVIEKPFGRDLSSAQSLNRVVQSVCKENQVYRIDHYLGKETVQNLMVFRFANAIFEPLWNRQFVDHVQITVAETVGVEERAGYYESAGALRDMVQNHLMQLFCLTAMDPPNAIDADSIRNEKVKVLQATRLADINNLENAGIRGQYKAGWMGGKPVPGYREEPGVDPSSTTPTFAALKLMVDNWRWQGVPFYLRTGKRMPKKVSEIAIQFRQVPLLIFQSVAHQANPNVLSLRIQPNEGISLRFEAKMPGSELRTRTVDMDFSYGSSFGVAAADAYHRLLLDCMLGDQTLFTRADEVEEAWRVVTPVLSAWDAPSDPLSMPLYEAGTWEPAEAEWLINKDGRRWRRL

SEQ ID NO: 2448 - DNA, 2047 bp, Arabidopsis thaliana (mouse-ear cress)
  CDS (51)..(1850)
gtttgcatccaaatccaattcataactcacactcgtctcaaattcgaaaaatgtcgtctctctcctgccctacctaccgctcccgcacttcgtcttcgtctcctttcttgtcgaatcatcatcattcttcgctgatcaatgttgttgacccacgccgctcactctccttccactacgcttctcctcaggggcttaatctagctgagctctgtgttgttagatcgcagaggaggtccgttcagagttctgttgtcgtgcaagatggatcagtagccaccgagtcaagctcgtccgaggaggcgaaagatgtaggggtgttaacgattccttcacttgaagctgacaaggttgtagcagagtctgatggcggtgaacaactttcaacagttagtatcacggtggtgggagcttctggtgatcttgccaagaagaaaatattcccagctcttttcgcactttactatgaaggctgtcttcctgagcattttaccatttttggctatgcaaggagtaagatgacagatgctgaacttagagttatggtcagcaaaacattgacatgtagaattgataagagggcaaactgcggtgaaaagatggaagagtttctcaagagatgtttttaccattcgggtcagtatgattctcaggaacattttgttgcattggacgagaagctcaaggagcatgagggtggaagactttcgaaccgtcttttctatctttcaatccctccaaatatctttgttgacgcggtgaaatgtgcaagctcatctgcttcatctgtcaatggatggactagggtcattgtcgagaaaccttttggccgggactccaaaacctcggctgcattaacaaagtctcttaagcagtacctggaggaagaccaaatatttaggatagaccattacttagggaaggagctggttgagaacttgtcggttcttcgattctcaaatcttatatttgaaccgctatggtcaaggcagtatataaggaacgtgcaattcattttttctgaggatttcggcactgaaggacgcggagggtacttcgacaattacggaataataagagatataatgcagaatcatctgcttcagatattagctcttttcgccatggaaacacctgtgagtttggatgcagaggatatcagaaatgaaaaggtaaaggtactacgttcaatgagaccaataaaacttgaagatgtggtgataggacagtacaagagccacagcataggaggagtcacttatccaagctatactgatgataaaactgtgccaaaaggtagtctgaccccgacatttgcagctgctgcactcttcatcgacaatgcaagatgggatggtgtaccttttctaatgaaagctgggaaagcactaaacacccgaagtgcggagataagagtccagttcaggcatgtgcctggaaatttatataaccggaattctggtactgatcgtgatcagaccacaaatgagcttgtcatccgcgtccaacctgatgaagctatctatttgaaaatcaacaacaaggtccctggtttaggaatgagattagatcagagtaacttaaatcttctctattcagcaaggtattcaaaggagattccagatgcatatgagaggcttttgttagatgcgatcgaaggtgaacgcagattgttcataagaagcgatgaacttgacgctgcttgggcgcttttcactccattgctcaaagagatagaagaaaagaagacaaccccagaattctatccttacggcagtcgtggtccagtcggtgcccattatctagccgcaaaacacaaggtccaatggggagacctaagtcttgatcagtgaaagagtggaagaacattttttgttcatagattcacgtcttagaattttcattatttgtgtggtttatggaaactttctttcgctttcagagataggagtgagttttgttcgattttgtatctggaataataagtaagaactaccctattcttgccaccctttttgctttcaataaaggaaacacaaatttaagtgta

SEQ ID NO: 2449 - protein, 599 aa, Arabidopsis thaliana (mouse-ear cress)
MSSLSCPTYRSRTSSSSPFLSNHHHSSLINVVDPRRSLSFHYASPQGLNLAELCVVRSQRRSVQSSVVVQDGSVATESSSSEEAKDVGVLTIPSLEADKVVAESDGGEQLSTVSITVVGASGDLAKKKIFPALFALYYEGCLPEHFTIFGYARSKMTDAELRVMVSKTLTCRIDKRANCGEKMEEFLKRCFYHSGQYDSQEHFVALDEKLKEHEGGRLSNRLFYLSIPPNIFVDAVKCASSSASSVNGWTRVIVEKPFGRDSKTSAALTKSLKQYLEEDQIFRIDHYLGKELVENLSVLRFSNLIFEPLWSRQYIRNVQFIFSEDFGTEGRGGYFDNYGIIRDIMQNHLLQILALFAMETPVSLDAEDIRNEKVKVLRSMRPIKLEDVVIGQYKSHSIGGVTYPSYTDDKTVPKGSLTPTFAAAALFIDNARWDGVPFLMKAGKALNTRSAEIRVQFRHVPGNLYNRNSGTDRDQTTNELVIRVQPDEAIYLKINNKVPGLGMRLDQSNLNLLYSARYSKEIPDAYERLLLDAIEGERRLFIRSDELDAAWALFTPLLKEIEEKKTTPEFYPYGSRGPVGAHYLAAKHKVQWGDLSLDQ

SEQ ID NO: 2450 - DNA, 1953 bp, Nicotiana tabacum (common tobacco)
  CDS (43)..(1824)
gtagatacagattcttcatagagaagtgaagaaatcaagaaaatggtgaccctttattcttctccttcaacccattcttctgggccagttgcttcttactctaattcctctattgggctctataattatcatcataataagcagatagcagtttcttcaattttgtcgagaaagtttggttctttgcaaattaatcagaagccattttggaatgccgttcgcatgcaagatggtgcagtagcgactccgcctagcaaaatcgaaaatgagactcctttgaagaaattaaaaaatggaattttgccagtcgcacctccaaaggagcagaaagatacaattgatttcgacagcaacaaagctaaatcaactgtcagtattactgttgttggtgcttcaggagatcttgccaagaaaaagatatttcctgcactgtttgcactttattatgagggttgcctccctgagcatttcactatctttggctatgcccggagtaagatgactgatgctgaactacggaacatggttagcaagacccttacttgcaggattgacaagagggaaaattgtggtgaaaagatggaacagtttttagaaaggtgcttctaccacagcggccaatacgattccctggaaaactttgcggagctcgataaaaagctgaaggaacatgaggctggaaggttttccaatcgtctattctacttatccattccaccaaatatttttataaatgcggttcgatgtgctagcctctctgcatcatctgctcatggctggacaagagtcattgtagagaaaccctttggtcgggattctgaatcctctgctgcattgacaagatcacttaagcagtacttgaatgaagaccaaatttttaggatcgatcactatttagggaaggagcttgtggaaaacctttctgtccttcgtttctccaacttgatatttgaacccttgtggtcaaggcagtgtataaggaatgtgcagtttattttctcagaagattttggcactgaaggacggggaggttattttgatcattatgggataatcagagacatcatgcaaaaccatctgcttcaaattctggccctctttgccatggaaacacctgtgagtttggatgcggaagatatcagaaatgaaaaggtaaaagttctgcgttccatgagacctttacaactagacgatgttatcattgggcagtacaaatgtcacacaaaaggagatgttacctatcccggttatactgacgacaagactgtaccgaaggacagtctaaccccaacttttgctgcagctgctcttttcatagataatgcacgatgggatggggtgcctttccttatgaaagctgggaaagctttacatactaggagtgcggaaataagagtacaattcaggcacgtaccaggaaatttatacaataagaactttggctcagatcttgaccaggcgaccaacgagcttgttatccgtgtccagcctaatgaagctatatacctaaagatcaataacaaagttcctggtctaggaatgagattggatcgcagtaatcttaatcttctttactcggcaagatactcgaaggagatccctgatgcatatgagcggctgcttcttgatgctatagaaggtgaaaggcggcttttcatccgcagtgatgagctggatgctgcttggtctcttttcactccagtgttaaaagaacttgaggataagaaaatagttccagaatattacccctatggaagtcgaggacctattggagcacattatctcgcagcacgatataaagtaagatggggtgatcttgtgtagacaagtgatttccagactttgctatcactgtcagaaaaccatatgtcgcctttctacttcttgagcttagtatgtcgcaaccaaatttgttgtactgcaattctagaaccaagactagcaaagcgtgaa

SEQ ID NO: 2451 - protein, 593 aa, Nicotiana tabacum (common tobacco)
MVTLYSSPSTHSSGPVASYSNSSIGLYNYHHNKQIAVSSILSRKFGSLQINQKPFWNAVRMQDGAVATPPSKIENETPLKKLKNGILPVAPPKEQKDTIDFDSNKAKSTVSITVVGASGDLAKKKIFPALFALYYEGCLPEHFTIFGYARSKMTDAELRNMVSKTLTCRIDKRENCGEKMEQFLERCFYHSGQYDSLENFAELDKKLKEHEAGRFSNRLFYLSIPPNIFINAVRCASLSASSAHGWTRVIVEKPFGRDSESSAALTRSLKQYLNEDQIFRIDHYLGKELVENLSVLRFSNLIFEPLWSRQCIRNVQFIFSEDFGTEGRGGYFDHYGIIRDIMQNHLLQILALFAMETPVSLDAEDIRNEKVKVLRSMRPLQLDDVIIGQYKCHTKGDVTYPGYTDDKTVPKDSLTPTFAAAALFIDNARWDGVPFLMKAGKALHTRSAEIRVQFRHVPGNLYNKNFGSDLDQATNELVIRVQPNEAIYLKINNKVPGLGMRLDRSNLNLLYSARYSKEIPDAYERLLLDAIEGERRLFIRSDELDAAWSLFTPVLKELEDKKIVPEYYPYGSRGPIGAHYLAARYKVRWGDLV

SEQ ID NO: 2452 - DNA, 1869 bp, Nicotiana tabacum (common tobacco)
  CDS (22)..(1788)
cggatcggccgaaaaaactgcatgggtgggcagttgcaattgaatccttgttcttcatcttcagttgctactactttccataatggggcacataagttttgcagaaattttaatattttaccatttaaagcccattcccttgaatcttcagttgctagtactttccataatggaatttattcaagaatccagccaagaaagcattttgagatcatgtcatcaaatggttttcatctgaatgctgtgtctttgctggatggttcggcgtcaaaatctatgccagaacaagtgcctttgacagagttagaaaatgcagagacaactgtcagcataactgttattggagcttcaggtgacctagccaagaagaagattttcacagctttatttgctcttttctatgaagattgtttgcctgagaattttatagtttttggttattcacgaacaaaaatgagtgatgaagagctgagaaacatgatcagcaagaccttaacttgtagaattgatcagagagagaattgcgaggctaaaatggaccactttctggaaagatgcttttaccactccggtcagtaccattctgaggatgattttgcagaactggattacaaattaaaggcaaaggaggggtctagggtttctaataggttgttttacttatcaatacctccaaatatattcgtggatgtggtgagatgtgcaagtcttaaagcttcttcaacaagtgggtggacaagagtcattgttgagaaaccgtttggtcgtgacttagaatcatctagtgagctgaccagatgcctaaagaagtatctaactgaggagcaaatattccgaattgaccattacttgggaaaggaacttgttgagaatctctcagttcttcgtttctcgaatcttgtctttgagcctctctggtccagaaactacatacgcaatgtccaattcatattttccgaggactctggtaccgagggacgaggagggtactttgacaattacgggatcatccgagatataatgcaaaatcatctccttcaaatattagcattgtttgctatggaaacacctgtcagcatggatgccgaggacatcagaaatgaaaaggttaaagttttaaggtcaatgaggccattgcagcttgaagatgtggtacttggccagtataaaggtcatagcaagggtggtaaattatatccagcttatacagacgatccaactgtgccaaacggtagtgtcactccaacgttttctgctgctgcactctttattaataatgcacgctgggacggcgttcctttcctcatgaaagctggaaaagctctccatactaggagggcggagatcagggtacagttcagacatgttcctggaaatttgtacaaaaggaactttggaactgatctagataaggccacaaatgagctagttctgcgcttacaacctgatgaagccatatatctgaagatcaacaacaaggttcctggtcttggaatgagacttgaccggagtgaccttaatcttctttacaaagcaaagtatcgaggtgaaataccagatgcatatgagcggcttctgttagatgcaatagaaggagagcgaagattgttcattagaagtgatgagctggatgctgcatgggctctatttacaccattgctgaaggagctagaagagaagaagattgcgccagagctttatccgtatggcagtaggggtccagtaggagcacattatctagctgcaaagcacaacgttcgttggggagatctgtctggtgatgattgatgtatccgacacatcttctccccaaaattggagcgcgaactttcaaaaatattgactataaatgtatgaatattgaggagg

SEQ ID NO: 2453 - protein, 588 aa, Nicotiana tabacum (common tobacco)
MGGQLQLNPCSSSSVATTFHNGAHKFCRNFNILPFKAHSLESSVASTFHNGIYSRIQPRKHFEIMSSNGFHLNAVSLLDGSASKSMPEQVPLTELENAETTVSITVIGASGDLAKKKIFTALFALFYEDCLPENFIVFGYSRTKMSDEELRNMISKTLTCRIDQRENCEAKMDHFLERCFYHSGQYHSEDDFAELDYKLKAKEGSRVSNRLFYLSIPPNIFVDVVRCASLKASSTSGWTRVIVEKPFGRDLESSSELTRCLKKYLTEEQIFRIDHYLGKELVENLSVLRFSNLVFEPLWSRNYIRNVQFIFSEDSGTEGRGGYFDNYGIIRDIMQNHLLQILALFAMETPVSMDAEDIRNEKVKVLRSMRPLQLEDVVLGQYKGHSKGGKLYPAYTDDPTVPNGSVTPTFSAAALFINNARWDGVPFLMKAGKALHTRRAEIRVQFRHVPGNLYKRNFGTDLDKATNELVLRLQPDEAIYLKINNKVPGLGMRLDRSDLNLLYKAKYRGEIPDAYERLLLDAIEGERRLFIRSDELDAAWALFTPLLKELEEKKIAPELYPYGSRGPVGAHYLAAKHNVRWGDLSGDD

SEQ ID NO: 2454 - DNA, 2058 bp, Solanum tuberosum (potato)
  CDS (41)..(1774)
aagaaaactcattcttgaaaaaaggcatttctctgtctgtatgggtgtgcaattgagattgaacccttgttcttcatcttcagctgcaacttctccttcaactttccataatgggacaccatatttctgcaaaaagtttaactttttaccatttagaacccaacccctcaattgggtatctggaatttactcaagaatccaaccaagaaagcattttgaagtcttttcctcaaatgggtttccacttaatgctgtgtctgtgcaagatgtacaagtgcctttgacagagttaggaagtggagataccactgtcagcataactgttattggagcttcaggtgacctagccaagaagaagattttaccagctttatttgctcttttctatgaagattgtctgcctgagaattttgtagtttttggctactcacgaacaaaattgagtgatgaagagctgagaaatatgatcagtacaaccttaacttgtcgaattgataagagagagaattgcgatgccaaaatggagcattttctggaaagatgcttttatcattcgggtcagtacaattctgaggatgattttgcagaactggattacaaattaaaggaaaaggagggttgtagggtttctaataggttgttttacttatcaatacctccaaatatattcgtggatgtggtgcgatgtgcaagtcttaaagcttcttcaacaagtgggtggacaagggtcattgttgagaaaccatttggtcgtgatttagaatcatctagtgagctgaccagatccctaaagaagtacctaactgaggagcaaattttccgaattgaccattacttgggaaaggaacttgttgagaatctctcagttcttcggttctcgaatcttgtctttgagcctctttggtccagaaactacatccgcaatgtccaatttatattttccgaagattttggtaccgagggacgaggagggtactttgaccactacggcatcatccgtgatattatgcaaaatcatctccttcaaatattagcattgtttgctatggaaacacctgtcagcttggatgctgaggacatcagaaatgagaaggttaaagttttaaggtcaatgaggccattgcaacttgaagatgttgttcttggacagtataagggtcatagcaatggtgctaaatcatatccagcttacacagatgatccaactgtgccaaatggcagtatcactccaacattttctgctgctgcactcttcattgataatgcacgttgggacggggttcctttcctcatgaaagcaggaaaagctctccatacgaagagggcagagatcagggtccagttcagacatgttcccggaaatttgtacaaaaggaactttggaactgacatggataaagcaaccaatgagctagttctgcgcctacaacctgatgaagccatatatctgaaaattaacaacaaggtccctggtcttgggatgagacttgaccggagtgaccttaatcttctttataaagcaaagtatcgaggtgaaataccagatgcatatgagcggcttttgttagatgcaatagaaggagagcgaagattgttcataagaagcgatgaacttgatgctgcatgggctctatttacaccgttgctgaaggagctggaagagaagaagattgcaccagagctttatccatacggaagtagggggccagtgggagcacattatctagctgcaaagcacaacgttcgttggggagatctatctggtgatgattgattgtatgtgagatcttcttgaggagtactatgaaatggaggaaatctctaatttcctcacaaagggggacaattgatattcatttagttttataggaattgatctacttgctgtttcagctcatcaagaatgcaaaaattatggacaacttggaactgctgtcagcaattgttgtatagctagcttgtctattttgttaagaaaatactcatgttttattcttcttgttgtgttacatcctgggctatattttgctaatgactaataatataccctactcttca

SEQ ID NO: 2455 - protein, 577 aa, Solanum tuberosum (potato)
MGVQLRLNPCSSSSAATSPSTFHNGTPYFCKKFNFLPFRTQPLNWVSGIYSRIQPRKHFEVFSSNGFPLNAVSVQDVQVPLTELGSGDTTVSITVIGASGDLAKKKILPALFALFYEDCLPENFVVFGYSRTKLSDEELRNMISTTLTCRIDKRENCDAKMEHFLERCFYHSGQYNSEDDFAELDYKLKEKEGCRVSNRLFYLSIPPNIFVDVVRCASLKASSTSGWTRVIVEKPFGRDLESSSELTRSLKKYLTEEQIFRIDHYLGKELVENLSVLRFSNLVFEPLWSRNYIRNVQFIFSEDFGTEGRGGYFDHYGIIRDIMQNHLLQILALFAMETPVSLDAEDIRNEKVKVLRSMRPLQLEDVVLGQYKGHSNGAKSYPAYTDDPTVPNGSITPTFSAAALFIDNARWDGVPFLMKAGKALHTKRAEIRVQFRHVPGNLYKRNFGTDMDKATNELVLRLQPDEAIYLKINNKVPGLGMRLDRSDLNLLYKAKYRGEIPDAYERLLLDAIEGERRLFIRSDELDAAWALFTPLLKELEEKKIAPELYPYGSRGPVGAHYLAAKHNVRWGDLSGDD

SEQ ID NO: 2456 - DNA, 2049 bp, Spinacia oleracea (spinach)
  CDS (147)..(1871)
taaaattctaaactaggattttttttttctttttccatttaaatttcttctgcttaaaaacttccattttcggcaacccaattacatggctaagcatttgagtttgagcgcttgttcgtcttttttagcagcagtcaaaattaaggatggaggaacttgtttcttgccaccatcttccattattatgcctccaaagctctgttcctccaaatgggtgtctcacattctttcaagattctgcctgccaaaggtgttcccattctgaattttcaaatgggcatcctttaaatgatgtctctcttcaaaatgatgtggctgtaaacccaattgttgcaaaaagtattgatccgtcagcagatcttcagttgcttcccctattggagtccgtcaaagaagagcccacactgagcataattgtagttggtgcctcaggagatcttgccaaaaagaagatatttcctgccctttttgctctcttttatgaaaactgtcttcctgagaacttcacagtctttggtttttcacgaacggaaatgaatgatgaagagctgcggactatgatcagtaaaaccttaacctgtagaatagaccagagggaaaactgtggtgaaaaaatggatcattttttgcaaagatgcttttaccattctggtcagtataattctgaggatgacttttcaggattggactgtaagcttaaagaaaaagaggctggtagactgcaaaataggctattctacctttcaataccaccaaacatttttgtggatgtggtgagatgtgttagccatcgagcttcttctgcaagtggatggacaagggttatagtagaaaagccttttggacgtgactcggattcttctcgtgagctaactagaagcttcaagcagtacttgagcgaggaccagatattcaggattgaccattacttggggaaggagttggtggagaatttatctgttctacgcttttcaaatctagtttttgaacctctatggtcaaggaactacatccgaaatgtccagctgatattctctgaagattttggtacagagggacgagggggatactttgataattatggaataatccgagatataatgcaaaaccatcttcttcaaattctagccttgtttgcaatggagacacctgttagcttagatgctgaggacattaggaatgaaaaggtgaaagtgcttaggtcaatgaaaccacttaaactgcaagatgtggtagtgggtcagtacaagggtcacagcaaagggaacaaatcatattctggttacacagatgatccaacggtgccaaacaatagtgtgactccaacatttgcagctgcagcgttgttcatcgacaatgctcgatgggatggagttcctttcctgatgaaagctggaaaagctcttcatacgaagagagctgaaatccgagtgcagtttagacatgttcctggaaacttgtacaagaaaacttttgggacggatttggacaaagctacgaatgagcttgtactacgggtacaacctgatgaagcaatatacttgaagatcaataacaaggttcctggccttgggatgagattggaccgtactgaccttaatttgtgttacagtactaggtaccggggagaaatacctgacgcgtatgagaggctacttctggacgcaatagaaggagagcgtagattgttcatcagaagtgataaactggatgcggcttggtcattgttcacgccgttgttaaaggaactagaggagaaaaaggtagcaccagagctgtacccttacggtagcaggggaccagtcggagctcattatcttgccgccaagcacaatgtccggtggggggatcttagtggtgaagactcgtgagggctttgttgatactgattcacatatacactttcaagatcacttccatgtatgatttgtattgtgaaaatccaaggtatatatatttttcatgtacaacaacctcctactaaagcaatgttgatgcttctgcaattcacactgtagatcttttttaatataaattttacagaaaatt

SEQ ID NO: 2457 - protein, 574 aa, Spinacia oleracea (spinach)
MEELVSCHHLPLLCLQSSVPPNGCLTFFQDSACQRCSHSEFSNGHPLNDVSLQNDVAVNPIVAKSIDPSADLQLLPLLESVKEEPTLSIIVVGASGDLAKKKIFPALFALFYENCLPENFTVFGFSRTEMNDEELRTMISKTLTCRIDQRENCGEKMDHFLQRCFYHSGQYNSEDDFSGLDCKLKEKEAGRLQNRLFYLSIPPNIFVDVVRCVSHRASSASGWTRVIVEKPFGRDSDSSRELTRSFKQYLSEDQIFRIDHYLGKELVENLSVLRFSNLVFEPLWSRNYIRNVQLIFSEDFGTEGRGGYFDNYGIIRDIMQNHLLQILALFAMETPVSLDAEDIRNEKVKVLRSMKPLKLQDVVVGQYKGHSKGNKSYSGYTDDPTVPNNSVTPTFAAAALFIDNARWDGVPFLMKAGKALHTKRAEIRVQFRHVPGNLYKKTFGTDLDKATNELVLRVQPDEAIYLKINNKVPGLGMRLDRTDLNLCYSTRYRGEIPDAYERLLLDAIEGERRLFIRSDKLDAAWSLFTPLLKELEEKKVAPELYPYGSRGPVGAHYLAAKHNVRWGDLSGEDS

SEQ ID NO: 2458 - DNA, 2359 bp, Petroselinum crispum (parsley)
  CDS (172)..(1986)
gaagaggaaggcagcctttcggagataccaaaggactcaaccccctcgaactctccgaagtattttagtcccccctgtgtcttctcaacccccccaatactcctctttcattttcagttttgatacaacaactaatcatttgagattggattacattgtttcacacaacaaatggccaccctttcttcagctaccaattgtcgctcctcctcctcctcctcctattcctcttcatcttctctctttccaaggattcatcatcaacaacacttcatcgtttcgttggcttctcccaaacctctattcaacaagctttctttccattccaatcaaccttctttttccttcactcctgctcctgctcctgctgctgcatcccaagatggtgcaatatccacaacggtgccacatattgaaaatgaaactccactcaagaaagtcaagaatgcaaatttatcagttccaccccctcaggagtccaaaggcattactccttttcgtctcaacaaagacaagtcctctgtcactatcactgtcgtcggagcttctggggacctggccaagaagaagatatttcctgcactttttgcactttattacgaggactgcctacctgagcacttcacaatttttggttatgcccgaagtaagatgactgatgctgaacttagggacatggtgagcaagaccctcacttgcaggattgataagagggcaaactgtggggaaaagatggaacaatttttgaaacgatgcttctatcattctggtcaatatgattctgaagccaattttgccgaacttgacaaaaaactgaaggaacacgaggctggaacaattgccaatcgtcttttctatctatcaattccaccaaacatttttataaatgctgtaaaatctgcaagcatatccgcttcttctgcaaatggctggacaagggtcatcgtagagaaaccatttggtcgggattctgaatcctctgctgcactgacaacagctctcaaacagtatctggaggaagatcaaatattcaggatagatcactatcttggaaaagagctagtggagaatctttctgtccttcgattctccaatctcatatttgaacctttatggtctagacagtttattagaaacgtgcagctgatattttctgaagattttggaaccgaaggcaggggagggtactttgataactatggaatagtcagagacataatgcaaaaccatctgctacaaattttggcactctttgccatggaaacacctgttagtttggatgcagaagatatcaggaatgaaaaagtcaaagttctccgatcaatgaggcccattcaacttgatgatgtggttatagggcagtataagagccacacaaggggaggtgtcaattaccctgcatacaccgacgacaagactgtcccccataatagtctgacaccaacatttgctgcagccgccctttttatagataatgcaagatgggatggtgtaccgtttttaatgaaagctggaaaagccctccatgataggaggactgagataagagtacagtttagacatgtacctggtaatctatacaaacggaactttggaacaaatcttgaccatgagaccaatgagcttgttattcgcgtacaacctgatgaagctatatatctgaagattaataataaggtgccaggtttaggaatgagactggatcgcagcaatctgaatctcttatattcgacaaggtactcgggggagatccccgatgcatacgaaaggcttcttcttgatgccgtcgaaggtgaaaggagactgtttatccgcagtgacgaactggatgctgcttggtcgctctttacacccgtattgaaagatctagaagacaagaaaactgttcccgaatattacccttatgggagtcgaggacccgttggtgctcactatcttgcagccaaatataaagttaggtggggagattttgcaggagatcaatgactagcaagtattttgcatcgcttccaaacagtagaatgtaggaagaacttggccctgaggttggttttctttgttttagtgcatctatcagcattgtaccgcgtgttcaaagaagtaaaatggtatgtccaaaggccttgagatctgtggatgaatgctttgagcaattgagcttataataatttacagagtagtcttagtatttgtaagatgctgtaatggttttctttatgtatctagggatagtaagatagcatctgcaagatctgttttcattttaactgcaacaaatctgagaagaataatggtacatgtttcattgaccttttatagtacaaagttattgttttcataaaaaaaaaaaaaaaaaaaa

SEQ ID NO: 2459 - protein, 604 aa, Petroselinum crispum (parsley)
MATLSSATNCRSSSSSSYSSSSSLFPRIHHQQHFIVSLASPKPLFNKLSFHSNQPSFSFTPAPAPAAASQDGAISTTVPHIENETPLKKVKNANLSVPPPQESKGITPFRLNKDKSSVTITVVGASGDLAKKKIFPALFALYYEDCLPEHFTIFGYARSKMTDAELRDMVSKTLTCRIDKRANCGEKMEQFLKRCFYHSGQYDSEANFAELDKKLKEHEAGTIANRLFYLSIPPNIFINAVKSASISASSANGWTRVIVEKPFGRDSESSAALTTALKQYLEEDQIFRIDHYLGKELVENLSVLRFSNLIFEPLWSRQFIRNVQLIFSEDFGTEGRGGYFDNYGIVRDIMQNHLLQILALFAMETPVSLDAEDIRNEKVKVLRSMRPIQLDDVVIGQYKSHTRGGVNYPAYTDDKTVPHNSLTPTFAAAALFIDNARWDGVPFLMKAGKALHDRRTEIRVQFRHVPGNLYKRNFGTNLDHETNELVIRVQPDEAIYLKINNKVPGLGMRLDRSNLNLLYSTRYSGEIPDAYERLLLDAVEGERRLFIRSDELDAAWSLFTPVLKDLEDKKTVPEYYPYGSRGPVGAHYLAAKYKVRWGDFAGDQ

SEQ ID NO: 2460 - DNA, 1848 bp, Petroselinum crispum (parsley)
  CDS (41)..(1528)
ttctcttgaagcattcttcattcttgctttcagcttgaagatgacatctgataaatggagtatagagaaaagagcacctcttagaaatgattctgttttgaaagaagaaaatgtgccagaaattggatgtctttcaattgttgttcttggtgcttctggtgatcttgccaagaaaaagacttttccagcacttttcaatctttatcgtcaggggtttttgcaatcacatgaagtctacattttcggctatgcaaggacaaagatatcggacgaagagttgagagatcgaattcgtggatatcttgttccaagcaagaatactgtggaggggcatgaagaagatttaactaactttctgcaattgatcaaatatgtttgcggatcttatgacaccgaggaggggtatcaattactggataaagaaatatctgagcacgaaatatacagaaattgcacggaaggatcatcccgtagactattttaccttgctcttcctccatcagtatatcctcctgtctgcaagatgatcaggaaatgctgcatgaataaatctgatcttggtggatggactcggattgttgttgaaaagccctttggcagggatttggagtcggctgagcaactcagtaaccagataggggagttgtttgaagagccccagatttaccgtattgatcattatctgggaaaagaattggtgcagaacttgttggtacttcgtttcgcaaatcgtttcttcatgccactttggaatcgtgacaacattgacaatattcagattgtatttagggaggattttggaactgatggccgtggtggatattttgatcagtacggaattatccgcgatatcatccaaaaccatctattgcaggtcctatgccttgttgccatggagaagcctgtctctcttaagcctgagcatattcgagatgagaaagtgaaggttcttcaatctgtagttcctataaaagatgaagaggttgtgctcggacagtacgatggctatttggaagacccgacagttcctgatggctcgtacactcccacatttgctactatggttttaagaatacacaatgagagatgggaaggtgtaccctttatactcaaggccgggaaagctttgaattctagaaaggcagaaatccgggttcagttcaaggatgttcctggtgatatattcaaaagtaagaagcaaggaaggaacgaatttgtaatacgcctgcaaccttcagaggcaatgtatatgaagcttacagtcaaacaaccaggacttaagatgtcaactgtgcaaagtgagatggacttgtcatacggacagcgttatcaggacgttaccattccagaagcttatgaacgtctgattcttgatacgataagaggtgaccaacaacattttgttcggagagatgaacttaaggcggcctgggagattttcactcctctcctgcacagaatcgacaagggagagtttaaatcacttccgtacaagccaggcagcagagggccagaggaaagcggataagctgcttgagaaggccggttatgttcagacacatggctacatttggatccctcccaccctatagaaatccttagcttataaatgcaaacatgatcagataatgtatcagtataatcacttgaggttgtgatatttgtaagttagtttactatcagcgtttgttctcattatgtaaccttgtaatctgtttattttggtttgtatacgttatatgttgaattataaaaagtaaggaatattctccttagtttatcaaaaaaaaaaaaaaaaaaaaaaaaaaaaaaaaaaaaaaaaaaaaaaaaaaaaaaaaaaaaaaaaaa

SEQ ID NO: 2461 - protein, 495 aa, Petroselinum crispum (parsley)
MTSDKWSIEKRAPLRNDSVLKEENVPEIGCLSIVVLGASGDLAKKKTFPALFNLYRQGFLQSHEVYIFGYARTKISDEELRDRIRGYLVPSKNTVEGHEEDLTNFLQLIKYVCGSYDTEEGYQLLDKEISEHEIYRNCTEGSSRRLFYLALPPSVYPPVCKMIRKCCMNKSDLGGWTRIVVEKPFGRDLESAEQLSNQIGELFEEPQIYRIDHYLGKELVQNLLVLRFANRFFMPLWNRDNIDNIQIVFREDFGTDGRGGYFDQYGIIRDIIQNHLLQVLCLVAMEKPVSLKPEHIRDEKVKVLQSVVPIKDEEVVLGQYDGYLEDPTVPDGSYTPTFATMVLRIHNERWEGVPFILKAGKALNSRKAEIRVQFKDVPGDIFKSKKQGRNEFVIRLQPSEAMYMKLTVKQPGLKMSTVQSEMDLSYGQRYQDVTIPEAYERLILDTIRGDQQHFVRRDELKAAWEIFTPLLHRIDKGEFKSLPYKPGSRGPEESG

SEQ ID NO: 2462 - DNA, 1957 bp, Petroselinum crispum (parsley)
  CDS (74)..(1678)
gttggttaaggagtcgctgcaacaaagtcaaatatattggaatcgaaaactcaatctgtgttgtatacgggttatgaaatcagcagtgtgtgacatagttcataagatgtcggataaatggtgcttagaggaaagagcccctgttgttgaggatagtgccggagatcctattgttaaagatactcaaccaccaccacccgtgtctgaagatggttgcctatcaattgttgtgcttggtgcttctggtgatcttgccaagaaaaagacttttcctgctctctttaacctttaccgccagggtttcttgcagtcacatgaagtatacatttttggctatgccaggaccaagatttctgatgatgacttgagagaccgcattcgtggatatcttactccaaacaagaacactgcagaaggacacacagaagatgtatcaaaatttctgcaactgatcaaatacgtctgtggttcttatgacgcagcggagggttttcagtgtttggataaggaaatatctgagcatgaaatatcaagaaacagtattgaaggatcgtcccggagactattttaccttgcacttcctccttcagtatatcctcctgtctgcaaaatgattaagacttactgcatgaataaatctgatcttggtggatggactcgtattgttgttgagaagccctttggtagggacttggagtcagctgagcatctcagtaaccagataggagaactgtttgaggagccacagatatatcggattgatcactatttgggaaaagagctggtgcagaatttgttggtgcttcgttttgctaatcgtttcttcctgccttcatggaatcgtgacaacatcagtagtgtgcagattgtcttccgagaggattttggaactgaaggccgtggcggatattttgatcagtatggaatcatccgggatattatccaaaatcatctcttgcaggttctttgcctcgttgctatggaaaaacctatttctcttaaacctgagcacattcgagatgagaaagtgaaggttcttcaatctgtagctccacttaatgatgaagaggttgtgcttggacaatatgatggttacttggatgatcccactgtgcccgctggctctaacactccaacttttgcaaccatggtattgcgtatacacaatgaaagatgggaaggtgttcctttcgtacttaaggctggaaaagcattggaatctagaaaggcagaaattcgtatccaattcaaggaagtcccgggtgatatatttaaatgtcaaaagcaggggagaaatgaatttgtgatacggttacaaccttcagaggccatgtatatgaaacttacagtcaagaagcctggacttgagatgtctactgctcagagtgagctcgacttgtcatatgggcagcgttatcaggatgtaaccataccggaggcttatgaacgacttattcttgacactataaggggtgatcagcagcattttgttcgcagagatgagttgaaggcagcctgggagattttcacccctcttcttcacagaatagataaaagtgaacttaaatcagtttcatacaaaccaggcagccgaggcccagaggaagcggatgagttgctgaaaaaagttggctatgttcagacacatggctatacatggattcctccaaccctataatctgaacaggctgcattgatgcttggttgacggcttatcggtaatataagatgggaagttcccaaggtcccctgtgaaataataaatacatcagtacaaatgtatctctgtgatacacgtgatgtttttacgaggatcaaccttttcaaagtaagcttgatctatttacttaaccttgttcgctaaagtgtgtctctgtaatgtgttttgacgaacatgcactatttataagttgttgaaaatgtgaagcttatatactgtaaaaaaaaaaaaaaaaaa

SEQ ID NO: 2463 - protein, 534 aa, Petroselinum crispum (parsley)
MKSAVCDIVHKMSDKWCLEERAPVVEDSAGDPIVKDTQPPPPVSEDGCLSIVVLGASGDLAKKKTFPALFNLYRQGFLQSHEVYIFGYARTKISDDDLRDRIRGYLTPNKNTAEGHTEDVSKFLQLIKYVCGSYDAAEGFQCLDKEISEHEISRNSIEGSSRRLFYLALPPSVYPPVCKMIKTYCMNKSDLGGWTRIVVEKPFGRDLESAEHLSNQIGELFEEPQIYRIDHYLGKELVQNLLVLRFANRFFLPSWNRDNISSVQIVFREDFGTEGRGGYFDQYGIIRDIIQNHLLQVLCLVAMEKPISLKPEHIRDEKVKVLQSVAPLNDEEVVLGQYDGYLDDPTVPAGSNTPTFATMVLRIHNERWEGVPFVLKAGKALESRKAEIRIQFKEVPGDIFKCQKQGRNEFVIRLQPSEAMYMKLTVKKPGLEMSTAQSELDLSYGQRYQDVTIPEAYERLILDTIRGDQQHFVRRDELKAAWEIFTPLLHRIDKSELKSVSYKPGSRGPEEADELLKKVGYVQTHGYTWIPPTL

SEQ ID NO: 2464 - DNA, 1569 bp, Caenorhabditis elegans
  CDS (1)..(1569)
atggcatgcaaacgtcattcagtgtccgatcccatttcgaaggatctcgtcgagtgtcttcgtgaatcaatgcaaagagatctcaaatttgagactccgtacgttttcgtgatatttggagcatcgggagatctcgcaaaaaagaaaatatacccaacactgtggtggttgttccgtgacaaccttttgccagtcaacatcaaatttattggatatgcccgttccgatctgacagttttcaagcttcgtgaatcttttgagaaaaactgtaaagttcgagaaaatgagaaatgtgcttttgatgacttcatcaagaagtgctcatacgttcagggccaatacgacacttctgaaggattccaacgccttcaatcttcaattgatgatttccaaaaagaaagcaataatcaagccgtcaatcgtctctactacctcgctcttcctccatcagttttcaacgtggtttctacggaattaaagaagaattgtatggatcatggtgattcatggacacgtgttatcatagaaaaaccatttggacatgatttgaaatcatcttgtgaactttcaactcatttggcgaaactttttaaagaagatcaaatctaccgtattgatcattatctcggaaaagaaatggttcagaatttgatggttatgcgatttggaaaccgaattctcgctccatcttggaaccgcgatcacattgcatcagttatgatctcatttaaagaagattttggaactggtggccgtgctggatattttgatacagctggaattatccgtgatgttatgcagaatcatttgatgcaaattctaactttagtcgccatggagaaaccagcaagtttgaatgctgaagatattcgtgatgaaaaggtcaaagtgttgaaagctgctaaagttgtagaattaaaggatgtagtagttggacaatacattgccagtcctgaatttgatcacccagaagcatcacaaggatacaaagatgacaaatcagttccagccgattcgactactccaacgtatgctcttgctgttgttcacatcaataatgaacgttgggagggtgttccattcttcttgcgttgtggaaaagctctcaacgagaagaaagcagaagttcgtatacaattcaaagaagtcagtggagatatctatccgtctggtgaattaaagcgatccgaattagtgatgagagtgcaaccaaatgaggcagtttacatgaaactgatgaccaagaaacctggaatgggattcggtgttgaagaaactgaacttgatttgacttataataatagattcaaagaagtccgtcttcctgatgcttatgaacgcctatttctcgaagtattcatgggatctcaaattaatttcgttcgaactgatgagcttgaatacgcttggcgtattttgacgccagttctcgaagagcttaaaaagaagaaagttcaaccggttcaatataaatttggaagtcgtggtccaactgaaggtgacgaattgatgaaaaagtacggtttcatcttcactggaacatacaaatgggttgctccaaagctataa

SEQ ID NO: 2465 - protein, 522 aa, Caenorhabditis elegans
MACKRHSVSDPISKDLVECLRESMQRDLKFETPYVFVIFGASGDLAKKKIYPTLWWLFRDNLLPVNIKFIGYARSDLTVFKLRESFEKNCKVRENEKCAFDDFIKKCSYVQGQYDTSEGFQRLQSSIDDFQKESNNQAVNRLYYLALPPSVFNVVSTELKKNCMDHGDSWTRVIIEKPFGHDLKSSCELSTHLAKLFKEDQIYRIDHYLGKEMVQNLMVMRFGNRILAPSWNRDHIASVMISFKEDFGTGGRAGYFDTAGIIRDVMQNHLMQILTLVAMEKPASLNAEDIRDEKVKVLKAAKVVELKDVVVGQYIASPEFDHPEASQGYKDDKSVPADSTTPTYALAVVHINNERWEGVPFFLRCGKALNEKKAEVRIQFKEVSGDIYPSGELKRSELVMRVQPNEAVYMKLMTKKPGMGFGVEETELDLTYNNRFKEVRLPDAYERLFLEVFMGSQINFVRTDELEYAWRILTPVLEELKKKKVQPVQYKFGSRGPTEGDELMKKYGFIFTGTYKWVAPKL

SEQ ID NO: 2466 - DNA, 1779 bp, Streptomyces coelicolor
  CDS (1)..(1779)
atgagcgaggagcttcccgctggggcgccccaggagaccaaggcgacgaaggaagccaaggagacccggacggcccaggaggcggcggggccgctgcacgcggaggaggccgaggaggcccgcgccgccgaggcggcgaaggcgtccggccgggcgaaggctccccgcggcgcgaagaagtccgcgacgaaccgcgccgccaaggaggcgaagggcaagggcgcggccggggagggcgtcgagccggtggcaccgctcgactggagcaacccgctgcgcgatccccaggaccgccgtctcccccgcatcgcgggcccgtccgggctggtcatcttcggcgtcaccggcgacctgtcccgcaagaagctgatgcccgccgtgtacgacctggccaaccgcggcctgctgccgcccggcttctcgctggtcggcttcgcccgccgggactgggaggaccaggacttcgccgaggtcgtgcacgacgccgtcagggagcacgcgcgcacgccgttccgcgaggaggtctggcagcagctctccgagggcatgcgcttcatccccggcgacttcgacgacgacaacgcgttcgaacagctgcgcaaggccgtcgaggagctggacgcgtcccgcggcaccagcggcaactacgccttctacctctccgtgccgccgaagttcttcccgaaggtcgtccagcagctcaagaagcacgggctgaccgacgcgcccgcgggctcctggcgccgtgcggtgatcgagaagccgttcggccacgacctggacagcgcccgcgacctgaacgcgctggtgcacgaggtgttcgacccggagcaggtcttccgcatcgaccactacctgggcaaggagacggtccagaacatcctggcgctgcgcttcgccaaccagatgtacgagccgatctggaaccggtcctacgtggaccacgtgcagatcacgatggccgaggacatcggcatcggcggccgggccggctactacgacggcatcggcgccgcccgcgacgtcatccagaaccacctgctccagctgatggcgctgaccgccatggaggagccggccgccttcgacgcgcggtcgctgctcaccgagaagctgaaggtgctgcgggcggtgcggctgcccgacgacctgggcgagcacaccgtgcgcgggcagtacgcgggcggctggcagggcggcgcgcaggtgcccggctacctggaggaggagggcatcgacccggcctccaccaccgacacctacgcggcgatcaagctcggcatcgacaaccgccgctgggccggggtgcccttctacctgcgcaccggcaagcgcctgggccgccgggtcaccgagatcgcggtcgtcttccagcgggccccgcactcccccttcgactccacggcgacggaggagctgggcgagaacgccatcgtcatccgcgtccagcccgacgagggcatgacggtgcgcttcggctccaaggtgccgggcacgtcgatggagatccgggacgtgtcgatggacttcgcgtacggcgagtccttcaccgagtccagcccggaggcgtacgaacggctgatcctggacgtccttctgggtgacgccaacctgttcccgcgccaccaggaggtggaagagtcctggcggatcctcgacccgatcgaggagtactgggcctcgcacgacaagcccgcgcagtacgcgtcgggcggctggggaccgcgggaagcggacgagatgctcgcacgagacggacggagctggcgcaggccatga

SEQ ID NO: 2467 - protein, 592 aa, Streptomyces coelicolor
MSEELPAGAPQETKATKEAKETRTAQEAAGPLHAEEAEEARAAEAAKASGRAKAPRGAKKSATNRAAKEAKGKGAAGEGVEPVAPLDWSNPLRDPQDRRLPRIAGPSGLVIFGVTGDLSRKKLMPAVYDLANRGLLPPGFSLVGFARRDWEDQDFAEVVHDAVREHARTPFREEVWQQLSEGMRFIPGDFDDDNAFEQLRKAVEELDASRGTSGNYAFYLSVPPKFFPKVVQQLKKHGLTDAPAGSWRRAVIEKPFGHDLDSARDLNALVHEVFDPEQVFRIDHYLGKETVQNILALRFANQMYEPIWNRSYVDHVQITMAEDIGIGGRAGYYDGIGAARDVIQNHLLQLMALTAMEEPAAFDARSLLTEKLKVLRAVRLPDDLGEHTVRGQYAGGWQGGAQVPGYLEEEGIDPASTTDTYAAIKLGIDNRRWAGVPFYLRTGKRLGRRVTEIAVVFQRAPHSPFDSTATEELGENAIVIRVQPDEGMTVRFGSKVPGTSMEIRDVSMDFAYGESFTESSPEAYERLILDVLLGDANLFPRHQEVEESWRILDPIEEYWASHDKPAQYASGGWGPREADEMLARDGRSWRRP

SEQ ID NO: 2468 - DNA, 1524 bp, Streptomyces coelicolor
  CDS (1)..(1524)
atgtcaagcagcaatccgctgcgtgaccccgcagaccgacggctcccgcgcatcgcggggccgtcgggtctggtcatcttcggcgtcaccggcgatctgtcccgcaagaagctcatgcccgccgtgtacgacctcgccaaccggggtctgctgccgccgggcttctcgctcgtcgggttcgcccgccgggactgggagcacgaggacttcgcccaggtcgtgcacgacgccgtcaaggagcactcccgcacgccgttccgcgaggaggtctggcagcagctcatccaggggatgcgcttcgtgcagggcaccttcgacgacgacgacgccttcgagcggctgcgcggcaccatcgaggagctggacaaggcacagggcacgggcggcaacttcgccttctacctgtcggtgccgccgaagtccttcccggtggtcatccagcagctcaagaagcacggactggccgaccagacgaacggctcctggcggcgggcggtgatcgagaagcccttcggccacgacctgaagtcggccgaggagctgaacgccatcgtccacgaggtcttcggctccgaccaggtcttccgcatcgaccactacctgggcaaggagaccgtccagaacatcctggcgctgcgcttcgccaacacgatgttcgagccgatctggaaccggtcctacgtcgaccacatccagatcaccatggccgaggacatcggcatcggcggccgggccggctactacgacgggatcggcgcggcgcgtgacgtcatccagaaccacctgctccagctgctcgcgctgaccgcgatggaggagcccgcctccttcgacgcggacgcgctggcggcggagaagaccaaggtgctcggcgcggtccgcctccccaaggacctgggccgggacaccgtgcgcggccagtacgcggcggggtggcagggcggcgccaaggccgtcggttacctcgaagaggacggcatcgaccccaagtcgaagaccgacacctacgccgcgatcaaggtgggcatcgacaaccgccgctgggcgggtgtccccttctacctgcgcaccggcaagcggctgggccgccgggtcacggagatcgcggtcgtcttccagcgggccccgcactcccccttcgacacgacggccaccgaggaactcggctcgaacgcgatcgtcatccgcgtccagcccgacgagggcgtcaccgtccgcttcggttccaaggtgccgggcacgtcgatggagatccgggacgtgtcgatggacttcgcctacggcgagtccttcaccgagtccagcccggaggcgtacgagcgcctgatcctggacgtcctgctcggcgacgccaacctcttcccgcgcaccgaggaggtcgagctgtcctggaagatcctcgacccgatcgaggagtactgggacgagcacggcaccccggcccagtacccggccggcacctgggggcccgtcgaggcggacgacatgctggaacgagacggacggagctggcgccggccatga

SEQ ID NO: 2469 - protein, 507 aa, Streptomyces coelicolor
MSSSNPLRDPADRRLPRIAGPSGLVIFGVTGDLSRKKLMPAVYDLANRGLLPPGFSLVGFARRDWEHEDFAQVVHDAVKEHSRTPFREEVWQQLIQGMRFVQGTFDDDDAFERLRGTIEELDKAQGTGGNFAFYLSVPPKSFPVVIQQLKKHGLADQTNGSWRRAVIEKPFGHDLKSAEELNAIVHEVFGSDQVFRIDHYLGKETVQNILALRFANTMFEPIWNRSYVDHIQITMAEDIGIGGRAGYYDGIGAARDVIQNHLLQLLALTAMEEPASFDADALAAEKTKVLGAVRLPKDLGRDTVRGQYAAGWQGGAKAVGYLEEDGIDPKSKTDTYAAIKVGIDNRRWAGVPFYLRTGKRLGRRVTEIAVVFQRAPHSPFDTTATEELGSNAIVIRVQPDEGVTVRFGSKVPGTSMEIRDVSMDFAYGESFTESSPEAYERLILDVLLGDANLFPRTEEVELSWKILDPIEEYWDEHGTPAQYPAGTWGPVEADDMLERDGRSWRRP

SEQ ID NO: 2470 - DNA, 1422 bp, Schizosaccharomyces pombe
  CDS (1)..(1422)
atggttacttttatggtatttggtgcatcaggcaacctcgccaacaaaaagacattccctgccctgttccatctcttcaaacgaaacctggtagatcgttcttccttttacgtacttggatatgctagaagtaagatacctatcggtgaattcagggaaagtattcgtgaatctgtgaagccagatactgaaagcaaacaggtgtttcaggacttcattgaccgagtatcttacttcagtggtcagtatgatcagagcagttcttatgtggaatttcgaaaacacctagaatcagttgaaaaaaaagcagactcttcgaaagcacttcgtatcttttatatcgccttaccaccatctgtttacgtgacagtcagttctcatatatatgagaatttatatttaccaggaaaatcgcggttagttattgaaaaaccgtttggtaaaaactatcaatcggctgttaaactcaaagaagaagttcataagcattggaaagaggaagaaatttatcggattgatcattatacagccaaagatatggttaacaattttttcacccttcgttttgcaaactcttcgtccattgacgcagttttaaatcgccattctattcaatccgtcgaaatacacatgtatgaaacgggaggctgtgaaggccgtattggttactatgatgcgaatggagtcgttcgcgacgtcgtacagaatcatttaactcaaattttttgtattgctgctatgaatgaaccgaagtctgcttctgcgagtgatgttcgtgctgaaaaggtcaatttgttgaaagctaccagaccagcatctttgaaagaaagtatgcttggtcagtatacaactagcgaagacggtaaaataccgggctacttagacttggagggagtccctaaagatagtaaagccaccacatttgctgcatccactcttcatgttgataatgatcgatggaagggcgtacccttcgtatttgtctctggtaagcggatgaaaaaaggtgaagtatatatcaagtactatttccgtctaaaagactccggaattttctccgacgtaaaacgacgtcggtacttgattcttcatgttcagccggaggagtttgtcaatttgacatgtactattaataaacccatgactactgaccttcaaccgattgacgcctatgcttcgctcaattataatgagcaatttaaagatctgatgaaggaaaaacgagatggctatgaaattttattcgaagatgcaattcgcggtgatcccactaagttcattcgttatgatgaggttgagtatgcttggaagatatgggacgaaatcctcgattctcccaaaaaacctattccctatccagctggttcagatggtcctgagggtttggaagcttatatgaaaaggcatctaggccatgaatag

SEQ ID NO: 2471 - protein, 473 aa, Schizosaccharomyces pombe
MVTFMVFGASGNLANKKTFPALFHLFKRNLVDRSSFYVLGYARSKIPIGEFRESIRESVKPDTESKQVFQDFIDRVSYFSGQYDQSSSYVEFRKHLESVEKKADSSKALRIFYIALPPSVYVTVSSHIYENLYLPGKSRLVIEKPFGKNYQSAVKLKEEVHKHWKEEEIYRIDHYTAKDMVNNFFTLRFANSSSIDAVLNRHSIQSVEIHMYETGGCEGRIGYYDANGVVRDVVQNHLTQIFCIAAMNEPKSASASDVRAEKVNLLKATRPASLKESMLGQYTTSEDGKIPGYLDLEGVPKDSKATTFAASTLHVDNDRWKGVPFVFVSGKRMKKGEVYIKYYFRLKDSGIFSDVKRRRYLILHVQPEEFVNLTCTINKPMTTDLQPIDAYASLNYNEQFKDLMKEKRDGYEILFEDAIRGDPTKFIRYDEVEYAWKIWDEILDSPKKPIPYPAGSDGPEGLEAYMKRHLGHE

SEQ ID NO: 2472 - DNA, 1503 bp, Schizosaccharomyces pombe
  CDS (1)..(1503)
atgagttctgcaaatttatctatcaaggaaaatggcgcaatggtcgttttcggcgcttccggtgatctatccaagaaaaagacgtttccagctcttttctctttgtttagcgaaggacgtctccccaaagatattagaatcgttggctatgcgcgctccaagattgaacatgaagactttttagatcgcattacccaaaacatcaaaattgatgaagaggattcccaggccaaagagaagcttgaggaatttaaaaagagatgctcttactatcgtggctcttacgacaagcctgaagatttcgagggcttgaactctcatttgtgtgagagggaaggcgaccgttctacccacaaccgcattttctatctcgcgttacctcccgacgttttcgtatctgtagctacaaaccttaaaaaaaaatgtgtgcccgaaaaaggtattgctcgtcttgtaatcgagaagccatttggcgtcgatttgaaatccgcccaggaactccaatcccaattagctcccctttttgatgagaaggaaatttatcgtattgatcactatttaggcaaggagatggttcaaaatttggttcatcttcgtttttgcaatcctgttatttctcatctttgggacaaaaacagtatttccagtgttcaaattacattcaaagagcctattggtacggaaggccgtggtgggtactttgactctagtactattgtccgtgatatcgtgcaaaaccaccttgtccaaattctgacccttttgaccatggaaaccccgaccactttctctgcagacgatcttcgtgacgagaaagtcaaggtattgcgtcgcactcgattgggagatctcaaagatattgttcttggtcaatatgtcaaaagcaaggacggtaaaaaacctggctaccttgatgacgagactgttcccaagggtagtaggtgtcccacttactcagctattccctgttttattgataccgaaagatggcgcggcgttcctttcttacttaaagctggtaaagccatggatattggcaaggtagagattcgtgttcagttcaaagctgctgcaaatggtttatttaaggacgcatatcataatgagctcgtaatccgtgttcagccagacgaagctatttacttcaagatgaacattaagcaacccggtcttagtgaggctcccctccttactgatttggacttgacttactctcgtagatttaagaacatgaagctccatgaagcatatgaagcattgtttttggacgcgtttgccggtgaccaatcccgttttgctcgtatcgacgaattagaatgtgcctggtctttagttgatcctcttttgaaatatatggaggaagagaaacctgtacccgagccttacgagtatggttccgatggtcccgaatgtttatactcttttttgaaaaagttcggatatatttatgattcccctgattactatgattatccagtcatgtccgttccttccgatcactaa

SEQ ID NO: 2473 - protein, 500 aa, Schizosaccharomyces pombe
MSSANLSIKENGAMVVFGASGDLSKKKTFPALFSLFSEGRLPKDIRIVGYARSKIEHEDFLDRITQNIKIDEEDSQAKEKLEEFKKRCSYYRGSYDKPEDFEGLNSHLCEREGDRSTHNRIFYLALPPDVFVSVATNLKKKCVPEKGIARLVIEKPFGVDLKSAQELQSQLAPLFDEKEIYRIDHYLGKEMVQNLVHLRFCNPVISHLWDKNSISSVQITFKEPIGTEGRGGYFDSSTIVRDIVQNHLVQILTLLTMETPTTFSADDLRDEKVKVLRRTRLGDLKDIVLGQYVKSKDGKKPGYLDDETVPKGSRCPTYSAIPCFIDTERWRGVPFLLKAGKAMDIGKVEIRVQFKAAANGLFKDAYHNELVIRVQPDEAIYFKMNIKQPGLSEAPLLTDLDLTYSRRFKNMKLHEAYEALFLDAFAGDQSRFARIDELECAWSLVDPLLKYMEEEKPVPEPYEYGSDGPECLYSFLKKFGYIYDSPDYYDYPVMSVPSDH

SEQ ID NO: 2474 - DNA, 1428 bp, Schizosaccharomyces pombe
  CDS (1)..(1428)
atgctatccatcattgttttcggtgcatccggcgatctcgctaccaaaatgactttcccggccttgtttgccctttacgtccgcaaaattattcccgaggactttcaaatcatcggctatgcccgttccaaattgtcccaagaggccgctaacaaaatcgtcaccgcccatattcccattgacgatactgtcggtgcttctcaaaaggccttaaacacctttgtcgagcattacaagtatgtccccggtacttatgataagcccgagtcttttgagatgctaaacagcattattgctgaaaaggagactgctcccgcctccgaatgcacacgtatcttttacttggttctgcctcctcatctctttgctcccgtttccgagctaatcaagagtaaggctcatcccaatggtatggtcactcgtcttattgttgagaagcccatcggcttcgactacaagtctgccgatgccattctcagcgatctcagcaagcactggtctgccaaggatactttcaaagtcgaccatttccttggcgaggatatgattgatggattcactgcaattcgctttgcaaactccatgttcgagcccatctggaatcgtgaacacattgaaagtgttcgtgtcgactttcgtgaagactttggttgtgagggacgtggaggttattttgagggcgctggtatccttcgcgatgtcgttcaaaatcatcttttgcaactacttaccttactttgcatcgaagagccaaagtctcaagatgccgaagatatcatcaaatgcaaggttgacttcttgaaatcccttcatcccgtttccaaggaggacatcgtctatggacagtacactaaaagtgcaaatggaaaggtccccggttatcgtgaactggatggtgttgctgatgacagtgaagtttctacattctgtgctcttcaacttcgctctgaagcacctcgttggaagggtattcccatcatcatttctgccggtaaaggtttggaccgcgattactttgaagctcgtatcacttttaagcgtagggaaggaggtatgttccctaccgttgatagcagcaatgttctagtccttcgtgtttatcccaaggaattcattgccctcaagggacacattaaacaacctggtttctctcgtcaaattgttcctgtgactttggacgttaagtatcccgaagctttccctgatacatggatccataaggcctatgaagtggttattgccgatgccattaatggaaagcatacacactttattagtgatgatgaggttcgtacctcttggaaaatctttgatgatgtccttgacactacaggcgatttgtcacctcttccttatgcttttggttcccaccatggtccagatgccacactcgaatttttcaagaagcgtaatttagagtgggattaa

SEQ ID NO: 2475 - protein, 475 aa, Schizosaccharomyces pombe
MLSIIVFGASGDLATKMTFPALFALYVRKIIPEDFQIIGYARSKLSQEAANKIVTAHIPIDDTVGASQKALNTFVEHYKYVPGTYDKPESFEMLNSIIAEKETAPASECTRIFYLVLPPHLFAPVSELIKSKAHPNGMVTRLIVEKPIGFDYKSADAILSDLSKHWSAKDTFKVDHFLGEDMIDGFTAIRFANSMFEPIWNREHIESVRVDFREDFGCEGRGGYFEGAGILRDVVQNHLLQLLTLLCIEEPKSQDAEDIIKCKVDFLKSLHPVSKEDIVYGQYTKSANGKVPGYRELDGVADDSEVSTFCALQLRSEAPRWKGIPIIISAGKGLDRDYFEARITFKRREGGMFPTVDSSNVLVLRVYPKEFIALKGHIKQPGFSRQIVPVTLDVKYPEAFPDTWIHKAYEVVIADAINGKHTHFISDDEVRTSWKIFDDVLDTTGDLSPLPYAFGSHHGPDATLEFFKKRNLEWD

SEQ ID NO: 2476 - DNA, 1862 bp, Arabidopsis thaliana (mouse-ear cress)
  CDS (43)..(1593)
ctacgtcagggtttggttagagtgttaaaaaactattggaagatgggttctggtcaatggcatatggagaagaggtctactttaaagaatgattcgtttgtaaaagaatacaatccaatcacggaaactgggagtctctctatcattgttcttggtgcttctggtgatcttgctaagaagaagacttttcctgcacttttcaatctatttcatcagggatttcttaatccagatgaagttcatatatttggatatgcaaggagtaagattactgatgaggagcttagagataaaatccgcggatatcttgttgatgagaagaatgcatctaagaaaacagaagctttgtccaagtttctaaagctgattaagtatgtgagtggaccttatgattctgaggaagggtttaagagattagacaaggcgattttggagcacgagatatctaaaaagactgctgaaggatcttcgaggagattgttttatcttgcacttcctccgtctgtataccctcctgtaagcaagatgatcaaggcatggtgcactaacaaatctgatcttggtggatggactaggattgttgttgagaaaccatttggaaaggatttggaatctgcagagcagctgagttctcagattggagccttgtttgaagaaccacagatttatcgtattgatcactatctgggaaaagagttagttcaaaacatgttggttcttcggtttgccaatcgcttgtttttgccactatggaaccgcgacaatattgcaaacgtacagatcgttttcagagaagattttggaactgaaggtcgcggtggatattttgatgaatacggaatcattcgtgatattattcaaaaccacttgctccaggttctttgccttgtcgccatggagaaaccaatctctcttaaacccgagcacatccgggatgagaaagtgaaggttcttcaatctgtgattcccataaaagatgaagaggtggttcttggacaatatgaaggatatagagatgatccaactgttccaaatgactcaaacactccaacgtttgccacaacaattcttcgcattaacaatgaaagatgggaaggtgttccttttatactgaaggccggaaaggcaatgagttcaaagaaggcagatattcgcattcagtttaaagatgttcctggcgacatattcaaatgtcaaaaccaagggaggaacgagtttgttatacgcttgcagccttcagaggccatgtacatgaagctaactgtgaagcaaccgggtctggagatgcaaaccgtgcagagtgaactagacctatcgtacaagcagcgttaccaagatgtctcaattccagaggcttacgaacgccttattcttgacacaatcagaggcgaccaacaacactttgttcgcagagacgaattaaaggcagcttgggaaatcttcactccactgcttcacaggatcgacaagggagaagtgaaatcggtcccatacaaacaaggtagccgtggcccagcggaagcagatcagctacttaagaaagctggttatatgcagactcatggctacatttggatccctcctacattgtaaatggtataatcatagagatgatgatgatgagtacacacaaaataagagggttttttttcttttttttccttgcttgctgaataaaaactcttcaccagtttggagtttgtttaagtgaatcttatgtatactagtgatcttcactaggacattgtttgtttatgccttgtagtttttgttgtactagtcccttgttttctttttttacataatgcaaaacagctttgtggaaaagctaattaaattaagaaaaaaaaaccctgacgtag

SEQ ID NO: 2477 - protein, 516 aa, Arabidopsis thaliana (mouse-ear cress)
MGSGQWHMEKRSTLKNDSFVKEYNPITETGSLSIIVLGASGDLAKKKTFPALFNLFHQGFLNPDEVHIFGYARSKITDEELRDKIRGYLVDEKNASKKTEALSKFLKLIKYVSGPYDSEEGFKRLDKAILEHEISKKTAEGSSRRLFYLALPPSVYPPVSKMIKAWCTNKSDLGGWTRIVVEKPFGKDLESAEQLSSQIGALFEEPQIYRIDHYLGKELVQNMLVLRFANRLFLPLWNRDNIANVQIVFREDFGTEGRGGYFDEYGIIRDIIQNHLLQVLCLVAMEKPISLKPEHIRDEKVKVLQSVIPIKDEEVVLGQYEGYRDDPTVPNDSNTPTFATTILRINNERWEGVPFILKAGKAMSSKKADIRIQFKDVPGDIFKCQNQGRNEFVIRLQPSEAMYMKLTVKQPGLEMQTVQSELDLSYKQRYQDVSIPEAYERLILDTIRGDQQHFVRRDELKAAWEIFTPLLHRIDKGEVKSVPYKQGSRGPAEADQLLKKAGYMQTHGYIWIPPTL

SEQ ID NO: 2478 - DNA, 1696 bp, Leuconostoc mesenteroides
  CDS (123)..(1583)
tctagtcatttaatcaatttttgacttgttcaacgcttaatatgtttgtgaatcccgtacttttccagacctttttgcgttataatggagagtgaatttaattataatataaggggaacatcatggtttcagaaatcaaaacgttggtaactttctttggcggaactggtgatttagcaaagcgtaagctttacccatcagttttcaacctctacaaaaaaggatacttacaagaacactttgccattgttgggacagcacgtcaacaattaagtgatgacgagtttaagcaattggttcgtgattcaattaaagactttactgaagatcaagcacaagccgaagcgtttattgcgcatttttcttaccgtgcgcacgatgtcacagatgccgcttcttatggtatcttgaagtcagcgatcgaagaagcagcaaccaaatttgacattgatggcaatcgtattttctatatgtcagttgcccctcgtttcttcggtacaatcgctaaatatttgaaatcagaaggtttgctagctgagactggctacaatcgtttgatgattgaaaagccttttggtacatcatacgccaccgcagaagaattgcaaagtgatttggaaaatgcatttgatgatgaccaactgttccgtattgaccactatcttggaaaagaaatggtacaaaatattgcagcattacgttttggtaacccaatctttgatgccgcttggaataaggactatatcaaaaacgtacaagtaactttggctgaagttctaggtgttgaagagcgtgctggttactacgataccactggcgcccttttggatatgattcaaaaccacacaatgcaaattgttggttggttagcaatggaaaaacctgaatcattcaatgataaggatatccgtgcagctaaaaacgccgccttcaatgcattaaagatttataacgaagaagaagtgaataagtacttcgttcgtgcacaatatggtgctggtgatacagctgattacaagccatatttggaagaagcagatgtccctgctgactcaaagaacaacacattcattgctggtgaattgcagttcgatttgccacgttgggaaggtgttcctttctatgttcgttcaggtaagcgtttggctgccaagcaaacacgtgttgatattgtatttaaggctggcacattcaactttggttcagaacaagaagcacaagaatcagtactctcaatcatcattgatccaaagggtgctattgaattgaagcttaacgctaagtcagttgaagatgccttcaacacccgcacaatcaacttggattgggcagtatctgatgaagacaagaagaacacaccagaaccatacgaacgtatgattcacgatacaatgaatggtgacggatcaaactttgctgattggaacggtgtatcaattgcttggaagtttgttgacgcaattactgccgtttacgatgcagataaagcaccattggagacatataagtcaggttcaatgggtcctgaagcatcagacaagctattagctgaaaatggcgatgcttgggtatttaaaggataagcacatttaaaaagaccatcaaacaaatctttgtttgacggtctttttatattgtctgatttaagatgcgtttggtttcacggaaaacggctgacaaattggtgtattgatcc

SEQ ID NO: 2479 - protein, 486 aa, Leuconostoc mesenteroides
MVSEIKTLVTFFGGTGDLAKRKLYPSVFNLYKKGYLQEHFAIVGTARQQLSDDEFKQLVRDSIKDFTEDQAQAEAFIAHFSYRAHDVTDAASYGILKSAIEEAATKFDIDGNRIFYMSVAPRFFGTIAKYLKSEGLLAETGYNRLMIEKPFGTSYATAEELQSDLENAFDDDQLFRIDHYLGKEMVQNIAALRFGNPIFDAAWNKDYIKNVQVTLAEVLGVEERAGYYDTTGALLDMIQNHTMQIVGWLAMEKPESFNDKDIRAAKNAAFNALKIYNEEEVNKYFVRAQYGAGDTADYKPYLEEADVPADSKNNTFIAGELQFDLPRWEGVPFYVRSGKRLAAKQTRVDIVFKAGTFNFGSEQEAQESVLSIIIDPKGAIELKLNAKSVEDAFNTRTINLDWAVSDEDKKNTPEPYERMIHDTMNGDGSNFADWNGVSIAWKFVDAITAVYDADKAPLETYKSGSMGPEASDKLLAENGDAWVFKG

SEQ ID NO: 2480 - DNA, 1545 bp, Corynebacterium glutamicum
  CDS (1)..(1545)
atgagcacaaacacgaccccctccagctggacaaacccactgcgcgacccgcaggataaacgactcccccgcatcgctggcccttccggcatggtgatcttcggtgtcactggcgacttggctcgaaagaagctgctccccgccatttatgatctagcaaaccgcggattgctgcccccaggattctcgttggtaggttacggccgccgcgaatggtccaaagaagactttgaaaaatacgtacgcgatgccgcaagtgctggtgctcgtacggaattccgtgaaaatgtttgggagcgcctcgccgagggtatggaatttgttcgcggcaactttgatgatgatgcagctttcgacaacctcgctgcaacactcaagcgcatcgacaaaacccgcggcaccgccggcaactgggcttactacctgtccattccaccagattccttcacagcggtctgccaccagctggagcgttccggcatggctgaatccaccgaagaagcatggcgccgcgtgatcatcgagaagcctttcggccacaacctcgaatccgcacacgagctcaaccagctggtcaacgcagtcttcccagaatcttctgtgttccgcatcgaccactatttgggcaaggaaacagttcaaaacatcctggctctgcgttttgctaaccagctgtttgagccactgtggaactccaactacgttgaccacgtccagatcaccatggctgaagatattggcttgggtggacgtgctggttactacgacggcatcggcgcagcccgcgacgtcatccagaaccacctgatccagctcttggctctggttgccatggaagaaccaatttctttcgtgccagcgcagctgcaggcagaaaagatcaaggtgctctctgcgacaaagccgtgctacccattggataaaacctccgctcgtggtcagtacgctgccggttggcagggctctgagttagtcaagggacttcgcgaagaagatggcttcaaccctgagtccaccactgagacttttgcggcttgtaccttagagatcacgtctcgtcgctgggctggtgtgccgttctacctgcgcaccggtaagcgtcttggtcgccgtgttactgagattgccgtggtgtttaaagacgcaccacaccagcctttcgacggcgacatgactgtatcccttggccaaaacgccatcgtgattcgcgtgcagcctgatgaaggtgtgctcatccgcttcggttccaaggttccaggttctgccatggaagtccgtgacgtcaacatggacttctcctactcagaatccttcactgaagaatcacctgaagcatacgagcgcctcattttggatgcgctgttagatgaatccagcctcttccctaccaacgaggaagtggaactgagctggaagattctggatccaattcttgaagcatgggatgccgatggagaaccagaggattacccagcgggtacgtggggtccaaagagcgctgatgaaatgctttcccgcaacggtcacacctggcgcaggccataa

SEQ ID NO: 2481 - protein, 514 aa, Corynebacterium glutamicum
MSTNTTPSSWTNPLRDPQDKRLPRIAGPSGMVIFGVTGDLARKKLLPAIYDLANRGLLPPGFSLVGYGRREWSKEDFEKYVRDAASAGARTEFRENVWERLAEGMEFVRGNFDDDAAFDNLAATLKRIDKTRGTAGNWAYYLSIPPDSFTAVCHQLERSGMAESTEEAWRRVIIEKPFGHNLESAHELNQLVNAVFPESSVFRIDHYLGKETVQNILALRFANQLFEPLWNSNYVDHVQITMAEDIGLGGRAGYYDGIGAARDVIQNHLIQLLALVAMEEPISFVPAQLQAEKIKVLSATKPCYPLDKTSARGQYAAGWQGSELVKGLREEDGFNPESTTETFAACTLEITSRRWAGVPFYLRTGKRLGRRVTEIAVVFKDAPHQPFDGDMTVSLGQNAIVIRVQPDEGVLIRFGSKVPGSAMEVRDVNMDFSYSESFTEESPEAYERLILDALLDESSLFPTNEEVELSWKILDPILEAWDADGEPEDYPAGTWGPKSADEMLSRNGHTWRRP

SEQ ID NO: 2482 - DNA, 2491 bp, Cricetulus griseus
  CDS (136)..(1683)
tgaggcgggtcagctcagtcaaagcacccgccctcctgcgttaaacgagccagctaagcgcacgccccggaaacgagctgtgcactccagaactgtaaacctgtttggcagcagcaactaaacacagaaaacaccatggcagagcaggtggccctgagccggacccaggtgtgtggcatcctgagggaagagttgtaccagggtgatgccttccaccaagctgatacacatatatttatcatcatgggtgcatcgggtgacctggccaagaagaagatctatcccactatctggtggctgttccgggatggccttctacccgaagacaccttcattgtgggctatgcccgctcccgactcacagtggatgacatccgcaagcagagtgagcccttctttaaagccaccccagaggaaagacccaagctggaggagttctttgcccgtaactcctatgtggctggccagtatgatgatccagcctcctacaagcacctcaacagccacatgaatgccctgcatcaggggatgcaggccaaccgcctattctacctggccttgccccccacagtctatgaagctgtcaccaagaacattcaagagacctgcatgagtcagacaggctggaaccgcatcatagtggagaagcccttcgggagagacctgcagagctccaaccagctgtcgaaccacatctcctctctgttccgtgaggaccagatctaccgcattgaccactacctgggcaaggagatggtccagaacctcatggtgctgagatttgccaacaggatctttggccccatctggaaccgagacaacattgcctgtgtgatcctcacatttaaagagccctttggtactgagggtcgtgggggctactttgatgaatttgggatcatcagggatgttatgcagaaccacctcctgcagatgttgtgtctggtggccatggaaaaacctgcctccacagattcagatgatgtccgtgatgagaaggtcaaagtgttgaaatgtatctcagaggtggaaaccagcaatgtggtccttggccagtatgtggggaaccccaatggagaaggagaagctaccaatgggtacttggatgaccccacagtgccccgtgggtccaccactgccacctttgcagcagctgtcctctatgtggagaatgagcggtgggatggggtacccttcatcctgcgctgtggcaaagccctgaatgaacgcaaggctgaggtgagactacagttccgagatgtggcaggcgacatcttccaccagcagtgcaagcgtaatgagctggtgattcgtgtgcagcccaatgaggctgtatacaccaagatgatgaccaagaagcctggcatgttcttcaaccctgaggagtcagagctggacttgacctatggcaacagatacaagaatgtgaagctccctgatgcctatgaacgcctcatcctggatgtcttctgtgggagccagatgcactttgtccgcagtgatgaactcagggaagcctggcgtatcttcacaccactgctgcacaagattgatcaagagaagccccagcctatcccctatgtttatggcagccgcggccccacagaggcagatgagctgatgaagagagtgggcttccagtatgagggcacctacaaatgggtgaaccctcacaagctctgagccttgggaacttataccatctgcactctgccccttttggacaccctttctgtgtctatccttcttaccacctaacctcatatttggactattagccccacattggaacgactttgggaccataggctttagccacacattccagtccctgggctcgtgccaccactctataccctatgctgctgctgctgctgctaccactgccaccaccaccatcactgctgctgctgctgttaccaccaccactgaccccagctacattcctcaactatcaaattctccaagttctcaaaactcactgtaatgctttcagggccaccattgaccctatctgagccacccatctctccacaagaagcaaatcacctcctcccctcactccagcccctgcaaagggaagaagaacagcctatcagtctgtccctagactcctcaagacaggagttaggaacaatggggaggaaccttgagcctcagagggataaagaccaaaccacactccctagtgtctatgggcaagctcctcaaaattcaaatgaaatggtcaaggacacccatgtgagaagacctgcccatggccacaccagcttcagtgccacttgacattcctcctcaccagctggaagagaccacatactgcctaacaatattgtggcactagagatgtcccctaaccaactccatactccatggtcatcatcccacccacaggcagccttctcaccaaaggaaggcagaagtagcagctatgatttccctaccccaaccttgcaattaaatcctccaacagttaaaaaaaaaaaaaaaa

SEQ ID NO: 2483 - protein, 515 aa, Cricetulus griseus
MAEQVALSRTQVCGILREELYQGDAFHQADTHIFIIMGASGDLAKKKIYPTIWWLFRDGLLPEDTFIVGYARSRLTVDDIRKQSEPFFKATPEERPKLEEFFARNSYVAGQYDDPASYKHLNSHMNALHQGMQANRLFYLALPPTVYEAVTKNIQETCMSQTGWNRIIVEKPFGRDLQSSNQLSNHISSLFREDQIYRIDHYLGKEMVQNLMVLRFANRIFGPIWNRDNIACVILTFKEPFGTEGRGGYFDEFGIIRDVMQNHLLQMLCLVAMEKPASTDSDDVRDEKVKVLKCISEVETSNVVLGQYVGNPNGEGEATNGYLDDPTVPRGSTTATFAAAVLYVENERWDGVPFILRCGKALNERKAEVRLQFRDVAGDIFHQQCKRNELVIRVQPNEAVYTKMMTKKPGMFFNPEESELDLTYGNRYKNVKLPDAYERLILDVFCGSQMHFVRSDELREAWRIFTPLLHKIDQEKPQPIPYVYGSRGPTEADELMKRVGFQYEGTYKWVNPHKL

SEQ ID NO: 2484 - DNA, 1852 bp, Nicotiana tabacum
  CDS (102)..(1634)
acgttttgtctctcataatttcttcagatcagaaatcacaaggttgaagtgatcacaactacttggctgtattgagttcaagctggtcgtgggccttgaagatggcagcatcatggtgcattgaaaaaagaggttctcttcggctcgactcttttagagagaatgataatatacctgaaaccgggtgtctttccattattgttcttggcgcttctggtgatcttgccaagaagaaaacttttcctgctctcttcaacctctaccgacagggattcctgcaatccaatgaagttcacatttttggctatgcaaggacaaaaatttctgacgatgacttgagaagccgtatccgtgggtatctttctaaggggaaagaatatgaagaagtatcggagtttctgcaactgattaaatacgtcagtggctcttatgattctggggagggctttagtttactggacaaggcgatagctgagcacgaattcgcaaaaaatagcacggaaggatcatccagaagactcttctactttgctcttcctccatcagtatatccctctgtttgcaggatgataaaaaactattgtatgaacaaatctgatcttggtggttggactcgcattgttgttgagaagcccttcggcaaggatttagcttcagctgagcaactaagttcccagataggagaactatttaatgaaccccaaatttaccggattgaccattatttggggaaggagttggttcagaatgtgttggttctgcgttttgcaaaccgcttctttttgccgctctggaatcgtgacaacattgataatatacagattgtctttagggaggactttggaactgaaggccgcggtggatattttgatgaatatgggattatacgtgacattattcagaatcagctactgcaggtcctttgccttgttgctatggagaagcccgtgtctcagaagcccgagcacgtccgggatgagaaagttaaggttcttcaatcaatgcttccaatcaaagatgaagaggtcgttcttgaacaatatgaaggctataaggatgacccaacggttcctggcaactcaaatactcctacttttgcaactatggttttacgcatacacaatgaaagatgggaaggtgtgccctttataatgaaggctggaaaagcactaaattcaagaaaagcagaaatacgagtgcagtttaaggatgttcctggtgatatatttagatgtaaaaagcaggggagaaatgagtttgttatacgcctccagccttcagaagccatgtacatgaagcttacggtcaagaagcctgggcttgaaatgtcaactgttcaaagtgaattagacctgtcatatgggcagcgttatcaaggggttgtcattccagaggcttatgaacgtctgattctcgacacaataagaggggatcagcagcattttgtgcgcagagatgagctcaaggccgcttgggagatttttaccccacttttgcatagaattgacgatggagagatcaagccaattccatacaagccgggcagcagaggtcctgctgaagcagatgagttgctgcaaaatgtcggttacgttcaaactcatggctatatatggattcctcccacattataagtttgcaatgcgtgtcgcgaattacatcctactgtcccctaaatatgagtattaccttgtaacttttgccatgtatgatcctacctatgtgcaaactcgatgagaagtaagattttagtcggtataggagaaatatatctgcatgtaataatgtcatcttttttaagctaatgcatggaagtttgaatatatctcaagtttttcgcggccgcgaattc

SEQ ID NO: 2485 - protein, 510 aa, Nicotiana tabacum
MAASWCIEKRGSLRLDSFRENDNIPETGCLSIIVLGASGDLAKKKTFPALFNLYRQGFLQSNEVHIFGYARTKISDDDLRSRIRGYLSKGKEYEEVSEFLQLIKYVSGSYDSGEGFSLLDKAIAEHEFAKNSTEGSSRRLFYFALPPSVYPSVCRMIKNYCMNKSDLGGWTRIVVEKPFGKDLASAEQLSSQIGELFNEPQIYRIDHYLGKELVQNVLVLRFANRFFLPLWNRDNIDNIQIVFREDFGTEGRGGYFDEYGIIRDIIQNQLLQVLCLVAMEKPVSQKPEHVRDEKVKVLQSMLPIKDEEVVLEQYEGYKDDPTVPGNSNTPTFATMVLRIHNERWEGVPFIMKAGKALNSRKAEIRVQFKDVPGDIFRCKKQGRNEFVIRLQPSEAMYMKLTVKKPGLEMSTVQSELDLSYGQRYQGVVIPEAYERLILDTIRGDQQHFVRRDELKAAWEIFTPLLHRIDDGEIKPIPYKPGSRGPAEADELLQNVGYVQTHGYIWIPPTL

SEQ ID NO: 2486 - DNA, 1821 bp, Nicotiana tabacum
  CDS (88)..(1623)
ggcgtctcacaatttcttcagaaatcacaaggttggattgatcatacttcgctgagttgagggtgagctggttgtgaggccttgaagatggcagcatcatggtgcattgaaaaaaggggttctattcggctcgactcttttagagataatgataatatacctgaaactgggtgtctttccattattgttcttggtgcttctggtgatcttgccaagaagaaaacttttcctgcgctcttcaacctctaccggcagggatttctgcaatccaatgaggttcacatttttggctatgcaaggaccaaaatttctgacgacgacttgagaggccgtatccgtgggtatctttctcaggggaaagaaaatgaagaagaagtatcggagtttctgcagctgattaaatacgtcagtggctcttatgattctggggagggctttagtttactggacaaggctatagctgagcacgaaattgcaaaaaatagcacagaaggatcatccagaagactcttctactttgctcttcctccatcagtatatccctccgtttgcagaatgataaaaaattactgtatgaacaaatctgatcttggtggttggactcgcattgttgttgagaagcccttcggcaaggatttagcttcagctgagcaactaagttctcagataggagaactatttgatgaaccacaaatttaccggattgaccattatttgggaaaggagttggtgcagaatttgttggtgctgcgttttgcaaatcgcttctttttgccgctctggaatcgtgacaacattgataatatacagattgtctttagggaggactttggaactgaaggtcgctgtggatattttgatgaatatgggattatacgtgacattattcagaatcagctattgcaggtcctttgccttgttgccatggagaagcctgtgtcccagaagcccgaacacattcgggatgagaaagttaaggttcttcaatcaatgcttccaattaaagatgaagaggttgttcttggacaatatgaaggctataaggatgacccaacggttcctgacaactcaaatactcctacttttgcaactatggttttacgcatacacaatgaaagatgggaaggtgtgccctttataatgaaggctggaaaagcactaaattcaagaaaagcagaaatacgagtgcagtttaaggatgttcctggtgatatatttagatgtaaaaagcaggggagaaatgagtttgttatacgcctccagccttcagaagccatgtacatgaagcttacggtcaagaagcctgggcttgaaatgtcaactgttcaaagtgaattagacctgtcatataggcagcgttatcaaggggttgtcattccagaggcttatgaacgtctgattctcgacacaataagaggggatcagcagcattttgtgcgcagagatgagctcaaggccgcttgggagatttttaccccacttttgcatagaattgacgatggagaggtcaagccaattccatacaagccaggcagcagaggtcccgctgaagcagatgagttgctgcaaaatgtcggttacgttcaaactcatggctatatatgtattcctcccacattataagtttgcaatgcgtgtcgcgaattacatcctactgtcccctaaatatgagtattaccttgtaacttttgccaggtatgatcctgcctatgtgcaaactcgatagaagtaagattttcgtcggtataggagaaatatatctgcatgtaataatgtcatcttttttaagctaatgcatggaagtttggcggccgcgaattc

SEQ ID NO: 2487 - protein, 511 aa, Nicotiana tabacum
MAASWCIEKRGSIRLDSFRDNDNIPETGCLSIIVLGASGDLAKKKTFPALFNLYRQGFLQSNEVHIFGYARTKISDDDLRGRIRGYLSQGKENEEEVSEFLQLIKYVSGSYDSGEGFSLLDKAIAEHEIAKNSTEGSSRRLFYFALPPSVYPSVCRMIKNYCMNKSDLGGWTRIVVEKPFGKDLASAEQLSSQIGELFDEPQIYRIDHYLGKELVQNLLVLRFANRFFLPLWNRDNIDNIQIVFREDFGTEGRCGYFDEYGIIRDIIQNQLLQVLCLVAMEKPVSQKPEHIRDEKVKVLQSMLPIKDEEVVLGQYEGYKDDPTVPDNSNTPTFATMVLRIHNERWEGVPFIMKAGKALNSRKAEIRVQFKDVPGDIFRCKKQGRNEFVIRLQPSEAMYMKLTVKKPGLEMSTVQSELDLSYRQRYQGVVIPEAYERLILDTIRGDQQHFVRRDELKAAWEIFTPLLHRIDDGEVKPIPYKPGSRGPAEADELLQNVGYVQTHGYICIPPTL

SEQ ID NO: 2488 - DNA, 1539 bp, Chlamydia trachomatis
  CDS (1)..(1539)
atgctaggttgtaccttggaagaaattaaagactttggccccacattaccagcctgccctccctgtatcgtggttatttttggtgctacaggagacttgacctctaggaagctctttcctgctttatacaatttaacaaaggaaggacgtctatccgaaaactttgtttgtgttgggtttgctaggcgacctaagtctcatgagcaatttctcgaagaaatgaagcttgccgttcagcatttctctcactcatcggaaatagatattcgagtttgggaaagtctggaaaatagaatcttttaccaccaagctaatttttctgatgccgaaggctactctgctctgaaagcttatttggagcaactagatcaacaatatggaacacaagggaatcgtcttttttatttatcaacaccaccagattatttccaggaaatcatccgcaatttaaatcggcatcagctattctatcatgaacaaggagcacaacagccttggtctcggctaattatagaaaagccttttggagttaatttagaaacagctcgagagcttcaacaatgcattgatgccaatattgatgaagagtcggtttatcgaatagaccattatttaggaaaagaaacggttcaaaacattctgactattcgttttgctaatactctctttgagtcttgctggaattctcagtacatagatcatgtgcaaatcagcgttagcgaatcaattggtataggatctcgagggaatttcttcgaaaagtcgggcatgctacgagacatggtacagaatcatttgacgcagctgctatgtctactgactatggaacctccttctgaattttcttcagaagaaataaaaaaagaaaaaattaaaattctaaagaaaattcttcctatccgcgaagaagatgctgttcgtggccaatatggtgaagggattgtgcaagatgtttcagttctgggctatcgggaggaagaaaatgtcgatccgaattcttcagtagaaacctacgttgcattaaaattatttatcgacaatcctcgctggaaaggggttcccttttacttacaagcagggaaacgtcttactaaaagaacaacagatatcgctgtgatctttaaaaaatccagctacaatttattcaatgcagagaattgtcctttgtgtccgttagaaaatgatttacttattattcgtattcaaccggatgaaggtgttgcgctacaatttaactgcaaggttccaggaacaaataagctcgtacgtcctgtaaaaatggacttccgttacgacagctattttaatactgttactcccgaagcttatgaacggttactgtgcgactgtatccttggggacagaacgctattcactagcaatgaagaagtcttagcatcttgggaactattttctcctctattagaaaaatggtctcaagtacaccctatattccctaactatatggccggatctttacgtcctcaagaagctgatgaactattatctagagatggaaaagcttggcggccctattaa

SEQ ID NO: 2489 - protein, 512 aa, Chlamydia trachomatis
MLGCTLEEIKDFGPTLPACPPCIVVIFGATGDLTSRKLFPALYNLTKEGRLSENFVCVGFARRPKSHEQFLEEMKLAVQHFSHSSEIDIRVWESLENRIFYHQANFSDAEGYSALKAYLEQLDQQYGTQGNRLFYLSTPPDYFQEIIRNLNRHQLFYHEQGAQQPWSRLIIEKPFGVNLETARELQQCIDANIDEESVYRIDHYLGKETVQNILTIRFANTLFESCWNSQYIDHVQISVSESIGIGSRGNFFEKSGMLRDMVQNHLTQLLCLLTMEPPSEFSSEEIKKEKIKILKKILPIREEDAVRGQYGEGIVQDVSVLGYREEENVDPNSSVETYVALKLFIDNPRWKGVPFYLQAGKRLTKRTTDIAVIFKKSSYNLFNAENCPLCPLENDLLIIRIQPDEGVALQFNCKVPGTNKLVRPVKMDFRYDSYFNTVTPEAYERLLCDCILGDRTLFTSNEEVLASWELFSPLLEKWSQVHPIFPNYMAGSLRPQEADELLSRDGKAWRPY

SEQ ID NO: 2490 - DNA, 1581 bp, Vibrio vulnificus
  CDS (1)..(1581)
atgtcactgatagggtgggctcatcctttaagccgtatccaggcacacaacaagtacctcgtttttaagggaaagatgatggtaataccagaaaacagcagcatcgtaatttttggtgcttcaggtgatttaacatatcgcaagttgatccctgctttataccacctctacgcaagtaagcagctaccagaaaactttgctattttaggtgtcagccgcactgaatacagcgatgaatcttatcgcgaaaagttaaagcgctctcttcaggaaatggagaaaacggaaccagctattctggattcatttatcgaccatcttcactatcaagccatcaacacgtcagacacacaagactacgcgaagttggttgtacgtttagacgaattggccgctcaataccagttcgaacaacgtaatacactgttttatcttgccacaccgccaagcctttacagtgtcattccttcaagccttgctcatcacggtcttaacagtgaagaggatggttggaaacggctgatcattgaaaaaccgtttggttatgatttggcttcggcacgtcagctcgacaaagaaatacacgattgcttccaagagcatcagatctatcgcatcgaccactaccttggaaaagagaccgtgcaaaacttacttgttttccgtttctctaacgccatgtttgaacctctgtggaaccgcaacttcattgattatgtggaaatcacaggtgccgaattccttggcgtggaagagcgtggcggttattacgacggctccggcgctgtgcgcgatatgttccaaaaccatctactgcaagtattggcaatggtgggcatggaaccgcctgcacaaattaatgccgattccatgcgtgatgaagtagtgaaagttctgcagtgtttaaaaccgcttgaggaagatgatctgcgtaacaacctagttttgggtcaatacacagcatcagacgtgcgcggacaacatctgcttggctaccgtgaagaaaacggcgtagcggacgattctcgtactgagacttacattggtcttaaagcgtacatcaataactggcgttggaatggcgtgccattctacgtgcgcacgggtaagcgtcttccaactcgcgtaacagaagtggttatccacttcaaacaaacaccgcatccggtatttggccaaaacgccccagaaaacaaactgatcattcgtattcagcctgatgaaggcattcaaatgagcttcggtttgaaagaacctggtgcaggctttaaagcgaaagaagtgaagatgaacttccattatgcttcgttgcaagagacgcaaatgctgaccgcctatgagcgtctgcttcttgatgcgttaaacggcgatgcaacgctgtttgctcgcagcgatgcggtcgaagcgtgttggaaatacgttcaacctatcctcgatttcaaacaagatccacaagcactctttggttatgcctgcggcacttgggggccaaaagagtcagacgatttgctgcagcgtgacgatcgcgcgtggcgtttcccatgcaaaaacctaacagatacggactactgcgaactatga

SEQ ID NO: 2491 - protein, 526 aa, Vibrio vulnificus
MSLIGWAHPLSRIQAHNKYLVFKGKMMVIPENSSIVIFGASGDLTYRKLIPALYHLYASKQLPENFAILGVSRTEYSDESYREKLKRSLQEMEKTEPAILDSFIDHLHYQAINTSDTQDYAKLVVRLDELAAQYQFEQRNTLFYLATPPSLYSVIPSSLAHHGLNSEEDGWKRLIIEKPFGYDLASARQLDKEIHDCFQEHQIYRIDHYLGKETVQNLLVFRFSNAMFEPLWNRNFIDYVEITGAEFLGVEERGGYYDGSGAVRDMFQNHLLQVLAMVGMEPPAQINADSMRDEVVKVLQCLKPLEEDDLRNNLVLGQYTASDVRGQHLLGYREENGVADDSRTETYIGLKAYINNWRWNGVPFYVRTGKRLPTRVTEVVIHFKQTPHPVFGQNAPENKLIIRIQPDEGIQMSFGLKEPGAGFKAKEVKMNFHYASLQETQMLTAYERLLLDALNGDATLFARSDAVEACWKYVQPILDFKQDPQALFGYACGTWGPKESDDLLQRDDRAWRFPCKNLTDTDYCEL

SEQ ID NO: 2492 - DNA, 1476 bp, Photorhabdus luminescens
  CDS (1)..(1476)
atggcggttacttctacagctcaggcttgtgatttagtcatttttggcgctaaaggggatttggcacgccggaaattattgccttccctttatcagcttgagaaagcgggttatatccacccagaaacccggattatcggtgttggccgggctgattgggataaaaaagcttataccaaggttgttgaagaagctttaaatacattcttgccagaaaaattagattcagaattatggaagatattgagtgagcgtttggcgttctgcaatctggatgttaatcaaaaagaagactttgccaaattgaaggcaattcttaagcaggataatcggcctgcaatccattattttgcgatgccacccagtacttttggttcggtttgtcacggattgggccttgcagggctaaataaagagccaaatcgagttgtgatggaaaagcctttagggaccgatcttgaatcatccaaagccatcaatgatgaagtagctaaatatttcaatgagcgtcaggtttatcgcatcgatcattatctgggtaaagaaaccgtattgaatctgttggcgctgcggtttgccaattccttgtttgtgaataattgggataaccggacaattgatcatgtacaaattacagtagctgaagaagtcggtattgaaggccgttggggttattttgaccaagctgggcagatgcgcgatatgattcagaatcacctgttgcaaatattgaccatgattgctatgtctcctccggcagatctgacgacagaccgtatccgtgatgaaaaagtaaaagtattgcgttctctgcgctgtattgatcatacgaatgtgcgggagaagacggtacgaggtcaatacactgctggttttgttcaggggcataaggtaccggggtatctggaagaagagggggcaaaccagtccagccggacggaaacttttgtctctatccgtgtcgatattgatgactggcgttgggccggggttcctttctacctgagaaccggtaaacgtctgccaacgaaatgttccgaggtggtagtttatttcaaaaagcctgcactgaacttgttttctgagtcttatcaacaactaccgcagaataagctaacgattcgtttgcagccggatgaaggtattgatattgaagtgctgaacaaagctccggggctggaacacaagcatcgtctgcaaaccactaagctagatctgagtttctctgaaacgtttaaccatattccgttggcggatgcttatgagaggttactgctggaggctatgcggggtattcaggcgctatttgttcgtcgtgatgaagtggaagaagcgtggaaatgggttgattctattatgaatgcatgggcggcggataatgatgcgcctaagccttatcaggcggggacgtgggggccggtcgcttctgttgcgatgatcactcgcgatggtcgttcgtggaatgagtttgagtaa

SEQ ID NO: 2493 - protein, 491 aa, Photorhabdus luminescens
MAVTSTAQACDLVIFGAKGDLARRKLLPSLYQLEKAGYIHPETRIIGVGRADWDKKAYTKVVEEALNTFLPEKLDSELWKILSERLAFCNLDVNQKEDFAKLKAILKQDNRPAIHYFAMPPSTFGSVCHGLGLAGLNKEPNRVVMEKPLGTDLESSKAINDEVAKYFNERQVYRIDHYLGKETVLNLLALRFANSLFVNNWDNRTIDHVQITVAEEVGIEGRWGYFDQAGQMRDMIQNHLLQILTMIAMSPPADLTTDRIRDEKVKVLRSLRCIDHTNVREKTVRGQYTAGFVQGHKVPGYLEEEGANQSSRTETFVSIRVDIDDWRWAGVPFYLRTGKRLPTKCSEVVVYFKKPALNLFSESYQQLPQNKLTIRLQPDEGIDIEVLNKAPGLEHKHRLQTTKLDLSFSETFNHIPLADAYERLLLEAMRGIQALFVRRDEVEEAWKWVDSIMNAWAADNDAPKPYQAGTWGPVASVAMITRDGRSWNEFE

SEQ ID NO: 2494 - DNA, 1539 bp, Gloeobacter violaceus
  CDS (1)..(1539)
atgaccgcatcgttgactggaggattgagcgccaatccgttgcgccaggggctgcgcctggagcgcacgcccaagcctgccattttgactatcttcggggcctccggagatttgaccgtccgcaagctgatcccagccctttacgacctggcccgcgaccggcgattgccccctgaattcacggtcgtgggctatgcccgtcgcccctacagccacgaagaatttcgcgaaatgatgaaggaaggggtagccaagtattcgcgcagcaagctgggcaacctctgggaaagtttctccaagggcatctattacttccagggggacctcgacaatctccagaattttaaggacctcggcgaatttttgcagactctagatagcgagcgcggcaccctcggcaaccgggccttctacatggctaccgccccgagtttctttgcgcccatcatcgagaatctgggcggagcgggcctggcgggcgacgtgcgcaacacgcgcctggtgatcgaaaaacccttcggccacgacctggagtcggctcaaaatctcaacaaagtcgtccagcaagtctttcacgaaaagcaggtctaccgcatcgatcactacctgggcaaagagaccgttcagaatatcctggtcttccgctttgccaattcgatctgggaaccgctctggaacaaccgctacgtcgatcacgtgcagatcacggtagcagagacggtgggggtcgaaaaccgcgggccgtactacgacgaagccggcggcgcgctgcgcgacatgatccagaatcacctggtacagctgttggctctcaccgccatggagccgccctccgccttcgaggccgacaccgtgcgcgacgaaaaagtgaaagtcctgcgcgccacccaggtcggccaggggccgaacggccttgcggcagtccgcgcccagtacgccaacggctggatttcaggcgaaccggtgcacgcctaccgcgacgaaccccgggtcaaccccgacgttcagactgcgagctatattgccgccaaattcatgatcaacaattggcgctggaagggcgtgccgtttttgctgcgcaccggcaaacgcctcgccaagcgcgtcaccgaaattgccctgcaatttcgggaagtgccgcacctgctctttccgtcgagcagcgcgggccagctcagcccgaacatgctggtgctgcgcatccaaccggacgaaggcatttcgctgcgcttcgaggccaagcggccggtggccgacatcgccatgcgctcggtgaacatggactttcactacggcggcaccttcgaggtcgcctcgcccgaagcctacgagcggttgctgctcgattttctgctcggggatcagacgctgtttacccgcgcggacgaagtcgaggcggcctggaagatcgtcacaccgctcatcgagcgctgggaaatccagaaagccggcgatctcaattactacgacgccggttcctgggggccgagtgccgcgagtaagctgatggacaacggccgccgctggcggcgcctatag

SEQ ID NO: 2495 - protein, 512 aa, Gloeobacter violaceus
MTASLTGGLSANPLRQGLRLERTPKPAILTIFGASGDLTVRKLIPALYDLARDRRLPPEFTVVGYARRPYSHEEFREMMKEGVAKYSRSKLGNLWESFSKGIYYFQGDLDNLQNFKDLGEFLQTLDSERGTLGNRAFYMATAPSFFAPIIENLGGAGLAGDVRNTRLVIEKPFGHDLESAQNLNKVVQQVFHEKQVYRIDHYLGKETVQNILVFRFANSIWEPLWNNRYVDHVQITVAETVGVENRGPYYDEAGGALRDMIQNHLVQLLALTAMEPPSAFEADTVRDEKVKVLRATQVGQGPNGLAAVRAQYANGWISGEPVHAYRDEPRVNPDVQTASYIAAKFMINNWRWKGVPFLLRTGKRLAKRVTEIALQFREVPHLLFPSSSAGQLSPNMLVLRIQPDEGISLRFEAKRPVADIAMRSVNMDFHYGGTFEVASPEAYERLLLDFLLGDQTLFTRADEVEAAWKIVTPLIERWEIQKAGDLNYYDAGSWGPSAASKLMDNGRRWRRL

SEQ ID NO: 2496 - DNA, 1539 bp, Gloeobacter violaceus
  CDS (1)..(1539)
atggcaaccgattcgacgacgcccttcccaatcgccccaccggctggaccctgcgcgatggtcgtcttcggggcggctggagatcttaccggtcggctactggtgccggcgctctataacctggccgcgggcgggctattaggtgaaaaatttgtcttgatcgggctggcccgcgccccgctcaccgacacgaattttcggacacaactgggcgaggcgctgcagcgccatggcactgctgcagtcaatccggccgtctgggatgcccttgcgcagcgatttttttatctggaagccaacttcgaagctcccgatacctacgcccgcctgcggcagcggctggccgaggcggaagccgaattcaacacggacggcaacacgctattttatctggcgaccgcccctgagcacttcggcggcattgtcgagcagttgggctgggctgggctgtcccgcgaggagaccggtcactggcgacgcgtcgtcctcgaaaaacccttcggtcaggatctcgcctccgcccaagccctcaacgcccgcctccggcgcgacctctccgaaagccaggtctaccgcatcgatcactacctgggcaaagaaaccgtccagaacatcctggtcctgcgcttcgccaacggcctgttcgagcccctctggaaccgcaaccacatcgaccacgtgcagatcaccgtcgccgagagcgtcggggtcgaaaagcggggcggttactacgagcgggccggggcgctcagggacatggtgcccaaccatcttttccagttgctggccctcaccgcgatggagccgcccacctgcttcggggccgacgccgtgcgcaccgaaaagaccaagctgctggaagccgtccagaccctcaagcccgcccagatctccacccacgtcgtgcgcgctcagtacgccgcgggtacggtcggggagcgggcactgccggactaccgcgccgagccgcgggtggcgccggattcgaccaccgagacgttcgtcgccctcaaactcgccgtcgacaactggcggtgggcgggggtgcccttttatctgcgcaccggcaaggccctggccaggcgcagcaccgagatcgccatccgcttcaagcaggcgccctacgcgatgtttcgcgacacgccggtggagcgcctcacacccaactatctggtgctccacatccagccggaggagcgcatcagcctcgaattcggcgccaaagtgccgggaccggcggtgcgcatggccggcgtcggcatggacttttgctacaatcgccacttcggcggcgagcgggcgatcggctatgaaacgttgctctacgactgcatgatgggcgatgctaccctgtttcagcgctcggatacggtggaggcggcctggcaggtcgtcgaaccgatctttgctgcctggaacgattcaactgccgacctggtcacctatccggccggcagttggggtccgcagcaggcggaggagttgctcgggcgcgacggtcggcagtggcggagagcggaccatgattcttgcgggtga

SEQ ID NO: 2497 - protein, 512 aa, Gloeobacter violaceus
MATDSTTPFPIAPPAGPCAMVVFGAAGDLTGRLLVPALYNLAAGGLLGEKFVLIGLARAPLTDTNFRTQLGEALQRHGTAAVNPAVWDALAQRFFYLEANFEAPDTYARLRQRLAEAEAEFNTDGNTLFYLATAPEHFGGIVEQLGWAGLSREETGHWRRVVLEKPFGQDLASAQALNARLRRDLSESQVYRIDHYLGKETVQNILVLRFANGLFEPLWNRNHIDHVQITVAESVGVEKRGGYYERAGALRDMVPNHLFQLLALTAMEPPTCFGADAVRTEKTKLLEAVQTLKPAQISTHVVRAQYAAGTVGERALPDYRAEPRVAPDSTTETFVALKLAVDNWRWAGVPFYLRTGKALARRSTEIAIRFKQAPYAMFRDTPVERLTPNYLVLHIQPEERISLEFGAKVPGPAVRMAGVGMDFCYNRHFGGERAIGYETLLYDCMMGDATLFQRSDTVEAAWQVVEPIFAAWNDSTADLVTYPAGSWGPQQAEELLGRDGRQWRRADHDSCG

SEQ ID NO: 2498 - DNA, 1479 bp, Chromobacterium violaceum
  CDS (1)..(1479)
atggagactcgttctacccctaccccggccttcgacatggtgctgttcggcggcgccggcgacctggtgatgcgcaagctgctgccttcattgtaccaggcgcataacgccggcctgctcaacgaacagggccgcatcctggcgctgggccgcaaggacctgagccgcgacgactacctggcttccgtcgaaaagcagtcccgcatccatatcaagtcccacttcgacgatgccgcctggcagagcttctgtagccgcatcgactacctgcgcgtcgacgcctcccaggccgccgactacccggcgctggccgagaaggtcggcgacgacgccggcaaggtggtggtgtgctaccttgccaccgcgcccaatctgttcgccggcatctgcgaaaacctggccgcggtcggcctgaaccgccccaatgtgcgggtggtgctggaaaagccgctgggcaccgacctcgactcgtccaacgagatcaacgacgacgtcgcccgcttcttcaaggaagagcagctgtaccggatcgaccactacctgggcaaggagtcggtgcagaacctgatggccatccgcttcgccaacgcgctgttcgagccgctgtggcgccgcgaatggatacacgacgtgcagatcaccatttcggaagaactgggcgtcggcagccgcggcgatttctacgacggcaccggcgcgctcagggacatggtgcagaaccacctgctgcagctgctgtgcatcgtggcgatggagccgccggccaacctggaagccgacgccgtccgcgacgagaagctgaaggtgctgaaggcgctgcgcccgttcaccgagcacgatgtcgccgccaagaccgtgcgcggccagtacaaggccggcgccagcggcggccagccggtggtcggctaccaggacgaggccggcattcccgccggcagccagaccgagaccttcgtcgccatcaaggccgagatcgacaactggcgctgggccggcgtgcccttcttcctgcgcaccggcaagcggatgcaggaacgcctggccgagatcgtcatcaacttccgcgatgtgccgcaccaggtgttcaccggcccgctgggcggcagccaccacgccaaccggctggtgatccgcctgcagcccgaggaaagcatccgcctgtacttcctggccaaggagccgggcgacaccatgcgcctgcagccggcctacctggacctggacttctacaaggcgttcaaggtgcgccgcgccgacgcctacgagcgcctgctcttggacgtgatccgcggcaagctggcgctgttcatgcgccgcgacgagctgatcgaggcctggcgctgggtcgagcccatcatggacacctgggccgccagcaccaacaacccgcccaagcaatacaccgccggcagctggggcccggccgcgtccagcgcgctgctgtcgcgcgacggcatcagctggcacgaggagtgttaa

SEQ ID NO: 2499 - protein, 492 aa, Chromobacterium violaceum
METRSTPTPAFDMVLFGGAGDLVMRKLLPSLYQAHNAGLLNEQGRILALGRKDLSRDDYLASVEKQSRIHIKSHFDDAAWQSFCSRIDYLRVDASQAADYPALAEKVGDDAGKVVVCYLATAPNLFAGICENLAAVGLNRPNVRVVLEKPLGTDLDSSNEINDDVARFFKEEQLYRIDHYLGKESVQNLMAIRFANALFEPLWRREWIHDVQITISEELGVGSRGDFYDGTGALRDMVQNHLLQLLCIVAMEPPANLEADAVRDEKLKVLKALRPFTEHDVAAKTVRGQYKAGASGGQPVVGYQDEAGIPAGSQTETFVAIKAEIDNWRWAGVPFFLRTGKRMQERLAEIVINFRDVPHQVFTGPLGGSHHANRLVIRLQPEESIRLYFLAKEPGDTMRLQPAYLDLDFYKAFKVRRADAYERLLLDVIRGKLALFMRRDELIEAWRWVEPIMDTWAASTNNPPKQYTAGSWGPAASSALLSRDGISWHEEC

SEQ ID NO: 2500 - DNA, 1476 bp, Neurospora crassa
  CDS (1)..(1476)
atggagcagctcaaggacaacaccgtcatcgttgtccttggcgcctctggcgatctcgctaagaagaagacctaccgcaaccaatttttgcccaaggacatccggattgtgggctatgccagaactaaaatggaccacgacgagtacatccgccgcatcaagtcgtacatcaagactcccacgaaggagagcgagcagcagcttgaggagttctgctccatctgcacatacgtttccggccagtacgatcgcgacgactccttcctgcagctcaacaagcatttggaggaactggagcaaggaaggaaagagaacaaccgactcttctacatggctctgcctcccagcgttttcaccattgtttcacagcatctcaagaagtgttgctacccctccaggggcgttgcccgtgttattgtcgagaaaccctttggcaaggacttggcaagctctcgagaactgcagaagtctcttgagcccgactggaaggaagaggagatcttccgtatcgaccattatctaggcaaggagatggtgaagaacattctcattctgcgtttcggcaactccttccttggcgctacctggaacaggcatcacatcgacaacgtccaaattacattcaaggaacccttcggcaccgagggccgtggtggctacttcgacgagttcggcatcatccgcgatgtgatgcagaaccatctgttgcaggtccttacgttgcttgccatggaacgccccatctctttctccgctgaagatatccgtgatgagaaggtgcgggtcctccgcgccattccggcaatcgagcccaagaatgtcatcattggacagtacggcaagtcgcttgacggaagcaagcctgcttacaaggaagacgatacggtccccaaggattcccgctgccccactttctgtgcgctagttgcgtacatcaagaacgagcgttgggatggtgtacctttcatcatgaaggcaggcaaggccttgaacgagcagaagaccgagatccgcgtgcagttcaaggacgtcacatcgggcattttcaaggacattcctcgcaacgaactcgttatgcgcattcagcccaacgaaagtgtctacatcaagatgaactctaagcttcccggcctgagcatgcagactgttgtcaccgagcttgacctcacctacaggagacgcttctccgacctcaagatccccgaagcttacgagtcccttattctcgactgcttgaagggtgaccattccaactttgtccgtgacgatgagctcgatgccagctggagaatctttacccctttgctccactatctcgatgataataaggaaatcatcccgatggagtatccttatggttctcgcggcccggctgttttggatgactttacggcttcgtacgggtacaaattcagcgatgctgcgggctaccagtggcccacaacctccgccatggggtcgggcatgaagttgtag

SEQ ID NO: 2501 - protein, 491 aa, Neurospora crassa
MEQLKDNTVIVVLGASGDLAKKKTYRNQFLPKDIRIVGYARTKMDHDEYIRRIKSYIKTPTKESEQQLEEFCSICTYVSGQYDRDDSFLQLNKHLEELEQGRKENNRLFYMALPPSVFTIVSQHLKKCCYPSRGVARVIVEKPFGKDLASSRELQKSLEPDWKEEEIFRIDHYLGKEMVKNILILRFGNSFLGATWNRHHIDNVQITFKEPFGTEGRGGYFDEFGIIRDVMQNHLLQVLTLLAMERPISFSAEDIRDEKVRVLRAIPAIEPKNVIIGQYGKSLDGSKPAYKEDDTVPKDSRCPTFCALVAYIKNERWDGVPFIMKAGKALNEQKTEIRVQFKDVTSGIFKDIPRNELVMRIQPNESVYIKMNSKLPGLSMQTVVTELDLTYRRRFSDLKIPEAYESLILDCLKGDHSNFVRDDELDASWRIFTPLLHYLDDNKEIIPMEYPYGSRGPAVLDDFTASYGYKFSDAAGYQWPTTSAMGSGMKL

SEQ ID NO: 2502 - DNA, 1524 bp, Synechococcus sp
  CDS (1)..(1524)
atggtcgccaccgccaccaatcccctgcgggtcggtctccgacaggaacgggtcatcgcaccgcaatgtctggtaattttcggcgccagtggtgacctgacccaccgcaagctggtccccgcgctgttcgaactgttcaagcagaggcgacttcccagtgaattcgcccttctcggctgcgcccgccggccctggagcgacgacgagtttcgcggaaaaatggccgaggccctggccagcaagatcgccgagaaccaggaagcctgggatcagttcgtctcgaagttgttctacgaacccgtcgatctgcagcaaccggaggatgtggttcgcctggggaaacgcctggaaaccgttgatcaacagtgcgccacccgcggcaaccgcaccttctatctctcggtgtcaccgaagttctacggcagtggctgtcgcgcgctagcggatgccggtctgctgaaggatcctcaacgcagccgcgtggtgatcgagaagcctttcggtcgtgactacggcagcgctcaagccctgaaccgtgttgtaaaaagctgcgggcaagagaatcagatcttcaggatcgaccattacctaggcaaggaaacggtccagaacatcatggtgctgcgctttgccaacaccattttcgaaccgatctggaaccggaactacatctccagtgttcagatcactgccgccgagaccgttggagtcgaggagcgggccgggtattacgagacctccggtgccctgcgggacatggtgcagaaccacctgacccagatgctggccatcacagccatggaaccgccaggtcgctttgacccggaggcgatccgcaacgaaaaggccaaggtgttgcaagcggcacgactggctgacgagcaggagccatggaactgctgcatccgcggtcagtacggccccggcggcagccatgacgctcccctggccggataccgccaggaacccggcgtcgatcccaacagcaccacggagacctacgtcgccatgaagctgttcgtcgacaactggcgttggcagggggtccccttctacgtccgcacaggcaagcggctggccaaacgcctcagcgaggtggtgctcaccttccgcgaagcaccagtgcatctcttcgatgcagccaccggcggccccacggccaaccagttgattctgcgcatccagcccgacgaaggggcggaattccgcttcgaagtgaaatcccccgggtccggcatgcgcagccgtccgatcgacatggagttctcctacgacgagtccttcggggagccctccgatgagggctatgtccgcctgctggcggacgccatgctcagcgatccgaccctgttcacccgcagtgacgaggtggaagcggcctggcgtctgtacaccccgctgctggagctgatcgaagacagcccttggcagctgccgatccatccctacgaatcccgcacctggggacctgccgccgctgatgccctgctggcccgtgacggactgctctggcgtcgtccctga

SEQ ID NO: 2503 - protein, 507 aa, Synechococcus sp
MVATATNPLRVGLRQERVIAPQCLVIFGASGDLTHRKLVPALFELFKQRRLPSEFALLGCARRPWSDDEFRGKMAEALASKIAENQEAWDQFVSKLFYEPVDLQQPEDVVRLGKRLETVDQQCATRGNRTFYLSVSPKFYGSGCRALADAGLLKDPQRSRVVIEKPFGRDYGSAQALNRVVKSCGQENQIFRIDHYLGKETVQNIMVLRFANTIFEPIWNRNYISSVQITAAETVGVEERAGYYETSGALRDMVQNHLTQMLAITAMEPPGRFDPEAIRNEKAKVLQAARLADEQEPWNCCIRGQYGPGGSHDAPLAGYRQEPGVDPNSTTETYVAMKLFVDNWRWQGVPFYVRTGKRLAKRLSEVVLTFREAPVHLFDAATGGPTANQLILRIQPDEGAEFRFEVKSPGSGMRSRPIDMEFSYDESFGEPSDEGYVRLLADAMLSDPTLFTRSDEVEAAWRLYTPLLELIEDSPWQLPIHPYESRTWGPAAADALLARDGLLWRRP

SEQ ID NO: 2504 - DNA, 1455 bp, Rhodopirellula baltica
  CDS (1)..(1455)
atgtcacatacaattgtcatctttggtgccagcggcgacctgaccagccgcaaactggtcccggcactcttccgactcttctcacgcggacgcctgcccgactcgactcgcattgtcggtgtttcgcgaagtccctacgaacattccgagtggcgaaaatcgcttcgcgaaaccaccgccaaatttgtcggcaagtctttcagcgaagaagcctgggaatcattcgcaccgaacatctactaccagcccggcgacatcaaagacgcagagtcgtttcaatcgctggcgacgtttttggatgaaatcgaagaaggcaaatcgaccggtcgagtctactacctgtcgaccatgccacagttgtacgaagaagcgatccagcaactcggggccgcgggactcgcctgcgacaaaaccggaccgcgacgggtgatcatcgagaaaccgttcggcacggatctgaaaacggcccagcgtctgaacgaatcgatccacaacgtttttcgcgaagatcagatctaccggatcgatcattacctcggcaaagaaaccgtacagaacattttcgcgttgcgttttgccaacagtatcttcgaaccgctgtggaaccggaactacatcgaccacgtgcaaatcaccgtggccgaagaagtcgtcatcggccggcgagctggctactacgacaacagcggaatcctccgcgacatgttccagaatcatattctgcaactgatgatgatcacggcgatggaaccgccggcgaaatttgacgccgctttggttcgcgatgagaaagtcaaagtgttgcacagtgttcgcaagatgacgggtggcgacttcgcatctcaaaccgttcgcggccagtacgacggctacctgcaagaggaaggcgtcccggcgaacagccaaacggaaacctttgccgcgttgaaactgtactgcgacaactggcgatggcagggcgtgccgttcttcttgcgaagcggcaaaggcatgtcatgccgaacgacccagatcgtgatccagttcaaaaacgttccgcaccaattgtttggcggatcgaagaaggagaacaaacttggcaaccgattggtcattcaagtccaaccggccgaaggcatccaattgcacttcgaaaccaaggttgccgacgccggaatgaagacgcgaaccaaccacttggacttcaacttccaagattcgatcggcggccaagaaatgcccgacgcctatcagcgactgctgctggacgcggtgcaaggcgacgccagcctctttgctcgcggcgacgaagtcgaactggcctggagcatcatcgatccaatcatcgaagcgtggcgaagcccggccgctccgccactgcacacgtaccaaaccggcctttggggccccgaagaatgctcgcagtggctgttcgaccaaaaacgcgaatggttcgacgtctgcccagttatttaa

SEQ ID NO: 2505 - protein, 484 aa, Rhodopirellula baltica
MSHTIVIFGASGDLTSRKLVPALFRLFSRGRLPDSTRIVGVSRSPYEHSEWRKSLRETTAKFVGKSFSEEAWESFAPNIYYQPGDIKDAESFQSLATFLDEIEEGKSTGRVYYLSTMPQLYEEAIQQLGAAGLACDKTGPRRVIIEKPFGTDLKTAQRLNESIHNVFREDQIYRIDHYLGKETVQNIFALRFANSIFEPLWNRNYIDHVQITVAEEVVIGRRAGYYDNSGILRDMFQNHILQLMMITAMEPPAKFDAALVRDEKVKVLHSVRKMTGGDFASQTVRGQYDGYLQEEGVPANSQTETFAALKLYCDNWRWQGVPFFLRSGKGMSCRTTQIVIQFKNVPHQLFGGSKKENKLGNRLVIQVQPAEGIQLHFETKVADAGMKTRTNHLDFNFQDSIGGQEMPDAYQRLLLDAVQGDASLFARGDEVELAWSIIDPIIEAWRSPAAPPLHTYQTGLWGPEECSQWLFDQKREWFDVCPVI

SEQ ID NO: 2506 - DNA, 1524 bp, Prochlorococcus marinus subsp
  CDS (1)..(1524)
atgtcctcaaccttaagtaatcctcttagattaggtttgcgacaagaaagagtgatatctccacaatgcctaataatatttggagctagtggagatcttactcataggaaacttatacctgccttatttgaactttatctgcaaagaaggatcccaagtgaattcgccatagttggatgtgcaagaaggccttggagtgatcaagattttaaggaaaaaatgaagggtaagttagctgatcaaatatctgacaatgaaaaggaatgggaacagttttcaaattatctattctacgaaccagttgatttgcagcaaagtgatcatgtagtaagactttccaaaagattaaatgagattgataaattacaggctacacatggaaataacaccttttacttatcagtatctccaaacttttatggaagtggatgtaaggctctaaaggctgctggattactagatgatccgaagaaaagtcgaatcgttattgaaaaaccctttggaagagattattcaagtgcgaagaaattaaataagatcgttcaaagttgtgcagatgaaagtcagatatatcgaatagatcattatttggggaaagagactgttcaaaacatacttgttatgaggtttgctaatactatttttgaacctatatggaataggaattatatttcaagtgttcaaataacatcatcggaaactgttggggttgaagatagagctggttattatgaaagctctggggctttaagagatatgctccaaaatcatttaactcaaatgcttgctgtaacagcgatggagcctcctggtaaatttgaacctgaggcaataagaaatgaaaaagcaaaagttcttcaagcttcaaaacttgccgatgagaatgaaccctggaattgctgtgtcagaggtcagtatgcacaaggaggtaatagtcttaaaagacttaaaggttatagggatgaagatggagtaaatttgaacagtacaacagaaacttatattgcaacaaaagtatttattgataattggcgatggcaaggagttcctttcttcttaagaacaggtaaaagactaccgaaaagacttggggaaattgtattaacatttaaagatgtcccagtacatttatttgaatcaacaataattaatcctgcgccaaatcagcttattcttaggattcagcctaatgaaggagctacttttaaatttgaagtcaaatcacctggatctgggatgaaagcaagaccagttgaaatggaattttcttacgatgaatcttttggagagccttctgacgaaggttatgtaaggttgttggctgatgccatgctctcagatcctaccttgtttacaaggagtgatgaggtagaagctgcttggaaactttatacaccattaatagaattaatggaagacgctccttggaagttacctattcataaatacgaatcaatgacttggggacctcctgaatcagatcaattactttccaaagataatattttttggcgcagaccctaa

SEQ ID NO: 2507 - protein, 507 aa, Prochlorococcus marinus subsp
MSSTLSNPLRLGLRQERVISPQCLIIFGASGDLTHRKLIPALFELYLQRRIPSEFAIVGCARRPWSDQDFKEKMKGKLADQISDNEKEWEQFSNYLFYEPVDLQQSDHVVRLSKRLNEIDKLQATHGNNTFYLSVSPNFYGSGCKALKAAGLLDDPKKSRIVIEKPFGRDYSSAKKLNKIVQSCADESQIYRIDHYLGKETVQNILVMRFANTIFEPIWNRNYISSVQITSSETVGVEDRAGYYESSGALRDMLQNHLTQMLAVTAMEPPGKFEPEAIRNEKAKVLQASKLADENEPWNCCVRGQYAQGGNSLKRLKGYRDEDGVNLNSTTETYIATKVFIDNWRWQGVPFFLRTGKRLPKRLGEIVLTFKDVPVHLFESTIINPAPNQLILRIQPNEGATFKFEVKSPGSGMKARPVEMEFSYDESFGEPSDEGYVRLLADAMLSDPTLFTRSDEVEAAWKLYTPLIELMEDAPWKLPIHKYESMTWGPPESDQLLSKDNIFWRRP

SEQ ID NO: 2508 - DNA, 1524 bp, Prochlorococcus marinus
  CDS (1)..(1524)
atgagcaccacgatcaccaaccctttacgggttggactacgtcaagagcgggttatcgctccgcagtgcctagtcatctttggtgcaagtggcgacctgacccaccgaaaattggttccagcccttttcgagctatacaaacaacggcggctaccgagtgaattcgccctacttggctgcgcgcgacgtccttggagcaacgaaatatttcgccaaaaaatggctgaagccctcggcgagactatcaacgaaaaccatcttgcttgggatcaattcgccgctggtcttttttacgaacctgtcgatctacagaagccagaagacctcatcaaactcagccatcggctggaagagattgatcgactccgcgccacccgcagcaatcgcaccttctatctttcggtgtcaccaaagttctacggcagtggctgcaaagctcttgctaatgccggtcttctaagtgatcccaaacgcagtcgagtggttatcgaaaaaccattcgggcgtgattacgccagtgctcagtctttaaatcaaatcgtccaaagctgtggccaagagaatcaaatcttccgcatcgaccactacctcggcaaagaaacagtccagaacatccttgtgctgcgattcgcaaataccatctttgaaccaatctggaaccggaattacatctccagcgttcaaatcacagccgctgaaaccgtaggggttgaagaacgagccaactactacgaatcgtcaggggccctgcgcgacatggtgcaaaaccatctcacccagatgctggccatcaccacgatggaaccgccagggcgctttgaccctgaggcaatccgcaatgaaaaagccaaggttttgctagcggctcgcctagcggatgagttggaaccttggaactgctgcatccgtggccagtacgcacctggcggcaccaaggaagctccgatagcaggctaccgacaggagccgggtgtcgatcccagcagcaccaccgagacctatgtagcgatgaaacttttcatcgacaactggcgctggcagggagtgcccttttacgttcgcactggcaaacgactggcaaagcgtcttagtgaagtggttctcacctttcgagaagcacccgtgcatcttttcgatgccgctgggggcagccctacagcgaaccaactcatcctgcgaatccaaccggatgaaggagccgagtggcgctttgaggtgaagtcacctggttcaggcatgcgcagccgaccagtagagatggaattctcctatgacgaatccttcggtgagccatccgatgagggatacgtccgacttttagccgatgccatgctcagtgacccaactttattcacccgcagtgatgaggttgaagcagcgtggcgcctttacacccctctcctggaactgattgaagacagcccatggcaattgcccattcatccctatgaatcacgtacctgggggcccgctgctgccgataccctgcttgccaatgacggattgctctggcgccgaccctga

SEQ ID NO: 2509 - protein, 507 aa, Prochlorococcus marinus
MSTTITNPLRVGLRQERVIAPQCLVIFGASGDLTHRKLVPALFELYKQRRLPSEFALLGCARRPWSNEIFRQKMAEALGETINENHLAWDQFAAGLFYEPVDLQKPEDLIKLSHRLEEIDRLRATRSNRTFYLSVSPKFYGSGCKALANAGLLSDPKRSRVVIEKPFGRDYASAQSLNQIVQSCGQENQIFRIDHYLGKETVQNILVLRFANTIFEPIWNRNYISSVQITAAETVGVEERANYYESSGALRDMVQNHLTQMLAITTMEPPGRFDPEAIRNEKAKVLLAARLADELEPWNCCIRGQYAPGGTKEAPIAGYRQEPGVDPSSTTETYVAMKLFIDNWRWQGVPFYVRTGKRLAKRLSEVVLTFREAPVHLFDAAGGSPTANQLILRIQPDEGAEWRFEVKSPGSGMRSRPVEMEFSYDESFGEPSDEGYVRLLADAMLSDPTLFTRSDEVEAAWRLYTPLLELIEDSPWQLPIHPYESRTWGPAAADTLLANDGLLWRRP

SEQ ID NO: 2510 - DNA, 1521 bp, Prochlorococcus marinus
  CDS (1)..(1521)
atgataccgactacaaacccattgagagttggtcttagacaagagagggtaatttcacctcagtgtttaattatttttggggccagtggagatttaactcataggaaacttgtccctgcccttttcaagctattcaaacaaagacgcttgcccagtgaatttgcattactaggttgcgctagaagaccttggagtgacattgagttccgaaaaaaaatgtcagtttctcttaaagatgaaatcaaattaaatccaaatgaatgggaagaattcataactcgtcttttctatgaaccagtcaatcttgaacgaccagaagatcttgtaaaactaggtacaaggctcgaagaaatagaccggataaaagctacccatgcaaatagaaccttttatttatctgttgcaccaaaattctatgcaagtggttgcaaagctttagcagatgcaggccttctcaaagacccacgaagaagcagagtggttatcgagaaacctttcgggagggattacagaagcgctcaaagtttaaatcgtattgttcagaattgtgctcttgaaagtcaaatctttcgcatcgatcattatctagggaaagagactgttcagaacattctggttctaagatttgcaaacacaatttttgaaccaatttggaacagaaattatatatctaatgttcaaataacttcagctgaaacagtaggagtcgaagatcgagcaggctattacgaaagttcaggagcattaagggatatggtgcagaatcatttaacgcaaatgcttgcaattactgcaatggaaccacctggtcattttgatccagaagccattaggaatgaaaaagccaaagtactgcaagctgctcatttagctaatgaacttgagccttgggaatgttgtgtaagaggccaatattcaaaaggtggctctaagaaaagaccattgattggttaccgagatgaacctggtgttaatccaaatagcacaactgaaacctatgttgctatgaagcttttcattaataattggcgatggcaaggagtccctttttatattcgtactgggaaaagattggcaaaaagaactagtgaagtagttttaacctttagagaggcacctgttcaccttttcgatgcggcaggggggacaccaacatctaatcaactagtcctaagaatccaacctgatgaaggagctgagttcaagtttgatgtgaagtctccaggttctggaatgaggagcaggcctgttgaaatggaattctcttatgatgaatcatttggagaaccttcagacgaaggatatgtaaggcttttagctgatgcaatgcttggagatcctactcttttcacgagaagcgatgaggtagaagccgcttggcgtttatatactcctcttttagaaataattgaagatagtccttggcaacttccaacttatccttatgaatccagaacttggggcccttcagaagctgatgcattactagctaaagatcaattactttggagaagaccctaa

SEQ ID NO: 2511 - protein, 506 aa, Prochlorococcus marinus
MIPTTNPLRVGLRQERVISPQCLIIFGASGDLTHRKLVPALFKLFKQRRLPSEFALLGCARRPWSDIEFRKKMSVSLKDEIKLNPNEWEEFITRLFYEPVNLERPEDLVKLGTRLEEIDRIKATHANRTFYLSVAPKFYASGCKALADAGLLKDPRRSRVVIEKPFGRDYRSAQSLNRIVQNCALESQIFRIDHYLGKETVQNILVLRFANTIFEPIWNRNYISNVQITSAETVGVEDRAGYYESSGALRDMVQNHLTQMLAITAMEPPGHFDPEAIRNEKAKVLQAAHLANELEPWECCVRGQYSKGGSKKRPLIGYRDEPGVNPNSTTETYVAMKLFINNWRWQGVPFYIRTGKRLAKRTSEVVLTFREAPVHLFDAAGGTPTSNQLVLRIQPDEGAEFKFDVKSPGSGMRSRPVEMEFSYDESFGEPSDEGYVRLLADAMLGDPTLFTRSDEVEAAWRLYTPLLEIIEDSPWQLPTYPYESRTWGPSEADALLAKDQLLWRRP

SEQ ID NO: 2512 - DNA, 1488 bp, Haemophilus ducreyi
  CDS (1)..(1488)
atgaatatagaaaatagttgtatcgtaatttttggtgcatcaggggacttaacattccgtaaacttatcccagcactatataatctttttaaagtaggtcggttaggcgaacatttttctgttttaggtgtttcacgatcagacctaactcacgattcttttagacaaaaaatgcgtgaagcattaatcaaatatgagcaagcaagcgggcagtttttagatgatttttgcaatcacttgtattatcaagcaatcaacaccgctgatccggacgattatgccaaactattaccttgtttagatgaattacacaataaatacggtagctgtggtaacactttatattacctttcaacaccgcctagtttatacggcattatccctgaatgcttggcggctcacggcttaaccactgaagaatatggttggaaacggattatcatcgaaaaaccatttggttacgatattaaaacagccaaacaactcgatgagaaaatacatcattattttgaagaacatcaaatttaccggatcgatcattatcttggtaaagaaaccgtgcaaaatttattagtactccgtttctcaaacggtttatttgaaccactttggaatcgtaattttattgaatatgtagaaattaccggtgcagaatcattaggtgttgaagatcgtggtggttattatgatggatctggtgcaatgcgtgatatgttccaaaaccatttactacaagtattagcaatggttgccatggaacctccggccattattaatgctaactcaatgcgtaatgaagtagcaaaagtcttatatagcttacgtccattaagcactgaagacgtcaaaaataatgtggtacttggtcaatatacctccggtgaaattgatgacttagttgtacccggttatactgaagaaaatggcgttcccaacgattcaaatacagaaacttatttagccgtaaaatgcgaaattgataactggcgttgggccggcgtgccattttatgtgcgaacaggtaagcgtttgcctactcgggtaactgaaatcgtaatccacttcaaaacgactccacatccagtctttagccaaaatgcgcctgaaaataaattaattatccgggtacaacctgatgaaggtatttctatgcggtttggtttgaaaaaacccggtgctggttttgaggcgaaagaagtctctatggattttcgctattctgatttaagctctgcttcaagtttattaaccgcttatgaacggttactattagatgcattaaaaggagatgcgaccctatttgcccgaaccgatgccgtacatgcctgttggcatttcgtacagccgattctagactataaggcagaacgtggccgagtgtatgaatatgaagcaagcagttgggggcctaaagaagctgataaactgattgcacgcaatggcaaagtatggcgtaaaccgtctggaatgatgaagaaaaaaatatag

SEQ ID NO: 2513 - protein, 495 aa, Haemophilus ducreyi
MNIENSCIVIFGASGDLTFRKLIPALYNLFKVGRLGEHFSVLGVSRSDLTHDSFRQKMREALIKYEQASGQFLDDFCNHLYYQAINTADPDDYAKLLPCLDELHNKYGSCGNTLYYLSTPPSLYGIIPECLAAHGLTTEEYGWKRIIIEKPFGYDIKTAKQLDEKIHHYFEEHQIYRIDHYLGKETVQNLLVLRFSNGLFEPLWNRNFIEYVEITGAESLGVEDRGGYYDGSGAMRDMFQNHLLQVLAMVAMEPPAIINANSMRNEVAKVLYSLRPLSTEDVKNNVVLGQYTSGEIDDLVVPGYTEENGVPNDSNTETYLAVKCEIDNWRWAGVPFYVRTGKRLPTRVTEIVIHFKTTPHPVFSQNAPENKLIIRVQPDEGISMRFGLKKPGAGFEAKEVSMDFRYSDLSSASSLLTAYERLLLDALKGDATLFARTDAVHACWHFVQPILDYKAERGRVYEYEASSWGPKEADKLIARNGKVWRKPSGMMKKKI

SEQ ID NO: 2514 - DNA, 1497 bp, Candidatus Blochmannia floridanus
  CDS (1)..(1497)
atgcggtcaaaaacaactaccactcaagcttgtaatttcattatttttggagctaaaggagatttagctcgtaggaaattaattcctgcgctatatcaattagagaaaatcggttctatacatcctagaacttttatattaggagtaggtagagcggaatgggatttattaacatatattaaaattgtgcgttcttctttagagagatttatgaaagaatctattaatgaaaatatatggtgtcgtttttctaaaagatttgatttttgtaatttagatgttaatcaaacggaacaatttgtacatgtgctgaataaattaaaaaatttagatttattgacaataaattattttgcaatgcctcctcatacatttggatctatttgtaaaggattaagtttagtgggtttaaataaagaaagaaatagaatagtgatagaaaagccattaggaatgaactttgattctgctcgtgttattaattctcaagtatctaaatattttcatgaaactcaaatttatcgggtagatcattatttaggaaaagaagctattttaaatttgttggtattacgttttgcaaattctgtatttttttcaaattgggataacaataccattgatcatgtacaaattactgtttcagaagaggttggaattgaaggtcgttggggttattttgatgctatggggcaaatgcgtgatatggtacaaagtcatttattacaaattcttactatcattgctatgtctcctccttttgatttaagtgctgattgtattcgggacgaaaaagttaaagtgttacgttcattgcgtatgattaatactaatacgatacatgaaattgcggtacgaggtcaatatactgctggttttattaatggtcaaccagtaccaggatatttagaggaaataggttctaacaaggatagtaaaacggaaacatttgtatcgattaaagtgaatatagataattggaggtggtttggagtgcctttttatttacgtactggaaaaagattagcaatgaaatattctgaagttgttatatattttaaaaaaccaatattgaatttatttaaagattcttattcaattttacctaataataaattaattattcgattacaaccatatgaaggaatagatatgcagattctaagtaaaataccgggattaggtaataagaatcgtttaaaaattactaatttgaatttaaatttgaggaaaatattttccggagaatacatattagatgcttatgaacgattattattagaggtaatgcgtgggattcaagtattatttgtacgttatgacgaaatagaggattcatggaggtgggttgattctgttatagaggcatggtctttagttgatggtgttccaaaattatataaagctggtacatggggtccgagtgaatctacagaaatgattcgtaaaggaaatcatcattggaataaatgtacgttgaaatatacgaatatttga

SEQ ID NO: 2515 - protein, 498 aa, Candidatus Blochmannia floridanus
MRSKTTTTQACNFIIFGAKGDLARRKLIPALYQLEKIGSIHPRTFILGVGRAEWDLLTYIKIVRSSLERFMKESINENIWCRFSKRFDFCNLDVNQTEQFVHVLNKLKNLDLLTINYFAMPPHTFGSICKGLSLVGLNKERNRIVIEKPLGMNFDSARVINSQVSKYFHETQIYRVDHYLGKEAILNLLVLRFANSVFFSNWDNNTIDHVQITVSEEVGIEGRWGYFDAMGQMRDMVQSHLLQILTIIAMSPPFDLSADCIRDEKVKVLRSLRMINTNTIHEIAVRGQYTAGFINGQPVPGYLEEIGSNKDSKTETFVSIKVNIDNWRWFGVPFYLRTGKRLAMKYSEVVIYFKKPILNLFKDSYSILPNNKLIIRLQPYEGIDMQILSKIPGLGNKNRLKITNLNLNLRKIFSGEYILDAYERLLLEVMRGIQVLFVRYDEIEDSWRWVDSVIEAWSLVDGVPKLYKAGTWGPSESTEMIRKGNHHWNKCTLKYTNI

SEQ ID NO: 2516 - DNA, 1548 bp, Bos indicus
  CDS (1)..(1548)
atggcagagcaggtggctctgagccagacacagacgtgtgggatactgtgggaagagctgtgccaaagctattctttccatcagtcggatacacacatattcatcatcatgggtgcatcgggtgacctggccaagaggaatatctaccccaccatctggtggctgttccaggatggccttctgccaaaagataccttcattgtgggctacaccgactcccacttcacagtggccaacatccgcaagcagagtgagcccttcttcaagtccaccccagaggaggagcccaagctggaggagttctttgcccacagctcctacatggccagccagtatgatgacgtggcttcctacgagcacctcaacagtggcatgaacgctctccaccagggtccgcaggccaactgcctcttctacctggccttgctccccagcggctacaggactgtcaccaagaacatctgtgacacctgcacgagccagacaggctggaaccgcatcatcgtggagaagccgtttgggagggacctgcagagctccaaccagctgtccaaccacatcgcctccctgttccacgaggaccagatctaccgcatcgaccactacctgggtaaggaggtagtccagaacctcatggtgctgaggtttgtcaacaggatcttaggccccatctggaaccgggacaacattgcttgcatgagcttcaccttcaaggagccatttggcactgagggccggtggagctacctcagtgaatctgggatcatctgggaggtgatgcaaaatcccctcctccagatcctgtgtctggtggccatggagaagcccatctccaccaactcagataacatccgtgatgataaggtcagggtgttgaaatgtatatcaaaggtgcaggtgagcaatgtggtcctgagccaatatatggagaaccccactgaagaaggtgaggccaccagagggtacccagaggaccccagggtgccccatgggtccaccactgacacctttgcagcagctgtcctctatgtggaaaatgagcgctgggacggggtgcccttcatcctgcgctgcggcaaagccctgaatgagcgcaaggccgaggtgcgcctgcagtttcgtgacgtggccggggacatcttccggcagcagtgcaagcgcaacgagctggtaatccgtgtgcagcccaacgaggccgtgtacaccaagatgatgaccaagaagcctggcatgttcttcaaccccgaggagtcggagcttgacctgacctatggcaaccgatacaagaacgtgaagttccctgacgcctacgagcgcctcatcctggacgtcttttgcgggagccagatgcacttcgtgcgtagtgatgaactgcgggaggcctggcggatcttcactccactgctccaccacattgaacgcgagaaggcccggcccatcccgtacgtgtacggcagccggggccctgtggaggcagacgagctgatgaagcgtgtgggcttccagtacgagggcacctacaagtgggtgaaccctcacaagctctga

SEQ ID NO: 2517 - protein, 515 aa, Bos indicus
MAEQVALSQTQTCGILWEELCQSYSFHQSDTHIFIIMGASGDLAKRNIYPTIWWLFQDGLLPKDTFIVGYTDSHFTVANIRKQSEPFFKSTPEEEPKLEEFFAHSSYMASQYDDVASYEHLNSGMNALHQGPQANCLFYLALLPSGYRTVTKNICDTCTSQTGWNRIIVEKPFGRDLQSSNQLSNHIASLFHEDQIYRIDHYLGKEVVQNLMVLRFVNRILGPIWNRDNIACMSFTFKEPFGTEGRWSYLSESGIIWEVMQNPLLQILCLVAMEKPISTNSDNIRDDKVRVLKCISKVQVSNVVLSQYMENPTEEGEATRGYPEDPRVPHGSTTDTFAAAVLYVENERWDGVPFILRCGKALNERKAEVRLQFRDVAGDIFRQQCKRNELVIRVQPNEAVYTKMMTKKPGMFFNPEESELDLTYGNRYKNVKFPDAYERLILDVFCGSQMHFVRSDELREAWRIFTPLLHHIEREKARPIPYVYGSRGPVEADELMKRVGFQYEGTYKWVNPHKL

SEQ ID NO: 2518 - DNA, 1485 bp, Bacillus anthracis
  CDS (10)..(1485)
ttggaatcaatgacctttgttttatttggagcgacaggggacttagcgaaacgcaaaatttaccccgcactatataacttatatagagatcaaaagcttccaaagcaaatatccgttatcgggcttgggagacgtgaagtatctcatgtagattttcaaaaaagaataaaagaatcaatagagacgttttctcgtcatagagaagaaggtactccagaactcgaaggttttttagataattttcgctattgtccattagatgtgagtaagccggaagactatgagagattattacaagtcgttcgtgaaagggaagaagagctacatataaaagggaatagaatgttctatctttccggtgctcctgaattttttgagacaatcgctttaaatattaaggaaagcggacttgataaaacggatggatggaaacgcctaatgattgagaaaccgttcgggcacgaccttacatctgctcgtgagctgaatgataagcttagtcgcacgtttgaagaagacgagatataccgtattgatcattatttaggtaagccgatgattcaaaaccttgaagcactagagtttgcaaatcctgttttacaatcgatttggaataaagaacatatagcgaatgtacaaatcacagcgagtgaaacagttggtgttgaagaaagggcaggatattatgatcaggcaggagccattcgagatatggttcaaaatcatatgttacaaatattaatgatgactgctatgaatttgccggaaaaggttaatgcatgtgaaattcgagaggaaaagcgaaaggtaatggaggcgcttcgtaaagtgaaaaaagaagacgttcaaaaccatatcattcgcggacaatatggtgcaggtgagataaatggcgggcaagttgtagcatataaagaggagccaggagtaaatccctcttctaatatagacacatttattgctgctcgcttgtggatcgataatccattttggactggcgttcccttttatatacgaacaggcaaacgaatgaaagaaaagtctactcgtattgtaatcgaatttaaaaatacgttaaaacagcaatatcaagatagtaatccaaatgcagcacctaacttgttaataattgaaattagcccaggtgagaacgtttcattacagttaaatagtaaaaatccattgaaaaatggagaaattgaaccgatccgtattaactttacttgtgagcaagcggatgtgggagtacctgaagcgtatgaaagactcattcatgatgctgtgagtggagacgctacattctttgcacattggagagaagttgaattgtcatgggaatgggtacaaccaattcttgaagcattcgaggaaaacttattaccacttcatgaatatgagtctggttcatatggtccagaggcatctaatgaattattgcaagaaagtggatttaaatggtggttagatcaagaaacgaaaaaatga

SEQ ID NO: 2519 - protein, 491 aa, Bacillus anthracis
MTFVLFGATGDLAKRKIYPALYNLYRDQKLPKQISVIGLGRREVSHVDFQKRIKESIETFSRHREEGTPELEGFLDNFRYCPLDVSKPEDYERLLQVVREREEELHIKGNRMFYLSGAPEFFETIALNIKESGLDKTDGWKRLMIEKPFGHDLTSARELNDKLSRTFEEDEIYRIDHYLGKPMIQNLEALEFANPVLQSIWNKEHIANVQITASETVGVEERAGYYDQAGAIRDMVQNHMLQILMMTAMNLPEKVNACEIREEKRKVMEALRKVKKEDVQNHIIRGQYGAGEINGGQVVAYKEEPGVNPSSNIDTFIAARLWIDNPFWTGVPFYIRTGKRMKEKSTRIVIEFKNTLKQQYQDSNPNAAPNLLIIEISPGENVSLQLNSKNPLKNGEIEPIRINFTCEQADVGVPEAYERLIHDAVSGDATFFAHWREVELSWEWVQPILEAFEENLLPLHEYESGSYGPEASNELLQESGFKWWLDQETKK

SEQ ID NO: 2520 - DNA, 1536 bp, Chlamydophila caviae
  CDS (1)..(1536)
atgacaagtaatgaaaataaagatggcgggaaaaccttgctcccatgtcctccctgtgtgatggtaatcttcggagctaccggagatcttacagcgcgcaagttattcccagcattgtatcatcttattaaagagggtaggctgtctgaaaactttgtctgcgtaggttttgctagaagaaagaaaagccatgaggaatttcgtgaagaaatgaaacaggcaatacaaaacttttcacgtgctcaagagcttgatatccgcatttgggaagagtttgaatcacgtatattttatcacgaatccaacttctcttctcccgagggctacgcctcattaaaagagagacttgaggatattgataagaaatataagacacaagggaatcggctattttacttatcaacgcctccagagtatttccccgagattatcgaaaatattaataagcataagcttttttatcatgatcaaagcgaaggcaagccatggtctcgagtgattatagaaaaaccctttggtgtggatctacaaagcgctaaagaactacaaaagtacatagatgataatctagatgaagattctgtctatcgtatcgatcattatctggggaaagaaactgtacagaatattcttacgatacgttttgcaaatactctatttgagtcttgttggaattctcaatacattgatcatgtgcaaattagcgtgagtgaatctataggcataggcacacgagggaacttctttgaaaaatctggaatgcttcgtgatatggtgcaaaaccatatgatgcagcttttatgtctattaactatggaacctccttcagtattcaattctgaagaaattaaaaaagaaaagatcaatattcttaagaaaatccgtccatttgctaaagaagatattattcgtggacaatatggtccgggagaagtacaagatgtgtctgttcttggctatcgtgaagaagacaatgtagctccagattctaatgtggagacttatgtagcgttaaagatgtttattgataacccacgttggttgggagtgcctttttatcttcgagccggtaaacgtctttctaaacgctctacagatatctctatcattttcaaaaagtctttgcccagcttatttacagcggaatcttgtcccgtatgtcctttagaaaatgatctgctaattatccgtatacaaccggatgaaggcgtggccttgaaatttaactgtaaagttcctggaatgaataatatcgtacgtcctgtgaaaatggattttcgctacgatacgtatttcaagacaacggcgccggaagcttacgagagattgctttgtgactgtattctaggcgataggattctatttacctgtagtgatgaagttatggattcttgggagctctttacaccgattttaaagcgatgggagcaagattcctcagatgcgcatttccctaattatgttgctggatcttcaggtcctaaggaagcagaggaattactacaagctgatggaagaagttggcgtcccctgtaa

SEQ ID NO: 2521 - protein, 511 aa, Chlamydophila caviae
MTSNENKDGGKTLLPCPPCVMVIFGATGDLTARKLFPALYHLIKEGRLSENFVCVGFARRKKSHEEFREEMKQAIQNFSRAQELDIRIWEEFESRIFYHESNFSSPEGYASLKERLEDIDKKYKTQGNRLFYLSTPPEYFPEIIENINKHKLFYHDQSEGKPWSRVIIEKPFGVDLQSAKELQKYIDDNLDEDSVYRIDHYLGKETVQNILTIRFANTLFESCWNSQYIDHVQISVSESIGIGTRGNFFEKSGMLRDMVQNHMMQLLCLLTMEPPSVFNSEEIKKEKINILKKIRPFAKEDIIRGQYGPGEVQDVSVLGYREEDNVAPDSNVETYVALKMFIDNPRWLGVPFYLRAGKRLSKRSTDISIIFKKSLPSLFTAESCPVCPLENDLLIIRIQPDEGVALKFNCKVPGMNNIVRPVKMDFRYDTYFKTTAPEAYERLLCDCILGDRILFTCSDEVMDSWELFTPILKRWEQDSSDAHFPNYVAGSSGPKEAEELLQADGRSWRPL

SEQ ID NO: 2522 - DNA, 1524 bp, Streptomyces avermitilis
  CDS (1)..(1524)
atgtcgagcagcaacccgctgcgtgaccccgcagaccgacggctcccgcgtatcgcggggccgtcgggcctggtcatcttcggcgtcacgggcgatttgtcacgtaaaaagctgatgccagccgtgtacgatctcgccaaccgcgggctgctgccgccgggcttctcgctcgtcggcttcgcccgccgcgactgggagcacgaggacttcgcccaggtcgtccacgacgccgtcaaggaacacgcccgtacggagttccgcgaggaggtctggcagcagctcatccaggggatgcgcttcgtccagggcaccttcgacgacgacgacgccttcgagcggctgcgcgacaccatcggggaactggacaaggcacagggcacgggcggcaacttcgccttctacctgtccgtgccgccgtccgccttcccggtggtcatccagcagctcaagaagcacggcctggccgaccagtcggacggctcctggcgccgcgcggtcatcgagaagcccttcggacacgacctcaagtcggccgaggagctcaacgcgatcgtccacgaggtcttcggctcggaccaggtcttccgcatcgaccactacctgggcaaggagaccgtccagaacatcctggcgctgcgcttcgccaacacgatgttcgagccgatctggaaccggtccttcgtggaccatgtgcagatcaccatggccgaggacatcggtatcggcggccgcgccggctactacgacggcatcggcgccgcccgtgacgtcatccagaaccacctgctccagctgatggcactgaccgccatggaggagcccgcctccttcgacgcggacgcgctcgccgccgagaagaccaaggtgctcggcgccgccaagctgccgaaggacctgagcaagaacaccgtccgcggacagtacgcggccggctggcagggcggcgagaaggtcgtcggctatctccaggaagacggcatcgaccccaagtcgaagaccgacacctacgcggccgtcaagctcgaggtggacaaccgccgctgggcgggcgtccccttctatctccgtaccggcaagcgcctgggccgccgcgtcaccgagatcgcggtcgtcttccagcgcgccccgcactcccccttcgaccacacggcgacggaggagctcggccagaacgcgatcgtcatccgcgtccagcccgacgagggcatcaccgtccgcttcggctccaaggtgcccggcacctcgatggagatccgggacgtctcgatggacttcgcgtacggcgagtcgttcaccgagtccagcccggaggcgtacgagcggctgattctggacgtgctgctcggcgactcgaacctcttcccgcgcaccgaggaggtcgagctgtcctggaagatcctcgacccgatcgaggagcactgggacaagcacggcaagcccgcgcagtaccccgcgggcacgtggggtcccgtcgaggcggacgaaatgctcgaacgagacggacggagctggcgtcgcccatga

SEQ ID NO: 2523 - protein, 507 aa, Streptomyces avermitilis
MSSSNPLRDPADRRLPRIAGPSGLVIFGVTGDLSRKKLMPAVYDLANRGLLPPGFSLVGFARRDWEHEDFAQVVHDAVKEHARTEFREEVWQQLIQGMRFVQGTFDDDDAFERLRDTIGELDKAQGTGGNFAFYLSVPPSAFPVVIQQLKKHGLADQSDGSWRRAVIEKPFGHDLKSAEELNAIVHEVFGSDQVFRIDHYLGKETVQNILALRFANTMFEPIWNRSFVDHVQITMAEDIGIGGRAGYYDGIGAARDVIQNHLLQLMALTAMEEPASFDADALAAEKTKVLGAAKLPKDLSKNTVRGQYAAGWQGGEKVVGYLQEDGIDPKSKTDTYAAVKLEVDNRRWAGVPFYLRTGKRLGRRVTEIAVVFQRAPHSPFDHTATEELGQNAIVIRVQPDEGITVRFGSKVPGTSMEIRDVSMDFAYGESFTESSPEAYERLILDVLLGDSNLFPRTEEVELSWKILDPIEEHWDKHGKPAQYPAGTWGPVEADEMLERDGRSWRRP

SEQ ID NO: 2524 - DNA, 1647 bp, Streptomyces avermitilis
  CDS (1)..(1647)
atgagcaagactccttcgaccgggacgccgggcaccgagaagcctgtcaccgggacgccggccaccgagacgcctgtcacggaggctccggtcaccgaggctccggtcaccgaggcgtcggccgtcgactgggccaaccccctgcgcgacccccgggaccgccgtctcccccgtatcgcgggcccctcgggcctcgtcatcttcggggtcaccggcgacctgtcccgcaagaagctgatgccggccatctacgacctggccaaccgcggtctgctcccgccgggcttctcgctcctcgggttcgcccgccgggactgggaggaccaggacttcgcgcaggtggtgcacgactcggtgcgcgagcacgcccgcacggagttccgcgaggaggtctggcagcagctcgccgagggcatgcggttcatcccgggcgacttcgacgacgacatggcgttcaagcaactgcgcgcgtccgtcgacgagctggacgcctcccgcggcaccagcggcaactacgccttctatctctcggtaccgccgaagttcttcccgaaggtcgtccagcagctcaagaagcacgggctcgcggacgcgccggagggctcctggcggcgtgcggtcatcgagaagccgttcggccacgacctggccagcgcgcgtgagctgaacgcgatcgtgcacgaggtgttcgacccggaccaggtgttccgcatcgaccactacctgggtaaggagaccgtccagaacatcctggcgctccgcttcgccaaccagatgtacgagccggtctggaaccggtcgtacgtcgaccacgtacagatcaccatggccgaggacatcggcatcggcggccgtgcggggtactacgacggcatcggttcggcccgtgacgtcatccagaaccacctcctccagctgatggcgctgaccgccatggaggagccggccgccttcgacgccgagtcgctgctcgccgagaagctgaaggtcctcaagtccgtgaagctgccggggaacctgggcgagcacaccgtgcgcggtcagtacacggcgagctggcagggcggcgagcgggtgcgcggctacctccaggaggacggcatcgaccccaggtcgacgacggacacctacgcggccgtgaagctggaggtcgacaaccgccgctgggcgggcgtccccttctatctgcgcaccggcaagcgtctgggccgccgggtgaccgagatcgcggtggtcttccagcgcgcgccccactcccccttcgactcgaccgccaccgaggagttgggcgccaacgcgatcgtcgtccgtgtccagcccgacgagggcatgaccgtgcgcttcggttcgaaggtgccgggtacgtcgatggagatccgggacgtctcgatggacttcgcgtacggcgagtcgttcaccgagtccagcccggaggcgtacgaacggctgatcctggatgtcctgctcggcgacgccaatctcttcccccgccatcaggaggtggaagagtcctggaagatcctcgacccgatcgaggggtactgggacacgcacggcaagcccgcgcagtacccctcgggatcctggggtcccgaggaagccgacgagatgctcgcacgagacggacggagctggcgcaggccatga

SEQ ID NO: 2525 - protein, 548 aa, Streptomyces avermitilis
MSKTPSTGTPGTEKPVTGTPATETPVTEAPVTEAPVTEASAVDWANPLRDPRDRRLPRIAGPSGLVIFGVTGDLSRKKLMPAIYDLANRGLLPPGFSLLGFARRDWEDQDFAQVVHDSVREHARTEFREEVWQQLAEGMRFIPGDFDDDMAFKQLRASVDELDASRGTSGNYAFYLSVPPKFFPKVVQQLKKHGLADAPEGSWRRAVIEKPFGHDLASARELNAIVHEVFDPDQVFRIDHYLGKETVQNILALRFANQMYEPVWNRSYVDHVQITMAEDIGIGGRAGYYDGIGSARDVIQNHLLQLMALTAMEEPAAFDAESLLAEKLKVLKSVKLPGNLGEHTVRGQYTASWQGGERVRGYLQEDGIDPRSTTDTYAAVKLEVDNRRWAGVPFYLRTGKRLGRRVTEIAVVFQRAPHSPFDSTATEELGANAIVVRVQPDEGMTVRFGSKVPGTSMEIRDVSMDFAYGESFTESSPEAYERLILDVLLGDANLFPRHQEVEESWKILDPIEGYWDTHGKPAQYPSGSWGPEEADEMLARDGRSWRRP

SEQ ID NO: 2526 - DNA, 1491 bp, Nitrosomonas europaea
  CDS (1)..(1491)
atgaatgatgcaaaaatgagccagactgaaaagctgccctgcctgtttgtcatttttggtgcaactggagatctcgcctcaaacaagttgctgcccgcgttatttgagttggaaaatgctggccgcctggcagataatttttccatcgttgctttctcgcgccgcgagtggacaactgacgattggctcgaacatctgcgtgaaatactgaagaataggattgatcaatcttttccggaaggagtgctggagcgtttttttgcacgtttccgttatcagcagggagatctcaacgatatcgaatcctatcgtgtgttagctgccggtctggcgcccggatcggcttgttctcgtacggtattttatcttgcgatcaggcctgctgatttcgttgcggtgatcaggaatctcaaagctgctggcctcaatgagccgcgaggaatgaaccgtgtagtgattgaaaaaccgtttggagaggatcttgaatcggcacaggtactgaatcgcttattgcatcagcattttgatgaagagcagatttatcgtatcgatcatttccttggtaaggaaaccgtacagaatctgcttgttttccggtttgccaatacgttgatcgagccactgtggaatcgtaattttattgatcatgtacaaattacggtggcggaatcgggtggtattgaaaaacgtgcagggtattatgatcgtgctggtgcgttgcgtgatatgttgcagaatcatttgatgcaattattgaccgtagttgccatggaaccgccacctgctcttgaggcagatgctttacgtgacgaaaaggtcaaagtactacgttcgattcgtcccattgccaagcgcgcgatacatgcccatgctgtgcgcgctcaatatactcacggtaatatcgatgggcaggtggtggcaggttatcagcaggaagataatgttgaacgggattcgattaccgaaacttttgtggcagccaagttctacattgataattggcgctggcggggagtgccgttttatctgcgtacaggtaagcgtatgccgaaacagaattcgatgatcgcaattcgtttcaagcatcctccccagcaacttttccgtgaaacaccattggaatggattgcaccaaactgggtgttgctttcgattcagcctgaagaatcgatgcacatggaaattcatgttaaacaacccggtctcgatatgaatacccgggtgatgcagatgaacgcaagttttctcaaaaccgatgaacaggcgctggatgcttatgaagcgctactgctcgacgtcattgaaggcgatcgctcacttttcattcgttttgatgaagttgaatgggcgtggcaagtgattgatcctattctgaaacattgggtggtagagcgcgaatatatcccgacttaccctgctggcagttgggggccggcagaggctaatcgcttgtttgacaacgatgatcagacctggcgcaacgagctttag

SEQ ID NO: 2527 - protein, 496 aa, Nitrosomonas europaea
MNDAKMSQTEKLPCLFVIFGATGDLASNKLLPALFELENAGRLADNFSIVAFSRREWTTDDWLEHLREILKNRIDQSFPEGVLERFFARFRYQQGDLNDIESYRVLAAGLAPGSACSRTVFYLAIRPADFVAVIRNLKAAGLNEPRGMNRVVIEKPFGEDLESAQVLNRLLHQHFDEEQIYRIDHFLGKETVQNLLVFRFANTLIEPLWNRNFIDHVQITVAESGGIEKRAGYYDRAGALRDMLQNHLMQLLTVVAMEPPPALEADALRDEKVKVLRSIRPIAKRAIHAHAVRAQYTHGNIDGQVVAGYQQEDNVERDSITETFVAAKFYIDNWRWRGVPFYLRTGKRMPKQNSMIAIRFKHPPQQLFRETPLEWIAPNWVLLSIQPEESMHMEIHVKQPGLDMNTRVMQMNASFLKTDEQALDAYEALLLDVIEGDRSLFIRFDEVEWAWQVIDPILKHWVVEREYIPTYPAGSWGPAEANRLFDNDDQTWRNEL

SEQ ID NO: 2528 - DNA, 1524 bp, Enterococcus faecalis
  CDS (1)..(1524)
atgaatgaaaaagtagcattatttactattttcggggggacaggtgatcttgccaaacgtaaattgtatccttccctgttccgcttatataaaaaaggattattagctgagcgttttgcggtgattggtaccgcacgtcgggaatggacagacgaatactatcgtgaaatcgtccgtgaaaccattcaagacttaaatcccacggccgaagaggcaactgaattttctagtcatttctattaccaatcacataatgtgaatgatacggaacattataataccttaaaagaattatctgatcgcctaaatgaacaataccacttagaaggcaatcatgtttactatttagctatggcccctcaattctttggaaccattgttaatcacttgaaatcacaacatattatttcggaagaaggctttgatcgtctaattatcgaaaagccatttggttctgattatgaatctgcctacgaattaaatgaagaaattcgtgctgcatttcctgaacaagatattttccgaattgaccattacttaggcaaagaaatgatccaaaatatttcagccattcgttttgccaataatatttttgaatcacaatggaacaatcgttacattgataatgtccaaatcaccttcgctgaaagcttaggtgtcgaggatcgtggcggctattatgaccacagtggcgcactaaaagatatggttcaaaatcatattttacaagtcgttgcattgctttctatggagcctcctgttgccttttctgaaaaagaaattcggactgaaaaagtaaaagctttacgtgccatccgcctttattctgaagaagaagcccttcaaaatttcgtgcgtggacaatacggcgaaggtcagctagctgatcaaacatttgcagcctatcgtgatgaaccaaatgtggcagaaacttcatccactgaaacttttgttgctggtaaatttttaattgataatttccgttggtctggcgtccctttctatgttcgcacaggtaaacgattaactgaaaaaggcacacgcattaacatcgtctttaaacaagtacctattaatgtcttcaaagatgatacgtgtgaagaatgcgataaaaccgatttaccaccgaatgttttaactatctatatccaaccaactgaaggattttcattaaccttaaatggaaaagaaatcggtcaagggttcaatacaactccagtgaaacttgatttccgtcaaagtgctgaaatgactgaaaatagtccagaagcatacgaaaaacttctattagactgcctaaatggcgatagtacaaacttctctcattgggacgaagttgcccaatcttggcgcattgttgacattattcgacatgcttgggataaaacagacgtttctttccctaattatgccgctggcacaatgggcccgcaagctgccttcgacttattagaaaaagatggctttacttgggaatggcaaccagataactggtaccgtgaccgcggtcaacttgatcaatga

SEQ ID NO: 2529 - protein, 507 aa, Enterococcus faecalis
MNEKVALFTIFGGTGDLAKRKLYPSLFRLYKKGLLAERFAVIGTARREWTDEYYREIVRETIQDLNPTAEEATEFSSHFYYQSHNVNDTEHYNTLKELSDRLNEQYHLEGNHVYYLAMAPQFFGTIVNHLKSQHIISEEGFDRLIIEKPFGSDYESAYELNEEIRAAFPEQDIFRIDHYLGKEMIQNISAIRFANNIFESQWNNRYIDNVQITFAESLGVEDRGGYYDHSGALKDMVQNHILQVVALLSMEPPVAFSEKEIRTEKVKALRAIRLYSEEEALQNFVRGQYGEGQLADQTFAAYRDEPNVAETSSTETFVAGKFLIDNFRWSGVPFYVRTGKRLTEKGTRINIVFKQVPINVFKDDTCEECDKTDLPPNVLTIYIQPTEGFSLTLNGKEIGQGFNTTPVKLDFRQSAEMTENSPEAYEKLLLDCLNGDSTNFSHWDEVAQSWRIVDIIRHAWDKTDVSFPNYAAGTMGPQAAFDLLEKDGFTWEWQPDNWYRDRGQLDQ

SEQ ID NO: 2530 - DNA, 1464 bp, Tropheryma whipplei
  CDS (1)..(1464)
atgccaaaggtgaattgcgcaacacagcagattgccctgcctggggcgcttgctatattcggggcaacgggtgacctgagctccaaaaaactattgccagcggtgtacgacttgtttcataactctcttctatcaaatgggttcgttttaattgctctgaatagagacttctcggcgcaagattttatctgtcacttccgccattgcgttaagtctttctctaggacgggatggtcagagtctgtttttcttgatctccaaaaaagggtacatcatgtaagtggcgacttttccgaccccgagacatatattgagctctctgagaaattagaaaccaccaaagaggaaactgggggtaattgtgttttttatctctcagttccgccaaatgtatttactcccatcatgaaaaacttgtctgctagtgggctgtctagaggatgtttgcataaaattgctgttgaaaaaccctttggtaatgaccttaaaagtgcaatacagcttaattcagtgcttaggtcagctttccctgagcgtgctatctttcgggttgatcactatcttggtaaagagaccattcaaaatattcttacttttcgttttggaaaccaaatctttgaccctatttggaataggaaacatgttgatcatgtgcagattacgatgtctgaagatataggggttgagggtcgcagtaagtactatgacggaatcggtgctgcacgtgatgtattacaaaatcatcttttgcagcttatggctctaattacgatggagagaccctcgaatttgaataacgcgagtgatataaggcacgagaagcagagagttttggaatgtgtgagtcttccgaaaaatatagctcaaaatgctgttcgtggccaatactcatccggctatctacgggatgagagggttgtatcttttttgcaagaagatggggttaatccatcttcaagaactgaaacattcgcggcgataaagctaaatgccgataatgaacgttggtatggtgtacctttctacgttagaactgggaaacggatggcaaaacgtagtgcatatataagtcttgtattcaagccaactgatatgagtattttgcaaaatgtgattgttataaggttgcaaccagacgagggtgtgtctatttggtttgcgtcgaaagtgcccggttatcgttctgatattcgacaggtgaattttgatttttcgtataaaagctcatttactgaatcaagtccagaggcttatgaacgcttaattctggatgcaatgaggggtgaggcctccttgtttccgcagcaaagagaagtggagttgtgttggggcataatagacccccttgaggaggtttgggaaaacgacaataccctgataccccaatacactccaggaagttgggggccagatacttcaaacgaccttttgctcagaacgtccaggcactggagaaattactga

SEQ ID NO: 2531 - protein, 487 aa, Tropheryma whipplei
MPKVNCATQQIALPGALAIFGATGDLSSKKLLPAVYDLFHNSLLSNGFVLIALNRDFSAQDFICHFRHCVKSFSRTGWSESVFLDLQKRVHHVSGDFSDPETYIELSEKLETTKEETGGNCVFYLSVPPNVFTPIMKNLSASGLSRGCLHKIAVEKPFGNDLKSAIQLNSVLRSAFPERAIFRVDHYLGKETIQNILTFRFGNQIFDPIWNRKHVDHVQITMSEDIGVEGRSKYYDGIGAARDVLQNHLLQLMALITMERPSNLNNASDIRHEKQRVLECVSLPKNIAQNAVRGQYSSGYLRDERVVSFLQEDGVNPSSRTETFAAIKLNADNERWYGVPFYVRTGKRMAKRSAYISLVFKPTDMSILQNVIVIRLQPDEGVSIWFASKVPGYRSDIRQVNFDFSYKSSFTESSPEAYERLILDAMRGEASLFPQQREVELCWGIIDPLEEVWENDNTLIPQYTPGSWGPDTSNDLLLRTSRHWRNY

SEQ ID NO: 2532 - DNA, 2145 bp, Leishmania mexicana
  CDS (298)..(1986)
aggcggagcgcgagcgcggcatcacgatcgacattgcgctgtggaagttcgagtcgcccaagtcggtgttcacgatcatcgatgcgcccggccaccgcgacttcatcaagaacatgatctaaaataaagcgaagaacaccaaggagaaatcgaaaaggacaggcgactcgtcgagaaagagaatttggtgtccttattgaacccccttcctattacttgtttagagctctcgatcgcattttattttgcctttggctaccatatagtgatcagtggcaggtacatcaattaagcaccatgtcggaagagcagtttgctgcttctcaagaggcctatgtggccgacgtcgacagcattctggacgtgctccgcgcgcaagtgctggagcggaagccggataacgttctccagtttatctccaagtcggcgcttagtctacagaaggacagcagctcggaatcctgcgatctcatcagctgtaaggtgaaggatgagcagaagagtcgttcgttgaccatcatcgtgttcggtgccagcggagatctggccaagaagaagacatttcctgccctcttcagcctgtactgcggtggccttctccccccggatgtcaatattatcggctatgcgcgcaccaaggtggacgatgccgagaagtggaagcatgagacgctcatgaagcatttttcgaacttgtcggagcgtgaatgccacgccgaggatttcttgaaacatatcagctatttttgtggatcatacgacaaggtggaagacttcaagcgtcttgacattatgattcgcgaaaaggagaatgcttttaagggccctgaaaagggtggaaaccgtctcttctacctcgctcttccgccatccgttttcgcgactgtctgtgaaagcatttacaagggcgtgatgccgcaagaagtagggggatgggttcgggtgatcatcgagaagccctttggccgcgatactgagagctccgcggagctgtcacgagcgctggagccgttcttcaacgagtcacagatctaccgcattgatcactacctcgggaaggagatggtgcagaacatcattacaacacgcttcgccaaccgtattttcagcgctgtgtggaactcgagcaacatcgcgtgcgtgcagatcaccttcaaggagaccataggcactgagggccgtggtggctacttcgacagcatcggcattattcgcgacgtcatgcaaaaccatctcacacaaattcttgcattgctggcgatggagaagccgcggacgcttgacgccgagtgtatccgtgacgagaaagtgtcagtactgaaacacattgaaccagtaaccaaggagaattgtgttctggggcagtacactgcctccgccgatggctccattcctggctacctggaagacgagaccgtacccaagggcagcacttgccctacatttgctgtgatgcggcttaacatcaacaacgaccgctgggccggcgttccttttattctcaaggccggcaaggctgtggagcagaagtacgtagcaattcgcattcagttcaaggacgaggtacacccctacggtgaggcgacacagcgcaacgagctcgtcatccgtgcccagccgtccgaggccatgtatgtcaagatcaccacaaaggttcctggcctgagcggtgacttgcgacaaacgcaccagacagagctggacctcacatatcacacccggtacgatgtgcgccttccagatgcctacgaaagccttctcaatgacgcacttctggggagctcgacaaattttgtgcgcaaggacgagcttgacgtggcatggcgcatcttcacaccgcttctgcaccagatcgaccgtggagagatcaaacccattcagtaccaggccggtacgcgtgggcccaaggaagcggatgagttcatcatcagcaacggctttaagcaccagaaaggctatcactggcttcccttcaacaaactgtgaaaggaggcgaatcagtctgttttacagtcgcctgctgatgacagcgagagacgcagagcgtctcacgctgatgagtgtcatatgcggtcaggaatcactgatggcgctctgccatatgcacacacgggcaacacacgagagtgaagacagacatcacgc

SEQ ID NO: 2533 - protein, 562 aa, Leishmania mexicana
MSEEQFAASQEAYVADVDSILDVLRAQVLERKPDNVLQFISKSALSLQKDSSSESCDLISCKVKDEQKSRSLTIIVFGASGDLAKKKTFPALFSLYCGGLLPPDVNIIGYARTKVDDAEKWKHETLMKHFSNLSERECHAEDFLKHISYFCGSYDKVEDFKRLDIMIREKENAFKGPEKGGNRLFYLALPPSVFATVCESIYKGVMPQEVGGWVRVIIEKPFGRDTESSAELSRALEPFFNESQIYRIDHYLGKEMVQNIITTRFANRIFSAVWNSSNIACVQITFKETIGTEGRGGYFDSIGIIRDVMQNHLTQILALLAMEKPRTLDAECIRDEKVSVLKHIEPVTKENCVLGQYTASADGSIPGYLEDETVPKGSTCPTFAVMRLNINNDRWAGVPFILKAGKAVEQKYVAIRIQFKDEVHPYGEATQRNELVIRAQPSEAMYVKITTKVPGLSGDLRQTHQTELDLTYHTRYDVRLPDAYESLLNDALLGSSTNFVRKDELDVAWRIFTPLLHQIDRGEIKPIQYQAGTRGPKEADEFIISNGFKHQKGYHWLPFNKL

SEQ ID NO: 2534 - DNA, 1494 bp, Dictyostelium discoideum
  CDS (1)..(1494)
atgacatcaacaccagactctcgttcagttttaacagtaattattttaggtgcatcaggtgatcttgcaaagaaaaagacctatccagcactctttggtttatatcttagagatttgttaccaagcaacacaatcatttatggttatgctagatcacatattgaaattggtgatttcaaagctagaatctcaaaaggattaaaaggtgatgaagaaaagaaaaaacaatttttaaatttattacattatcattcaggtaaatatgatgaaaaagcatcctatgatgaatttgaaaaattaattttagcagaagaaaagaaacaacaaggtgttgataaattcaatcgtttattctatatggcaattccaccatcaattttcattgaagttagtattggtattcatggttcattgatctcaaagaatggttggtcaagagttatcgttgagaaaccatttggacgtgatttagcatcctcaagagagttggttagtgaattgggtaaacttttcaaagagaaagatttattccgtatcgatcattatttgggtaaagagatggtacaaaatttaatggtattaagattcgccaatgcagtattcgagccattatggtcaaaatcacatatctcttcaatcaccatcacattcaaagaagacattggtaccgagggtagaggtggttatttcgatcaatttggtatcattagagatgtaatgcaaaatcatttgcttcaagtactctctttggttgcaatggagccaccagtgtcattgaatgccgatgatatcaccaatgaaaaggttaaattacttcgttgtattcaaccaattaaaatgagtgaagttgtactcggtcaatatacttccgatcctgaaggtaaaattccagcctatttagatgatgaaggtgttccaaaggattcaaccactccaacctatgctgccgctgttttccatatcaataatccaagatggagaggtatgccattcatcttaaaatgtggtaaagctttagatgaaagaaaaactgaagttagaattcaattcaaacgtccagataactttttattctctgatgatgatatctcaagaaatgaattagttatgagaattcaaccaggtgaagctgtttacttaaaattattatcaaagaaaccaggtttagaaaataaaattgaacaaactgaattagatttatcatatcgtcatagatttgaaaatcttgatttaccagatgcatatgaacgtttaattcttgattcaattaaaggtgatcataaccttttcgtcagagatgatgaattagatgttgcatggcaaatatttacaccattactcgatcaaattgaaaaagaaaagattaaacctgaaccatattcctttggttcacgtggtccaaaatctgctgatgaattatcaaagaaatttggtttcattagatccttaggttataattggccaggtaattctccacaaggtagtaaaaaataa

SEQ ID NO: 2535 - protein, 497 aa, Dictyostelium discoideum
MTSTPDSRSVLTVIILGASGDLAKKKTYPALFGLYLRDLLPSNTIIYGYARSHIEIGDFKARISKGLKGDEEKKKQFLNLLHYHSGKYDEKASYDEFEKLILAEEKKQQGVDKFNRLFYMAIPPSIFIEVSIGIHGSLISKNGWSRVIVEKPFGRDLASSRELVSELGKLFKEKDLFRIDHYLGKEMVQNLMVLRFANAVFEPLWSKSHISSITITFKEDIGTEGRGGYFDQFGIIRDVMQNHLLQVLSLVAMEPPVSLNADDITNEKVKLLRCIQPIKMSEVVLGQYTSDPEGKIPAYLDDEGVPKDSTTPTYAAAVFHINNPRWRGMPFILKCGKALDERKTEVRIQFKRPDNFLFSDDDISRNELVMRIQPGEAVYLKLLSKKPGLENKIEQTELDLSYRHRFENLDLPDAYERLILDSIKGDHNLFVRDDELDVAWQIFTPLLDQIEKEKIKPEPYSFGSRGPKSADELSKKFGFIRSLGYNWPGNSPQGSKK

SEQ ID NO: 2536 - DNA, 1503 bp, Xylella fastidiosa
  CDS (1)..(1503)
atgctgctcacgcaaacaaaaacacccccacaccaacaaacgttaacatccaaatccgagaccaggtccatgcacaacaccctcttattgtttggcgccaccggcgacctcgcccaacgctatctcttcccctccttactgcaactgtttactgatggcttattgccacaagacttccgcattcgtgctctggccttgtcaccccataacaccacacaattccgcgacatcctgcgcacgcgcttggaacaagcactacccatcgccaacaccgcgcacatccaagccctactacaacgtgtcgactacctttccgtagacttgaacgacccaacatcaatcgccgaagcagtccgagatctgacggaacatccctgcatcagctacttggcaatcccaccaggcctgtataccaacaccgccctaggattggcacaaggaggggcactgcagacaccacaccgattgatgctggaaaaaccgatcggacgcgactcaataaacgcacgcgaaatcctaaacaccatcggcacactgattgacgaagatcgcatcttccgcgtagaccactatctaggcaaagcagcagtgcagaacctcgtcgcactgcggttcggaaacaccctgctagaagcggtatggaaccgaaaccacattgagtccgtacacatcctcatcgccgaaaccgaaggcgtcgatggccgcaatgcttactacgcacgtgctggcgcactacgtgacatgatgcaaagccacatcctgcaactcctatgcctggtcgctatggaacccccggtctctatggaagccgaccgcatacgcgacgaaaaagtcaaagtcctgcgcgcactacgcccactgaacgcccaaaacgccgcaatgcacagcgtgcgcggacgctacagcgcgggcaccattaacagccaaccagtgccagcctatcaaccaccagaaggcagcaatgtagagacctttgtcggtgtcaccgcatacatcgacaactggcgctgggcgggcgtaccgttccatctatgcacaggaaaacgcttggccgaacgctcaacccaaatcgtcgtcaccctcaaacccgtcacacactggctatttgaacgtccaaaccggaacaatgcagcaccaaaccgcctgtgcttcaaactacagccccaggaaaatatcgaactaaacctgatgagcagcctggccggccccgaatggggaaccctagaactgcaaccgctggaattggagttatccgtcccaaccgggaaacatcgccacatcgcctatgagcgccttttcctcgacgcattcaacggcaaccctgcgctatttgtacgtcacgacgaagtcacagaagcctgggcttggatcgacagcatcagcaatgcctgggaactgtccgacttaccactgcaaccctaccccgccggcggctggggcccacctcaagcccaccaatttctgccgccattggggattgatggccatggaaacaacgcatga

SEQ ID NO: 2537 - protein, 500 aa, Xylella fastidiosa
MLLTQTKTPPHQQTLTSKSETRSMHNTLLLFGATGDLAQRYLFPSLLQLFTDGLLPQDFRIRALALSPHNTTQFRDILRTRLEQALPIANTAHIQALLQRVDYLSVDLNDPTSIAEAVRDLTEHPCISYLAIPPGLYTNTALGLAQGGALQTPHRLMLEKPIGRDSINAREILNTIGTLIDEDRIFRVDHYLGKAAVQNLVALRFGNTLLEAVWNRNHIESVHILIAETEGVDGRNAYYARAGALRDMMQSHILQLLCLVAMEPPVSMEADRIRDEKVKVLRALRPLNAQNAAMHSVRGRYSAGTINSQPVPAYQPPEGSNVETFVGVTAYIDNWRWAGVPFHLCTGKRLAERSTQIVVTLKPVTHWLFERPNRNNAAPNRLCFKLQPQENIELNLMSSLAGPEWGTLELQPLELELSVPTGKHRHIAYERLFLDAFNGNPALFVRHDEVTEAWAWIDSISNAWELSDLPLQPYPAGGWGPPQAHQFLPPLGIDGHGNNA

SEQ ID NO: 2538 - DNA, 1506 bp, Vibrio parahaemolyticus
  CDS (1)..(1506)
atgatggtaataccagaaaacagcagcatcgttatttttggtgcttcaggtgaccttacatatcgtaagctcattcctgctttataccacctttatgcgaacaagcagcttccagagagttttgccattcttggcgtaagtcgtactgaatacagtgacgagtcctaccgcgagaagctgaaaaaatcgcttcaagaaatggaaaaaaccgagccagaaacgcttgatgcatttatcaaccatctgcattaccaagcaattaacacttctgacacgcaagattacagcaagctggcaacacgtttagaccaacttgccgacgaatatcaattcgaacaacgtaatacgcttttctacctagctacacctccaagcctatacagtgtgatccctgcaagccttgcagcacatggtttgaacaatgaggaagatggctggaaacgtctgatcatcgagaaaccgttcggttacgaccttgagtcagcacgcacgttggataaagaaattcacgagcacttccaagaacatcaaatctaccgtatagaccattatttaggtaaagagacggttcaaaacctgcttgttttccgtttctctaacgcgatgtttgaaccgctttggaaccgtaacttcattgattacgtggaaatcacaggcgctgaattccttggcgtagaagagcgtggtggttactacgacaactctggcgctgtgcgcgatatgttccaaaaccacttgctacaagtattggcaatggtcggtatggaaccaccagcacaaatcaacgcagattcaatgcgtgatgaagtggtgaaagtgcttcaatgcctaaaaccactggatgaaacagcattacgtaacgatcttgtccttggtcagtacactgcatcagacgtacgcggccaacaccttccgggttaccgtgaagaaaacggcgtagcggacgattctcgtactgagacgtacattggtctaaaagcttacatcaacaactggcgttggaatggtgtacctttctatgtacgtacaggtaagcgtcttccgactcgcgttactgaagtggttattcactttaaacaaacaccgcacccagtgtttggccaaaatgcgccagaaaacaaactgatcattcgtattcagccagacgaaggcattcagatgagctttggtttgaaagaaccaggtgcaggctttaatgcgaaggaagtgaaaatgaacttccactacgcagacctgcaagagactcaaatgctaactgcgtacgagcgtcttctacttgatgctctaaatggcgatgcgacgctatttgcacgtagcgatgcagttgaagcatgttggcagtacgttcagccaattttagacttcaaacaagatcctcaatcactcttcggatacgcatgtggtacatggggtcctaaagagtctgatgacttgcttcagcgtgacaaccgcgcttggcgtttcccatgtaaaaacctaacagatacggactactgtgaactatga

SEQ ID NO: 2539 - protein, 501 aa, Vibrio parahaemolyticus
MMVIPENSSIVIFGASGDLTYRKLIPALYHLYANKQLPESFAILGVSRTEYSDESYREKLKKSLQEMEKTEPETLDAFINHLHYQAINTSDTQDYSKLATRLDQLADEYQFEQRNTLFYLATPPSLYSVIPASLAAHGLNNEEDGWKRLIIEKPFGYDLESARTLDKEIHEHFQEHQIYRIDHYLGKETVQNLLVFRFSNAMFEPLWNRNFIDYVEITGAEFLGVEERGGYYDNSGAVRDMFQNHLLQVLAMVGMEPPAQINADSMRDEVVKVLQCLKPLDETALRNDLVLGQYTASDVRGQHLPGYREENGVADDSRTETYIGLKAYINNWRWNGVPFYVRTGKRLPTRVTEVVIHFKQTPHPVFGQNAPENKLIIRIQPDEGIQMSFGLKEPGAGFNAKEVKMNFHYADLQETQMLTAYERLLLDALNGDATLFARSDAVEACWQYVQPILDFKQDPQSLFGYACGTWGPKESDDLLQRDNRAWRFPCKNLTDTDYCEL

SEQ ID NO: 2540 - DNA, 1533 bp, Pseudomonas syringae
  CDS (1)..(1533)
atgggtctgtcgcgcggcagtgccgagcaaaaagccgaagttgcgcccccaaccaccctgtttctgttcggtgcacatggtgacctggtcaagcgtctgctgatgccggcgctttacaacctgtcgcgcgacggtctggtggatgaagggctgcacatcgtcggcgtcgatcacaacgcgatcagcgatgcggacttcgccaaaaaactcgaaaatttcattcgcgacgaggccgccggcaaaattgccggcggtggcaaggaccctctcgatcctgcgttgtggggcacgctggccgagcgtatcagctatgtgcagggtgactttctggatgattcgacctatcaggacatcgccagcaagattgagagcaccggtgcgaaaaacgcggtgttttatctggccaccgcgccgcggttcttcagcgaagtggcccagcgcctggggtcgtccggtttgctgcaggaaaccgatgacgggttccgccgggtaatcatcgaaaagccgttcggctccgatctggccagtgcagtggcgctcaatggctgcctgctcaaggtcatgagcgaaaaacagatctaccggatcgaccattacctgggcaaggagacggtgcagaacattctggtcagccgtttctccaatggcctgttcgagtcgttctggaacaaccactacatcgaccacgtgcagatcaccgccgcggaaaccgtgggtgtcgagacccgtggcagtttttacgagcacaccggtgcactgcgcgacatggtgcccaatcacctgttccagttgctggcgatggtcgcgatggagccccccgcggccttcggtgccgacgcggtccgtggcgaaaaagccaaggtggtgggcgcgatcaggccgtggaacaaagaggaagcactggccaattcggtacgcggtcagtatgcgcagggcacgatgggcgacaaggaggttgtcggttatcgccaggaagatcgggtcgagcctgacagtacgacggaaacctatgtggcgctcaaggtcatggtcgacaactggcgctgggtgggcgtgcctttttatctgcgcacaggcaagcgcatgagtgcccgcagcactgaaatcgccatctgcttcaaacctgcgccctatgcgcaatttcgtgacaccgaagtcgatcgtttgaagcccaactacctgcgcatccagattcagcccaacgaaggcatgtggttcgatctgttcgccaaacggcccggcccgacgctggacatggaggacatcgcgctgggttttgcctataaggacttcttcgagatgcagccttcgaccggctacgaaacccttatatacgactgtctgaccggcgaccagaccctgtttcagcgtgccgacaacatcgaaaacggctggcgtgctctgcagccgtttcttgatgcctgggccagccagcctgaagttcagccgtatgaggctggcaagaacggacctgatgcgggtgacgagttgctgagccgtgatggtcgcgagtggagagatctgaatgtctga

SEQ ID NO: 2541 - protein, 510 aa, Pseudomonas syringae
MGLSRGSAEQKAEVAPPTTLFLFGAHGDLVKRLLMPALYNLSRDGLVDEGLHIVGVDHNAISDADFAKKLENFIRDEAAGKIAGGGKDPLDPALWGTLAERISYVQGDFLDDSTYQDIASKIESTGAKNAVFYLATAPRFFSEVAQRLGSSGLLQETDDGFRRVIIEKPFGSDLASAVALNGCLLKVMSEKQIYRIDHYLGKETVQNILVSRFSNGLFESFWNNHYIDHVQITAAETVGVETRGSFYEHTGALRDMVPNHLFQLLAMVAMEPPAAFGADAVRGEKAKVVGAIRPWNKEEALANSVRGQYAQGTMGDKEVVGYRQEDRVEPDSTTETYVALKVMVDNWRWVGVPFYLRTGKRMSARSTEIAICFKPAPYAQFRDTEVDRLKPNYLRIQIQPNEGMWFDLFAKRPGPTLDMEDIALGFAYKDFFEMQPSTGYETLIYDCLTGDQTLFQRADNIENGWRALQPFLDAWASQPEVQPYEAGKNGPDAGDELLSRDGREWRDLNV

SEQ ID NO: 2542 - DNA, 1470 bp, Pseudomonas syringae
  CDS (1)..(1470)
atgcccttgattacggttgaaccgtgcacatttgccctgtttggtgccctgggggacctggcggtacgcaagctgttcccggctctttatcagcttgatcgcgctggactgctgcatgaagacacaaaaattcttgccctggcgcgtgaaccaggcgacgaacagtcgcatctggcctacatcgaaaaatccatgcgccgcttcattcccgaggcggagcttgaggccgacaacgcagcgcgcttcctggcgcgcctcagctacctgcatgtcgattttctcaaggccgaggactatgttgcgctggccgagcgcgttggcaatgccgagacgctgatagcctacttcgccacgccggcctcggtgtacggcgcgatctgcgagaacctcgcgtcggtgaacctggccgagcgcacacgcgccgtcctggaaaagcccatcggccatgacctggcctcgtcgcgacgggtcaacgacgccgttgcgcagttcttcccggaaaaccgcgtctaccgaatcgaccattacctgggcaaggacacggtccagaacctcattgccctgcggttcgccaacagcctgttcgagacccagtggaaccagaaccatatttcccacgtggaaatcacggttgccgagaaagtcggcattgagggccgctggggctacttcgatcaggccggccagctgcgcgacatgattcagaaccacctgctgcagttgctctgcctgatcgccatggacccgcccagcgacctgtcggccgacagtattcgtgacgagaaggtaaaagtgctcaaggcactggccccgttcacccccgagcgtctggccacccaggtggtgcgcggtcagtacaccgctggctacagcgaaggcaaggcagtgccgggttatctggaagaagagaactcaaacacccagagcgacaccgaaacctttgttgcgttgcgtgccgatatccgcaactggcgctggtcgggtacgccgttttatctgcgtaccggcaagcgcatgccgcagaaaatgtcgcagatcgtgatccacttcaaagagccgccgcactacatctttgcccctgagcagcgtttgcagatcagcaaccgcctgatcattcgtctgcagcctgacgaaggtatttccctgcaggtgatgaccaaggatcaggggctggacaaaggcatgcagctgcgcagcggccccttgcaactgaatttttccgacacctaccgcagcgctcgtgtccccgacgcttatgagcggttgttgctggaagtcatgcgtggcaatcagaacctgtttgtccgcaaagatgaaatcgagtacgcctggcaatggtgcgatcagctgattgccggctggaagaaggcgggcgatgcgcccaagccttacccggccggaacctgggggccaatgagctccattgccctgattactcgcgacgggagatcctggtatggcgatatgtga

SEQ ID NO: 2543 - protein, 489 aa, Pseudomonas syringae
MPLITVEPCTFALFGALGDLAVRKLFPALYQLDRAGLLHEDTKILALAREPGDEQSHLAYIEKSMRRFIPEAELEADNAARFLARLSYLHVDFLKAEDYVALAERVGNAETLIAYFATPASVYGAICENLASVNLAERTRAVLEKPIGHDLASSRRVNDAVAQFFPENRVYRIDHYLGKDTVQNLIALRFANSLFETQWNQNHISHVEITVAEKVGIEGRWGYFDQAGQLRDMIQNHLLQLLCLIAMDPPSDLSADSIRDEKVKVLKALAPFTPERLATQVVRGQYTAGYSEGKAVPGYLEEENSNTQSDTETFVALRADIRNWRWSGTPFYLRTGKRMPQKMSQIVIHFKEPPHYIFAPEQRLQISNRLIIRLQPDEGISLQVMTKDQGLDKGMQLRSGPLQLNFSDTYRSARVPDAYERLLLEVMRGNQNLFVRKDEIEYAWQWCDQLIAGWKKAGDAPKPYPAGTWGPMSSIALITRDGRSWYGDM

SEQ ID NO: 2544 - DNA, 1458 bp, Pseudomonas putida
  CDS (1)..(1458)
atggagagtggtggtttgactattccttgcgacattctggtcttcggcggcaccggtgatctggccctgcacaaattgcttccggcgctctaccacctgtttcgcgaggcccgtctgaaccctgccgtgcgggtcatcgcactggccaggcgcaacctgccacgcatcgactatctgaagctcgccgaacgccattgtcgggcgcagattgcccgcagcgacttcgacgaagaggtgtggcagcggttttccgcacgggtcgactacttcccgatggatgcttcacagagcgccgacttcggccgcctggcacgctacctgggcgaacccggtggactgacacgcatcttctacctggccaccgctcccaacctgttcgtgccgattgccaaccacctgcgcattgccggactggccgacaccgaagcgcgcatcgtgctggaaaaaccgatcggccattcgctggaatcggccactgccatcaatgaagcgattggcacggtgttcgaagaaagacaggtgttccgcatcgaccactacctgggcaaggaaaccgtgcagaacctgatggccctgcgttttgccaatgccctgctggagccggtgtggcgcaacaaccaggtcgaccatgtccagatcagcgtttgcgagacactgggcgtagaaaaccgcggtgcctactacgatcgcgccggggctattcgcgacatgctgcagaaccacctgctgcagctgctgtgcctggtggccatggagccacccgcgcaattcgaggcagaggcggtacgcgacgaaaaggtgaaaatcctgcgcgccctcaagccgatcaccggccaggatgtgcaggacaagacggtacgcggccaatatggggccgggcgtatcggcggccaggaagtgccggcctactactttgaaaaggacgtcgacaacgacagcgataccgaaactttcgtggccatcgaggcgcatatcgacaactggcgctgggcgggcgtgcctttctatctgcgcaccggcaaacgcatggcgcggcgcgcttcgcagatcgtcatccagttcaagccagtgcctcacgaactgttcagcggcggccaggtcaaccagttgctgatacagctgcaaccggacgaacgcatcagcctgcgcatgatgaccaagagcccaggcaagggcatgcgcctggaacccgtggacctggaccttaatctggcccaggtgttcagccagactcgccgctgggaagcctacgagcgtctgctgctggatgtgctcgaaggtgattcgacactgttcatgcgccgcgatgaagtggaagcagcctgggcttgggtagatccaatcatcaagggctgtgaagagcacttccaggcgccccgcccctacccggctggcagtttcgggcccgaacaagccaacagcctgctcgccaggcatggcaggcactggcatggctga

SEQ ID NO: 2545 - protein, 485 aa, Pseudomonas putida
MESGGLTIPCDILVFGGTGDLALHKLLPALYHLFREARLNPAVRVIALARRNLPRIDYLKLAERHCRAQIARSDFDEEVWQRFSARVDYFPMDASQSADFGRLARYLGEPGGLTRIFYLATAPNLFVPIANHLRIAGLADTEARIVLEKPIGHSLESATAINEAIGTVFEERQVFRIDHYLGKETVQNLMALRFANALLEPVWRNNQVDHVQISVCETLGVENRGAYYDRAGAIRDMLQNHLLQLLCLVAMEPPAQFEAEAVRDEKVKILRALKPITGQDVQDKTVRGQYGAGRIGGQEVPAYYFEKDVDNDSDTETFVAIEAHIDNWRWAGVPFYLRTGKRMARRASQIVIQFKPVPHELFSGGQVNQLLIQLQPDERISLRMMTKSPGKGMRLEPVDLDLNLAQVFSQTRRWEAYERLLLDVLEGDSTLFMRRDEVEAAWAWVDPIIKGCEEHFQAPRPYPAGSFGPEQANSLLARHGRHWHG

SEQ ID NO: 2546 - DNA, 1506 bp, Pseudomonas putida
  CDS (1)..(1506)
atgactaaacagacccttgcggccgcccccccttgtaccctgttcctgttcggcgccaatggcgacctggtcaagcgcctgctgatgcccgcgctgtacaacctcagccgtgacggtttgctggaccgtaacctgcgcatcgtcggcgttgaccataacccggccagcgccgaggatttcgccgcgcgcctgcacgcgttcatggtcgagcgtgacaaaggcggcgagggcagcgccaagtgcctggacgagaagctatgggcccgcctggccaagcgcctcgattaccagacgggcgactttctcgatccggccacctaccaggccctggccaggcgcatcgacaagacccgccacggcaatgccattttctatctggccacgtcgccgcgcttcttccccgaggtggcgcagcgcctggggcaggccggcttgctggacgagtctgccggcggctttcgccgggtggtggttgaaaaaccgttcggcaccgacctggccagcgccgaggcgctcaacgcctgcctgctgaaggtgatgggcgagcggcagatctaccgcatcgaccattacctgggcaaagagacggttcagaatattctggtcagccgcttttccaacggcttgttcgaatcgttctggaacaatcactacatcgaccacgtgcagatcaccgcagcggaaaccgtcggtgtcgagacccgtggtgcgttctatgacagcaccggcgccctgcgcgacatggtgcccaaccacctgttccagttgctggcgatggtggccatggagccgccggccgcgttcggcgccgatgcggtgcgcggtgaaaaggccaaggtggtcggcgctattcgcccatggtcggcaaaaatggcccagaagaattccgtacgaggccagtacagagccggcaagcaggggcgcaagccgttgccaggctaccggcaggagcccaacgtcgcgccggatagccagaccgagacctacgtggcgctgaaggtgatgatcgacaactggcgctgggccggcgtgccgttctacctgcgcaccggcaagcgcatgagcgtgcgtgacaccgagattgccatctgcttcaagcccgcaccgtatgcgcagtttcgcgagtcggagctggaacggcccaaacccaactacctgaaaatccagatccagcccaatgaaggcatgtggttcgacctgcaagccaaacggcccgggccagagctggtgatggagaatgtcgagttgggttttgcctacaaggacttcttcaagatgaccccggccactggctacgagacgctgatctatgactgcctgaccggtgaccagaccctgttccagcgggctgacaacatcgaaaacggttggcgagcggtgcagccgtttctcgatgcctgggcccagggcggcgaagtgcatgagtactcggctggcgaagatgggcctgaggccggcaatgaattgctgacccgcgacaagcgggagtggcaccggttggggtga

SEQ ID NO: 2547 - protein, 501 aa, Pseudomonas putida
MTKQTLAAAPPCTLFLFGANGDLVKRLLMPALYNLSRDGLLDRNLRIVGVDHNPASAEDFAARLHAFMVERDKGGEGSAKCLDEKLWARLAKRLDYQTGDFLDPATYQALARRIDKTRHGNAIFYLATSPRFFPEVAQRLGQAGLLDESAGGFRRVVVEKPFGTDLASAEALNACLLKVMGERQIYRIDHYLGKETVQNILVSRFSNGLFESFWNNHYIDHVQITAAETVGVETRGAFYDSTGALRDMVPNHLFQLLAMVAMEPPAAFGADAVRGEKAKVVGAIRPWSAKMAQKNSVRGQYRAGKQGRKPLPGYRQEPNVAPDSQTETYVALKVMIDNWRWAGVPFYLRTGKRMSVRDTEIAICFKPAPYAQFRESELERPKPNYLKIQIQPNEGMWFDLQAKRPGPELVMENVELGFAYKDFFKMTPATGYETLIYDCLTGDQTLFQRADNIENGWRAVQPFLDAWAQGGEVHEYSAGEDGPEAGNELLTRDKREWHRLG

SEQ ID NO: 2548 - DNA, 1470 bp, Pseudomonas putida
  CDS (1)..(1470)
atggccgcaatcagtgtcgaaccttgcacctttgccctgtttggcgccctcggcgacctggcattgcgcaagctgtttcctgcgctctaccagctcgaccgggccaacctgttgcacccggacacccgcctgctggccctcgcccgtgaggtcggcagtgcgcaggagcacctggacagcatcgaagcccacctgcgccggcacgtgcccgaggcagatatcgagcctgctgcgctggggcgcttccttgcccgcctgaattaccagcacctggacttccttcagcccgagggctatcaggccctggccgagcagctgccgggcgagctgccgctgatcgcctacttcgccacggcggcggcggtgtatggggccatctgcgaaaacctcgacaaggtcgggctggctgcgcgcacccgggtagtgctcgagaaacctattggccacgacctggagtcgtcgcgccgggtcaacgacgccgtggcgcggttcttccctgaaagccgggtttaccgcattgaccattacctgggcaaagagacggtgcagaacctgattgccctgcgcttcgccaatagcctgttcgaaacccagtggaaccagaattccatctcccatgtggagattaccgtcgcggaaaaggtcggtatcgagggccgttggggttatttcgacaaggccggccaactgcgcgacatgatccagaatcacctgctgcagttgctgtgcctgatcgccatggacccgcccagcgaactgtccgccgatgccatccgcgacgagaaggtgaaagtgctcaaagccctggcaccgatcactggcgacggcctgagcaccagcgtggtgcgcggccagtacattgccggctacagcgaaggcaagccggtgccgggttacctggaagaagacaacgccaacgcccagagcgacaccgaaaccttcgtcgccctgcgcgccgacatccgtaactggcgctggtcgggcgtgccgttctacctgcgaaccggcaagcgcatgccgcaaaaactgtcgcagatcgtcattcacttcaaggaaacgccgcactacatcttcgccccggaacagcgtttgcagatcggtaacaagctgatcatccgcctgcaaccggacgaaggcatttctttacgggtgatgaccaaggagcagggcctggacaagggcatgcaactgcgcagtggcccattgcagctgaatttttccgatgcctggcgcagtgcacgaattccggatgcctacgagcggctgttgctcgaagtgatgcgcggcaaccagaacctgttcgtgcgcaaggacgaaatcgagtatgcctggaagtggtgcgaccagttgatcgccggctggcgtaatgcgggcgatgcgcccaagccatacgcggcgggctcctgggggccgatgagctcgattgcactgatcacacgcgatgggagggcgtggtatggggatatctga

SEQ ID NO: 2549 - protein, 489 aa, Pseudomonas putida
MAAISVEPCTFALFGALGDLALRKLFPALYQLDRANLLHPDTRLLALAREVGSAQEHLDSIEAHLRRHVPEADIEPAALGRFLARLNYQHLDFLQPEGYQALAEQLPGELPLIAYFATAAAVYGAICENLDKVGLAARTRVVLEKPIGHDLESSRRVNDAVARFFPESRVYRIDHYLGKETVQNLIALRFANSLFETQWNQNSISHVEITVAEKVGIEGRWGYFDKAGQLRDMIQNHLLQLLCLIAMDPPSELSADAIRDEKVKVLKALAPITGDGLSTSVVRGQYIAGYSEGKPVPGYLEEDNANAQSDTETFVALRADIRNWRWSGVPFYLRTGKRMPQKLSQIVIHFKETPHYIFAPEQRLQIGNKLIIRLQPDEGISLRVMTKEQGLDKGMQLRSGPLQLNFSDAWRSARIPDAYERLLLEVMRGNQNLFVRKDEIEYAWKWCDQLIAGWRNAGDAPKPYAAGSWGPMSSIALITRDGRAWYGDI

SEQ ID NO: 2550 - DNA, 1485 bp, Lactobacillus plantarum
  CDS (1)..(1485)
atgagtaacgaaaaaattgccttattcaccatctttggcggtactggtgacctcgcacagcgtaaactgtacccgtcactatttaagctctatcaaaagggctatctcaaggaccactttgccgttattgggacggctcggcgtccttggactgatgatcactatcatgaagttattagtgactccctagctgatctgaatgctgatcaggaaacggtgacgcaatttgcgagccatttttattatcaatcgcatgacgttactgatgctgaacattaccgaactttgaaaaaattatcagaaaagctggacgcccaatatggtttacaaggcaaccggatcttctacttagcaatggcaccaaacttcttcggtacgattgcccaacacttacgttccgaaaatattctgacagataacggttttaaccgcgtcattatcgaaaagccttttggtcatgattatgaaagtgccaaggaacttaacgaccaattaacggctacttttaacgaaaatcagatttatcgaattgaccactaccttggtaaagaaatgattcaaaatatcacggccattcgttttggcaataatatttgggaatcattatggaacaaccgttacatcgacaatgtccaaattacgttaagtgaaaaactgggtgtcgaagaacgggccgtttactatgataacagcggtgccttgcgggatatggtccaaaatcacattttgcaaattttgagtctgttaacaatggatcaaccagttgaattcactgaaaatgatatcgacgtggaaaaggtcaaggctttacggagcttacgaccacttaaaccagaagaagtcgcaaccaactttgtccgtggtcaatacggtgccggcgatgatgctaaagcttaccgcgacgaagataagatttcatcagattctaacaccgatactttcgtcgctggtaaagtcatgatcgataattatcggtggtccggagtgccgttttacatccggactgggaaacgcttagccgataagttcacgcgaatcgacgtggtgttcaaacggccagtcgtcaatatcttcaatcatgaagacgtccgagctaatgacgacgcagcaaccagtctcgatccaaacatcttgacaatcaacgttgaaccgactgaaggcttcgagctccgcatgaatgctaaagcaatcggccaaggcttcgcaaccaccccggtcaagttgaattattctcacgatgctgaagccacggctggtagcccagaagcttacgaacgtttgcttcacgatgccttaaatggcgacgcaaccaactttacccactggcaagaggttgccgattcgtggaaattcgttgacgtcattcaaaaatactgggatgaacatcaacccgaatttccaaactaccgccctggtacaatgggaccagatgcggccgatgaattattacgtcaagatggtcaccgctgggtctaccgcaactag

SEQ ID NO: 2551 - protein, 494 aa, Lactobacillus plantarum
MSNEKIALFTIFGGTGDLAQRKLYPSLFKLYQKGYLKDHFAVIGTARRPWTDDHYHEVISDSLADLNADQETVTQFASHFYYQSHDVTDAEHYRTLKKLSEKLDAQYGLQGNRIFYLAMAPNFFGTIAQHLRSENILTDNGFNRVIIEKPFGHDYESAKELNDQLTATFNENQIYRIDHYLGKEMIQNITAIRFGNNIWESLWNNRYIDNVQITLSEKLGVEERAVYYDNSGALRDMVQNHILQILSLLTMDQPVEFTENDIDVEKVKALRSLRPLKPEEVATNFVRGQYGAGDDAKAYRDEDKISSDSNTDTFVAGKVMIDNYRWSGVPFYIRTGKRLADKFTRIDVVFKRPVVNIFNHEDVRANDDAATSLDPNILTINVEPTEGFELRMNAKAIGQGFATTPVKLNYSHDAEATAGSPEAYERLLHDALNGDATNFTHWQEVADSWKFVDVIQKYWDEHQPEFPNYRPGTMGPDAADELLRQDGHRWVYRN

SEQ ID NO: 2552 - DNA, 1440 bp, Clostridium tetani
  CDS (1)..(1440)
atgaaaaataaagccattaccatatttgggggaacaggagatttagcctatcgaaaattattcccttctctatataatttatatatgttagggagtattaatgatgaatattctattataggaattggtaggagagattatacaaaagaggattatttaacttatattcaagcaggagttaaaaagtttgccagaataaattatagtgatgataagtttgataagttttctaaaattataacctattataaaatggatattcaaaaggaagaagaatataagggtttaattaaatattataaagataaagatattattaaaaatcatatttactattatgcagttgcaccaagattttttattccaataactaaaggattaaaaaataataaatgttaccttaaagatgcaaaagttattattgaaaagccttttggagaagatttagaatcagctacttacctaaatgaacagctttcttttgtatttaaggacaagaatatttatcatattgatcattatttaggcaaagaaatgatacaaaatattataaatataagatttgccaacgcaatatttaaaggaatttggaacaaagattttattgagaatatacaaattaatgcttttgaaagcataggtgttaacaatagaggtggctattatgaccaaagtggtgcattaaaagatatggttcaaaatcatctatttcaattattgtccatagtagctatggaagaacccaaagaatttaatagtgattttattcatgaagctcaactcaaggtattaactgaaatgaagccaatagaggatagggatattgataattacttagttatgggtcaatatgaaggatatagggaagaaaaagatgttaatctaaaatcaaaaacagaaacttatgttgctatgaaaataataattgataatgaaagatggcaaggtgtacctttctatattcgtacaggtaaaaagctaaataagagagaaacggaaattataattaaatttaaatcaacaaataaaaatatagaaggaaatttattaattataaaaattcaaccagatgagggaatttatttaaaatttaatataaagaaacctggtactgtggatgagattcaaaaagtaagtatggatttttgtcaaagctgtattttagagaatagaattaatacgccagaagcctatgaaagattattaaaagcatgtatggattcagatagaagtttattttcaaaatgggagcaaattgtagtaagttggaaatatatcaacaaagttttagaaagttatagatcttattcaaataaactttataggtataagccggagacaattggaccaaaggaggcagaagagttagttaaaaaggataatcattattggataaatgatgaaagtaatagttgcttaaaacaaggagaggatagttaa

SEQ ID NO: 2553 - protein, 479 aa, Clostridium tetani
MKNKAITIFGGTGDLAYRKLFPSLYNLYMLGSINDEYSIIGIGRRDYTKEDYLTYIQAGVKKFARINYSDDKFDKFSKIITYYKMDIQKEEEYKGLIKYYKDKDIIKNHIYYYAVAPRFFIPITKGLKNNKCYLKDAKVIIEKPFGEDLESATYLNEQLSFVFKDKNIYHIDHYLGKEMIQNIINIRFANAIFKGIWNKDFIENIQINAFESIGVNNRGGYYDQSGALKDMVQNHLFQLLSIVAMEEPKEFNSDFIHEAQLKVLTEMKPIEDRDIDNYLVMGQYEGYREEKDVNLKSKTETYVAMKIIIDNERWQGVPFYIRTGKKLNKRETEIIIKFKSTNKNIEGNLLIIKIQPDEGIYLKFNIKKPGTVDEIQKVSMDFCQSCILENRINTPEAYERLLKACMDSDRSLFSKWEQIVVSWKYINKVLESYRSYSNKLYRYKPETIGPKEAEELVKKDNHYWINDESNSCLKQGEDS

SEQ ID NO: 2554 - DNA, 1512 bp, Bradyrhizobium japonicum
  CDS (1)..(1512)
atgacaaaagacccgcaagccaagcgcaagccggaaaattgcgccttcgtcatctttggcgtgaccggagaccttactcatcgccttgtgatgccctcgctctacaatctcgcggccgagcacctgttaccggaaaagttctgtgtcgtcggcgtggcccgcaagggccaatcggatgacgagctgcgcagcagcctgttgaagggcctgcgccagttcgcgacgcgacccgtggacgacgatatcgcccagaagctgctgcaatgcctgaccttcgtcgaggccgacccgaaggactcgccgtccttcgaccgcttgcgcgagcatctggattcgctggaatgcgcgcaggacaccggcggcaaccggctgttctatctggcaacgccgcccgccgcgttcgcgccgaccgcgcgcgagctcggccgcaccggcatgatggaggagaacggcgcctggcgacgcctcgtgatcgaaaagccgttcggcaccgatctcgcctcggcacgcgcgctgaacgccgagctcctgaagatcatggacgagcaccagatctaccggatcgatcactatctcggcaaggagacggtgcagaacattttggtgctgcgctttgccaacggcatgttcgagccgatctggaatcgcaaccacatcgaccacatccagatcacggtggaagagaagctcggcgtcggccatcgcggcggcttctacgacgccaccggcgcgctgcgcgacatggtaccgaaccatctgttccagctgatgtcgctggtcgcgatggagccccccgcccgcttcgacgcgcattccgtgcgctccgagaaggccgacgtgctcacctcgatccagcagcccagccgggaagaggcgctgaagaattcagtgcgcgcgcaatatctcgccggccgcatcggcgacgaggagatcacggactatcgcaagaccgaggacgtcaagcccggcagcaccaccgagacctttgtcgcgctcaagctgatgatcgacaattggcgctgggccggcgtccccttctacttgcgcaccggcaaggcgctgggtcacaagcgcaccgaagtcgcgatcaagttcaagcaggcgccgctgtcgatgttttcgggcacggacgtcgaccgcctgtcgcagaacttccttaccatcggcatcgcgccgaccgagaccatcgagcttcagttcaacgccaagattccgggcccgagcatcaccatcgacggcgtcgagatgaagttccgctatggcgactatttccgcgtcgatccctcgaccggctacgagacgctgatctacgactgcatgatcggcgacaacatactgttccagcgcgccgacggcatcgaggccggatggcaggcggtgcagccgttcctggacgcctggaagagcgagggcaccaacggcatcgagacctatgaagccggcagcgacggccccgcctgcgcggacgagctgctccggcgcgacggacgaagctggcggaagttttcgtga

SEQ ID NO: 2555 - protein, 503 aa, Bradyrhizobium japonicum
MTKDPQAKRKPENCAFVIFGVTGDLTHRLVMPSLYNLAAEHLLPEKFCVVGVARKGQSDDELRSSLLKGLRQFATRPVDDDIAQKLLQCLTFVEADPKDSPSFDRLREHLDSLECAQDTGGNRLFYLATPPAAFAPTARELGRTGMMEENGAWRRLVIEKPFGTDLASARALNAELLKIMDEHQIYRIDHYLGKETVQNILVLRFANGMFEPIWNRNHIDHIQITVEEKLGVGHRGGFYDATGALRDMVPNHLFQLMSLVAMEPPARFDAHSVRSEKADVLTSIQQPSREEALKNSVRAQYLAGRIGDEEITDYRKTEDVKPGSTTETFVALKLMIDNWRWAGVPFYLRTGKALGHKRTEVAIKFKQAPLSMFSGTDVDRLSQNFLTIGIAPTETIELQFNAKIPGPSITIDGVEMKFRYGDYFRVDPSTGYETLIYDCMIGDNILFQRADGIEAGWQAVQPFLDAWKSEGTNGIETYEAGSDGPACADELLRRDGRSWRKFS

SEQ ID NO: 2556 - DNA, 1497 bp, Bacteroides thetaiotaomicron
  CDS (1)..(1497)
atggataaatttgcaatgattatttttggtgcttcgggcgacttgactaaacgcaagttgatgcccgcattgtactctctgtatcgggataaacggctgacggggagttttactgttctgggaattgggcgtactgtctattctgatgaagattaccgttcatatatacttggggagttgcagcagtttgtaaaggctgaagagcagaatttggagctgatgtcttcttttgtgtctcatttgtattatttgccgatggatcctgcgaaagtggagggatattcgcagttgcgggagcgtttggtagagcttacgaaggaggtcgatccggataatttgttgttctatctggctactccgccttcgctgtatggggtggtgcctttgcatttgaaggcggccgggctgaatactcctcattctcgtattattgttgagaagccgttcgggtatgatctggagtcggcgcttgagttgaataagatttactcttctgtgtttgatgagcatcagatttatcgtatcgatcattttctgggcaaggagacggcgcagaatgtgcttgctttccgtttcgccaatggtatttttgagccgttatggaatcgtaattatattgattatgtggagattactgctgtagagaatctgggtattgagcagcgcggaggtttttacgagacggcgggggctttgcgggatatggtgcagaatcacctgattcagctcgtagctcttacggctatggagccgccggcggtattcaatgcggataatttccggaatgaggtagtgaaggtttatgagtcgctgactccgcttacggagacggacttgaatgaacatatcgttcgcggacaatatacggcttcgggcaataagaaggggtatcgtgaggaaaagggagtggctcccgactcgcgtacggagacttatattgcgatgaagctgggcatcagtaactggcgttggagcggggtaccgttctacatccgcaccggtaagcagatgccgacgaaggtgacggaaattgtcgttcacttccgcgagacgccccatcagatgttccgctgttccggcggtaactgtccgagggctaataagttgatccttcgtttgcaaccaaacgagggtattgtgttgaagatcggaatgaaggttccgggtgcaggtttcgaagtccgtcaggtgacgatggatttcagttacgcacagttgggcggcgtgccgagcggtgacgcttatgcccgtctgattgacgactgcattcagggagatccgaccttatttactcgaagtgatgctgtagaggcttcctggaacttctttgatccggtcttacgttattggaaagataatccggacgcacctttgtacggctatccggcaggtacgtggggacctctcgaaagtgaagctatgatgcacgagcatggggcagactggaccaatccgtgtaagaatttaacaaatacagaccaatattgcgaactatga

SEQ ID NO: 2557 - protein, 498 aa, Bacteroides thetaiotaomicron
MDKFAMIIFGASGDLTKRKLMPALYSLYRDKRLTGSFTVLGIGRTVYSDEDYRSYILGELQQFVKAEEQNLELMSSFVSHLYYLPMDPAKVEGYSQLRERLVELTKEVDPDNLLFYLATPPSLYGVVPLHLKAAGLNTPHSRIIVEKPFGYDLESALELNKIYSSVFDEHQIYRIDHFLGKETAQNVLAFRFANGIFEPLWNRNYIDYVEITAVENLGIEQRGGFYETAGALRDMVQNHLIQLVALTAMEPPAVFNADNFRNEVVKVYESLTPLTETDLNEHIVRGQYTASGNKKGYREEKGVAPDSRTETYIAMKLGISNWRWSGVPFYIRTGKQMPTKVTEIVVHFRETPHQMFRCSGGNCPRANKLILRLQPNEGIVLKIGMKVPGAGFEVRQVTMDFSYAQLGGVPSGDAYARLIDDCIQGDPTLFTRSDAVEASWNFFDPVLRYWKDNPDAPLYGYPAGTWGPLESEAMMHEHGADWTNPCKNLTNTDQYCEL

SEQ ID NO: 2558 - DNA, 1485 bp, Staphylococcus epidermidis
  CDS (1)..(1485)
atgagtactaaacaaaaacacattccctgtttgattacaatattcggtgccacaggagatttgagtcatagaaagctatttccttctatattccatttatatcaacaagacaatttagatgaacatattgctattattggtataggacgtcgcgattataataacgaacaatttcgcgaccaagttaaaacgtcaattcaaacttatgttaaagatacagatagaattgatgagtttatgacgcatgttttttatcataaaactgacgtgagtgataaagaaagttatcagtcattacttcaatttagtgagcgactagattcagaatttgctttaggtgggaatcgtctgttttacttagcgatggcaccacaattttttggagtgatctcagattaccttaaatcttctggtcttactcaaactacaggatttaaacgcttagttatagagaaaccatttggcagtgatcttaaatctgctgaatcattaaataatcaaataagacgttcgtttaaagaagaagaaatttatcggatagatcactatcttggcaaagatatggtgcaaaatatagaagttttgcgattcgcaaacgcgatgtttgaacctttatggaataataaatacatttcaaatattcaagttacatcatcagaagtattaggtgtcgaagatcgtggtggctactatgaatctagtggtgcacttaaagacatggtacaaaatcacatgctacagatggttgctttacttgcaatggaagcaccgataagtttgaatagtgaagatatacgtgcagaaaaagtcaaagtacttaaatctcttagacaattaaaaccagaagaagttaaaaagaatttcgtgcgtggtcaatatgatcaaggcaatatagatggtaaacaggttaagtcatatcgagaagaagatcgcgtagcaaaggattcggttacaccgacatttgtatcgggtaaattaacaattgataactttagatgggctggagttcctttctacattagaacgggtaaacgtatgaaatcaaaaacgatacaagtcgtagtagaatttaaagaagtacctatgaatttatattatgaaactgacaatttactagattctaatttgctagtcattaatattcaaccaaatgaaggaatttcattgcatttaaatgctaaaaagaacattcaaggaattgatactgagccagtgcaattatcatacgcaatgagtgctcaagataaaatgaatacagttgatgcatatgaaaacttattgtttgattgtcttaaaggtgatgcgactaattttacacattgggaagaattaaaatctacttggaaatttgtagatgcaatccaagatcaatggacaatggttgaaccatgtttccctaactatgaagcgggtacaaatggacctcttgaaagtgatcttttattaagtcgtgatggaaatcattggtgggatgatatccactaa

SEQ ID NO: 2559 - protein, 494 aa, Staphylococcus epidermidis
MSTKQKHIPCLITIFGATGDLSHRKLFPSIFHLYQQDNLDEHIAIIGIGRRDYNNEQFRDQVKTSIQTYVKDTDRIDEFMTHVFYHKTDVSDKESYQSLLQFSERLDSEFALGGNRLFYLAMAPQFFGVISDYLKSSGLTQTTGFKRLVIEKPFGSDLKSAESLNNQIRRSFKEEEIYRIDHYLGKDMVQNIEVLRFANAMFEPLWNNKYISNIQVTSSEVLGVEDRGGYYESSGALKDMVQNHMLQMVALLAMEAPISLNSEDIRAEKVKVLKSLRQLKPEEVKKNFVRGQYDQGNIDGKQVKSYREEDRVAKDSVTPTFVSGKLTIDNFRWAGVPFYIRTGKRMKSKTIQVVVEFKEVPMNLYYETDNLLDSNLLVINIQPNEGISLHLNAKKNIQGIDTEPVQLSYAMSAQDKMNTVDAYENLLFDCLKGDATNFTHWEELKSTWKFVDAIQDQWTMVEPCFPNYEAGTNGPLESDLLLSRDGNHWWDDIH

SEQ ID NO: 2560 - DNA, 1590 bp, Yersinia pestis
  CDS (1)..(1590)
atgaccttttttgacgcatttttatctgggtttactggctatagtcaaagagagtacattagtaatgtaagaaaattacaaatatcctgcaacgaggagaatagcatggcagtaatgaatacagtccaggtagcccaggcgtgtgacctggtgattttcggcgctaaaggtgatttggctcgccggaaactgctgccttctctttaccaattagaaaaagcgggtcatatccacccagatactcggataatcggtgttggccgtgctgagtgggataaagatgcgtacaccgctgtggtaaaggaagccctcgatacctttatgaaagagccgctggatgacgagctatggcaaaaactcagctcgcgcctcgacttctgcaatctggatgtgaatgacagtaagcatttcaccaaattaggtaaaatgctcgatcaaaaacatcgcaccacgattaactactttgctatgccgccgagtacatttggtgcgatttgtaaaggcctgggagaagccgggttaaacaaagagcctagccgagtggtaatggaaaaaccattgggaaccgatttagcgccctcaagggtaattaacgatcaggtagccgagtatttcaacgaatgtcaggtttaccgtattgaccactatttagggaaagaaacggtattaaacctgttggcgcttcgcttcgctaactcgttgttcgcctcaaactgggacaaccgcactatcgatcatgtgcaaattaccgtcgcagaagaggtcggaattgaagggcgttggggctattttgatcaggccggtcagatgcgtgacatgatccaaaaccatctgttgcaaatcctgacgatgatcgccatgtcaccccccgcagatctcagtacggatcgcatccgtgatgaaaaagtaaaagtactgcgttcgctgcgccgtattgatcacaccaatgtgcgcgaaactacagttcgtgggcaatatactgccggctttgtacagggcaataaagtgccgggttatctggaagaggaaggcgcgaataagaatagcaataccgaaacatttgtgtctattcgggtggatatcgatgactggcgttgggctggggtacctttctacctgagaaccggtaagcgcctacccagcaaatgctctgaagttgtggtttactttaagaaccccgcactgaatctcttccgcgaatcttatcaacaactgccacaaaacaaactgacaattcgtttgcaaccggacgaagggatcgaaattgaagtgctgaataaagtccccggattggaacataagcatcgtttacaaaccactaagcttgatctcagtttctccaaaaccttcaatgagcagcatattgctgatgcctatgaacgtctgctactggagaccatgcggggtattcaagcgctgtttgtgcgccgtgatgaggtcgaagaggcgtggaaatgggtcgattctattatgaatgcgtgggcggcagataatgaagcaccaaaaccataccagtccggtacatgggggcctgtggcatccgttgctatgatcacccgtgatggccggtcatggaatgagttcgagtaa

SEQ ID NO: 2561 - protein, 529 aa, Yersinia pestis
MTFFDAFLSGFTGYSQREYISNVRKLQISCNEENSMAVMNTVQVAQACDLVIFGAKGDLARRKLLPSLYQLEKAGHIHPDTRIIGVGRAEWDKDAYTAVVKEALDTFMKEPLDDELWQKLSSRLDFCNLDVNDSKHFTKLGKMLDQKHRTTINYFAMPPSTFGAICKGLGEAGLNKEPSRVVMEKPLGTDLAPSRVINDQVAEYFNECQVYRIDHYLGKETVLNLLALRFANSLFASNWDNRTIDHVQITVAEEVGIEGRWGYFDQAGQMRDMIQNHLLQILTMIAMSPPADLSTDRIRDEKVKVLRSLRRIDHTNVRETTVRGQYTAGFVQGNKVPGYLEEEGANKNSNTETFVSIRVDIDDWRWAGVPFYLRTGKRLPSKCSEVVVYFKNPALNLFRESYQQLPQNKLTIRLQPDEGIEIEVLNKVPGLEHKHRLQTTKLDLSFSKTFNEQHIADAYERLLLETMRGIQALFVRRDEVEEAWKWVDSIMNAWAADNEAPKPYQSGTWGPVASVAMITRDGRSWNEFE

SEQ ID NO: 2562 - DNA, 1506 bp, Vibrio vulnificus
  CDS (1)..(1506)
atgatggtaataccagaaaacagcagcatcgtaatttttggtgcttcaggtgatttaacatatcgcaagttgatccctgctttataccacctctacgcaagtaagcagctaccagaaaactttgctattttaggtgtcagccgcactgaatacagcgatgaatcttatcgcgaaaagttaaagcgctctcttcaggaaatggagaaaacggaaccagctattctggattcatttatcgaccatcttcactatcaagccatcaacacgtcagacacaaaagactacgcgaagttggttgtacgtttagatgaattggccgctcaataccagttcgaacaacgtaatacactgttttatctggccacaccgccaagcctttacagtgttattcctgcaagccttgctcatcacggtctcaatagtgaagaggatggttggaagcgcctgatcattgaaaaaccgtttggttatgatttggcttcggcacgtcagctcgacaaagaaatacacgattgcttccaagagcatcagatctatcgcatcgaccactaccttggaaaagagaccgtacaaaacttacttgttttccgtttctctaacgccatgtttgaacctctgtggaaccgcaacttcattgattatgtggaaatcacaggtgccgaattccttggtgtggaagagcgcggtggttattacgacggctccggcgctgtgcgcgatatgttccaaaaccacctactgcaagtgttggcgatggtgggcatggagccgccagcacaaattaacgccgattccatgcgtgatgaagtagtgaaagttctgcagtgtttaaaaccgcttgaggaagatgatctgcgtaacaacctagttttgggtcaatacaccgcatcagacgtgcgcggacaacatctgcttggctaccgtgaagaaaacggcgtagcggacgattctcgtaccgagacttacattggtcttaaagcgtacatcaataactggcgttggaatggcgtaccattctacgtgcgcacgggtaagcgtcttccaactcgcgtgacagaagtggttatccacttcaaacaaacaccgcatccggtatttggccaaaacgctccagaaaacaaactgatcattcgtattcagcctgatgaaggcattcaaatgagcttcggtttgaaagaacccggtgcaggctttaaagccaaagaagtgaagatgaacttccattatgcttcgttgcaagagacgcaaatgctgaccgcctatgagcgtctgcttcttgatgcgttaaacggcgacgcaacgctgtttgctcgcagcgatgcggtcgaagcgtgttggaaatacgttcaacctatcctcgatttcaaacaagatccacaagcactctttggttatgcttgcggtacttgggggccaaaagagtcggacgatttgctgcagcgtgatgatcgcgcgtggcgtttcccatgcaaaaacctaacagatacggactactgcgaactatga

SEQ ID NO: 2563 - protein, 501 aa, Vibrio vulnificus
MMVIPENSSIVIFGASGDLTYRKLIPALYHLYASKQLPENFAILGVSRTEYSDESYREKLKRSLQEMEKTEPAILDSFIDHLHYQAINTSDTKDYAKLVVRLDELAAQYQFEQRNTLFYLATPPSLYSVIPASLAHHGLNSEEDGWKRLIIEKPFGYDLASARQLDKEIHDCFQEHQIYRIDHYLGKETVQNLLVFRFSNAMFEPLWNRNFIDYVEITGAEFLGVEERGGYYDGSGAVRDMFQNHLLQVLAMVGMEPPAQINADSMRDEVVKVLQCLKPLEEDDLRNNLVLGQYTASDVRGQHLLGYREENGVADDSRTETYIGLKAYINNWRWNGVPFYVRTGKRLPTRVTEVVIHFKQTPHPVFGQNAPENKLIIRIQPDEGIQMSFGLKEPGAGFKAKEVKMNFHYASLQETQMLTAYERLLLDALNGDATLFARSDAVEACWKYVQPILDFKQDPQALFGYACGTWGPKESDDLLQRDDRAWRFPCKNLTDTDYCEL

SEQ ID NO: 2564 - DNA, 1530 bp, Synechococcus elongatus
  CDS (1)..(1530)
atggtaaccctatttgaaaatcccctgcgggttggactacgccaagagcgaaccccagagccgctgattttagtcatttttggtgccagtggcgaccttactcagcgcaagctgattccctcgatttatcaactgagactcgaacgccgtctgccccccgaactgaccattgttggcgtggcgcggcgcaactggagtcatgactattttcgcaagcacctccgtcaaggggtcgaggagtttggtggcggcattcaggcggaacccctgtggcaggaatttgcccaaggtttgttttattgctctggcaatatcgatgatcccgccgcctacacccagctgaaaacactgctagctgagctagatgaaaaacgccaaactcgcagcaatcgcgtcttttaccttgcggtctcaccgagctttttcgttgaggccattcagcaactgggggcagcggggctattgagtgatccccaaaaacatcgtcttgtgattgaaaagccctttggccgtgatctcacctctgcccaagccctcaatgaggtggtgcagtcggtgtgcaaggaggagcaagtttaccgcattgaccactacctcggtaaagagacggtgcaaaacctgatggtgtttcgctttgccaatgccatttttgaacccctctggaaccgccagtacgtggatcatgtgcagattactgttgctgaaaccgtcggggtggaagatcgcgcgggctactatgaaactgcgggtgccctgcgggacatggtgcaaaaccacattctccagttgctggctctgaccgcgatggaaccccccaatgccctcgatgccgatagtctgcgtagcgaaaaggtgaaagtcctccaagctacccgtttagcggatcttgataatctcgatgcctgtgctgtccgcggccaataccgagccggctggatgaagggcaaacctgttgtgggctatcgtcaggagccgggggtgagtcctacctccaccactcccacctatgcggccctaaaactagggattgataactggcggtggcagggggtgcccttctatgtgcgcacgggtaaacgcttggcaaaaaaggtcacagaaatctcaattcagtttcgtggggtgcctttactgattttccagtcggccgcccgccaaaccaatcccaatatcctgacgatgcgcattcaacccaatgaagggattgctctgcgctttgaggcaaaaatgccgggtgcagatctgcgcacacgcacggtggaaatggactttagctacggctcctcctttggaatggccacagcggatgcctatgcgcggttattactggactgcatgttgggggaccaaaccctgtttacgcgcgcagatgaggtagaggcggcttggcgggtggtgatgccggttttaacggcttgggacgcccccacagatccagaggccatacccacctatgacgcggggacttgggggcccgatgcggcagaagtgatgattaatgccgatggccggcgctggcggcgactttga

SEQ ID NO: 2565 - protein, 509 aa, Synechococcus elongatus
MVTLFENPLRVGLRQERTPEPLILVIFGASGDLTQRKLIPSIYQLRLERRLPPELTIVGVARRNWSHDYFRKHLRQGVEEFGGGIQAEPLWQEFAQGLFYCSGNIDDPAAYTQLKTLLAELDEKRQTRSNRVFYLAVSPSFFVEAIQQLGAAGLLSDPQKHRLVIEKPFGRDLTSAQALNEVVQSVCKEEQVYRIDHYLGKETVQNLMVFRFANAIFEPLWNRQYVDHVQITVAETVGVEDRAGYYETAGALRDMVQNHILQLLALTAMEPPNALDADSLRSEKVKVLQATRLADLDNLDACAVRGQYRAGWMKGKPVVGYRQEPGVSPTSTTPTYAALKLGIDNWRWQGVPFYVRTGKRLAKKVTEISIQFRGVPLLIFQSAARQTNPNILTMRIQPNEGIALRFEAKMPGADLRTRTVEMDFSYGSSFGMATADAYARLLLDCMLGDQTLFTRADEVEAAWRVVMPVLTAWDAPTDPEAIPTYDAGTWGPDAAEVMINADGRRWRRL

SEQ ID NO: 2566 - DNA, 1473 bp, Shewanella oneidensis
  CDS (1)..(1473)
atgggcaaaacaacatcaggcgccaaagcttgtgacttcgtactctttggtactaaaggtgacttagcaagacgtaagttattaccttctttataccagttagataaggctgagcttctcgataaagatactaaggtgataggtgtcgcaaaagatgaattcagtcaggatgaatacagagacttagtcatccttgcgttaaaaaccttcgtcaaagaacccctctgcgaagacactctcaaccgattcgtgtcccgttgttattatgtaggcactaattttaccgaatcagcaggctacggtgccttccatgaattgctcaaaccagaagagcgtgtcatggtcagttactttgccacccctccatcgatttttggtgatatctgccgctgtttacatgaacaaaacctgatccacagtgactctcgcgtagtactcgaaaaacccattggctctgatctcgcatcttcccgtattattaacgatcaagtgtctgcctactttaaagaaagccaagtctaccgtatcgaccattatcttggtaaagagaccgttcaaaacttgattgcgctgcgttttgctaactccttatttgcctctaaatgggataaccggaccattgaccatgtccagatcacggttgcggaagaagtcggtattgaaggccgttggggttacttcgataaagccggtcaaatgcgcgatatgatccaaaaccacttgctacaggtgctgacgctcgtcgcaatggatccgccagtgaacttagatgctgatagtattcgcgatgaaaaggtgaaagtgcttaagtcgctgcggccgattaatgctgacaatgtgtatgaaaacactgtccgtggtcagtacagtgcgggcttcctgaaaggtagtccggtgccaggctatttagaggaagagggcgcgaacgtacagtcacacaccgaaacttttgtggcgttgcgggtcgatatcgataactggcgttgggctggggtgccgttttatctgcgcagcggtaagcgcatgccgtttaagagttctgaaattgtggtgtattttaaaaatcctccgcacaacctttaccgctctagctaccgtaacttgccacctaacaagttaaccatccgtctgcaaccacacgaaggggttgagatccagatgatgaacaaggtgccaggattagagcaaaaacaacgtttgcaaaccactaagctcgacttgagtttctcggatacctttaaaaacgagcgcattgccgatgcctacgagcgtttgttgcttgaagccatgctcggtaatcaagctttgttcgtgcgccgagatgaagtggagcaagcctggacatgggtggatggcatcatccaagcatgggaacagagcaatgagaaaccgaaaccttatcctgcgggcacttggggccctgtggcttcggtcgcgctgatcaccaaagatggtcgctcgtgggatgaatag

SEQ ID NO: 2567 - protein, 490 aa, Shewanella oneidensis
MGKTTSGAKACDFVLFGTKGDLARRKLLPSLYQLDKAELLDKDTKVIGVAKDEFSQDEYRDLVILALKTFVKEPLCEDTLNRFVSRCYYVGTNFTESAGYGAFHELLKPEERVMVSYFATPPSIFGDICRCLHEQNLIHSDSRVVLEKPIGSDLASSRIINDQVSAYFKESQVYRIDHYLGKETVQNLIALRFANSLFASKWDNRTIDHVQITVAEEVGIEGRWGYFDKAGQMRDMIQNHLLQVLTLVAMDPPVNLDADSIRDEKVKVLKSLRPINADNVYENTVRGQYSAGFLKGSPVPGYLEEEGANVQSHTETFVALRVDIDNWRWAGVPFYLRSGKRMPFKSSEIVVYFKNPPHNLYRSSYRNLPPNKLTIRLQPHEGVEIQMMNKVPGLEQKQRLQTTKLDLSFSDTFKNERIADAYERLLLEAMLGNQALFVRRDEVEQAWTWVDGIIQAWEQSNEKPKPYPAGTWGPVASVALITKDGRSWDE

SEQ ID NO: 2568 - DNA, 1476 bp, Oceanobacillus iheyensis
  CDS (1)..(1476)
atggaacaaactatacagccaagagccgttattgtaatcttcggagcaactggagatttagcaaagcgtaaattattcccttccatttatcgtttgtaccgaagcggaaaattagatgagcattttgcagtaattggtttagcacgtcgtccttggacagatgaagtacttagagaaaatgtggaaaattccatacaagatgctctttctccggatgaggatttatccgaatttatttcccatttctattataaatcttttgatgtgacggaaaaagaatcgtatcaaggacttaatgaaatcattcaaaaccttgaaggtcaataccaaacagaaggaaatagactattttatctggcaatggctccagatttctttggtgctattgcaaatcaactcaatgattatggattaaagaacacgagtggttggactagacttgtgatcgaaaaaccatttggacatgatttaccttctgctaaaaagttaaaccatgaattacaagccgcatttcgtgaagatcaaatttatcgtatcgaccactatctaggtaaagagatggtgcaaaatattgaagtaatccgttttgccaacggtatttttgaacatttgtggaataatcgctttatctcaaacatccaaattacgagtagcgaaacgcttggagtagaggaacgagcacgttattatgacacttctggtgctacgcgggatatggttcaaaatcatatgttacaaatggttgctctactggcgatggaacctccgattagtttaacaacagaggaagtacgctctgaaaaaattaaagtattgcgtgccttaagaatgatggagacaaatgaaatagatgattatttcattcgcggtcaatacggtgctggtacagttaaaggtaattctgttattggttatcaagacgaagatgaacaactagaaaattctcgtactgaaacatttgtagctggaaaacttctcattgacaattaccgatgggcaggcgttcctttctatattcgtacaggaaagcgcatgacagaaaaatccacaaaaattgtaattgagttcaaagacattccaatgaatctttattaccaaaaagatgatcaaaggaatccaaatttattggttattaatattcaaccaaatgaaggaattacgctttgcttgaatgcacgtaaatcaggtgaaggtgcactagcagagccaattcaattagcataccaccaaaatgctgtatctggaatcaatacaccagaagcatatgaaaaactaatttacgatagtatgcttggtgatgcgactaactttacccattgggatgaagttgctttatcttggcaatttgtcgataagattttggaaaactggtcagaaaatcaaccagcattccctaattatcgttctggatcgatgggaccagaagcatctgatgaactgttgaaaaaagatggtttccattggtggccaatctaa

SEQ ID NO: 2569 - protein, 491 aa, Oceanobacillus iheyensis
MEQTIQPRAVIVIFGATGDLAKRKLFPSIYRLYRSGKLDEHFAVIGLARRPWTDEVLRENVENSIQDALSPDEDLSEFISHFYYKSFDVTEKESYQGLNEIIQNLEGQYQTEGNRLFYLAMAPDFFGAIANQLNDYGLKNTSGWTRLVIEKPFGHDLPSAKKLNHELQAAFREDQIYRIDHYLGKEMVQNIEVIRFANGIFEHLWNNRFISNIQITSSETLGVEERARYYDTSGATRDMVQNHMLQMVALLAMEPPISLTTEEVRSEKIKVLRALRMMETNEIDDYFIRGQYGAGTVKGNSVIGYQDEDEQLENSRTETFVAGKLLIDNYRWAGVPFYIRTGKRMTEKSTKIVIEFKDIPMNLYYQKDDQRNPNLLVINIQPNEGITLCLNARKSGEGALAEPIQLAYHQNAVSGINTPEAYEKLIYDSMLGDATNFTHWDEVALSWQFVDKILENWSENQPAFPNYRSGSMGPEASDELLKKDGFHWWPI

SEQ ID NO: 2570 - DNA, 1344 bp, Corynebacterium efficiens
  CDS (1)..(1344)
atgactcccacaggacacgaccaccggcagaccgtgacgttctacatcctcggcggcgcgggagatctcgtgcgtcgtctgctcatccccggtatggcggggtacctccgggagtatgagggcacccggatcaacatcgtcgccacggggcgttcggagatcgacgactacccgcagctggtgcgcgattccctcgccgcagccggcacagacatcgatgaccgggtggtcgacagcctggccgggcatgcctctttcctggcgtcggatgccactgatccggccgagctgcaggagctgctcgattcccgggaacccggtgaccgcccggtgctctacttcgcgctctcgccttccgtgaccgcgcaggccgtcgatgccctggcgggggtcaccctgcccgagggcatcgtgcttgccctggaaaaacccttcggcgaggacgcggacaccgcccgcgagctcaacgagaaattgtggaaaatcaccgatgaggagcacatcttccgcgtcgaccacttcaactgcgagaccgccctgtcgaacctggtcggactgatgggcgcgaatgcgatcctctccgccgggtggaataacagggcagtcgagagcattgagatcgtctatgacgaatccctcggcctggagggacgcgccgagttctacgacagcaatggggctgtgcgcgacatgctccaatcccacctgctgcaggtcatggcacacgccctggctgccgacaccgatgacacggtcaccgacattctcgccgccacggacatcgatccgggttccgtccgtcgcgcccggtacaccgcaggcgaggcgggtggcgaacagctgccggactacgcacaggaggagggcgtggatccggagcgggggaccgagacgctcttccagctcaccgcgcacgtggacaccgaccgctggcgtggcgtgcccatcaccctgcgttccggcaaggcactggggaaaccgcgcagggagatcgccatctcctaccggcgcgagggctaccccgaggaggtcgagctgcagccgggcagccgtctggtcttccccttcaccgatgaggtggtgctcgaggcgaatgtctccgaccatggttacagccacaacctgcagcgcgttgaactgcgcaccgaactggtgccctcgaagctgtcggcctacggccgggtggtgcgtgccatcctcgacatgagcgacaccgccgaggtgcccgccgacgccccggcccgggcctgggagatcgtggagcccgtgctcaccgcgttcgccaacgacgaggtcccgctggaggagtacccggcggggtcagcgggacctgcgggctggtag

SEQ ID NO: 2571 - protein, 447 aa, Corynebacterium efficiens
MTPTGHDHRQTVTFYILGGAGDLVRRLLIPGMAGYLREYEGTRINIVATGRSEIDDYPQLVRDSLAAAGTDIDDRVVDSLAGHASFLASDATDPAELQELLDSREPGDRPVLYFALSPSVTAQAVDALAGVTLPEGIVLALEKPFGEDADTARELNEKLWKITDEEHIFRVDHFNCETALSNLVGLMGANAILSAGWNNRAVESIEIVYDESLGLEGRAEFYDSNGAVRDMLQSHLLQVMAHALAADTDDTVTDILAATDIDPGSVRRARYTAGEAGGEQLPDYAQEEGVDPERGTETLFQLTAHVDTDRWRGVPITLRSGKALGKPRREIAISYRREGYPEEVELQPGSRLVFPFTDEVVLEANVSDHGYSHNLQRVELRTELVPSKLSAYGRVVRAILDMSDTAEVPADAPARAWEIVEPVLTAFANDEVPLEEYPAGSAGPAGW

SEQ ID NO: 2572 - DNA, 1545 bp, Corynebacterium efficiens
  CDS (1)..(1545)
atgagctcccacacgaatcccaccacctggattaatcccctgcgtgatccccaggacaaacgactgccccgcatcgcgggaccgtccggcctggtcatcttcggtgtcaccggtgacctcgcccgcaagaagctcctccccgcgatctatgatctggccaaccgtggtctgctccccccgggtttcgccctggtgggttacggacgccgtgactggagcaaggaggacttcgagaactacgtgcgcgaggccgtggaggccggcgcccgtaccgaattccgcggaaacgtgtgggaacgcctcgccgagggcatggaatttgtcaagggcaacttcgacgacgattccgccttcgacaatctcgcggacacgcttaagcgtctcgacgagaccaggggcaccgccggcaactgggccttctacctatccatcccgccggattccttcgcggcggtctgccaccagttggagcgctcaggtatggcggcatccacagacgaatcctggcgacgggtgatcatcgagaagcccttcggcaatgatctcaagaccgcgcatgaactcaatgagacggtcaacgctgtcttccccgaggaatcggtcttccgcatcgaccattacctgggcaaggaaaccgtccagaacattctggccctgcgtttcgccaaccagctgttcgagccgttgtggaactccaattatgtcgatcatgtgcagatcaccatggcggaggacatcggattggggggacgcgccggttattatgacggcatcggtgccgcccgtgatgtcatccagaaccacctgatccagctgctggccctggtggccatggaggagcccatctccttcacccccacccagctgcaggcagagaagatcaaggtgcttcgtgccaccaagccgagcctgccgatcgcggagaactccgcgcgtggccagtattccgccggctggcaggggtctgaatatgtcaagggtctgcgggaggaggatggtttcgatccggaatccaccaccgagacctatgccgcctgcaccctggagatcacctcccgcaggtgggcgggtgtgccgttctacctgcgcaccggcaaacgcctgggtcgtcgtgtcaccgagatcgccgtggtgttcaaggatgccccccaccagcccttcgatcccggcatgaccgcggcactcggtaacaacgccatcgtgatccgtgtgcagcccgacgagggtgtgctcatccgtttcggatccaaggtgcccggatctgccatggaggtccgtgatgtgaatatggacttctcctattccgagtccttcaccgaggaatcccccgaggcgtatgagcgtctcatcctggatgcgcttctcgatgagtccagcctcttccccaccaatgaggaagtggaactgagctggaagatcctggatccgatcctggagatctgggaggagaatggccaaccggaggagtatcccgccggcacatggggaccgaagagcgccgatgagatgctggcacgcaacggccaccagtggcgcaggccgtag

SEQ ID NO: 2573 - protein, 514 aa, Corynebacterium efficiens
MSSHTNPTTWINPLRDPQDKRLPRIAGPSGLVIFGVTGDLARKKLLPAIYDLANRGLLPPGFALVGYGRRDWSKEDFENYVREAVEAGARTEFRGNVWERLAEGMEFVKGNFDDDSAFDNLADTLKRLDETRGTAGNWAFYLSIPPDSFAAVCHQLERSGMAASTDESWRRVIIEKPFGNDLKTAHELNETVNAVFPEESVFRIDHYLGKETVQNILALRFANQLFEPLWNSNYVDHVQITMAEDIGLGGRAGYYDGIGAARDVIQNHLIQLLALVAMEEPISFTPTQLQAEKIKVLRATKPSLPIAENSARGQYSAGWQGSEYVKGLREEDGFDPESTTETYAACTLEITSRRWAGVPFYLRTGKRLGRRVTEIAVVFKDAPHQPFDPGMTAALGNNAIVIRVQPDEGVLIRFGSKVPGSAMEVRDVNMDFSYSESFTEESPEAYERLILDALLDESSLFPTNEEVELSWKILDPILEIWEENGQPEEYPAGTWGPKSADEMLARNGHQWRRP

SEQ ID NO: 2574 - DNA, 1668 bp, Bifidobacterium longum
  CDS (1)..(1668)
atgcgtacacgtttgcgtacgcgattggcccaacgcacggcacagcacacgcaatgtggcccaaatcgcagcccaaatcgcatatcgcctctagcgatagatagccgccggcgactacccttgtacattatgagtgaatcccccaattggagcaatcccctgcgcgactcgcgcgacctcagactgccccgtatcgccggcccatgcagcctcgtcattttcggtgtcacgggcgatctggcacaaaagaaactgctgccagccgtctacgacctggcgaaccgtggcctactgccgccgagcttcggtctgaccggcttcgcccgccgcgactggacacaggaacggttcatcgaattcgtcaaggccgccgtccaggcgcattgccgtacgccgttcaaggagtcgacttggcgcaatctggccgccggcatccgcttcgtgcagggtacgttcgacgacccggaggccttcgagcgcctgagcgccaccgtgcaggagcttgaccgcgaccgcggcacgcagggtaaccatgccttctacatgtcggtgccgccgcgcgcattcccacaggtcgccaagcagctggccgcctccggcctgtcgcgctcgtccgagggcgcatggcgccgcgtgatcatcgagaagccgttcggccatgatctggccagcgccaaggaactcgacagcgtggtatccgaagtgttcgacccgagctccgtgttccgcatcgaccactacctcggcaaggaaaccgtgcagaacctgctggccctgcgtttcgccaacgccatgtacgagccgatctggaacgccaactatgtggaccacgtgcagatcacgatggccgaggacatcggcatcggcggccgcgccggctattacgacggcatcggcgccgcacgcgacgtcatccagaaccacctgcttcagctcatggctctgaccgccatggaggagccggtgagcttcaccgccaaggacctgaccgccgaaaagaccaaggtgctttccgccgtgcgcctgcccaaggacctcgccgccaacaccgcgcgcggccagtacgccaagggctggcagggctcgcacgaagtggtcggctacttggaggaaaaaggcatcgaccccaagagcaccactgaaacgtacgccgccatccgcctcgatatcgacacccgccgctgggctggcgtgccgttctacctgcgttgcggcaagcgcctcggcaagcgtgtaaccgaaatcgccgtggtgttcaagcgcgccccgcatctgccgttcgagcagaccgccgtgcgcgaactcggcaagaacgccatcgtgattcgcgtgcagcccgacgagggcgtcaccatgcgcttcggagccaaggtgccgggcggctccaccatggaggtccgtgacgtgaacatggacttcagctacggccgctccttcaccgagaactcgccggaagcctatgagcgactgattctggacgtgctgctcggtgatccgccgttgttcccgaccaccgaagaggtgaacctcagctgggagatcctcgatccgattgaacaattctggtccacgcttggccagccgcaggcctaccgcgccggtacgtggggtccggcacaggccgacgaaatgctggcgcgcgacggccgccactggaggatgccatga

SEQ ID NO: 2575 - protein, 555 aa, Bifidobacterium longum
MRTRLRTRLAQRTAQHTQCGPNRSPNRISPLAIDSRRRLPLYIMSESPNWSNPLRDSRDLRLPRIAGPCSLVIFGVTGDLAQKKLLPAVYDLANRGLLPPSFGLTGFARRDWTQERFIEFVKAAVQAHCRTPFKESTWRNLAAGIRFVQGTFDDPEAFERLSATVQELDRDRGTQGNHAFYMSVPPRAFPQVAKQLAASGLSRSSEGAWRRVIIEKPFGHDLASAKELDSVVSEVFDPSSVFRIDHYLGKETVQNLLALRFANAMYEPIWNANYVDHVQITMAEDIGIGGRAGYYDGIGAARDVIQNHLLQLMALTAMEEPVSFTAKDLTAEKTKVLSAVRLPKDLAANTARGQYAKGWQGSHEVVGYLEEKGIDPKSTTETYAAIRLDIDTRRWAGVPFYLRCGKRLGKRVTEIAVVFKRAPHLPFEQTAVRELGKNAIVIRVQPDEGVTMRFGAKVPGGSTMEVRDVNMDFSYGRSFTENSPEAYERLILDVLLGDPPLFPTTEEVNLSWEILDPIEQFWSTLGQPQAYRAGTWGPAQADEMLARDGRHWRMP

SEQ ID NO: 2576 - DNA, 1284 bp, Rhodococcus opacus
  CDS (1)..(1284)
atgattgccggcgcacgcacttccttccggatcgacacatggaaccagctggcacgcaacttccgctatatacgaggcacatttgacgaccaatcggcctttgaggacctgaaacgcgtactagcacaattggatacgattcactccgccataggtcacgccttctacatgtcgatctccccggcgcacttttccctggtgtgcgctcagctgaactccgtgggtctcaaccaggatcgccacggataccggcgcatcgtgctggagaagccattcggcaacgacctggccagttcacgggagttgggcgccacggtggacgaggtgttcggggccggatcggtgttccgggtcgaccactatctcggcaaagagacggtccagaacatcctggcgctgcgattcgccaacgggctgttcgagccgctgtggaaccaccgccacatcgacaacatacagatcaccatggccgaggacatcggcgtcgaggggcgagccggctactacgacggtgtcggcgctgcccgagacgtcatacagaatcatttgctgcagttgttggccctcattgccatggaggagccagttggtgtcgacgcagcaagtctgtcggcggagaaggtgaaagttctctctgccacatcagcagtgagtccgctggccgacaccaccgcgcgtggtcagtactcggctaccgtccggggtgagacctacctgccggggctgctcgaggaggacggattcgatccttgctcgaccaccgagacgtacgcggccatcaccgtgcagatagcgaatcgccgctgggccggggttccgttctatctccgcgcgggtaagcgtctggccagaaggaccacggaagttgctgtgactttctcctcgccgcaccatttgaccggttccgccgaggccggcccacctccccagaatgtcttggtggtgcgagtgcagcccgacgacggaatctcgttgaggatcggagcgaagacacccggggaggggatgcgaatccaggatgtggatctgaacatgtcgttcgctgactcgttcggcgggtcctcacccgaggcctacgagcgcctgatcctcgatgtccttcgcggcgacgcctcactgttcccatcgcaggccgaggtcgacgcgtcgtgggcgattgtcgatccggtcatcgctttctgggccgagcagggccgccccgacacataccaatccggcagcgccggaccgagttcggccattcccgtcgtcactcgtacaggacgggcatggcggccgttgtga

SEQ ID NO: 2577 - protein, 427 aa, Rhodococcus opacus
MIAGARTSFRIDTWNQLARNFRYIRGTFDDQSAFEDLKRVLAQLDTIHSAIGHAFYMSISPAHFSLVCAQLNSVGLNQDRHGYRRIVLEKPFGNDLASSRELGATVDEVFGAGSVFRVDHYLGKETVQNILALRFANGLFEPLWNHRHIDNIQITMAEDIGVEGRAGYYDGVGAARDVIQNHLLQLLALIAMEEPVGVDAASLSAEKVKVLSATSAVSPLADTTARGQYSATVRGETYLPGLLEEDGFDPCSTTETYAAITVQIANRRWAGVPFYLRAGKRLARRTTEVAVTFSSPHHLTGSAEAGPPPQNVLVVRVQPDDGISLRIGAKTPGEGMRIQDVDLNMSFADSFGGSSPEAYERLILDVLRGDASLFPSQAEVDASWAIVDPVIAFWAEQGRPDTYQSGSAGPSSAIPVVTRTGRAWRPL

SEQ ID NO: 2578 - DNA, 2358 bp, Solanum tuberosum
  CDS (160)..(1905)
ctccacttggcggaagaaactaatgtttatttagcaaaggcgaaacaccctttcggagatctcaagagactaatcccaactccttttacgccataaccccccattcatatttcattcccctcacttctatcgaacccatcttctctgatttatcaagatatggtaaccctttattcttccccttccactaactgttctggggctttttcatcttactccaattcttctattggcttctacaattatcacaacaacttccctatttcatccagaaagtttggttctcacaagatttctttgcaaattaatgccattcgcatgcaagatggtgctgttgtggctcaacctagcaaaacccaagatgaaactcctttgaagaaattaaaagatggaattttgtcaaaggagcagaaacatacatttgattttgatagcaacaaagataaatcaactgtcagtattactgttgttggtgcttcaggagatcttgccaaaaaaaagatatttcctgcactttttgcactttattatgagggttgcttaccggagcatttcactatttttggttatgcccggagtaagatgactgatgatgaactcaggaacatggtcagcaagacacttacttgcaggattgataagagggaaaattgtggtgaaaagatggaacagtttctagaaaggtgtttctaccatagtggacaatatgattcccaagaaaactttgcagagcttgataaaaaactgaaagaacatgaggctggaaggttttccaatcgtctgttttacttgtccattccaccaaatatttttataaatgctgtacgatgtgcaagccttgcgtcatctgctcatggatggactagagtcattgtagagaaaccctttggtcgggattctgaatcctctgctgcattaacaggagcacttaagcagtacttgaaggaagatcaaattttcaggattgatcactatttagggaaggagcttgtggaaaacctttctgtccttcgtttctccaacttgatatttgaacccttatggtcaaggcagtatataaggaacgtgcaatttattttctctgaagattttggcactgaaggaaggggaggttattttgatcattatgggataattagagacattatgcaaaaccatttgcttcaaattcttgccctctttgccatggaaacacctgtcagtttggatgcagaagatatcaggaatgaaaaggtaaaagttctgcgttctatgagacctttacaactagatgatgttattgtcgggcagtacaaaagtcacacaaaagggggtgttaactatcctggttataccgacgacaagactgtacccaaggacagtctaaccccaacttttgctgcagctgctcttttcatagataatgcaagatgggatggtgtgcctttccttatgaaggctggaaaagctttacataccaggagtgcggaaataagagtacaattcaggcacgtgccaggaaacttatacaataagaactttggctcggatctagatcaggcaacaaacgagcttgttatccgtgttcaacctgacgaagctatatacctaaagatcaataacaaagttcccggtttaggaatgagattggatcgcagtaatcttaatctgctttactcagcaagatactcaaaggagatccctgatgcatatgagcggctacttcttgatgccatagaaggtgaacgtaggctttttatccgtagtgatgaactggatgctgcttggtctcttttcacaccagtgttgaaagaccttgagcataagaaaatagtaccggaaagctacccctatggaagtcgaggacctattggagcacattaccttgcagcacgatataaagtaagatggggtgatcttgcttagacaaagtaatttgctattgctatgagaaaccatatgtagccttacaagttcttctgcttagtatggtgcaaccaaatttgttgttgggattccagtatcaagactaacaaagcttgaagttgcttactgtcaaggcagatgacaatagagaacacaagttagtgaaacaaaagaagaggagaatctgggtttattttgttattcaaataaatcttttctattgcaccaatgcatatccagtggtagcatcttttttcatgtagcatttagtataccttgttagaatctaataattcgaaaagtcatcgtcttcttatcaagtattcatacatgcagctttctggttccgaactatattaaattttattgcatgaaatgtactatgaaatagaaggtttgttgccttcaatatttcttcaaaaaaaaaaaaaaaaaaaaaaaaaaaaaaaaaaa

SEQ ID NO: 2579 - protein, 581 aa, Solanum tuberosum
MVTLYSSPSTNCSGAFSSYSNSSIGFYNYHNNFPISSRKFGSHKISLQINAIRMQDGAVVAQPSKTQDETPLKKLKDGILSKEQKHTFDFDSNKDKSTVSITVVGASGDLAKKKIFPALFALYYEGCLPEHFTIFGYARSKMTDDELRNMVSKTLTCRIDKRENCGEKMEQFLERCFYHSGQYDSQENFAELDKKLKEHEAGRFSNRLFYLSIPPNIFINAVRCASLASSAHGWTRVIVEKPFGRDSESSAALTGALKQYLKEDQIFRIDHYLGKELVENLSVLRFSNLIFEPLWSRQYIRNVQFIFSEDFGTEGRGGYFDHYGIIRDIMQNHLLQILALFAMETPVSLDAEDIRNEKVKVLRSMRPLQLDDVIVGQYKSHTKGGVNYPGYTDDKTVPKDSLTPTFAAAALFIDNARWDGVPFLMKAGKALHTRSAEIRVQFRHVPGNLYNKNFGSDLDQATNELVIRVQPDEAIYLKINNKVPGLGMRLDRSNLNLLYSARYSKEIPDAYERLLLDAIEGERRLFIRSDELDAAWSLFTPVLKDLEHKKIVPESYPYGSRGPIGAHYLAARYKVRWGDLA

SEQ ID NO: 2580 - DNA, 2879 bp, Leishmania guyanensis
  CDS (205)..(1893): n means a or g or c or t/u
cgctatataagtatcagtttctgtactttattgcaacgcagcagaaagcgaataacaacagcaagaacacacaaaaacgcacgacttgagagataaaagtcggttatcctattcgggtcctcctatacaaccgtcttaatggtgttttaggtttgactctgggcaccctacattgatcactggtacatgcattaagtactcgccatgtcgtcggagcattccagtgctgatcagaattcctatgaggctgacgtgtgctgcattctggacgagctccgcgcacaggtgctggcgcagaagccggacaacgtgttgcagttcatctccaagtcagcgcttaatcttcagaaacagcgccagatggaagcgtgtgatcaaatcaccttcaaggtgaaggatgagcagaagaaccgtgcgttgaccatcattgtgatcggcgccagcggcgatctggccaagaagaagacattcccggccctctttcagctctactgcgacggattcctccccccggaagtcaacattgtcggctatgctcgcaccaaggtggatgatgtcgagaagtggaagcgtgagacgctcatgaagtactttttgaacctgtcggcgcttcgatgtcacgccgaagacttcttgaaacacattagctacttctcgggagcgtacgacaacgtggacgacttcaagcgtctcgacaagatgatccgcgagaaggaggatgctttcaagggccctgagaagggtggcgaccgtctcttttaccttgctctccccccatcagtgtttgcatgcgtctgtgggagcattcgcaagggtgccatgccgcaggaggtaggaggatgggtgcggctgatcatagagaagccctttggccacgacaccaacagttccgccgagctgtcccacgcgctggagccgttcttcgacgagtcgcagctgtaccgcattgaccactatctcgggaaggagatggtacagaacatcatcacgacacgcttcgccaaccgcatcttcagctctttgtggaactcgagcaatatcgcttgcgtgcagatcacgttcaaggagacgatcggcaccgagggccgtggcggctacttcgatagcattggcattattcgtgacgtcatgcaaaaccatctcacccagattcttgccctgctagccatggagaagccraagtcactcgaagccgagtgcatccgcgacgagaaggtgtcgttgctgaagtgtgttgagcccgtcaccaaggagaattgcgtgctgggccagtacactgcctccgccgacggttccatcccaggttacctggaggacgagaccgtacccaagggcagtacttgccccacgtttgccgtggtgcggctcaacatcaacaacgaccgctggtcgggagtcccttttattctcaaggctggcaaggccgtggagcagaagtacgtggcgattcgcgttcagttccacgatgaggttcacccgtacggcgatgcaacaaagcgtaacgagcttgtcattcgtgcccagccgtccgaggccatgtatgtcaagattaccacaaaagttcccggtcatagtgaggacttgcggcacacgcaccagacagaattggatctcacctaccactcccggtacagtgtgcgtctcccagacgcttacgagagcctcatcaacgacgcactgctgggcaactccacaaactttgtgcgaagggacgaactcgatgtggcgtggcgcatcttcacaccgctcttgcaccagatcgatcgtggcgaagtcgctccgattccgtaccaagccggcactcgcggacccaaggaagcggatgactttatcatcaacaacggcttcaagaaggaagaggactatcactgggctccctcgaacaagctgtaagaaaggtcaacattgcagtttgtttcacaagccccctttcgacgacagcgaagagaggcaagtggcttatatactgggaagcttgcctatccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatggatgagagagtttgctgtaggcagagtgcgcggatcctcaacacgaaggcacgcgcatagagtcgatacgttaccgaattttctttcgtttcttccactccccctttgctgtttgctatgatcagcctggctttcttctctcttgcgtccgcatttgtgtgccgcttttgctgttttttcgtttcggagtctcttcttgccgccgcaccccacacgcgccactgtggcgttccgctccttcctcctccaccttcccagatgactctccctctatctctccgtctataaaccagacctttttcctcttcccttttttctattattgccacttggatatatacacttacacgtaccgtgcgcgcgatgtagcgatgngttcagtcgtctgacagcgatcgagaccagaatacatgaaacacgagatagataggcttccttttaagcagcagggatacatacgctgatcggagttacatgcaagccccgacgacaattcgaaaatgatgtgctcttgnaacagaaagaaaccaaaaaaaaaaaaaaaaaaaaaaaaa

SEQ ID NO: 2581 - protein, 562 aa, Leishmania guyanensis
MSSEHSSADQNSYEADVCCILDELRAQVLAQKPDNVLQFISKSALNLQKQRQMEACDQITFKVKDEQKNRALTIIVIGASGDLAKKKTFPALFQLYCDGFLPPEVNIVGYARTKVDDVEKWKRETLMKYFLNLSALRCHAEDFLKHISYFSGAYDNVDDFKRLDKMIREKEDAFKGPEKGGDRLFYLALPPSVFACVCGSIRKGAMPQEVGGWVRLIIEKPFGHDTNSSAELSHALEPFFDESQLYRIDHYLGKEMVQNIITTRFANRIFSSLWNSSNIACVQITFKETIGTEGRGGYFDSIGIIRDVMQNHLTQILALLAMEKPKSLEAECIRDEKVSLLKCVEPVTKENCVLGQYTASADGSIPGYLEDETVPKGSTCPTFAVVRLNINNDRWSGVPFILKAGKAVEQKYVAIRVQFHDEVHPYGDATKRNELVIRAQPSEAMYVKITTKVPGHSEDLRHTHQTELDLTYHSRYSVRLPDAYESLINDALLGNSTNFVRRDELDVAWRIFTPLLHQIDRGEVAPIPYQAGTRGPKEADDFIINNGFKKEEDYHWAPSNKL

SEQ ID NO: 2582 - DNA, 2916 bp, Leishmania amazonensis
  CDS (207)..(1895): n means a or g or c or t/u, y means t/u or c
cgctatataagtatcagtttctgtactttattgcgacgtaggataaagcgaagagcagcaaaacgtactgaaaagagcggaggactctccgagcaatagaatttgctcatcttattcacccacccttatacaaccgttttgatcttatttcttgttgcctccggctaccatatattgatcggtgttatacaaattaagtaagcaccatgtcggaagcgcaggctcgtgctgatgaggatgcttacatggccgacgtcgacagcattctggacgtgctccggacgcatgtgctggaacggaagccagatgacgttttccagttcctttccaagtcggcgctaagtctgcagaaggacagcggcgccgaattgtgcgatcgcatcaactgtaaggtaaaggatgaacagaagagccgtgcattgtctatcatcgtattcggtgccagcggggatctggctaagaagaagacatttcctgccctcttcgatctgtactgtggcgggctccttcccccggaggtcaacattatcggctatgctcgcaccaaggtggacgatgtcgagaagtggaagcatgagacgctcatgaagtatttttcgaaagtgtcggagcgggaatgccacgccgaggacttcttgaaacacatcagctacttttgtggagcgtacgacaaggtggacgacttcaagcgtcttgacgcggtgattcgagagaaggaaaatgcctttaagggccctgaggagggtggaaaccgtctcttctatcttgctcttccgccctcagtgttcgcaattgtctgcgagcacattcacaagggggcgatgccgcaggaagtggggggatgggtgcgggtgatcatcgagaagccctttggccgcgataccaagagctccgccgagctgtcccaagcgctggagccgttcttcgacgagtcgcagctgtaccgcattgaccaytacctcgggaaggagatggtgcagaacatcatcacgacacgcttcgccaaccgtatcttcagcgctgtgtggaactcgagcaacattgcgtgcgtgcaaatcacgttcaaggagaccatcggyaccgagggccgcggcggctacttcgacaacattggcattattcgcgacgtcatgcaaaaccacctcacccagattcttgccctgctggccatggagaagccgcggtcgctggacgctgagtgcatccgcgacgagaaggtgtcggtgctgaagtgcattgagccagtaactaaggagaattgtgttctgggccagtacactgcctccgccgatggctccatgcctggttacctacaggatgagaccgtaccccggggcagcacttgccccacatttgccgtgatgcggctcaacatcaacaacgaccgctgggccggcgtcccttttattctcaaggctggcaaggctgtggagcagaagtacgtggcgattcgcattcagttcaaggacgaggtccacccctacggcgatgcgacacagcgcaacgagctcgtcatccgcgctcagccgtccgaggccatgtatgtcaagatcaccacaaaagttcctggccttagyggagacttacggcagaygcaccagacagagctggaccttacctaccacacccggtacgatgtgcgccttycagacgcctacgagagcctcatcaacgacgcactgctgggtaactcgacaaactttgtgcgtaaggacgagctcgatgtggcatggcgcatcttcacaccgctcctgcaccagatcgacaatggagagatccaaccgattccgtaccaggcaggcacgcgcgggcccaaggaagcggatgaattcatcatcaacaacggcttcaagcaccagaaagactaccagtggactccctcgaacaagctgtgatgaaggcagacattgcaatctatttcacagctccctgtcgacggcagcgagagaggcagggtattatacactggatgcgtgcctatccgcccctaagaaagcacgtggtcgcgctctgcggtacccaccgaccaacgctgcagatacaacacgtgccaattggcatcccgtacctctactgtctacaatccttttttttcgttctcccttgctatcgccattccccatgcgtgtgcactgcggcccagacagctagaggatgtgtgagcccgtgccgccgtacagacagtgccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgagggatagatctctggaatcttaggagaacgcgcggcacccaacacggaggcgcgcacttgatgcaaatgctgctctcgcgtttgttttccctttgccttatttttgttgtttgctttggtcggcctgttgttttcctctctcgcgcagctacctttgtatgcagatttttcattgcttgtgtcgttgctggagttgccttttgccgccgttcccccaccaccttttcagaacacacacacacacaccgcccctcgggcatttcgctcccttttcctacccccttttggccgttttcctttccaatttccgggcataaattacattcttgggttccttttttgttgtcatagtcccttgagggtgcattcccatgttccgcgagcgtggggcaacgacgtgccccagcgtccggaaaggatcgagaaaaggcccccgaaagggtcaaaaacgaagggtggccttcattcaagcagcagcgattcagatgtgtgtgggagtggcagccctttccgagtggcttcccaaacatggcatgtgctcgaaagggagccaacgagaaaaaaaaaaaaaaaaaaaaaaaaaaaaaaaaaaaaaaaaaaa

SEQ ID NO: 2583 - protein, 562 aa, Leishmania amazonensis
  misc_feature (463)..(463): Xaa can be Met or Thr
  misc_feature (481)..(481): Xaa can be Ser or Pro
MSEAQARADEDAYMADVDSILDVLRTHVLERKPDDVFQFLSKSALSLQKDSGAELCDRINCKVKDEQKSRALSIIVFGASGDLAKKKTFPALFDLYCGGLLPPEVNIIGYARTKVDDVEKWKHETLMKYFSKVSERECHAEDFLKHISYFCGAYDKVDDFKRLDAVIREKENAFKGPEEGGNRLFYLALPPSVFAIVCEHIHKGAMPQEVGGWVRVIIEKPFGRDTKSSAELSQALEPFFDESQLYRIDHYLGKEMVQNIITTRFANRIFSAVWNSSNIACVQITFKETIGTEGRGGYFDNIGIIRDVMQNHLTQILALLAMEKPRSLDAECIRDEKVSVLKCIEPVTKENCVLGQYTASADGSMPGYLQDETVPRGSTCPTFAVMRLNINNDRWAGVPFILKAGKAVEQKYVAIRIQFKDEVHPYGDATQRNELVIRAQPSEAMYVKITTKVPGLSGDLRQXHQTELDLTYHTRYDVRLXDAYESLINDALLGNSTNFVRKDELDVAWRIFTPLLHQIDNGEIQPIPYQAGTRGPKEADEFIINNGFKHQKDYQWTPSNKL

SEQ ID NO: 2584 - DNA, 1440 bp, Chlorobium tepidum
  CDS (1)..(1440)
atgagcggcactctcgacaacttcaccatcgtcatcttcggcgcgagcagcgacctggcttcgcgcaagctttttccgtcgattttccagctcgcgcggtgggggcacatgcctgagagcttccggctgattggcgtcgggcggcaggagcaaagccacgaggagttccgcgcgttcgtccgcagtcgcctgctggagcactcgcccgaagccgccggtgacgccgcgcggctcgacgccttctgcctccgcctcttttatgcccgcgtcgatctggacgatccggcgagctacgaagtgctgcgcgacgagatcatgcgcgaggaaaaagtgggagggagcacttgccgcaacctgatgttctatctgtcgataccgccgagccttgcgcctgccgtggtgcgcaatctcggcaaggccgggctgggtggacgtgaacagtcgtgcaccgggtggcgcaagctcatcgccgaaaagccctacggccacgatctcgaaagcgcccgcgagctgaaccgcgttatcaacgaggtgttcgaggagaaccaggtctatcgcatcgaccactacctcggcaaggagccggtgcagaacatcatggtgttccgcttctcgaacggtattttcgagccgctctggaaccggcagtatatcgcgcaggtgcagatcaccatcgccgaggatttcggcatccgggatcgcggcgcgtactacgaggagtcgggacttttgcgtgacatcatccagaaccacggcttgcagttgctcacggccatcgcgatggagccgccggtcgatctcagcgccgattcgatccgcgacgagaaagcgaaagttctgcgttcggtgcggcacttcactcctgattcggttcgggagtcggtggtgatcggccaatacgaggggtaccgcaacgagaaaaatgtcgcgccggactcgaaagtcgagaccttcgctgccgtgaagtttcacgtggataactggcgttggtcgggtgtgccgttctacatgaaagcgggcaagaatctcgccaagcgcgtgaccgaaatcgtcatcaccttccgctgcccgccgcagaattattacggcccatccggcggggcggcgtgctgtacgccgaaccaggtggtactcggcatccagcccgacgaaacggttgccatccgctttggcgccaagcgccccggcgagcagatgattaccgatccggtgttcatgaagttcgactaccgcgatacttttcagggcgaaggtcttacgccgtaccaccgcctcctgctcgatgccatcgagggcaaccagatgaacttcatccgcaaagacagcgtggagtactcgtgggaaattatcgacagcctgaaaaattcaatcgacggccaggttccggagcaatatccagttcatagctgggggccggaatcgtcgaggatttacgggtga

SEQ ID NO: 2585 - protein, 479 aa, Chlorobium tepidum
MSGTLDNFTIVIFGASSDLASRKLFPSIFQLARWGHMPESFRLIGVGRQEQSHEEFRAFVRSRLLEHSPEAAGDAARLDAFCLRLFYARVDLDDPASYEVLRDEIMREEKVGGSTCRNLMFYLSIPPSLAPAVVRNLGKAGLGGREQSCTGWRKLIAEKPYGHDLESARELNRVINEVFEENQVYRIDHYLGKEPVQNIMVFRFSNGIFEPLWNRQYIAQVQITIAEDFGIRDRGAYYEESGLLRDIIQNHGLQLLTAIAMEPPVDLSADSIRDEKAKVLRSVRHFTPDSVRESVVIGQYEGYRNEKNVAPDSKVETFAAVKFHVDNWRWSGVPFYMKAGKNLAKRVTEIVITFRCPPQNYYGPSGGAACCTPNQVVLGIQPDETVAIRFGAKRPGEQMITDPVFMKFDYRDTFQGEGLTPYHRLLLDAIEGNQMNFIRKDSVEYSWEIIDSLKNSIDGQVPEQYPVHSWGPESSRIYG

SEQ ID NO: 2586 - DNA, 2187 bp, Methylobacterium extorquens
  CDS (640)..(2187)
gtgggggctggagcgcggctactgcatgatgatcggcggcgagaaggccgtggtggatcgcctcgatcccatcttcgcggccctcgcgccgggccgcggcgagattccccccacccccggccgagcggggcgggacccgcgggccgagcagggctatatccacgccggcccgagcggggcgggccacttcgtcaagatggtccacaacggcatcgagtacggcctcatgcaggcctacgccgaaggtttcgagatcctgaagcacgcggactcggccgagctgccgcaggagcagcggttcgacctcgacctcgcggacgtggccgaggtctggcggcggggcagcgtcgtgtcgtcctggctcctcgacctcaccgcgatggcgctggccaacgatccgaagctcgactcgttcgcaggctacgtcgaggattcgggcgagggccgctggaccatcaatgcggccgtcgaggaggcggtgccggcgatcgttctctcggcggcgctctacgcccggttccgctcgcgccaggaggcgagcttcgccgacaagatgctgtcagcgatgcgcaagggcttcggcggccaccaggagcccaagaagagctgaacgtgacgttcgccacgcgggagccgcgcatgatccacccgaacaccgcccccaaggcgggcgccgcgaaaccggcgccggactgcacgcttgtcatcttcggcgtcaccggcgacctgacgcaccggctcttgatgccggcgctctacaacctcgcgcggtggaagctcctgcccgaacggttcgccatcgtcggcgttggccgcagcgagatgggcaccgacgggctgcgccacgacctcaccaggaccatgcagggcttcgtcgccgagaggggcggcgagttctcagccgacagcctcgaccgggaggcctggaaccgggtcgtcggccggctggactatctcgccggcgatgtcgaagacccggcgacttacgaagagctgtcgcggcgcatcggggtctcgcgagatgcccaggccgccggcggcaacgtgctgttctaccttgcggtcgcggcccgcctcttcggtccggtggtgacgcgactcggcgaagcggggctcacccgagaaggggagggcgcctggcggcgggtgatcatcgaaaaacccttcggccacgatctcgcctcggccaaggcgctcaaccgggaggtcctcgcggccctaagcgaggaccagatcttccggatcgaccacttcctcggcaaggagaccgtccagaacatcatggtcttccggttcggcaacggcctgttcgagccgttgtggaaccgcgaccgcatcgaccacgtccagatcacggtcgctgagacggttggggtcgagaagcgcggctcgttctacgacgcgaccggcgccctccgcgacatggtgccgaaccacctcttccagctcttcaccatgacggccatggagccgccgatctccttcgacgcccacgccgtgcgcgacaagaaggaggaggtgctcatggccgtgcaccagctctccgaggacgcggccgtgcgcgaggcggtgcgcgggcgatacacggcaggcgcggtgcgcggccagcccgtccgcagctaccgcgacgagccggacgtggacccggcctcgcagaccgagacctacgtcgcgctgcgcctcatggtcgacaactggcgctgggccggcgtgccgttctacctccgcacgggcaaggcgatgacgaggcgcgacacggagatcgccatccagttcaagcaggcgccgctggcgctgttccgcggcaccgccgtcgaggcctgcatcccgaactggctcgtgctgcagatccagccggacgagggcatctccctgcagttcggcgccaaggtgccgggcaccgaggtgcggctcggcgccgtcaacatggacttcctctacaaggactacttccagacccagccgagcaccggctacgagacgctcatctacgacgccatgatcggcgacgcgacgctgttccagcgcgccgacaatatcgaggccggctggcgggccgtgcagcccgtgctcgacgcctggtcgagcgggcgcgccccgatggccgcctacccggccggcagcgcaggcccgaaggaggcggacgacctcctcgcccgcgacggtcgcgcctggcgccctctgtga

SEQ ID NO: 2587 - protein, 515 aa, Methylobacterium extorquens
MIHPNTAPKAGAAKPAPDCTLVIFGVTGDLTHRLLMPALYNLARWKLLPERFAIVGVGRSEMGTDGLRHDLTRTMQGFVAERGGEFSADSLDREAWNRVVGRLDYLAGDVEDPATYEELSRRIGVSRDAQAAGGNVLFYLAVAARLFGPVVTRLGEAGLTREGEGAWRRVIIEKPFGHDLASAKALNREVLAALSEDQIFRIDHFLGKETVQNIMVFRFGNGLFEPLWNRDRIDHVQITVAETVGVEKRGSFYDATGALRDMVPNHLFQLFTMTAMEPPISFDAHAVRDKKEEVLMAVHQLSEDAAVREAVRGRYTAGAVRGQPVRSYRDEPDVDPASQTETYVALRLMVDNWRWAGVPFYLRTGKAMTRRDTEIAIQFKQAPLALFRGTAVEACIPNWLVLQIQPDEGISLQFGAKVPGTEVRLGAVNMDFLYKDYFQTQPSTGYETLIYDAMIGDATLFQRADNIEAGWRAVQPVLDAWSSGRAPMAAYPAGSAGPKEADDLLARDGRAWRPL

SEQ ID NO: 2588 - DNA, 1476 bp, Bartonella henselae
  CDS (1)..(1476)
atggtgagtaaaattattccagtctctccctttgactgtattgtgtttggtggcaatggtgatttagcagcacgcaaacttatacctgctttataccattgtcagtgtgttgggcaattgagcgagccaacacgtattattggagtttcgcgctcttctttgagtggtgaagagtatcaaaattttgttcgtgcttctttagaaaaatatgttcatccaaaagatctcaatcgaattgaactcaatcgttttcttgcgcgtttaacctatatttctgttgatattacatcaaatcgagggtggagagatctcgctttaccgctctcagaagatccatctgatattcgagttttttatttagcagttggttcatccctttttggtgatattgcgatgagattgggacaaaatggtttagtaacgcaaaaaacacgaattattattgaaaaacctattggttgtaatgtaaaaacagcggttcagctcaatgatacatttgcaagcgtatttgatgaagatcagatttttcgcattgaccattatctgggcaaggagaccgttcaaaatttgatggcattgcggtttgttaatacactttatgagccgttatggaactccaattatattgatcatgtacagataacggtggctgaatctttaggattggaagggcgtatagaatattatgagagtgcaggtgcactgcgtgatatggtacaaaatcatatgctgcaattgctctgtttggttgctatggaagtaccatttaccaatagtgcgaatgctgtgcgtgatgaaaaactgaaagttttgcattctttaatgcctctcgatgttcgtaatgtagagcaatatactgtacgtgggcagtatctttctggtatattggatgatgtttgtgtaaaatcttatcttgatgatttggggaaagaagttagtaggagcgaaacatttgtggcgcttaaaattaaggttgataattggcggtgggcagatacgcctttttatttgcgaacaggtaaacgcatgtccacgcggatgtctgaaattgttatcgttttcaaacccattccccataatatttttgagacggattcaaatgaaattttttctaatcggctcgtcattcgtctccagcctgatgaaggcgtaaaacaatggttgatgattaaggatccaggtcctggtggtatacgatttcgtcatattccattggatatgagttttgcgtctacattttctcagcgtaatcctgatgcttatgaacgcttattaatggatgttattcgcggagatcaaacactctttatgcgtcgtgatgaagttgaagctgcttggcgttggattgatccaattctagagggatgggaagccataaagcagcctgttcatggttatagcgctggctcatggggaccatctgcttcgaaacttttgatggaacgtgatgggcgtatatggaacaatttggtttag

SEQ ID NO: 2589 - protein, 491 aa, Bartonella henselae
MVSKIIPVSPFDCIVFGGNGDLAARKLIPALYHCQCVGQLSEPTRIIGVSRSSLSGEEYQNFVRASLEKYVHPKDLNRIELNRFLARLTYISVDITSNRGWRDLALPLSEDPSDIRVFYLAVGSSLFGDIAMRLGQNGLVTQKTRIIIEKPIGCNVKTAVQLNDTFASVFDEDQIFRIDHYLGKETVQNLMALRFVNTLYEPLWNSNYIDHVQITVAESLGLEGRIEYYESAGALRDMVQNHMLQLLCLVAMEVPFTNSANAVRDEKLKVLHSLMPLDVRNVEQYTVRGQYLSGILDDVCVKSYLDDLGKEVSRSETFVALKIKVDNWRWADTPFYLRTGKRMSTRMSEIVIVFKPIPHNIFETDSNEIFSNRLVIRLQPDEGVKQWLMIKDPGPGGIRFRHIPLDMSFASTFSQRNPDAYERLLMDVIRGDQTLFMRRDEVEAAWRWIDPILEGWEAIKQPVHGYSAGSWGPSASKLLMERDGRIWNNLV

SEQ ID NO: 2590 - DNA, 2266 bp, Toxoplasma gondii
  CDS (169)..(1851)
ccccctcctggcatcttgcgtcgcatagcagacatacatcgtggggttttggcccgctaggttaccatcacgctcaacggcttccagttgaggaaccgtgttttccccacattttcatgattttgtccaaaagttgcagagtcgacttccatctctggataaggcaacatggcaccggaaaatggtagaagcagttattctgcatatatcagactgttgtggcttctgacggcggtaactgctgcgtcggccctcgtcacgaacgtctcgggggggacggcaggcgaagatcaaacttatggatatgtgaatgtcggaaacaactctgatggtgtcacgttcattttttacggcgcaaccggagatctctgcaggaggaaaatttacccgacggtcttccaactatatttggagaaaaagctgccggagtcgtttctcattgtaggcatgagcaatcaagccatgagcttggtcgacttccgtaagatgcatcgtcctcagctcgagaatgtcttgcgttcttataagcggctacgtgatcctgcgaggctactgaatcagtttgagcagcggatgagctacaccacgggatcgatcgacgatgataatattttaagtcatttctgccacaatatatcgagaatggaacaggcacaatcccctaacgcttcttggggccgagtactgtacttggcgctgcctcctcatattttcgctccggcggcggccggcttcaagcggaattgctcgacacataacgggtggacgcgagtagtagttgaaaaaccatttggacgtgattatgagagctcagagcttctttcggagcagctgaggagcgtgctgcttgaagaggaaacataccgaatagatcactatctcggcaaggagatgttacaggcactgccaccgctgcgattcacgaacttcttcctcgagccgctcatgaaccgaaatttcgtgaaagcactcacgatttctttcaacgaggatattggtatcagcggccgcggcgagttctttaatgcatacgggatcattcgggacgtcatgcagaatcacctcctccaacttctaactctcgtggtgatggaaagaccagccactttgagtgatgaggatatcagagacgagaaggttaaggttctgaaacagatcgctcccattaaactagaggagaccattgtcggtcagtactcaaagtcggaggatggaagcgctggatcgtatctggagaccgatggagtgccctcgcactctcgaacgcccacttacgccgcggtatgtatgcacatacgaagtcctcggtgggaaggagttcccatttacatggaggctggtaaaggcatgggcaagaggatcgtctacgtccgcatagactttgctggcgtcccgggattcagagagagtaactatgacttcccaggaaatagtttgattttagaagtccagccgcacccgtctgtgcgctttgaagtcaatgccagggcacctggactcggagcgactttgggaaggaacgtcttgaaaatggatgtcaatccggacggcgtgcggatccccgatgcatacgaaaatcttctcctcaacgtgctcagcggcgacaaaagccattttgttagaacggatgagctccgcgaatcatggagaattttcacgccgatgttacatgcattagaagatttacaggtccagccacgactgtatcctttcgggacacctggtcctagtggcgctgttgatgagctgcgcgcagctgtcgctgcctcagtgaacggtacgcaaggcaaatctacgatagatagcagagtctctctgcgtttttctgccagcacagggaaacagaggtaatgctcgtcgtattcgcttaagcacaaagcaggcgccaggggatcacttgtgctatagcgtgaggagtttctgttttggtagggcgtgtgattttggtaaattatagtaacgttggtaactagtggagctatcagtgaaagcgtagacttgcatctcttgacgcttcatgcatgtgttgtaagaagtcgacgtccgaaatagccgcaggtttccctttgtcagacagcgacggttaggccgtaactgcggctgaagatgctctttaattcagtaatgcagacagggacagtaacatacacattcgtttcacccgtggaggcggaaagctcctggcacgtgtttcgtaactggatgaacgttttttataccacagcagtcataagacattggccgctaaaaaaaaaaaaaaaaaaaa

SEQ ID NO: 2591 - protein, 560 aa, Toxoplasma gondii
MAPENGRSSYSAYIRLLWLLTAVTAASALVTNVSGGTAGEDQTYGYVNVGNNSDGVTFIFYGATGDLCRRKIYPTVFQLYLEKKLPESFLIVGMSNQAMSLVDFRKMHRPQLENVLRSYKRLRDPARLLNQFEQRMSYTTGSIDDDNILSHFCHNISRMEQAQSPNASWGRVLYLALPPHIFAPAAAGFKRNCSTHNGWTRVVVEKPFGRDYESSELLSEQLRSVLLEEETYRIDHYLGKEMLQALPPLRFTNFFLEPLMNRNFVKALTISFNEDIGISGRGEFFNAYGIIRDVMQNHLLQLLTLVVMERPATLSDEDIRDEKVKVLKQIAPIKLEETIVGQYSKSEDGSAGSYLETDGVPSHSRTPTYAAVCMHIRSPRWEGVPIYMEAGKGMGKRIVYVRIDFAGVPGFRESNYDFPGNSLILEVQPHPSVRFEVNARAPGLGATLGRNVLKMDVNPDGVRIPDAYENLLLNVLSGDKSHFVRTDELRESWRIFTPMLHALEDLQVQPRLYPFGTPGPSGAVDELRAAVAASVNGTQGKSTIDSRVSLRFSASTGKQR

SEQ ID NO: 2592 - DNA, 1455 bp, Corynebacterium glutamicum
  CDS (1)..(1455)
atggtgatcttcggtgtcactggcgacttggctcgaaagaagctgctccccgccatttatgatctagcaaaccgcggattgctgcccccaggattctcgttggtaggttacggccgccgcgaatggtccaaagaagactttgaaaaatacgtacgcgatgccgcaagtgctggtgctcgtacggaattccgtgaaaatgtttgggagcgcctcgccgagggtatggaatttgttcgcggcaactttgatgatgatgcagctttcgacaacctcgctgcaacactcaagcgcatcgacaaaacccgcggcaccgccggcaactgggcttactacctgtccattccaccagattccttcacagcggtctgccaccagctggagcgttccggcatggctgaatccaccgaagaagcatggcgccgcgtgatcatcgagaagcctttcggccacaacctcgaatccgcacacgagctcaaccagctggtcaacgcagtcttcccagaatcttctgtgttccgcatcgaccactatttgggcaaggaaacagttcaaaacatcctggctctgcgttttgctaaccagctgtttgagccactgtggaactccaactacgttgaccacgtccagatcaccatggctgaagatattggcttgggtggacgtgctggttactacgacggcatcggcgcagcccgcgacgtcatccagaaccacctgatccagctcttggctctggttgccatggaagaaccaatttctttcgtgccagcgcagctgcaggcagaaaagatcaaggtgctctctgcgacaaagccgtgctacccattggataaaacctccgctcgtggtcagtacgctgccggttggcagggctctgagttagtcaagggacttcgcgaagaagatggcttcaaccctgagtccaccactgagacttttgcggcttgtaccttagagatcacgtctcgtcgctgggctggtgtgccgttctacctgcgcaccggtaagcgtcttggtcgccgtgttactgagattgccgtggtgtttaaagacgcaccacaccagcctttcgacggcgacatgactgtatcccttggccaaaacgccatcgtgattcgcgtgcagcctgatgaaggtgtgctcatccgcttcggttccaaggttccaggttctgccatggaagtccgtgacgtcaacatggacttctcctactcagaatccttcactgaagaatcacctgaagcatacgagcgcctcattttggatgcgctgttagatgaatccagcctcttccctaccaacgaggaagtggaactgagctggaagattctggatccaattcttgaagcatgggatgccgatggagaaccagaggattacccagcgggtacgtggggtccaaagagcgctgatgaaatgctttcccgcaacggtcacacctggcgcaggccatga

SEQ ID NO: 2593 - protein, 484 aa, Corynebacterium glutamicum
MVIFGVTGDLARKKLLPAIYDLANRGLLPPGFSLVGYGRREWSKEDFEKYVRDAASAGARTEFRENVWERLAEGMEFVRGNFDDDAAFDNLAATLKRIDKTRGTAGNWAYYLSIPPDSFTAVCHQLERSGMAESTEEAWRRVIIEKPFGHNLESAHELNQLVNAVFPESSVFRIDHYLGKETVQNILALRFANQLFEPLWNSNYVDHVQITMAEDIGLGGRAGYYDGIGAARDVIQNHLIQLLALVAMEEPISFVPAQLQAEKIKVLSATKPCYPLDKTSARGQYAAGWQGSELVKGLREEDGFNPESTTETFAACTLEITSRRWAGVPFYLRTGKRLGRRVTEIAVVFKDAPHQPFDGDMTVSLGQNAIVIRVQPDEGVLIRFGSKVPGSAMEVRDVNMDFSYSESFTEESPEAYERLILDALLDESSLFPTNEEVELSWKILDPILEAWDADGEPEDYPAGTWGPKSADEMLSRNGHTWRRP

SEQ ID NO: 2594 - DNA, 1923 bp, Xanthomonas campestris
  CDS (1)..(1923)
atgcaacgacgtgggcctgctcgccgaagagtacgacccgcgcagcaaacgcatgcttggcaacttcccgcaagggtattcccacgtggccctggtcaatgcggcattgcgcctgcatggacgcatgggcgagaaggagacgcatccatgagtgagcaagtgaccaccccgccgtgcatcatcgtggtgttcggtgcgcgcggtgacctgacccggcgcctggtgatgccggcgctgtacaacctgcgccgcgccggtgcacttggcgaggaattcgccattgtcggcatggaccacggcgacatcaccgagcgtgcctggcgcaccaacatgggcaaggcgatgaccgagctgctgagcagccgcgatgccgagttccaggccgatggattcgataccgacacctgggactggttgcgcgagcgcatgcattacgtgcgcggcgacttcaccgacctgcgtgcctatcagtcgctggacggcgtgctggaaaaactgcacaagcgctatggcacccgcggtaatgtgctgttctatctggccaccgccgcgcgcttcttcgagccggtgctgctgaatctgggcgaggccgggctggtcaagcagcgcgagggcgccggctggcgccgggtgatcgtggaaaagccgttcggccacgacctgcccagcgccaagcatctcaatgccacggttgcgcgcgtgctgcacgaagaccaggtgttccgcatcgaccatttcctgggcaaggaaaccgtgcagaacatcctggcgttccgcttcgccaatggcctgttcgagccggtgtggaaccgcgaccggatcgaccacgtgcagatcactgccgccgaaaccatcggtgtggaagggcgcgggcgtttctacgatcccaccggctgcctgcgcgacatggtgcccaaccatctgttccagctgctggcgatgattgcgatggagccgccggccgcgttcaccaccgaggcgatgcatcgccgccgcgccgaagtgatcgaagcggtgcgcccgatcaaacctgaagacgtggtgcgtgggcagtacgcgtccggtgcggtcaatcgcagcgccgtgccgggataccgcgaagaagacacggtaccggacgagtcggaaaccgaaaccttcgtggcgatgaagttgcaggtcgacacctggcgctgggccggcgtgccgttctatctgcgcaccggcaagcgcctgcgcgaacgcaccaccgagattgcgatccgcttcaagcctgcaccgttggcgccattccgcagcaccgaagtgggcggctacggccccgactggctggtgctgcatatccagcccgacgaaggcatctcgctgcagttcgacgtcaagcgcccgggcgcgcaagtggcgttggcgccggtgcggatggacttccgctaccgcgactggttcccgaaggaatacaccgttggctacgagcgcttgctgcaggactgcatgaatggcgaggccggtctgttccaggatgcagcgatggtggaaggcgcgtggcgcatcgtgcagccgatcctggatgcgtggaagcaaccgcccagtgactttcccaattacgcggctggcagtgccggcccgtcggcggccgatgcgttgctggcgatgaacggcgggcacgcctggcgtgcgctcactccgggccgcaaaccgccgccgcgtcgcccgcctgaagcgcgtgcgggtgcggcggcaccggcgaagaagagcgccaagaaggcggtcaaaaaggctgcgaaaaaagtcgccaaggcgcctgccaagcgcagcgctgcggttgccgggaaatctgcagcggcggcgtcgccgagcaaggcggcaagcaaggcggtcaccaagcgcgccaccaaaaaggcgacgaagccggcaaccaaagtcgtcaagaagagcgcttcgtag

SEQ ID NO: 2595 - protein, 640 aa, Xanthomonas campestris
MQRRGPARRRVRPAQQTHAWQLPARVFPRGPGQCGIAPAWTHGREGDASMSEQVTTPPCIIVVFGARGDLTRRLVMPALYNLRRAGALGEEFAIVGMDHGDITERAWRTNMGKAMTELLSSRDAEFQADGFDTDTWDWLRERMHYVRGDFTDLRAYQSLDGVLEKLHKRYGTRGNVLFYLATAARFFEPVLLNLGEAGLVKQREGAGWRRVIVEKPFGHDLPSAKHLNATVARVLHEDQVFRIDHFLGKETVQNILAFRFANGLFEPVWNRDRIDHVQITAAETIGVEGRGRFYDPTGCLRDMVPNHLFQLLAMIAMEPPAAFTTEAMHRRRAEVIEAVRPIKPEDVVRGQYASGAVNRSAVPGYREEDTVPDESETETFVAMKLQVDTWRWAGVPFYLRTGKRLRERTTEIAIRFKPAPLAPFRSTEVGGYGPDWLVLHIQPDEGISLQFDVKRPGAQVALAPVRMDFRYRDWFPKEYTVGYERLLQDCMNGEAGLFQDAAMVEGAWRIVQPILDAWKQPPSDFPNYAAGSAGPSAADALLAMNGGHAWRALTPGRKPPPRRPPEARAGAAAPAKKSAKKAVKKAAKKVAKAPAKRSAAVAGKSAAAASPSKAASKAVTKRATKKATKPATKVVKKSAS

SEQ ID NO: 2596 - DNA, 1431 bp, Xanthomonas campestris
  CDS (1)..(1431)
atgcacaacaccctgatcctgttcggcgccaccggcgatctcgcccagcgctatctctttccatccctgctgcgcctgtttgtcgacggcctgttgccggaggacttccgcatccgtgcgttggccctgtcgcagcacgacaccgacgccttccgcgaggtactgcgcccgcgcctggcccaggcgctgccgattgccaccgccgcgcagatcgatgcgctgctgcagcgcatcgactaccgctcggcggacctgcgcaatgccgaatcggtggccgaggccgtgcgcgaactggccagccgccagtgcgtaagctatctggcgattccaccgggcctgtacatcagtacctgccagggcctggccctgggcggcgcgctggctgcaccgcaccggttgatgctggaaaaaccgatcggccacgattcggacagcgcccgcgagatcctgcagtcgatcggcgcactgatcgacgaagaccgcgtgttccgtctcgaccactacctgggcaaggccgcggtgcagaacctggtggcgctgcgcttcggcaacaccttgctggaagcggtgtggaaccggacctacatcgaatcggtacagatcctggtggccgagagcgaaggcgtggacggccgcgatgcctactacgcccgctccggcgcgctgcgcgacatggtgcagagccatatcctgcagttgctgtgcctggtggccatggagccgccggcctcgctggaagccgaccgcatccgcgacgagaaggtcaaggtgctgcgcgccttgcgcccgatgaccgccgagcacgccgcgcaagacagcgtgcgtggccgctacaccgccggcagcatcaacggcgagccggcgcaggcctaccacccgccggaaggcagcgatgtggaaaccttcgtcgcggtcaccgcgcacatcgacaactggcgctgggctggcgtgccgttccacctgtgcaccggcaagcgcctggctgagcgctccacgcgcatcgtggtcacgctcaagccggtgacgcattggttgttcgagcgtccggaccgccagaacgcggtgcccaaccgcctgaccttccagctgcagccgctggaaaacatcgagctgggcctgatgagcagcctggccggcccggaatggggtgcgatcgaactgcagccgctggaactggagctgtccgtgcccaccggcctgcaccgccgtatcgcgtatgaacgcttgttcgtggatgccttcaacggcaacccggcgctgttcgtgcgcgatgacgaggtcaaggccgcctgggcctggatcgacagcgtcagcgatgcctggtcggacgcacagctgccgctgcagccgtatccggccggtagctggggccccgagaccgccgcaccgttcctgcccccggccaccgacgcacagggaaacaacgcatga

SEQ ID NO: 2597 - protein, 476 aa, Xanthomonas campestris
MHNTLILFGATGDLAQRYLFPSLLRLFVDGLLPEDFRIRALALSQHDTDAFREVLRPRLAQALPIATAAQIDALLQRIDYRSADLRNAESVAEAVRELASRQCVSYLAIPPGLYISTCQGLALGGALAAPHRLMLEKPIGHDSDSAREILQSIGALIDEDRVFRLDHYLGKAAVQNLVALRFGNTLLEAVWNRTYIESVQILVAESEGVDGRDAYYARSGALRDMVQSHILQLLCLVAMEPPASLEADRIRDEKVKVLRALRPMTAEHAAQDSVRGRYTAGSINGEPAQAYHPPEGSDVETFVAVTAHIDNWRWAGVPFHLCTGKRLAERSTRIVVTLKPVTHWLFERPDRQNAVPNRLTFQLQPLENIELGLMSSLAGPEWGAIELQPLELELSVPTGLHRRIAYERLFVDAFNGNPALFVRDDEVKAAWAWIDSVSDAWSDAQLPLQPYPAGSWGPETAAPFLPPATDAQGNNA

SEQ ID NO: 2598 - DNA, 1839 bp, Xanthomonas axonopodis
  CDS (1)..(1839)
atgagtgagcaagcaaccacaccgccgtgcatcatcgtggtgttcggcgcacgcggcgatctgaccaagcgcctggtcatgccggcgctgtacaacctgcgccgttccggtgcgctgggcgatgatttcgccattgtcggcatggaccatggcgacatcagcgagcgcgcctggcggaccaacatggggcagtcgatgacgcagctgctcagcagccgcgatgccgaattccagaccgacgaattcgacaccgccacctgggactggctgcgcgaacgcatgcattacctgcgcggcgacttcaccgatcagggagcctatcgatcgctgggcggcgtgctggacaagctgcacaagcgctacggcacgcagggcaatgtgctgttctatctggccaccgccgcgcgcttcttcgagccggtattgctcaacctgggcgaggctggcctggtcaagcagcgcgaaggcgaaggctggcgccgggtcatcgtggaaaaacccttcggctacgatctgcccagcgcccagcacctcaatgccacggtcgccaaggtgctgcacgaggatcaggtgttccgcatcgatcatttcctgggcaaggaaaccgtgcagaacattctcgcgttccgcttcgccaatggcttgttcgaaccggtgtggaaccgcgaccgcatcgaccatgtgcagatcaccgcggccgaaaccatcggagtggaagggcgcggacggttctacgaccccaccggctgcctgcgcgacatggtgccgaaccatctgttccagctgctggcgatgattgcgatggagccgccagcggccttcaccaccgaggcgatgcatcgccgtcgcgccgaagtgatcgaagcggtgcgcccgatcaaacccgaagacgtggtgcgcgggcaatacgcctccggtgcggtcaatcgcaatgcggtgccgggttatcgcgaagaagacaccgtgcccgacgattcggacaccgaaacctatgtggcgatgaagctacaggtggacacctggcgctgggccggcgtgccgttctacctgcgcaccggtaagcgcctgcgcgaacgcacgaccgagatcgccattcgcttcaagccggcaccgctggcgcccttccgcagtaccgaggtgggcggctacggccccgactggctggtgctgcatatccagccggacgagggcatctcgctgcagttcgacgtcaagcgtccgggcgcgcaggtggcactggcaccggtgcgcatggacttccgttaccgcgactggttccccaaggaatacacggtgggctacgagcgcctgctgcaggactgcatgaacggcgaagccggcttgttccaggatgcggccatggtggaaggcgcatggcgcatcgtgcaaccgatcctggatgcatggaaacaacccccaagcgacttccccaattacgccgccggcagcgccggcccttcggctgccgatgcactactggcaatgaatggcggacacgcctggcgcgcactcaccccagggcgcaagccgccaccgcgccggccgccggaagcgcgtgctggcgctgccgcgccgattaagaaaaccaccggcaaatctgccaagaaggccgccaaggcgccggccgagaaggtcaccaaggcgccagccagacgcgcatctgcggcttcagcaagaccatcgcaggatgcggctacgtcgcctagcagcgcggccaggaaggccgtgagcaaacgcgtaaccggcaaggtcgcaaaggccgccggcaaaaccgcggcaggcaagggcgcagcgaagaagtcggccagcaagaccgtggcgcgcacgccacgccgctga

SEQ ID NO: 2599 - protein, 612 aa, Xanthomonas axonopodis
MSEQATTPPCIIVVFGARGDLTKRLVMPALYNLRRSGALGDDFAIVGMDHGDISERAWRTNMGQSMTQLLSSRDAEFQTDEFDTATWDWLRERMHYLRGDFTDQGAYRSLGGVLDKLHKRYGTQGNVLFYLATAARFFEPVLLNLGEAGLVKQREGEGWRRVIVEKPFGYDLPSAQHLNATVAKVLHEDQVFRIDHFLGKETVQNILAFRFANGLFEPVWNRDRIDHVQITAAETIGVEGRGRFYDPTGCLRDMVPNHLFQLLAMIAMEPPAAFTTEAMHRRRAEVIEAVRPIKPEDVVRGQYASGAVNRNAVPGYREEDTVPDDSDTETYVAMKLQVDTWRWAGVPFYLRTGKRLRERTTEIAIRFKPAPLAPFRSTEVGGYGPDWLVLHIQPDEGISLQFDVKRPGAQVALAPVRMDFRYRDWFPKEYTVGYERLLQDCMNGEAGLFQDAAMVEGAWRIVQPILDAWKQPPSDFPNYAAGSAGPSAADALLAMNGGHAWRALTPGRKPPPRRPPEARAGAAAPIKKTTGKSAKKAAKAPAEKVTKAPARRASAASARPSQDAATSPSSAARKAVSKRVTGKVAKAAGKTAAGKGAAKKSASKTVARTPRR

SEQ ID NO: 2600 - DNA, 1431 bp, Xanthomonas axonopodis
  CDS (1)..(1431)
atgcacaacaccctgatcctgttcggcgccaccggcgatcttgcccagcgctatctctttccttccctgctgcgtctgttcatcgacggtctgttgccggaggacttccgcatccgtgcgctggcgctgtcgccgcacgacaccgatgcatttcgcgacgtgctgcggccgcgcctgaccgaagcgctgccgatcgcgaccgccgaacagatcgacacgctgctacaacgggtcgactatcgctcggtggatctgcgcaatgccgattcggtggccgacgcggtccgcgaactggccagccgtcggtgtgtgagctatctggcgatcccgccgggcctgtacatcagcacctgccagggcctggcgctgggtggcgccctggcggcaccgcatcgcttgatgctggaaaaaccgatcggccacgactcggacagcgcccgcgacatcctgcagtcgatcggcgcgctgatcgacgaagaccgcgtgttccgcctggaccattacttgggcaaggcagcggtgcagaacctgatcgcgctgcgcttcggcaacacgctgctggaggcggtctggaaccggacctacatcgagtcggtgcagatcctggtcgccgaaagcgaaggcgtcgacgggcgcgatgcctactacgcccgctccggcgccctgcgcgacatggtgcagagccatatcctgcagctgttgtgcctggtggcaatggagccgccggcctcgctggaagccgaccgcatccgcgatgagaaggtcaaggtgctgcgcgccctgcgcccgatgaccgccgagcacgccgcgcacgactgcgtgcgcggccgctacaccgccggcagcatcaacggccagccggcgcaggcctaccacccgccggaaggcagcgacgtggaaacctttgtcgccgtcaccgcgcatatcgataactggcgctgggccggcgtgccgttccacctgtgcaccggcaagcgtctggccgagcgctccacccgcatcgtggtgacgctcaagccggtgacgcactggctgttcgaacgccccgaccgccagaacgcggtgccgaaccgcctgaccttccagttgcagccgcaggaaaacatcgagctcggcctgatgagcagcctggctggcccggaatggggtgcgatcgaactgcagccgctggaactggaactgtcggtgccgaccggcctgcaccgtcgtatcgcctacgaacgtctgttcgtcgacgccttcaacggtaaccccgcgctgttcgtgcgcgacgacgaggtcaaggcggcgtggtcgtggatcgacagcgtgagcgacgcctggaaagacgccgcgctgccgctgcagccctacccggccggcagctggggtcccgaatcggccgcccacttcctgcccccggccaccgacgcacagggaaacaacgcatga

SEQ ID NO: 2601 - protein, 476 aa, Xanthomonas axonopodis
MHNTLILFGATGDLAQRYLFPSLLRLFIDGLLPEDFRIRALALSPHDTDAFRDVLRPRLTEALPIATAEQIDTLLQRVDYRSVDLRNADSVADAVRELASRRCVSYLAIPPGLYISTCQGLALGGALAAPHRLMLEKPIGHDSDSARDILQSIGALIDEDRVFRLDHYLGKAAVQNLIALRFGNTLLEAVWNRTYIESVQILVAESEGVDGRDAYYARSGALRDMVQSHILQLLCLVAMEPPASLEADRIRDEKVKVLRALRPMTAEHAAHDCVRGRYTAGSINGQPAQAYHPPEGSDVETFVAVTAHIDNWRWAGVPFHLCTGKRLAERSTRIVVTLKPVTHWLFERPDRQNAVPNRLTFQLQPQENIELGLMSSLAGPEWGAIELQPLELELSVPTGLHRRIAYERLFVDAFNGNPALFVRDDEVKAAWSWIDSVSDAWKDAALPLQPYPAGSWGPESAAHFLPPATDAQGNNA

SEQ ID NO: 2602 - DNA, 1458 bp, Thermoanaerobacter tengcongensis
  CDS (1)..(1458)
atgaaagataaagacctttcaaacgtgatggtcatattcggtggaacaggagatttaacccataaaaaattgatgccggccctttacaacttaagatatcaaaatatcctgcctgaaaattttgctgtagttgctatagggagaagagacaagactgaagaggaatatagaaatgagatgctggagtctgttaaaacttattctagatttgacattgacgaaaaaatctggcaagatttaagtagcaggatattctacaaaagatttgattttaactatgacaacggatatatggaacttagttactttttagatgaactggataggaaatacaatacacagggcaacagggtatattatcttgcagttgcaccggaatattttggcatcattgtggaaaagttatacagacacggaatggtaagtaatgaaacttcatggcagagagtagttatagaaaagccttttggagaaaatttagaatctgcccggaaactaaataaaatgataacagatgtctttacagaaagaaatacttatagaattgatcactatttaggaaaagagatgctacagaatataatggtcatcagatttgccaatgtgttttttgagccagtttggaacagaagatatatagacaatgtgcaaatttcttctaatgagacggtagggatagaaaatagaggaggatactacgagaaagcaggagctttgagggacatggttcaaaaccacatgatgcagcttctgaccttgacggcgatggaaccacctgtaaatttggatacagaatctataagggatgagaaggtgaaggttttaaaatccttagagattatgactcctgagcttgtagagaaaaatgtggtgagagggcagtatgtgggatataggcaggaggaaaaagtatctccaacttccaatacagagacttttgtggcattaaaagtgcacatagaaaatttcagatgggcaggagttcctttttacatcaggactggaaaaaggatgccggaaaaatccacacagattgtcatccaatttaagcctctgccaggtattttgtatttcaaagagtataaaaatttgcttcccaatttgcttgtaataaaaattcagccggaggaaggagtaaaacttcagtttaatgccaaagtgccgggagcaggagatataactatagagcctgtaaatatggatttttgtcagaactgccagatatccaataattctccagaggcatatgaaagacttctttttgatgtgatgagaggagattctactttatttactcgctgggatgaggtagaatattcttggaggtttgtagatgctattgctaaagcatgggcagaaaaaacacccgattttcctaattactatccagggacctggggtcctagtgaggcagaagagcttttgagaagagatggaagaatgtggtggaatgtatag

SEQ ID NO: 2603 - protein, 485 aa, Thermoanaerobacter tengcongensis
MKDKDLSNVMVIFGGTGDLTHKKLMPALYNLRYQNILPENFAVVAIGRRDKTEEEYRNEMLESVKTYSRFDIDEKIWQDLSSRIFYKRFDFNYDNGYMELSYFLDELDRKYNTQGNRVYYLAVAPEYFGIIVEKLYRHGMVSNETSWQRVVIEKPFGENLESARKLNKMITDVFTERNTYRIDHYLGKEMLQNIMVIRFANVFFEPVWNRRYIDNVQISSNETVGIENRGGYYEKAGALRDMVQNHMMQLLTLTAMEPPVNLDTESIRDEKVKVLKSLEIMTPELVEKNVVRGQYVGYRQEEKVSPTSNTETFVALKVHIENFRWAGVPFYIRTGKRMPEKSTQIVIQFKPLPGILYFKEYKNLLPNLLVIKIQPEEGVKLQFNAKVPGAGDITIEPVNMDFCQNCQISNNSPEAYERLLFDVMRGDSTLFTRWDEVEYSWRFVDAIAKAWAEKTPDFPNYYPGTWGPSEAEELLRRDGRMWWNV

SEQ ID NO: 2604 - DNA, 1446 bp, uncultured proteobacterium
  CDS (1)..(1446)
atgaccggagtcgacctaattatttttggcgcttccggagacctttcagcaagaaagctctttcccgcactgtttcaactcgaccgcgccgaattactgcccagcgacctgcgcatcacagcaattgctagagatcaggtcgacgtaaatacttttttggaaggcctaagacagcgaatgcatgcctacatgggctctgagtcgccttccgatgccgagtggcagcactactcacgacattttcaatatgtgggcgccgacttcgccaacgctgacagctattccagtatcagggcaactctagatgatacccgtatcagcttattttacttggctacaccacccagcatcttcgccctaatttgcaacaatctggccactaataattgcctcaccggcgactgccgaatcgtactcgaaaaacccattggcgaatgtctagcctcgtcaaaggaagtcaatgaaacgctggctcgctactttgacgaaggatctatttatcgcatagatcactacctgggaaaggagaccgttcagaacttactcgcgctgcgctttgcaaaccgatttattaatagtcagtgggatgccaactgtatcgaccatgttcaaatcaccgtcggcgaaatcgtcggtattgagggtcgctggtcttactatgaccgcgttggccagctccgcgacatggttcaaaaccaccttatgcagttactctgtctcgtcgctatggagccccccaatagcctagaagccgatagcatccgcgacgaaaaagtcaaaatcgtcaaggccttgagacgcatcgactctgatcaggtctctgagcacgtgattaaagggcaatacagccagggttggtcttcaggtgcggccgtgcctgggtaccttgaggagcccggttgtgagcgcccggacagcgataccgagacgtttatcgcgatcaaagctcatgtagacaactggcgctgggccggcgttccattttacctgcgaacaggaaaacgcgttcctgaaaaattaactgaaatcatcattcagtacaaagaccttccccacaacatttttagcggcggcaccagcgcgaacaagttaatcattcggttacagcccagggaaggcatcgagctaacaatggcatcgaaacgccagacgctgcgagaaaaactgtccttacagaaccataccttggatttagattttcgggaaaccaccggcatgaatcgaattcccgacgcctacgaacgattatttcttgatgcaattaatggcgatcagtcgctgtttgtaggtcgagaggagatcgaagaaagctggcgctggtgtgatgaactgattgacgcctgcaaccaaaagaacatagagaccaagccctatcacgctggatcttggggcccacctaaagccgagcttttaattgaaaaggatgggcgtagctggcatgtctga

SEQ ID NO: 2605 - protein, 481 aa, uncultured proteobacterium
MTGVDLIIFGASGDLSARKLFPALFQLDRAELLPSDLRITAIARDQVDVNTFLEGLRQRMHAYMGSESPSDAEWQHYSRHFQYVGADFANADSYSSIRATLDDTRISLFYLATPPSIFALICNNLATNNCLTGDCRIVLEKPIGECLASSKEVNETLARYFDEGSIYRIDHYLGKETVQNLLALRFANRFINSQWDANCIDHVQITVGEIVGIEGRWSYYDRVGQLRDMVQNHLMQLLCLVAMEPPNSLEADSIRDEKVKIVKALRRIDSDQVSEHVIKGQYSQGWSSGAAVPGYLEEPGCERPDSDTETFIAIKAHVDNWRWAGVPFYLRTGKRVPEKLTEIIIQYKDLPHNIFSGGTSANKLIIRLQPREGIELTMASKRQTLREKLSLQNHTLDLDFRETTGMNRIPDAYERLFLDAINGDQSLFVGREEIEESWRWCDELIDACNQKNIETKPYHAGSWGPPKAELLIEKDGRSWHV

SEQ ID NO: 2606 - DNA, 1762 bp, Oryza sativa
  CDS (41)..(1558)
ggtatattgctgaaggaagaagagcaccaacctatttatcatgtcaggaggatcttcaccaaggtcaagacgaagcagctttaattctttatcaagagatctcgaactcccttcagagcaaggttgtctctctgttattgtcctcggggcttctggagacctagccaagaagaaaactttcccggcactcttccatctttttgcacagggatttatacaatcaggtgaagtgcatatatttgggtatgcgagatcaaacctttctgatgatgggttaagggaacgcattcgtggatacctcaaaggagcctcagaagaacatctctcagactttttgcaacatataaaatatgtcagtggttcctatgacagcggagaaggatttgagaaattgaacaaggaaatttcagagtatgagaagtcaaacaaatcagaaagccctcgcaggctcttctatttggcattgcctccatctgtctacccttcagtctgcaaaatgatcagaacatattgcatgaatccatctggatggactagagtcattgttgagaagccatttggaaaggacttggactcttcagaagaattaagtgcccaacttggggagctatttgacgaaaaccaactctacagaattgatcactacttgggaaaagagttggtccaaaacctgcttgtgcttcgttttgccaaccgcttgttcttgcctctttggaaccgcgacaatattgataatatacagattgtattcagggaggactttgggactgacgggcgtggtggatattttgatcaatatggaatcattcgtgacatcatccagaaccatttgttacaggttttctgtttggttgcaatggaaaagcctgtctctcttaagcctgagcacattagagatgagaaagtcaaggttctgcagtccgtgaaccctataaagcatgatgaggttgtccttggacaatacgaggggtacaaggatgaccctacagtgccagatgactcaaacaccccaacttttgcatctgtcgtgtttcgggtacacaatgaaagatgggagggtgttcctttcattcttaaagctggtaaagcactaagctcaaggaaagcagaagtccgtgtgcagttcaaagatgttcctggtgacatctttaaatgtaaaaggcaaggaagaaatgagtttgtcatacgccttcagccatcagaagccatgtacatgaaacttactgtcaaaaaacctggattggagatggccaccgagcagagtgaacttgatctgtcatacgggatgcggtaccaaaacgtcaaaattccagaggcatgcgagcgtctcatattggatacgatacgaggagaccaacagcacttcgttcgccgagatgagctgaaggctgcttggcagatcttcactcccctgctgcacgacatcgacgaaggcaaggtgaagtctattccataccagcctggcagccgaggccccaaggaagccgatgaactgagcgagagggttgggtatatgcagacccacggttacatatggataccacccacccttgcatagacagacagacagacagacagtagtattgtttagctaggaagagtgcctctaaactgttattattgcggatatattcgtttcatattttcacgataacgcctgactagtgactacctggcgttgtaataatgtgttgcttcgtaagtataactgctattgtgaaataaaagtgcatgtttcgatcaaaaaaaaaaaaaaaaaaaa

SEQ ID NO: 2607 - protein, 505 aa, Oryza sativa
MSGGSSPRSRRSSFNSLSRDLELPSEQGCLSVIVLGASGDLAKKKTFPALFHLFAQGFIQSGEVHIFGYARSNLSDDGLRERIRGYLKGASEEHLSDFLQHIKYVSGSYDSGEGFEKLNKEISEYEKSNKSESPRRLFYLALPPSVYPSVCKMIRTYCMNPSGWTRVIVEKPFGKDLDSSEELSAQLGELFDENQLYRIDHYLGKELVQNLLVLRFANRLFLPLWNRDNIDNIQIVFREDFGTDGRGGYFDQYGIIRDIIQNHLLQVFCLVAMEKPVSLKPEHIRDEKVKVLQSVNPIKHDEVVLGQYEGYKDDPTVPDDSNTPTFASVVFRVHNERWEGVPFILKAGKALSSRKAEVRVQFKDVPGDIFKCKRQGRNEFVIRLQPSEAMYMKLTVKKPGLEMATEQSELDLSYGMRYQNVKIPEACERLILDTIRGDQQHFVRRDELKAAWQIFTPLLHDIDEGKVKSIPYQPGSRGPKEADELSERVGYMQTHGYIWIPPTLA

SEQ ID NO: 2608 - DNA, 1305 bp, Encephalitozoon cuniculi
  CDS (1)..(1305)
atgaaggtcgttatcttcgggtccagtggcgatcttgcaaaaagaaagctttttcctgcactctctcggattgacttggagggtgtcggggtggttggctatgcaaggaccaagtacaacatcgagttttcggaagttcttcaggaggtcgggaactactcgccggaatttctttcgaaggtcacctacattccagggccctacgatgacctttcgaagcttaaagaggtctcagactcggagactgtgctgtacttttcagttccatcctctgtgtacacttgtttattcagagagatatcgaagcttgactacaaggtgattggagtcgagaagccatatggagatagcattgagtcgtttatggagataaaggggtttgatctggggaagaccaggtttattgaccactatcttctgaagccgcttgtggtggctatgcctgggattataagggagacgggggcgattcgagaggtgatgagcaacagatatgtgaagagtgttgagatagtctcgaaggaagttcttgggggagagggaagacactacttcgataagaacggaattataagggacatggtcctgagccacatgggcgagcttcttggggttgttgcgtctgacgtaacaaagccatcgaggattatggaagcattggcgagaatggaggttttcaaggcatgcaccgtcgacaccgagagatgcatttatgggcagtatgacgactatattaaggagattcacaaggactcgagtacggagacgttctgcatggttcccataagcatagggactccccgctggtctaaggttcccttcatcattgttgcagggaaggggatgaacgaaaagagaacagagataatacttgagtttcgaagagatgtatttgcgaagtgcattgagctgttttctatgccgaggcaatcttcgtgcaggattgttcacaccaacgaaatagaaacggttcgactggtctttaatatatatcctgaatgcgaagtatttctggaagttctcgtgggaggggagcctgtccggtatgttctgcatgacaagaaagagattgatggcctgatgcatgacagttatggaggataccatgactatgagatcatctttgacagtcttgtaagaggcaaggactttagcagcgtgagctctcaggaggcagagcttctgtggaaggtgtttaaccccatactatctattagcaaagaggacatgctgttctactattctaagggaattgacatgcctaaggaagctgaagaaatgatcagggaaattaaagaccattag

SEQ ID NO: 2609 - protein, 434 aa, Encephalitozoon cuniculi
MKVVIFGSSGDLAKRKLFPALSRIDLEGVGVVGYARTKYNIEFSEVLQEVGNYSPEFLSKVTYIPGPYDDLSKLKEVSDSETVLYFSVPSSVYTCLFREISKLDYKVIGVEKPYGDSIESFMEIKGFDLGKTRFIDHYLLKPLVVAMPGIIRETGAIREVMSNRYVKSVEIVSKEVLGGEGRHYFDKNGIIRDMVLSHMGELLGVVASDVTKPSRIMEALARMEVFKACTVDTERCIYGQYDDYIKEIHKDSSTETFCMVPISIGTPRWSKVPFIIVAGKGMNEKRTEIILEFRRDVFAKCIELFSMPRQSSCRIVHTNEIETVRLVFNIYPECEVFLEVLVGGEPVRYVLHDKKEIDGLMHDSYGGYHDYEIIFDSLVRGKDFSSVSSQEAELLWKVFNPILSISKEDMLFYYSKGIDMPKEAEEMIREIKDH

SEQ ID NO: 2610 - DNA, 2125 bp, Drosophila melanogaster
  CDS (158)..(1738)
gcgatttttgcctcagtctatacctccaggcaatatctatcactaatcttttttaaattacaactatttattcttggccaaaatttgacgttaccttgctttcttttattctctcaaaattatactttacccgaaatgatttccatggacccccacaatgaggaggcgtattccatcgtggtcttcggagcctcaggcggattggccaaaaagaaggtgtttccggcgctttgggctctcttccgggagaatcggctgccccagggcaccaaaatatttactttcacccggtccccgctgcagacgaagacgtaccggttgcagattcttccctatatggagctggacaagcatcgggaccccaagaagtacaacctctctttggacgaccgtgcactgtgtgcagggcgagtacgacaagccggagaactacgtggcactcacggaggcgatggtacaccaggagacaaagcacaatcaggtgcgcgcgaatcgaatcttctacctggcgctgccaccgatcgttttcgatcaggtgaccctcaatgtcagtcgaaaatgcagctcgaccacgggatggaaccgcataatagtggagaagcccttcgcgcgggacgacatctcctacaaggcctttcaaacctcgctgtgcaactgcttccgggagtcgcagatttacctgatggaccacctcctcagccggcaggtgatgcagaacttctttgcgctgcgctattcaaaccacttgtgggccgagaccctgaaccaccgccacgtggcggcggtgatgatatccataaagtgtgagctgccggtgtcggtgaatcgggcagactactttaatcagtttggcattattcgcgacctgatgaccaaccacatgatccagatgctggccatgctggctatggatcagccgtacgccaacactgctgacgacctgcgtgccgaacggctgaaggttcttcgccaggtgctaactcccaacataggcgacgtcgtcttggctcaataccgcaacaaccggcgggagactgaccccgcgaagtgcggctacacggagcacacctacatcccgaaggactcctttacgcccacattcgctctggtggtgctgcacatcaacaaccgccgttggaccggggtacccttcattctcagagcgggaaaggccttgaacgacaccaagtcggaggtgcgtatccagtacaagccggtggactgcgacaccttccacagcgacagtactgacattcgtaacgagctagtcctgagatccttccccacggaagaggtctttatgcgcatgcgcctcaagcggcagggcgaggatatctgccttcgggagagcgagatcaacctgcgagtggatgatcggggaccgaagggactccaaggactgcccggctacctgctcaacgtgtttcaaggcgaccagacgctcttcatgcgctccgatgagcagtgcgagatttggcgcatattctcccccgttctcgccaccatcgattcggatcgtccccgcccgttgcactatgactttggatcacggggtcctttgctggcctatcgcaaggccgagcgcgctggcttcgtattcttcgccacggacgagtggcatcagagcgaagagacgttagaatacacggtcaagaagagcaagcagctaatcggaccccataccgccctcaagccagtaagagatcctcggtccaagaggtcgaattccaatccttaggcgtagggagatagttaaagcttatacgaaagttttttaattaagcaagtgcagcctgctgtgttacaccagttggccaccacttcaccttggctgcccagtctaacccttcaccgctgtccgttccattcggttctaatccgttccgtgccattgttgcccatgttgccggtgaggatttcgccaagaggggcgtaaacaacacgcaagtcttggccattgtcctttgcagataggggtgagatgcactatagtgtatgggaactacgtaattctctataaatttatatctacttatatttgtacatacaaaattgttttcagtttaataaaaattttatttaaattacaaaaaaaaaaaaaaaaaaaaaaaaaaaaaaaaaaaaa

SEQ ID NO: 2611 - protein, 526 aa, Drosophila melanogaster
MRRRIPSWSSEPQADWPKRRCFRRFGLSSGRIGCPRAPKYLLSPGPRCRRRRTGCRFFPIWSWTSIGTPRSTTSLWTTVHCVQGEYDKPENYVALTEAMVHQETKHNQVRANRIFYLALPPIVFDQVTLNVSRKCSSTTGWNRIIVEKPFARDDISYKAFQTSLCNCFRESQIYLMDHLLSRQVMQNFFALRYSNHLWAETLNHRHVAAVMISIKCELPVSVNRADYFNQFGIIRDLMTNHMIQMLAMLAMDQPYANTADDLRAERLKVLRQVLTPNIGDVVLAQYRNNRRETDPAKCGYTEHTYIPKDSFTPTFALVVLHINNRRWTGVPFILRAGKALNDTKSEVRIQYKPVDCDTFHSDSTDIRNELVLRSFPTEEVFMRMRLKRQGEDICLRESEINLRVDDRGPKGLQGLPGYLLNVFQGDQTLFMRSDEQCEIWRIFSPVLATIDSDRPRPLHYDFGSRGPLLAYRKAERAGFVFFATDEWHQSEETLEYTVKKSKQLIGPHTALKPVRDPRSKRSNSNP

SEQ ID NO: 2612 - DNA, 1470 bp, Ralstonia solanacearum
  CDS (1)..(1470)
atgtcggtgcccgcattcgacatggtgttgtttggcggtacgggtgatctggcccgccgcaagctgattccggccttgttcgatgcgcaccaggggggcgagctccattcgcgcgggcggatctttgccatcggcacccagccgctggagaccgccggttacctggccctgctcgagcgggaggtgcgccccaccatgcgcctgtattccggcgcgcccgtgtcggacgatgcctgggcctctttcgtcgcccgcatcgtctaccagcaggtcgatgcccgcaagccggaacagttcgatgccctggccgccgcgctgggcgagaaccgcgccccggtcaccgtgtgctacctggccaccgcgcccggcattttcgtcgacatctgcgcgcagcttgcccgcgtcggcctgaacacgcccaacgtgcggttggtgctcgagaagccgctgggcaccgacctggcctccaacgagcgcatcaattcggccgtggccgagttctttgccgaagaccagatctaccggatcgaccactacctcggcaaggagtcggtgcagaacctgatggcgatccgcttcggcaacgcgctgttcgagccgctgtggcgccgcgagtggatcaaggacgtgcagatcaccatcgccgagcagctcggcgtggagaagcgcggcgacttctacgacggcgtcggcgccctgcgcgatatggtgcagaaccacctgctgcagctggtgtgcatcgtcgccatggagccgcccgccagcctgtcgcaggacgccatccgtgacgagaagctgaagatcctcaaggcgctcaagccgatcccgctgcaggaggtgcccgagaagaccgtgcgcggccagtatctggagggcgccatcgccgggcagccggtgcagggctacctggacgagcacggcattccgcatgacagccgcaccgagaccttcgtcgccatcaaggccgagatcgccaactggcgctgggccggcgtgccgttctacctgcgcaccggcaagcgcatgccgcagcggctggcggagatcgtggtgcgttttcatgacgtgccgcacgcgctgtttcccaagccgctggtccagttccccgagaaccgcctggtgatccgcctgcagccggaggaaagcatccgcctgcagttcctgaccaaaacgccgggcgcggcactgggcctgcagccgtccacgctggacctggatttcaccaaccacggcggcgtgcgccacgccggcgcctacgagcgcctgctgatggacgccgtcaacggccagcttggcctgttcgtgcgccgcgacgagcaggccgaggcctggcgctgggtcgagcccatcatcgaggcatggaaccaggcccgcacgccgcccaagggctacacggcgggcagctgggggccggccgcttccagcgcgctgctctcacgcgatgccgctgcctggcacgaggagatgtga

SEQ ID NO: 2613 - protein, 489 aa, Ralstonia solanacearum
MSVPAFDMVLFGGTGDLARRKLIPALFDAHQGGELHSRGRIFAIGTQPLETAGYLALLEREVRPTMRLYSGAPVSDDAWASFVARIVYQQVDARKPEQFDALAAALGENRAPVTVCYLATAPGIFVDICAQLARVGLNTPNVRLVLEKPLGTDLASNERINSAVAEFFAEDQIYRIDHYLGKESVQNLMAIRFGNALFEPLWRREWIKDVQITIAEQLGVEKRGDFYDGVGALRDMVQNHLLQLVCIVAMEPPASLSQDAIRDEKLKILKALKPIPLQEVPEKTVRGQYLEGAIAGQPVQGYLDEHGIPHDSRTETFVAIKAEIANWRWAGVPFYLRTGKRMPQRLAEIVVRFHDVPHALFPKPLVQFPENRLVIRLQPEESIRLQFLTKTPGAALGLQPSTLDLDFTNHGGVRHAGAYERLLMDAVNGQLGLFVRRDEQAEAWRWVEPIIEAWNQARTPPKGYTAGSWGPAASSALLSRDAAAWHEEM

SEQ ID NO: 2614 - DNA, 1521 bp, Enterococcus mundtii
  CDS (1)..(1521)
atgaatgaaaaaaacgtattatttactatatttggcggtacaggagatttagcacaacgtaaattgtatccttccctttttcgtttatacaaaaagggcaacttgagcgaacattttgctgtgatcggtacagcacgtcgtccttggagcgatgaacactatcgtgaagtggttaaaggaacaatcaaaacattgaatccttctgccgaagaagccgaacgatttgccagccatttttattatcaatcccatgatgtcaatgattcttctcattaccaaacattaaaagaattatctgatcgtttagatgaaaaataccacttgaatggtaatcgaatgtactatttagccatggctccacaatttttcggtacgatcgtttcacatttgaaatctcagaaaatcatcactgaagctggcttcaaccgattgattatcgaaaaaccttttggttctgatttccattctgcctttgaattgaatgaaaaaattcgacaagtctttccagaagatgatattttccgtattgaccattatttaggtaaagaaatgatccaaaatatctctgcgattcgctttgccaataatatttttgagtctcaatggaacaatcgttacatcgacaacatccaaatcacttttggtgagagtttaggtgttgaagatcgtggcggctattatgaccacagtggtgcgttaaaagatatggtccaaaatcatatccttcaagtattagctttacttgcgatggaaccaccagttgccttttccgaaaaagaaatccgatcagaaaaaatcaaagcgttaaaagctattcgtatttatgaaaaaaaagaagtcttagaaaattttgtacgtgggcaatatgctgcaggtcaattagatgatcagacattcaaaggctatcgtgaagaagacaacgttgatccagaatcaacaactgaaacatttgttgctggaaaattcacgatcgataacttccgttggtctggcgtaccgttttatgtacggactgggaaacgtcttactgaaaaaggtacacgaatcaatatcgtctttaaacaagtacctgtcaatgtatttaaaacatcgatcgacgaaccttgtaatgatccaacgttaccaccaaatgttttgactatctatattcaaccaacagaaggtttttcatttacattaaatggaaaaaaagttggtcaaggcttcgccaccgatccaatcaaactggaatatcgcaatagtgctgaaatggtcgaaaatagtcctgaagcgtatgaaaagcttatgttagatgcattgaacggtgatagtacaaacttctctcattgggaagaagtcgcacaatcttggcatatcgttgacgtgatccgccaagtttgggatcaagtacaaccggatttcccgaattataaagctggttctatgggtcctgaagcagcattcgagcttttagaaaaagacgggttcgaatggatctggcaaccagatcattggtaccgtgaacgtggtaaattggattag

SEQ ID NO: 2615 - protein, 506 aa, Enterococcus mundtii
MNEKNVLFTIFGGTGDLAQRKLYPSLFRLYKKGNLSEHFAVIGTARRPWSDEHYREVVKGTIKTLNPSAEEAERFASHFYYQSHDVNDSSHYQTLKELSDRLDEKYHLNGNRMYYLAMAPQFFGTIVSHLKSQKIITEAGFNRLIIEKPFGSDFHSAFELNEKIRQVFPEDDIFRIDHYLGKEMIQNISAIRFANNIFESQWNNRYIDNIQITFGESLGVEDRGGYYDHSGALKDMVQNHILQVLALLAMEPPVAFSEKEIRSEKIKALKAIRIYEKKEVLENFVRGQYAAGQLDDQTFKGYREEDNVDPESTTETFVAGKFTIDNFRWSGVPFYVRTGKRLTEKGTRINIVFKQVPVNVFKTSIDEPCNDPTLPPNVLTIYIQPTEGFSFTLNGKKVGQGFATDPIKLEYRNSAEMVENSPEAYEKLMLDALNGDSTNFSHWEEVAQSWHIVDVIRQVWDQVQPDFPNYKAGSMGPEAAFELLEKDGFEWIWQPDHWYRERGKLD

SEQ ID NO: 2616 - DNA, 2630 bp, Homo sapiens
  CDS (474)..(2021)
agggacagcccagaggaggcgtggccacgctgccggcggaagtggagcctaccgcgagcgcgcgaggccgccggggcaggcggggaaaccggacataggggcggggccgggccggcgatggggatgcgggagcactacgcggagctgcacccgtgcccgccggaattggggatgcagagcagcggcagcgggtatggcaggcagccggcgggccggcctccagcgcaggtgcccgagaggcaggggctggcctgggatgcgcgcgcacctgccctcgccccgccccgcccgcacgaggggtggtggccgaggccccgccccgcacgcctcgcctgaggcgggtccgctcagcccaggcgcccgcccccgcccccgccgattaaatgggccggcggggctcagcccccggaaacggtcgtacacttcggggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacaagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagcc

SEQ ID NO: 2617 - protein, 515 aa, Homo sapiens [sequence omitted]

SEQ ID NO: 2618 - DNA, 1491 bp, Pasteurella multocida
  CDS (1)..(1491)
atgaaaattgaagcagacaacaattgtattgtaatttttggtgcatcaggtgatttaacttatcgtaaattgattcctgcactgtataacttatataaaatcggtcgtttgactgagcatttctccgtgttaggtgtggcaagaacggaattaagtgatgagggtttccgtgaaaaaatgcgccaagcgttgatcaaaagtgaaaaagcgaatggcgaaacactcgatcaattttgtagccacctttattatcaggcattaaataccgcggatgctgccgattatggcaagttaattcctcgtcttgatgatttacatgataaatatcaaacctgtggtaacacactttactatttatccacgccgccaagtctttatggtgtgattccagaatgtcttgcggcacatgggttaaatactgaagagtttggctggaagcggttaattgtggaaaaaccgtttggttatgatatccgcacggcaaaagaactcgatattcaaattcaccgtttctttgatgaacaccaaatttatcgtattgaccactatcttggtaaagaaacggttcaaaatctgctcgtgctgcgtttttctaatggatggtttgaaccactctggaaccgtaattttattgattatattgaaatcacgggcgcagaatctatcggtgtagaagagcgtggtggttattacgatgattctggcgcaatgcgtgatatgttccaaaaccatttgttgcaagtgttagccatggttgcgatggagccaccggcaattattaatgctgactcaatgcgtgatgaagtggcaaaagtcttgtattgtttacatccattaagtgaggatgacttagaaaatcatttagtcttagggcaatatacggcaggcacagttgaaggtgaagcagttaagggctacttacaggaaaaaggtgtaccggcagagtctaatacggaaacttacatggcattacgctgtgaaattgacaactggcgttgggcgggtgtgccattttatgtgcgtactgggaaacggttaccaagtcgagtgaccgaaattgtgattcatttcaaaaccacaccacatccggtatttagccaaaaagcaccagaaaacaaattaattatccgtattcaacccgatgaagcgatttcgatgcgttttggtttgaaaaaaccgggagcaggttttgaagcaaaagaagtgtcgatggatttccgttatgcggatcttgcctcaccaagcttactgaccgcttatgagcgtttattattggattctatgaaaggcgatgccactttgtttgcgcgtactgatgcggtacatgcctgttggcagtttgtggagccgattttacaatataaagcacaaaatgggcgtgtttatgagtatgaagccggtacttggggaccgacagaagccgacaaactgatcgcgaaaacgggtcgtgtttggcgtaaaccaagtggattaatgaaaaagaaagtgtaa

SEQ ID NO: 2619 - protein, 496 aa, Pasteurella multocida
MKIEADNNCIVIFGASGDLTYRKLIPALYNLYKIGRLTEHFSVLGVARTELSDEGFREKMRQALIKSEKANGETLDQFCSHLYYQALNTADAADYGKLIPRLDDLHDKYQTCGNTLYYLSTPPSLYGVIPECLAAHGLNTEEFGWKRLIVEKPFGYDIRTAKELDIQIHRFFDEHQIYRIDHYLGKETVQNLLVLRFSNGWFEPLWNRNFIDYIEITGAESIGVEERGGYYDDSGAMRDMFQNHLLQVLAMVAMEPPAIINADSMRDEVAKVLYCLHPLSEDDLENHLVLGQYTAGTVEGEAVKGYLQEKGVPAESNTETYMALRCEIDNWRWAGVPFYVRTGKRLPSRVTEIVIHFKTTPHPVFSQKAPENKLIIRIQPDEAISMRFGLKKPGAGFEAKEVSMDFRYADLASPSLLTAYERLLLDSMKGDATLFARTDAVHACWQFVEPILQYKAQNGRVYEYEAGTWGPTEADKLIAKTGRVWRKPSGLMKKKV

SEQ ID NO: 2620 - DNA, 1470 bp, Pseudomonas putida
  CDS (1)..(1470)
atggctgcgatcagtgtcgatccttgcacgtttgccctgtttggcgcccttggcgacctggcgttgcgcaagctgtttcctgcgctctaccagctcgaccgggccaacctgctgcacccggacacccgcctgctggcgctggcccgcgaggcaggcagcgcgcaggagcacctgaacagcatcgaagcccacctgcgccggcatgtgcccgaggccgatatcgagcctgctgcattgggccgcttcctggcccggttgagctaccagcacctggacttcctgcaacctgagggttaccgggccctggccgagcagttgccgggcgacctgccgctgatcgcctacttcgccacggcggcagcggtgtacggggccatctgcgaaaacctcgacaacgccgggctggccccgcgtacccgggtggtgctggagaagcccatcggccacgacctggagtcgtcgcgacgggtcaacgatgccgtggcgcggttcttccccgaaaaccgggtgtaccgtatcgaccactatctgggcaaggagacggtgcagaacctgattgccctgcgcttcgccaatagcctgttcgaaacccagtggaaccagaattccatctcccacgtggagatcaccgttgccgagaaagtcggtatcgaaggccgctggggctacttcgacaaggccggccaactgcgcgacatgatccagaaccatctgctgcagttgctgtgcctgatcgccatggacccgcccagcgagctgtccgccgatgccattcgtgacgagaaggtgaaggtgctaaaggccctggcgccgatcacgggcgagggtttgagcacccaagtggtgcgtggtcagtatattgccggctacagcgagggcaagccggtacctggctacctggaagaggacaacgccaacgcccgcagcgacaccgaaaccttcgtcgccctgcgtgccgatatccgcaactggcgctggtcgggcgtgccgttctacctgcgtactggcaagcgcatgccgcagaagctgtcgcagatcgtcatccacttcaaggaaacgccgcactacattttcgccccggaacagcgtttgcaaatcggtaacaagctgatcattcgcctgcaaccggacgaaggcatttctttacgggtgatgaccaaggagcagggcctggacaaaggcatgcaactgcgcagcggtccgttgcagcttaatttttctgacacctggcgcagtacgcggattccggatgcctacgagcgcctgttgctcgaagtgatgcgtggcaaccagaacctgttcgtgcgcaaggacgaaatcgaatatgcctggaagtggtgcgaccagttgatcgccggctggcgtaatgcgggcgatgcgcccaagccttacgcggcgggctcctgggggccgatgagctcgattgcattgattacacgcgatgggagggcgtggtatggggatatctga

SEQ ID NO: 2621 - protein, 489 aa, Pseudomonas putida
MAAISVDPCTFALFGALGDLALRKLFPALYQLDRANLLHPDTRLLALAREAGSAQEHLNSIEAHLRRHVPEADIEPAALGRFLARLSYQHLDFLQPEGYRALAEQLPGDLPLIAYFATAAAVYGAICENLDNAGLAPRTRVVLEKPIGHDLESSRRVNDAVARFFPENRVYRIDHYLGKETVQNLIALRFANSLFETQWNQNSISHVEITVAEKVGIEGRWGYFDKAGQLRDMIQNHLLQLLCLIAMDPPSELSADAIRDEKVKVLKALAPITGEGLSTQVVRGQYIAGYSEGKPVPGYLEEDNANARSDTETFVALRADIRNWRWSGVPFYLRTGKRMPQKLSQIVIHFKETPHYIFAPEQRLQIGNKLIIRLQPDEGISLRVMTKEQGLDKGMQLRSGPLQLNFSDTWRSTRIPDAYERLLLEVMRGNQNLFVRKDEIEYAWKWCDQLIAGWRNAGDAPKPYAAGSWGPMSSIALITRDGRAWYGDI

SEQ ID NO: 2622 - DNA, 1566 bp, Trypanosoma brucei
  CDS (1)..(1566)
atgcagaattgtagaaaggttgcagacactctcaggaaggattcatgcgacatcatcccggatgctgctgcacctgaattgaaggaaagagcacttactattgtcgtgcttggggcaagcggtgacttggcgaggaataaaacgttcccggcgctgtttcaactattctgtaacggattaattccgcgaacgattaacattgtcggctacgctcgcaccaaaatgcctgacgtggagcaatggaaaaaagagagcctagctaagcattttcctcgggctaaggatcgctgcccccatattgaggctttcttgaagacaatcacctatatctcgggctcgtatgacggtgcggatgatttttttcgtcttaacgacgtgataacaaaatttgaggagtcgtttccaggaaaacagaaaggaggcaacaggttgttctaccttgcgttaccaccttctgtatttatgcatgcgtgcacggggattcgcactcatgtgatgcagaaaccgggcctggggtgggttcgaataattattgaaaagccattcgggcacgacacggaaagttctaatgaactttcgaggcagttggagcctcttttcgaagaatcccaaatttttcgaatcgatcattatcttgggaaggaaatggtgcaaaatattgttgtcacccgcttcgccaaccgtgttttcagtgcactatggaacaataataacatcgcgtgcgtccggatcacttttaaggagtctatcgggacggagggccgcggtggttactttgacaaggcgggtattatccgcgacgtggtgcaaaaccaccttacccagatcctttcactgttagcaatggagaaaccacgctcactaagcccagaggatatacgtgatgaaaaggtaattgtactaaggcatgtgaatcccgtgactcccgccgactgcgtgttgggacagtacacgaggtctgaagacggttctattcctggttacctggaggatccaacggtgccgaggggaagtaaatgcgcgacattcgtggtacttcgactgttcattaacaacgaccgctgggacggtgtgccattcatcatagaggcggggaaagcggtggagcggcgctatctcggcatacgcatccagtttaaggatgaaatccgcccctttggagttgccgcacagcgcaacgaactgatcatacgagcgcagccctcggaggcaatgtatttgagacttaccgcaaaaacacccggcgttctctcagacactcaccagaccgaacttgacctctcctacgaacatcgttacaacataactctgccagatgcctatgagagcctcattcacgaagcacttctggggaggtccaccaatttcgttcgaaaggatgaactcgatgccgcgtggaggatctacacaccactcttggaggctattgaacgtggagaaaccacaacgtacccctactccgctgggtcaaaggggccggcggaagcacaaaagtttgttgatgacactgggtttaaacctctcacaggggatatttaccagcagcggaagcttcatcatttgtaa

SEQ ID NO: 2623 - protein, 521 aa, Trypanosoma brucei
MQNCRKVADTLRKDSCDIIPDAAAPELKERALTIVVLGASGDLARNKTFPALFQLFCNGLIPRTINIVGYARTKMPDVEQWKKESLAKHFPRAKDRCPHIEAFLKTITYISGSYDGADDFFRLNDVITKFEESFPGKQKGGNRLFYLALPPSVFMHACTGIRTHVMQKPGLGWVRIIIEKPFGHDTESSNELSRQLEPLFEESQIFRIDHYLGKEMVQNIVVTRFANRVFSALWNNNNIACVRITFKESIGTEGRGGYFDKAGIIRDVVQNHLTQILSLLAMEKPRSLSPEDIRDEKVIVLRHVNPVTPADCVLGQYTRSEDGSIPGYLEDPTVPRGSKCATFVVLRLFINNDRWDGVPFIIEAGKAVERRYLGIRIQFKDEIRPFGVAAQRNELIIRAQPSEAMYLRLTAKTPGVLSDTHQTELDLSYEHRYNITLPDAYESLIHEALLGRSTNFVRKDELDAAWRIYTPLLEAIERGETTTYPYSAGSKGPAEAQKFVDDTGFKPLTGDIYQQRKLHHL

SEQ ID NO: 2624 - DNA, 1904 bp, Triticum aestivum
  CDS (153)..(1682)
aattcgattgccacccccctccccattcctacccacccagcatctcggcagtaactctcctccctcccacgcggcgcgcccgctcgccgcgcgcgcgaatctcggtcgcaactggtgtactgttgaaggaaggaaaaatcatcctatttgtcatggcgggaactgactcctcggcgtcatcgagacaaagcagtttcaactcattagcaaaggacctagaacttcctttggagaaagggtgcctcaccatcgttgtacttggggcttctggagatcttgccaagaagaaaacgttcccggcactctaccacctttttgagcaggggttcttacaatctggtgaagtgcatatagtggggtatgcgagaacaaatctttctgatgatgggttgagagggcgcatccgtgcataccttaaaggagcctcagaggaacatgtttcagaattcttgcaattgataaaatatgtcagtggttcctatgacagtggagaaggttttgaaaaactgaacaaggaaatatcagattatgagatgtcaaacaactcaggaagctcccgtaggctcttttatttggcattgcctccatctgtctacccttcagtgtgcaaaatgatccgaacatattgcatgagtccaacttctcgcgctggatggactagagtaattgttgagaagccctttggaaggggcctggactctgcagaagaattgagttcccaacttggggagctattcgaggaagatcaactctacaggattgaccactacttgggaaaagagttggtccaaaacttgcttgtgcttcgttttgcgaaccgtttgttcttaccactttggaaccgtgacaatgttgataatatacagattgtattcagggaggacttcggaactgatggacgtggaggatattttgatcaatatggaatcatccgtggtatcattcagaaccatttgttgcaggttttctgtttggttgcaatggaaaagcctgtatctcttaagcctgagcacatcagagatgagaaagtcaaggttctgcaatccgtgaacccgataaaggacgaagaggtagtccttggacaatatcagggctacaaggaggaccctacagtgccagatgactctaacaccccaacgtttgcatctattgtacttagggtacacaatgaaagatgggaaggtgttcctttcattcttaaagctggtaaagcattaaactcaagaaaagcagaaattcgtgtgcagttcaaggatgttcccggtgacatttttaaatgtaagaagcagggaagaaatgagtttgtcatacgcctccagccatcagaagccatgtacatgaaactaactgtgaagaaacctggattggaaatggctactgaacagagtgaacttgatctgtcatatgggatgcgttaccaagatgtcaaaattccagaggcatacgagcgcctcattttggatacaataagaggagaccagcaacactttgtgcgccgagatgagctgaaggctgcctggcagatcttcactcccttgttgcacgacatcgacgctggcaagctgaaggctgtttcatacaagcctggcagccgaggccccaaggaagctgatgaactgagtgagaaggttgggtacatgcagacccacggttacatctggataccacccacccttgcatagagtgcctccctcgatccttgtaggtttgtttagctaggaagagtgaaagtatcacggataaaaatcttacgaattttagctgtactgcggtttacctggcgttgtaataacggatctgttcgacggagtatacctcaccacggtgtgaaataaaaaatggagtgtttcaatcaaaaaaaaaaaaaaaaaaaagagtcgcgcgatcgatgccaatcactagtg

SEQ ID NO: 2625 - protein, 509 aa, Triticum aestivum
MAGTDSSASSRQSSFNSLAKDLELPLEKGCLTIVVLGASGDLAKKKTFPALYHLFEQGFLQSGEVHIVGYARTNLSDDGLRGRIRAYLKGASEEHVSEFLQLIKYVSGSYDSGEGFEKLNKEISDYEMSNNSGSSRRLFYLALPPSVYPSVCKMIRTYCMSPTSRAGWTRVIVEKPFGRGLDSAEELSSQLGELFEEDQLYRIDHYLGKELVQNLLVLRFANRLFLPLWNRDNVDNIQIVFREDFGTDGRGGYFDQYGIIRGIIQNHLLQVFCLVAMEKPVSLKPEHIRDEKVKVLQSVNPIKDEEVVLGQYQGYKEDPTVPDDSNTPTFASIVLRVHNERWEGVPFILKAGKALNSRKAEIRVQFKDVPGDIFKCKKQGRNEFVIRLQPSEAMYMKLTVKKPGLEMATEQSELDLSYGMRYQDVKIPEAYERLILDTIRGDQQHFVRRDELKAAWQIFTPLLHDIDAGKLKAVSYKPGSRGPKEADELSEKVGYMQTHGYIWIPPTLA

SEQ ID NO: 2626 - DNA, 1924 bp, Triticum aestivum
  CDS (161)..(1702)
cgattgggcaaggaaggggccacccccctccccattcctacccacccagcatctcggcagtaactctcctccctcccaccggcgcgcccgctcgccgcgcgcgcgaatctcggtcgcaactggtgtactgttgaaggaaggaaaaatcatcctatttgtcatggcgggaactgactcctcggcgtcatcgagacaaagcagtttcaactcattagcaaaggacctagaacttcctttggagcaagggtgcctcaccatcgttgtacttggggcttctggagatcttgccaagaagaaaacgttcccggcactctaccacctttttgagcaggggttcttacaatctggtgaagtgcatatagtggggtatgcgagaacaaatctttctgatgatgggttgagagggcgcatccgtgcataccttaaaggagcctcagaggaacatgtttcagaattcttgcaattgataaaatatgtcagtggttcctatgacagtggagaaggttttgaaaaactgaacaaggaaatatcagattatgagatgtcaaacaactcaggaagctcccgtaggctcttttatttggcattgcctccatctgtctacccttcagtgtgcaaaatgatccgaacatattgcatgagtccaacttctcgcgctggatggactagagtaattgttgagaagccctttggaagggacctggactctgcagaagaattgagttcccaacttggggagctattcgaggaagatcaactctacaggattgaccactacttgggaaaagagttggtccaaaacttgcttgtgcttcgttttgcgaaccgtttgttcttaccactttggaaccgtgacaatgttgataatatacagattgtattcagggaggacttcggaactgatggacgtggaggatattttgatcaatatggaatcatccgtgatatcattcagaaccatttgttgcaggttttctgtttggttgcaatggaaaagcctgtatctcttaagcctgagcacatcagagatgagaaagtcaaggttctgcaatccgtgaacccgataaaggacgaagaggtagtccttggacaatatcagggctacaaggatgaccctacagtgccagatgactctaataccccaacgtttgcatctattgtacttagggtacacaatgaaagatgggaaggtgttcctttcattcttaaagctggtaaagcattaaactcaagaaaagcagaaattcgtgtgcagttcaaggatgttcccggtgacatttttaaatgtaagaagcagggaagaaatgagtttgtcatacgcctccagccatcagaagccatgtacatgaaactaactgaattcgtgcaggtgaagaaacctggattggaaatggctactgaacagagtgaacttgatctgtcatatgggatgcgttaccaagatgtcaaaattccagaggcatacgagcgcctcattttggatacaataagaggggaccagcaacactttgtgcgccgagatgagctgaaggctgcctggcagatcttcactcccttgttgcacgacatcgacgctggcaagctgaaggctgtttcatacaagcctggcagccgaggccccaaggaagctgatgaactgagtgagaaggttgggtacatgcagacccacggttacatctggataccacccacccttgcatagagtgcctccctcgatccttgtaggtttgtttagctaggaagagtgaaagtatcacggataaaaatcttacgaattttagctgtactgcggtttacctggcgttgtaataacggatctgttcgacggagtatacctcaccacggtgtgaaataaaaaatggagtgtttcaaaaaaaaaaaaaaaaaagggtcgcgcgatcgatgccgaatcactagtgaattc

SEQ ID NO: 2627 - protein, 513 aa, Triticum aestivum
MAGTDSSASSRQSSFNSLAKDLELPLEQGCLTIVVLGASGDLAKKKTFPALYHLFEQGFLQSGEVHIVGYARTNLSDDGLRGRIRAYLKGASEEHVSEFLQLIKYVSGSYDSGEGFEKLNKEISDYEMSNNSGSSRRLFYLALPPSVYPSVCKMIRTYCMSPTSRAGWTRVIVEKPFGRDLDSAEELSSQLGELFEEDQLYRIDHYLGKELVQNLLVLRFANRLFLPLWNRDNVDNIQIVFREDFGTDGRGGYFDQYGIIRDIIQNHLLQVFCLVAMEKPVSLKPEHIRDEKVKVLQSVNPIKDEEVVLGQYQGYKDDPTVPDDSNTPTFASIVLRVHNERWEGVPFILKAGKALNSRKAEIRVQFKDVPGDIFKCKKQGRNEFVIRLQPSEAMYMKLTEFVQVKKPGLEMATEQSELDLSYGMRYQDVKIPEAYERLILDTIRGDQQHFVRRDELKAAWQIFTPLLHDIDAGKLKAVSYKPGSRGPKEADELSEKVGYMQTHGYIWIPPTLA

SEQ ID NO: 2628 - DNA, 2098 bp, Solanum tuberosum
  CDS (27)..(1775)
cacgagcttctctgatttctcaagatatggtaaccctttattcttccccttccactaactgttctggggccttttcatcatactccaattcttctattgggttctacaattatcattacaacttccctatttcatccagaaagtttggttctcacaagatttctttgcaaattaatgccgttcgcatgcaagatggtgctgtagtggctcaacctagcaaaacccaagatgaaactcctttgaagaaattaaaagatggaattttgtcaaaggagcagaaacatacatttgattttgattgcaacaaagataaatcaactgtcagtattactgttgttggtgcttcaggagatcttgccaaaaaaaagatatttcctgcactttttgcactttattatgagggttgcttaccggagcatttcactatttttggctatgcccggagtaagatgtctgatgacgaactcaggaacatggtcagcaagacacttacttgcaggattgataagagggaaaattgtggtgaaaagatggaacagtttctagaaaggtgtttctaccatagtggacaatatgattcccaggaacactttgcagagcttgataaaaagctgaaagaacatgaggctggaaggttttccaatcgtctgttctacttgtccattccaccaaatatttttataaatgctgtacgatgtgcaagcctctctgcatcatctgctcatggatggactagagtcattgtagagaaaccctttggtcgggattctgaatcctctgctgcattaacaggagcacttaagcagtacttgaaggaagatcaaattttcaggattgatcactatttagggaaggagcttgtggaaaacctttctgtccttcgtttcttcaacttgatatttgaacccttatggtcaaggcagtatataaggaacgtgcagtttattttctctgaagattttggcactgaaggaaggggaggttattttgatcattatgggataattagagacattatgcaaaaccatttgcttcaaattcttgccctctttgccatggaaacacctgtcagtttggatgcagaagatatcaggaatgaaaaggtaaaagttctgcgttctatgagacctttacaactagatgatgttatcgtcgggcagtacaaaagtcacacaaaagggggtgttaactatcctggttataccgacgacaagactgtacccaaggacagtctaaccccaacttttgctgcagctgctcttttcatagataatgcaagatgggatggggtgcctttccttatgaaggctggaaaagctttacataccaggagtgcggaaataagagtacaattcaggcacgtgccgggaaatttatacaataagaactttggctcagatctagatcaggcaacaaacgagcttgttatccgtgttcaacctgatgaagctatatacctaaagatcaataacaaagttcctggtctaggaatgagactggatcgcagtaatcttaatctgctttactcagcaagatacgcgaaggagatccctgatgcatatgagcggctacttcttgatgccatagaaggtgaacgtaggctttttattcgcagtgatgaactggatgctgcgtggtctcttttcacaccagtgttgaaagaacttgagcataagaaaatagtaccggaaagctacccctatggaagtcgaggacctattggagcacattaccttgcagcacgatataaagtaagatggggtgatcttgcttagacaaagtaatttgccattgctatgagaaaccatatgtagccttacaacttcttctgcttagtatgttgcaaccaaatttgttagtgggattccagtatccagactaacaaagcttgaagttgcttactgtcaaggcatatgacaatagagaacacacagttggtaaaacaaaagaagaggagaatctgggttcattttgttatttcaaataaatcttttctattgcaccaacgcatatccattggtagcagcttttttcatgtagcatttagtataccttgttagaatctaataattcgaaaagtaaaaaaaaaaaaaaaaaa

SEQ ID NO: 2629 - protein, 582 aa, Solanum tuberosum
MVTLYSSPSTNCSGAFSSYSNSSIGFYNYHYNFPISSRKFGSHKISLQINAVRMQDGAVVAQPSKTQDETPLKKLKDGILSKEQKHTFDFDCNKDKSTVSITVVGASGDLAKKKIFPALFALYYEGCLPEHFTIFGYARSKMSDDELRNMVSKTLTCRIDKRENCGEKMEQFLERCFYHSGQYDSQEHFAELDKKLKEHEAGRFSNRLFYLSIPPNIFINAVRCASLSASSAHGWTRVIVEKPFGRDSESSAALTGALKQYLKEDQIFRIDHYLGKELVENLSVLRFFNLIFEPLWSRQYIRNVQFIFSEDFGTEGRGGYFDHYGIIRDIMQNHLLQILALFAMETPVSLDAEDIRNEKVKVLRSMRPLQLDDVIVGQYKSHTKGGVNYPGYTDDKTVPKDSLTPTFAAAALFIDNARWDGVPFLMKAGKALHTRSAEIRVQFRHVPGNLYNKNFGSDLDQATNELVIRVQPDEAIYLKINNKVPGLGMRLDRSNLNLLYSARYAKEIPDAYERLLLDAIEGERRLFIRSDELDAAWSLFTPVLKELEHKKIVPESYPYGSRGPIGAHYLAARYKVRWGDLA

SEQ ID NO: 2630 - DNA, 1924 bp, Dunaliella bioculata
  CDS (68)..(1840)
gaattcggcacgaggtgttcagcatcatcaacccttagctcgtgccctccaggcgttcgtttttctcatgttgggtggaaggcagttgggtatggacaagctgtcccggaagctgtccggtgctcaacctgttgcgaactactcgcgtcgcccgatttcgcgcccatttcgcgcagcgcctgttcctcgagtcgcgcagaattcccaagatgctgtgacccagaatggcagcgggacaagcgaggcacccacctcctggcagaacccagcactcaagaaggccatccccactgtggtttctctctcagatgaggctgcagccatggcagctgatgactggagccaatctagcttgtcggttgttgtggtgggcgccagcggcgacctggccaagaagaaaatttttcctgcactttttgcccttttctatgagggcctgctgccaccggacttccagctctttggatatgcacgcagcaagatgactgatgaggagttccgagacctcatcggcaacaccctgacgtgccgcattgatgccaggtcccgctgcgaagactcccaggccgccttcttgtcgcgctgcttctactgcccaggccagtatgatgcccctgagggctatgccaacttggacaagaagtgcaaggagcaggaggccctgactggcaagatggtagccaaccgcatgttcttcctgtccatccctcccaacgtgtttgtgcaagcagcaggcggcgcagccgacaactgctcttctcccaccggctggacgcgcgtcattgtggagaagccctttggcagggacagcgccagcagtgctgagcttggcaggggtctggccaggcatttgacagaggaccagatctaccgtattgaccactacctggggaaggagctgattgagaacctgacagtgctgcgcttttcaaaccttgtgtttgagcccttgtggagcaggcagtacatccgcaatgtgcaggtgatcttctcagaagactttggcactgaaggccgcggaggctacttcgaccggtacggcatcatccgcgatgtcatgcagaaccacttgctccagattgtggcattgttcgccatggagccaccggtgtccctggatggagaggccatccgtaatgagaaggtcaaggtcctgcagtctatgtctcaagtggcgctggaggatgtcacactgggccaataccgcggcaggtctggcgctggccgttccggtggtgctgatttgcctggctacctggatgatgcaacagtgcccaagggctccctgtgccccacctttgctgccattgcgctgcacatcaacaatgcacgctgggatggtgtgccattcctgctcaaggctggcaaggcgctgcacacgcgcggcgctgagatccgtgtgcagttcaggcatgtgcccggcaacattttcaagcacaaagtgggccccaacatcgacatgaccaccaacgagcttgtgatccgcattcagccgcgggagtccatctacctcaagatcaacaacaaggtccctggcttgggcatgcgcctggataccaccaagctggacctggtgtacaacgacgcatactccaaggagttgccagatgcgtatgagcgcctcctgttggatgtggtgaacggcgataagcgcttgttcatccgcgatgatgagctggagcaggcctggaacatctttaccccagtgctgcatgagatcgagcgcagaaaggtggcacctgagctgtacccctacggcagcagaggccctgtgggggcacactacttggctgccaagtacaacgtgcgctggggagacttgacggaggatgagatctgaggtgtgaggccctggaccgacctcatccctggtgttcaatggttacatcagacatgagggcacctcaacacaggggcattccga

SEQ ID NO: 2631 - protein, 590 aa, Dunaliella bioculata
MLGGRQLGMDKLSRKLSGAQPVANYSRRPISRPFRAAPVPRVAQNSQDAVTQNGSGTSEAPTSWQNPALKKAIPTVVSLSDEAAAMAADDWSQSSLSVVVVGASGDLAKKKIFPALFALFYEGLLPPDFQLFGYARSKMTDEEFRDLIGNTLTCRIDARSRCEDSQAAFLSRCFYCPGQYDAPEGYANLDKKCKEQEALTGKMVANRMFFLSIPPNVFVQAAGGAADNCSSPTGWTRVIVEKPFGRDSASSAELGRGLARHLTEDQIYRIDHYLGKELIENLTVLRFSNLVFEPLWSRQYIRNVQVIFSEDFGTEGRGGYFDRYGIIRDVMQNHLLQIVALFAMEPPVSLDGEAIRNEKVKVLQSMSQVALEDVTLGQYRGRSGAGRSGGADLPGYLDDATVPKGSLCPTFAAIALHINNARWDGVPFLLKAGKALHTRGAEIRVQFRHVPGNIFKHKVGPNIDMTTNELVIRIQPRESIYLKINNKVPGLGMRLDTTKLDLVYNDAYSKELPDAYERLLLDVVNGDKRLFIRDDELEQAWNIFTPVLHEIERRKVAPELYPYGSRGPVGAHYLAAKYNVRWGDLTEDEI

SEQ ID NO: 2632 - DNA, 1976 bp, Cyanidium caldarium
  CDS (46)..(1848)
cacgagcaccattttattttcttcttctcaacgtgtaagagcaatatgtggatacctctattcataactggtttttggaataccaatacatcttcatctcacttatggaaaacaaaatatacaaagggatggacaactcctttgtatttctctaaagtggacaagtcgttctttgctcctcgtttagcttctattcaagctgttcaaggagatttggataatatcgcccctcaatggaacgactcttcattagaaacaactcttcctataactaccaatgaacgtccagctattccaagacaacacttcagccacctcggagacactttagatcctagtttgatggactccgtcaagaaacgaaaacagagagcaaaagaagagcctttatgtattgttgttattggtgctagtggagacttggcaaagaagaaaacttttcctgctttgttttccttgtattatcacgatttgttaccaaaggactttctcattgtaggttatgctagaagacaaatgactcaagaagagtttagaaactctattatggaatcattgacttgtagagttatcgatggcccacagtgtcaacgaaagatggatgagtttctacccaaatgtcactatatgtcaggtatgtatgatagaactgaagattttgttcgattggatcaatttttgaacaactttgaacaatcatttcccaatactcgagtggatagactatattatttagctgttccttctcaagtatttgaaaatgtggtacatcatgttcatgaaagcggaagaacgcaacgaggttggaatcgcatcgtcatggaaaaaccatttggaaaagacattacttcttatctacagcttcgaaatagtcttcgcaattgtatttctgaagatgaaatataccgaattgatcactatttgggaaaggagttggtacaaaatttgatggttttacggtttgccaattatctatttgagcctttatggaatcgagaccatatagcttccattcaaattgtgtttaaagagaattttggtgtggaaggaagagctggatatttcgatgaatatggaattattagagatattatgcagaatcatttattacaagtgatggcattgttgggtatggaacaaccagtaactttacatgcggaagatattcgagatgaaaaggtaaaatttctacgctctatacgtcctttaaaagcatcagactttgtacttggtcaatatagagaccgtcagaatcctcaacgttcttatttatcggaacctggagtaatgaatgatagtcatactcctacttttgctgcttgtgtatttcaagtggataatagaagatggtcaggtgtaccatttcttatgaaggctggtaaggcattggatgaacgcaaggcagaaatacgtattcagtttcaatctgttcctggtggactattttctcaagtagtttcgtcacatcttccacataatgaattggtgattatagtacaaccagatgaagccatttatatgcgtattcttagcaaggcaccgggttttacttcgcgtttggaagaggcacgtttgaatctcttctatcgtacggcttgggaagatagtaaagatatacctgatgcctatgagagacttattctggatgtcatacatggtgagaaaagtttgtttattcgtgatgatgaattggaagtggcttggaatatatttactccttcattgaaggaaatggaaatggctcaagattcgtggaaacctattttgtacgattacggtggaagaggtccaatcgaaagtgattatttggctgccaaatatgcagtgcaatggagtgaaggtgattgatgttcatgtaaggataatatagaaagaactggaatccattcagttgcaatggcattcatggattcttcatgtttctatataaaatagttgttcgtctaaaaaaaaaaaaaaaaaaaaaaaaaaaaaaa

SEQ ID NO: 2633 - protein, 600 aa, Cyanidium caldarium
MWIPLFITGFWNTNTSSSHLWKTKYTKGWTTPLYFSKVDKSFFAPRLASIQAVQGDLDNIAPQWNDSSLETTLPITTNERPAIPRQHFSHLGDTLDPSLMDSVKKRKQRAKEEPLCIVVIGASGDLAKKKTFPALFSLYYHDLLPKDFLIVGYARRQMTQEEFRNSIMESLTCRVIDGPQCQRKMDEFLPKCHYMSGMYDRTEDFVRLDQFLNNFEQSFPNTRVDRLYYLAVPSQVFENVVHHVHESGRTQRGWNRIVMEKPFGKDITSYLQLRNSLRNCISEDEIYRIDHYLGKELVQNLMVLRFANYLFEPLWNRDHIASIQIVFKENFGVEGRAGYFDEYGIIRDIMQNHLLQVMALLGMEQPVTLHAEDIRDEKVKFLRSIRPLKASDFVLGQYRDRQNPQRSYLSEPGVMNDSHTPTFAACVFQVDNRRWSGVPFLMKAGKALDERKAEIRIQFQSVPGGLFSQVVSSHLPHNELVIIVQPDEAIYMRILSKAPGFTSRLEEARLNLFYRTAWEDSKDIPDAYERLILDVIHGEKSLFIRDDELEVAWNIFTPSLKEMEMAQDSWKPILYDYGGRGPIESDYLAAKYAVQWSEGD

SEQ ID NO: 2634 - DNA, 1777 bp, Mesembryanthemum crystallinum
  CDS (39)..(1589)
ccactacgaaatttctccgaactcaaattcttccaagaatggggtcaggcgagtggcacgtggaaaaaagatcgagcttgaagagtgaattatctaaagacataggagagtctgaaagttcacaagaatgtggctctctttctatcattgttctaggtgcctctggtgatcttgccaagaagaagaccttccctgctctgtttaatctttaccgccagggatttcttcctcccagtgaggttcacatatttggttatgcaaggtcaaagatgacagatgatgacttgagagatcgcatacgtggacatctgattcccaggaatgtaacagcggagatatctgaggatgttttgaactttctgcatctgattaaatatgttagtgggtcttatgacactgaggacggttttcacttgttagatgatgaaatatcaaagtatgagtgtcaaaagaacagccaggaacattctaagagactcttttatcttgctcttcctccatcagtatatccatcagtctgcagaatgataaagctttgctgtatgaataaatctgatcttgggtggactcggattgttgttgagaagccttttggaagagacttagaatcagcagaacaacttagtgctcagattggagagttgtttgatgagtcacagatttaccgaattgatcactatttggggaaggagttggtgcagaacttgctggtgatgcgcttcgcgaatcgtctttttctacctctctggaatcgggacaatattgcgaatgtgcagattgtcttcagggaagattttggaacacaaggtcgtggtgggtactttgatcaatatggaataatccgtgacattattcaaaaccaccttttgcaggttctttgtttagttgccatggagaagcctgtctcaatcaaaccagagcacattcgtgatgagaaagtgaaggttctccaagctgttaatctaataaaagatgaagaggttgttcttgggcaatatgaaggctacaaggatgatccaactgttcccgaagactcaaacactccgacatttgcgactatggttttgcggatacacaatgaaagatgggaaggtgttccatttatactaaaggcagggaaagcattgaattcacgaaaagcagaaatacgtgttcagttcaaagatgttcctggtgacatattcaaatgtaacaagcaggggagaaatgagtttgtaatacggctacagccttcagaagcactctatatgaagcttacggtgaagcagcctgggcttgaaatgtcaactatacaaagtgagctggatttgtcgtatgggcagcggtatcagggagtcgttattccagaggcctatgagcgtctgattctggacacgataaaaggcgatcaacaacattttgtccgtagagatgagttgaaggctgcgtgggagatctttactcctcttctacacagaattgataagggagaattcaagccaatttcatacaagcctggaactcgaggcccagcagaagcagatgagctactggcaaaggctggatacgttcaaactcatgggtacatctggattccacccaccttatagtcactcggaaaagctacacggattgaatcggccatcaaaatttgtgtttggatatagtttgagaaaagctcttcgtggtgctggtagctcttattgaaccttgacagtaatttgtcttgggtacactaaagctactacagttgtatgtaattcattttgctggtgtaataaaagtcatttccggtttt

SEQ ID NO: 2635 - protein, 516 aa, Mesembryanthemum crystallinum
MGSGEWHVEKRSSLKSELSKDIGESESSQECGSLSIIVLGASGDLAKKKTFPALFNLYRQGFLPPSEVHIFGYARSKMTDDDLRDRIRGHLIPRNVTAEISEDVLNFLHLIKYVSGSYDTEDGFHLLDDEISKYECQKNSQEHSKRLFYLALPPSVYPSVCRMIKLCCMNKSDLGWTRIVVEKPFGRDLESAEQLSAQIGELFDESQIYRIDHYLGKELVQNLLVMRFANRLFLPLWNRDNIANVQIVFREDFGTQGRGGYFDQYGIIRDIIQNHLLQVLCLVAMEKPVSIKPEHIRDEKVKVLQAVNLIKDEEVVLGQYEGYKDDPTVPEDSNTPTFATMVLRIHNERWEGVPFILKAGKALNSRKAEIRVQFKDVPGDIFKCNKQGRNEFVIRLQPSEALYMKLTVKQPGLEMSTIQSELDLSYGQRYQGVVIPEAYERLILDTIKGDQQHFVRRDELKAAWEIFTPLLHRIDKGEFKPISYKPGTRGPAEADELLAKAGYVQTHGYIWIPPTL

SEQ ID NO: 2636 - DNA, 1587 bp, Mus musculus
  CDS (31)..(1572)
atgcagtggcaactaaactaggaaaacatcatggcagagcaggtgaccctaagccggacccaagtgtgtgggatcctgagggaagagttgtaccaaaatgatgccttccaccaagctgatacacacatatttatcatcatgggtgcatcgggtgacctggccaagaagaagatctatcccaccatctggtggctgttccgggatggtcttctacccaaagaaaccttcattgtgggctatgcccgctcacaactcacagtggatgacatccaaaagcagagtgagcccttctttaaggccactccagaagaaagacccaagctggaggagttcttcacgcgtaactcctatgtagttggccagtatgatgatccagcctcctataagcacctcaacagctacattaatgccctgcaccaggggatgcaggccaaccatctattctacctggccttgccccccacagtctatgaagcagtcaccaagaacattcaagagacctgcatgagtcagacaggctttaaccgcatcatagtggagaaacccttcgggagagacctgcagagctccaatcaattgtctaaccacatctcctctcttttccgtgaagaccagatctaccgcattgaccactacctggacaaagagatggtccagaacctcatggtgctgaggtttgctaacaggatctttggccctatctggaatggagacaacattgtttgtgtgatcctcacatttaaagagccctttggtactgagggtcgtgggggctattttgatgaatttgggatcatcagggatgttatgcagagccacctcctgcagatgttgtgtctggtggccatggaaaagcctgctaccacagattcagatgatgtccgtaatgagaaggtcaaagtgttgaaatgtatctcagaggtggaaactgacaatgtgatccttggccagtatgtggggaaccccaatggagaaggagaagctgccaatggatacttagatgaccccacagtaccccgtgggtccacaactgccacctttgctgcagctgtcctctatgtgaagaatgaacggtgggatggggtacccttcatactgcgctgtggcaaagccctgaatgaacgcaaagctgaagtgagactgcaattccgagatataccaggcgacatcttccaccagaagtgcaagcgtaatgagctggtcatccgtatgcagcccaatgaggcagtatacaccacgatgatgaccaagaagcctggcatgttctttaaccctgaggagtcggagctggacctaacttatggcaacaaatacaagaatgtgaagctccctggtgcctatgaacgcctcatcctggatgtcttctgtgggtgccagatgcactttgtccgtactgatgaactcagggaaggctggcgtatcttcacaccactgctgcacaagattgaacgagaaaagccccagcccttcccctatgtatatggcagccgtggccccacagaggcagatgagctgatgaggagagtgggcttccagtacaagggtacctacaagggtactcacaagcactgagccctggaacttctg

SEQ ID NO: 2637 - protein, 513 aa, Mus musculus
MAEQVTLSRTQVCGILREELYQNDAFHQADTHIFIIMGASGDLAKKKIYPTIWWLFRDGLLPKETFIVGYARSQLTVDDIQKQSEPFFKATPEERPKLEEFFTRNSYVVGQYDDPASYKHLNSYINALHQGMQANHLFYLALPPTVYEAVTKNIQETCMSQTGFNRIIVEKPFGRDLQSSNQLSNHISSLFREDQIYRIDHYLDKEMVQNLMVLRFANRIFGPIWNGDNIVCVILTFKEPFGTEGRGGYFDEFGIIRDVMQSHLLQMLCLVAMEKPATTDSDDVRNEKVKVLKCISEVETDNVILGQYVGNPNGEGEAANGYLDDPTVPRGSTTATFAAAVLYVKNERWDGVPFILRCGKALNERKAEVRLQFRDIPGDIFHQKCKRNELVIRMQPNEAVYTTMMTKKPGMFFNPEESELDLTYGNKYKNVKLPGAYERLILDVFCGCQMHFVRTDELREGWRIFTPLLHKIEREKPQPFPYVYGSRGPTEADELMRRVGFQYKGTYKGTHKH

SEQ ID NO: 2638 - DNA, 1485 bp, Actinobacillus actinomycetemcomitans
  CDS (1)..(1485)
atgaaagcagaaaactgttgtattgtaattttcggcgcctccggcgatctcacttatcgtaaacttattccggctttatataacctctataaaattgatcgactgggtgaagatttctccgttctcggcgtggcacgtaccgaactgaatgacaaatcattccgtgagaaaatgcgccaaacgctgatcaaaaatgaaggcgcgaaaggcgagtgcttggagcaattttgcagccacctgtattatcaggcggtcaatacggcggacaaagcggattacgccaaactggttccgcgtcttgacgaactgcacgacacctatcgcaccgaaggcaacaccttgtattatctttccacgccgccgagcctatatggcgtgattccggaatgtttgggcgaacatggcttaaataaagaagatcgcggctggaagcgtcttattgtggaaaaaccgttcggttatgaccgtgaaaccgccgaagcgctggatattcaaattcaccgtttctttgaagaacatcaaatttaccgtatcgaccattatcttggtaaagaaaccgtccaaaacctgcttgtgttgcgcttttccaacggttggtttgagccgttgtggaaccgtaatttcattgattacattgaaatcaccggcgcggaatctatcggtgtagaagagcgtggcggctattatgacggttccggcgcgatgcgcgatatgttccaaaaccatttattacaagtgctggcaatggtggcgatggagccgccggtgattatcaacgccaattccatgcgtgacgaagtggcgaaagtgctgcattgtttgcgcccgttgacccaggaagacgtggagcataatctggtgttgggacaatatgtcgcaggcgaagtggacggcgaatgggtgaaaggctatttagaggaaaaaggcgtgccgccgtattccaccaccgaaacctacatggcgctacgctgtgaaatcgaaaactggcgttgggcgggcgtgcctttctacgtgcgcaccggtaaacgtctgccggcacgcgtcacggaaatcgtgattcacttcaaaaccaccccgcacccggtattcagccaaaatgcgccggaaaataaactgattatccgtattcaaccggacgaaggcatttctatgcgttttggcttgaaaaaaccgggcgccggctttgaagccaaagaagtgtcgatggatttccgctatgccgatcttgcgggtgccaccgtcatgaccgcttatgagcgtttattgcttgatgccatgaaaggcgacgcgaccctatttgcgcgtaccgatgccgtacacgccgcctggaaattcgttcaaccgattttgaactataaagcccaaggcggcagactttatgattacgaggccggcacctggggaccgacggcagccgataaactcatcgccaaaagcggtcgtgtatggcgccgcccaagcgggttgatgaagaaaaaagtgtaa

SEQ ID NO: 2639 - protein, 494 aa, Actinobacillus actinomycetemcomitans
MKAENCCIVIFGASGDLTYRKLIPALYNLYKIDRLGEDFSVLGVARTELNDKSFREKMRQTLIKNEGAKGECLEQFCSHLYYQAVNTADKADYAKLVPRLDELHDTYRTEGNTLYYLSTPPSLYGVIPECLGEHGLNKEDRGWKRLIVEKPFGYDRETAEALDIQIHRFFEEHQIYRIDHYLGKETVQNLLVLRFSNGWFEPLWNRNFIDYIEITGAESIGVEERGGYYDGSGAMRDMFQNHLLQVLAMVAMEPPVIINANSMRDEVAKVLHCLRPLTQEDVEHNLVLGQYVAGEVDGEWVKGYLEEKGVPPYSTTETYMALRCEIENWRWAGVPFYVRTGKRLPARVTEIVIHFKTTPHPVFSQNAPENKLIIRIQPDEGISMRFGLKKPGAGFEAKEVSMDFRYADLAGATVMTAYERLLLDAMKGDATLFARTDAVHAAWKFVQPILNYKAQGGRLYDYEAGTWGPTAADKLIAKSGRVWRRPSGLMKKKV

SEQ ID NO: 2640 - DNA, 1473 bp, Buchnera aphidicola
  CDS (1)..(1473)
atgattatagaaactaatcaagcttgcgatctagtgatttttggaacaaaaggagatttagcaagaagaaaattgttaccagctttatataaattagaaaaatctcaaaaaatacatccagatacacgtataattggtacaggtcgtgctgattggaatacagaagattatataaagatagtaaaaaaagcaataaaaatgtttttaaatgaaaaaattgatgaaaaaatttggaaaaaattacgttcacgtttaaattttttttatattgatgtatttcaagatcttcactttttagaattaaaaaatatattaaatcaaaaaaaaaacattattatttattattgtgcagttccttcaaatacatttaatgctatttttacaggattaggaaaagttaatttaaattcttttccatcaagaatcataatcgaaaaaccactcggtgtatctttagaaacatcaaaaaaaatcaataatcaaattgctaaatattttttagaatcgcaaatctttcgtattgatcactatcttggaaaagaatcaatattaaatcttttagcattacgtttctcaaattcatttttttttcatagttggaataataaaattattgatcatattcaaattactgtatctgaagaagttggtattgaaaatagatggaattattttgatcaaatgggacaaacacgagatatggtacaaaatcatctcctgcaaattcttacaatcgtttctatggataaaccaaaaaatattacacctgaaggcataagagatgaaaaattaaaaatattgcgttctcttaaaaaaattgacttaaatgaaattcatattaagacagcacgaggtcaatatgcatctggaattataaatggtaaaaaggtaccttcttacatagaagaaaatggtgcaaacaaacatagtaaaacagaaacatttgtttcaattaaagttgatattaataatgatcgatggtttggagttccattttatttaagaacgggtaaacgtttagcatataaatactctgaaatagttattgtctttaaaaaaatatctaagaacttgtttcaagaattcaataaaaatttatcacctaacaaattgattatacgtctagaacctaatgaaagtattaaaatatattttttaaataaagtaccaggactcagtaaggaatataaattaaaaagtgataaaatggaatttaattttaatataaataatactaaaaattttgtcgacgcttatgaaaggctattatttgaaagtatgagaggaatacaatcattatttgtatgtcgagaagaagtagaagaagcgtggaaatggattgatccaataataaacggttggaaaaaaacaaatataaatactgtacagttatataaatctggtacatgggggccaaaaagttcggacgaaatcattatgcgagatggtcgattttgggaaacatttaattaa

SEQ ID NO: 2641 - protein, 490 aa, Buchnera aphidicola
MIIETNQACDLVIFGTKGDLARRKLLPALYKLEKSQKIHPDTRIIGTGRADWNTEDYIKIVKKAIKMFLNEKIDEKIWKKLRSRLNFFYIDVFQDLHFLELKNILNQKKNIIIYYCAVPSNTFNAIFTGLGKVNLNSFPSRIIIEKPLGVSLETSKKINNQIAKYFLESQIFRIDHYLGKESILNLLALRFSNSFFFHSWNNKIIDHIQITVSEEVGIENRWNYFDQMGQTRDMVQNHLLQILTIVSMDKPKNITPEGIRDEKLKILRSLKKIDLNEIHIKTARGQYASGIINGKKVPSYIEENGANKHSKTETFVSIKVDINNDRWFGVPFYLRTGKRLAYKYSEIVIVFKKISKNLFQEFNKNLSPNKLIIRLEPNESIKIYFLNKVPGLSKEYKLKSDKMEFNFNINNTKNFVDAYERLLFESMRGIQSLFVCREEVEEAWKWIDPIINGWKKTNINTVQLYKSGTWGPKSSDEIIMRDGRFWETFN

SEQ ID NO: 2642 - DNA, 1473 bp, Buchnera aphidicola
  CDS (1)..(1473)
atgaaaaataaaaattcaggatatgatttagttatttttggagcaaaaggagatctatcttgtagaaaactactaccttcattatatcaattagaaaaaaaaaataaattatgtactcacactagaataataggcgtaggtcgcgctaattgggataaaattatttatactaatgtagtatataaatcattaattaaatttttaaatgaaacaataatcgaatctatttggaaaaaattttcgtctcggttagaattttgtaatttagatattaattgcttgcacaattttaaaaaattaaaacaaataattcaacaaaataataacattataattaattatctagctatgccacctcacacatttggaaatatttgtttaggattagaatcaataaatttaaatttagaacctacgcgtattataattgaaaaaccattaggttcttctttaaaaacatctataaatattaataacaaaattggaaaattttttaaagaaaaacaaatttttcgaatagatcattatcttggaaaagaaactatacaaaatttgttagcattcagattttcaaattcacttttttactataattggaataataaatttattgatcatgttcaaattactgtatcagaaacaattggagttgaaggaagatttaattatttcgatacagttggacaaattaaagatatggttcaaaaccatttattacaaatattgacgattactactatgtcgacaccaattgattgccatgaaaatagcataagggatgaaaaagtaaaaattttaaaatcattacgaccatttaacattaataatattcataaaaatgtaatattaggtcaatatacttcaggaataataaatcaaaaaaaagttaaatcttatttagatgaaactaataatcaagaatatcaaatgaataaatataccgaaacatttgtatctatgaaaatatatatcgataatgatcaatggtctggagtcccattttatttgcgtactggaaaacgacttccaaaaaaatgttcagaaatcgttattttttttaaaacacctcctttaaatatttttagtaaaaattacaatacgttatctaaaaataagttaatattatcgttacagcctaacgaagcgattaagatatatattttaaataaaaaaccaaaactaacttctcaatacaaattagatttaattactttagattttaattattcaaaattttataaaaaaatacagttatctgatgcatatgaaaaattgttattagaaagcatgaaaggaattcagtctctatttgttagacgagatgaagttgaattagcatggaaatggattgactctactttgcaatgtttacatctaaaacctagattaccagatctatatccagctggaacttggggacctgcacgttcgaaaactatgataaataatgatggttacgaatggaatgaataa

SEQ ID NO: 2643 - protein, 490 aa, Buchnera aphidicola
MKNKNSGYDLVIFGAKGDLSCRKLLPSLYQLEKKNKLCTHTRIIGVGRANWDKIIYTNVVYKSLIKFLNETIIESIWKKFSSRLEFCNLDINCLHNFKKLKQIIQQNNNIIINYLAMPPHTFGNICLGLESINLNLEPTRIIIEKPLGSSLKTSININNKIGKFFKEKQIFRIDHYLGKETIQNLLAFRFSNSLFYYNWNNKFIDHVQITVSETIGVEGRFNYFDTVGQIKDMVQNHLLQILTITTMSTPIDCHENSIRDEKVKILKSLRPFNINNIHKNVILGQYTSGIINQKKVKSYLDETNNQEYQMNKYTETFVSMKIYIDNDQWSGVPFYLRTGKRLPKKCSEIVIFFKTPPLNIFSKNYNTLSKNKLILSLQPNEAIKIYILNKKPKLTSQYKLDLITLDFNYSKFYKKIQLSDAYEKLLLESMKGIQSLFVRRDEVELAWKWIDSTLQCLHLKPRLPDLYPAGTWGPARSKTMINNDGYEWNE

SEQ ID NO: 2644 - DNA, 2049 bp, Ceratitis capitata
  CDS (60)..(1640)
ttaaagtgtaaactaaaacatttttaagttttaaacaaattatttgatttgctttaaatatggccactcagcatttcaccaatggcagcgccaccgacgatggggagaccgcactcgaacatatcatcaaatcattggagactccaacaatgaagtgcgagggtacacatttcgattcccatgtgccgcacacgtttgtcatctttggtgcttcgggtgatttggccaaaaagaaaatctatccaaccttgtggtggctttaccgtgataatttactgccgaaatcaactaaattctgcggttatgcacgttcgaagttaacgattgaggagttgcgggcgaagtgtcatcaatacatgaaggtgcaaccggacgagcaggcaaaatatgaggaattctggcagaatcatgactacgctgcgggtagctatgatcagcgcagtgattttgtggctttaaaagaacgtttgagcagtttggagagctgcaattgtagttgtaatcgcatattttatttggccttaccgccgtccgtctttgagcgagttactgtgaacattaaggacatttgtttggctgaacgcggctggaatcgcgttattatcgaaaaaccttttggtcgcgacgatgtcacttcaaagaaactaagcgatcatcttgcatcactcttccacgaggaccaactctatcgtatcgatcattatctgggcaaggaaatggtgcaaaatctaatgaccattcgctttgccaataaaattctcaactccacatggaatcgggaaaatatcgcctcagtgctgatcacattcaaggaacccttcggcacacaaggacgcggcggctactttgacgagtttggcattatacgcgatgtcatgcaaaatcacctgctgcaaatattgtctttggtcgccatggagaaacccacctcctgccagccggatgatatacgcgatgaaaaagttaaagtattgaaaagcattccagcacttacattggacgatatggttttgggtcaatatgtgggcaatccaaatggcgttggtgagcaacgcgaggggtatctcgacgatccgacagtgtcgaacgactccaacacacccacttacgcgcagggtgtattgcgtatcaataatgaacgttgggacggcgtacccttcatcttacgttgcggtaaagcgctggacgaacggaaagccgtggtgcgtatacaatatcgtgatgtgcctggcgatattttcgagggcaatagcaaacgtaatgagttagttatacgtgtgcaacccggcgaggcgttgtatttcaaaatgatgaccaaaagtccgggtataactttcgatatagaggagaccgagttggacttaacctatgagcatcgctacaaaaactcctacctgccagatgcctacgaacgtctcattttggatgtattctgtggttcgcaaatgcatttcgtgcgttccgatgagctgagcgaggcgtggcgcatcttcacgccggtcttgaatgaaatcgaaaacaacaaggttaaacccataccttatgtatttggttcacgtggtcccaaggaggcggatcagaagacgtcggagaataacttcaaatattacggttcctacaagtggattggaaagaaatagagtttggtgtggctaaacctatggcagcagtgtgcacctacgtacatacatatgtttgtatgtatgtagggggaccaatgaataagataaacgcgtagaaaagacaaatacttaagcgattgtataagcaatttgaagaaaatgattgtgtacatatgtacatacatatttgtatatttgtatatttgtatatttgtaaatgtactcgtagcttgtagttaatgatgtaatgaatggattgtgcgagcgacctctgagctttgtaccagagcatcgggtatacaataatactttttgttaaatggaataatggatttataaataagttttttaagccaattttttttttgctcaaaatgaaatacaaaataaaacctaaaggacaagtgtaaaaaaaaaaaaaaaaaaa

SEQ ID NO: 2645 - protein, 526 aa, Ceratitis capitata
MATQHFTNGSATDDGETALEHIIKSLETPTMKCEGTHFDSHVPHTFVIFGASGDLAKKKIYPTLWWLYRDNLLPKSTKFCGYARSKLTIEELRAKCHQYMKVQPDEQAKYEEFWQNHDYAAGSYDQRSDFVALKERLSSLESCNCSCNRIFYLALPPSVFERVTVNIKDICLAERGWNRVIIEKPFGRDDVTSKKLSDHLASLFHEDQLYRIDHYLGKEMVQNLMTIRFANKILNSTWNRENIASVLITFKEPFGTQGRGGYFDEFGIIRDVMQNHLLQILSLVAMEKPTSCQPDDIRDEKVKVLKSIPALTLDDMVLGQYVGNPNGVGEQREGYLDDPTVSNDSNTPTYAQGVLRINNERWDGVPFILRCGKALDERKAVVRIQYRDVPGDIFEGNSKRNELVIRVQPGEALYFKMMTKSPGITFDIEETELDLTYEHRYKNSYLPDAYERLILDVFCGSQMHFVRSDELSEAWRIFTPVLNEIENNKVKPIPYVFGSRGPKEADQKTSENNFKYYGSYKWIGKK

SEQ ID NO: 2646 - DNA, 1524 bp, Chlamydia muridarum
  CDS (1)..(1524)
atggaagaaataaaagaaatggggcccacattaccagcctgccctccttgtgtcatggttatttttggggctacaggagacttgactgcaaggaagctttttcccgctttatacaatttaacaaaagagggacggttatctgaaaactttgtttgcgtgggatttgccagaagacccaaatctcatgagcaatttcgtgaagaaatgagacaagctattcaaaatttctctcattcatcagaaattgatattcgtgtttgggagagccttgaacacagaattttctatcatcaggcgaatttttccgaagcagaagggtattcttctttaagatctttcttagagagcgtggatcaaaaatatgggacaaaaggaaatcgtcttttctacctctccactcctccagattatttccaagaaataatccggaacttgaacagacaccaactattttatcatgagcaaggagcccaacagccctggtctaggctaattatagaaaagccttttggagttgatttacaaactgctcaagagcttcagcaatgcattgatgctaatatcaatgaagaatctgtttatcgaatagatcattatcttgggaaagaaactgttcaaaatattctgaccatacgttttgctaatacgctattcgaatcttgttggaactctcaatatatagatcatgtacagattagtgttagtgaatcgattggtataggctctcgagggaacttttttgaaaagtctggcatgctaagggatatggtgcaaaatcacctgatgcaattactgtgtctacttactatggagcccccttctgaattttcttctgcagagatcaaaaaagaaaaaattaagattctaaaaaaaatccttcctattcgagaagaagacgtaattcgtggtcaatatggtgaaggagttgtgcaaggcgtttctgtttctggctacagagaagaagaaaatgttgatccaaattctttggtagaaacttacgtagccttgaaattattcattgataatcctcgctggaaaggggttcctttttatttacaagcagggaaacgtcttcctaaaaggacaacggatattgccgttatctttaaaaaatctagttacgacttgtttaattcagaaaattgccctctgtgccctttagagaatgatttgctcatcatccgcattcaaccagatgaaggagttgctctacaatttaactgcaaagttccagggacaaataaactcgttcgtcctgtgaaaatggatttccgttacgatagttattttaatacagttactccagaagcttatgaacgattgttgtgtgattgtatccttggcgataggacccttttcactagcaatgaagaagtcttagcatcttgggaactattttctcccttattggagcaatggtctaagatccgtcccattttccctaattatattgcaggatctttgcgcccgcaaggagctgatgagctattatctagagatggaagagcatggcgttcttactaa

SEQ ID NO: 2647 - protein, 507 aa, Chlamydia muridarum
MEEIKEMGPTLPACPPCVMVIFGATGDLTARKLFPALYNLTKEGRLSENFVCVGFARRPKSHEQFREEMRQAIQNFSHSSEIDIRVWESLEHRIFYHQANFSEAEGYSSLRSFLESVDQKYGTKGNRLFYLSTPPDYFQEIIRNLNRHQLFYHEQGAQQPWSRLIIEKPFGVDLQTAQELQQCIDANINEESVYRIDHYLGKETVQNILTIRFANTLFESCWNSQYIDHVQISVSESIGIGSRGNFFEKSGMLRDMVQNHLMQLLCLLTMEPPSEFSSAEIKKEKIKILKKILPIREEDVIRGQYGEGVVQGVSVSGYREEENVDPNSLVETYVALKLFIDNPRWKGVPFYLQAGKRLPKRTTDIAVIFKKSSYDLFNSENCPLCPLENDLLIIRIQPDEGVALQFNCKVPGTNKLVRPVKMDFRYDSYFNTVTPEAYERLLCDCILGDRTLFTSNEEVLASWELFSPLLEQWSKIRPIFPNYIAGSLRPQGADELLSRDGRAWRSY

SEQ ID NO: 2648 - DNA, 1536 bp, Emericella nidulans
  CDS (1)..(1536)
atgtccgccacgatagcccgcgccgaggagcagcagaatgggagcactgtcgaactcaaagatgacaccgtcattgtcgtactaggtgcctccggggatcttgcaaagaagaagactttcccagctctttttggcctttttcgcaacaagttccttcccaagggtatcaagatcgtcggatatgcccggacacagatggaccacaatgaataccttaagcgagtgcgctcatacattaagaccccgacaaaggagatcgaagagcaattgaacagcttttgcgagctttgcacatacatcagcggccaatacgaccaggatgactcattcaagaacctcgccaagcaccttgaggagattgagaaaaaccaaaaggaacagaacagagtcttttacatggcgttgccccccagcgttttcatcacagtctcagagcaactaaaacgcaactgctaccccaaaaatggtgtcgctcgtattattgtcgagaaacctttcggcaaggacctccagagctctcgtgatctccagaaggcccttgagcccaactggaaagaagaagagatcttccgtattgaccactacctcggcaaggagatggttaagaacatccttatcatgcgctttggcaacgagttcttcaatgccacctggaaccgccatcacatcgacaacgttcagatcacgttcaaggaaccattcggtacggagggccgtggaggttactttgatgaattcggcatcatccgtgacgttatgcagaaccaccttctgcaagttctcacactgcttgctatggagcgacccatctctttctccgccgaagacatccgtgacgagaaggttcgcgtcttgcgcgccatggaccccattcaacccaaggatgtcatcatcggccagtacggcagatcactagatggtagcaaacccgcatataaggaggatgatacagtgccacaggactctcgctgccccaccttctgtgcgctggtcgctcacatcaagaacgagagatgggatggtgttcctttcatcatgaaggcgggtaaagccctcaacgaacagaagaccgaaatccgtattcagttcaaggacgtcacttctggcatcttcaaggatatcccccgcaacgagcttgtcatccgtgtccaacccaacgaatctgtctacatcaagatgaactcgaaacttcctggactttccatgcagaccgtggttactgagctggatctcacctaccgtcgtcgattctccgacctcaagattcctgaagcctacgaatctttgatcttggatgctctcaaaggagaccactccaactttgtccgtgacgacgagctcgatgctagctggaggatgttcactcctctgctccactacctcgatgacaacaaggagatcatccctatggaatacccctacggttcccgcgggccctccgttcttgacgacttcaccgcttcctatggctacaagttcagtgatgctgcgggataccagtggccgttgacgcacactacgcctaacaggctgtag

SEQ ID NO: 2649 - protein, 511 aa, Emericella nidulans
MSATIARAEEQQNGSTVELKDDTVIVVLGASGDLAKKKTFPALFGLFRNKFLPKGIKIVGYARTQMDHNEYLKRVRSYIKTPTKEIEEQLNSFCELCTYISGQYDQDDSFKNLAKHLEEIEKNQKEQNRVFYMALPPSVFITVSEQLKRNCYPKNGVARIIVEKPFGKDLQSSRDLQKALEPNWKEEEIFRIDHYLGKEMVKNILIMRFGNEFFNATWNRHHIDNVQITFKEPFGTEGRGGYFDEFGIIRDVMQNHLLQVLTLLAMERPISFSAEDIRDEKVRVLRAMDPIQPKDVIIGQYGRSLDGSKPAYKEDDTVPQDSRCPTFCALVAHIKNERWDGVPFIMKAGKALNEQKTEIRIQFKDVTSGIFKDIPRNELVIRVQPNESVYIKMNSKLPGLSMQTVVTELDLTYRRRFSDLKIPEAYESLILDALKGDHSNFVRDDELDASWRMFTPLLHYLDDNKEIIPMEYPYGSRGPSVLDDFTASYGYKFSDAAGYQWPLTHTTPNRL

SEQ ID NO: 2650 - DNA, 1962 bp, Macropus robustus
  CDS (1)..(1548)
atggcagagcaggtggcactgagccggacccaagtgtgtggaattctccgggaagaattgtaccagggtgatgccttccaccagtcagacacacacatattcatcatcatgggagcctcgggtgacttagcaaagaagaaaatctaccctacaatctggtggctgttccgtgatgggcttctccccgaagacaccttcattgtgggctatgctcgctcaaacctcactgtggatgacatccgaaagcaaagcgagccctattttaaggccaccccggaagagaacctgaagctggaggagttcttctctcgaaattcctacgtggcaggccaatacgatgagccagcttcctttcagcgtctcaatgcccacatgaactccctgcatcatgggtcacaggccaaccgcctcttctacctggccttgccacccaccgtctatgaagctgtcactaagaacatcaaagagacttgcatgagccagataggttggaaccgggtcattgtggagaagccttttggaaaagatcttcagagctctgacaaactgtcaaaccacatttcctcactcttccatgaggaccagatctaccggatcgatcactacctgggcaaggaaatggtacagaacctcatggtgctaagatttggtaacaggatctttggaccgatctggaaccgagacaacattgcctgtgtcatcttcaccttcaaggagccctttggcactcttggccgagggggctattttgatgagtttgggatcattcgagacgtgatgcagaaccacctcttgcagatgctttgcctagtggccatggaaaaacctgcctccaccaactctgatgatgtccgggatgaaaaggtgaaggtcctgaagtgtatctcagaggtgagagcaactgatgtggtcttgggccagtatgtggggaacccagatggagaaggggaagccaccaaaggctatttggatgatcccacagtgccccggggctccaccactgccacctttgctgctgtggtcctctatgtggaaaatgaaagatgggacggagtcccctttatcctccgctgtggaaaggccctgaatgaacgcaaagcagaagtgaggttacagttccgggatgtggctggtgatatcttccagcgccagtgtaagcggaatgagctggtgatccgcgtgcagcccaacgaggctgtctacaccaagatgatgaccaagaagccagggatgttcttcaaccccgaagagtcagagctggacctgacctatggcaacagatacaaagatgtgaagctgcccgatgcttatgagcgccttatcctggatgtcttctgtggaagccagatgcactttgtgcgcagtgatgagcttcgggaagcctggaggatctttacgcccctgctgcaccacattgagaaggagaagacccagcccattgcctacgtctatggcagccgaggccctcctgaagcagacgaactgatgaagagagtgggcttccagtatgagggcacctacaagtgggtaaacccccacaagctctgaggcagcctggcagcccactagcttcctcccccttgtttcccatccccagcctccatgctcatccttttagccctttggcctcacttagggtctgtctctctgcccatcccctgttcatgttctactcaggcagaaactcttgggaccacaagaccaggagcccgtccctgggggagatggagggccccattgagagattccctgggccctttccactcccagaaggcccggggacccggccaccaacttctcagccctgtttacagctgcattaggtctgccattcagcagctaccagatacttcctcctgctttgagctcccagagccagctacattccaatagcagtcgctggaggtgtcctctgtttcccttcaggacagcagctttataaatacagagaattaccagtca

SEQ ID NO: 2651 - protein, 515 aa, Macropus robustus
MAEQVALSRTQVCGILREELYQGDAFHQSDTHIFIIMGASGDLAKKKIYPTIWWLFRDGLLPEDTFIVGYARSNLTVDDIRKQSEPYFKATPEENLKLEEFFSRNSYVAGQYDEPASFQRLNAHMNSLHHGSQANRLFYLALPPTVYEAVTKNIKETCMSQIGWNRVIVEKPFGKDLQSSDKLSNHISSLFHEDQIYRIDHYLGKEMVQNLMVLRFGNRIFGPIWNRDNIACVIFTFKEPFGTLGRGGYFDEFGIIRDVMQNHLLQMLCLVAMEKPASTNSDDVRDEKVKVLKCISEVRATDVVLGQYVGNPDGEGEATKGYLDDPTVPRGSTTATFAAVVLYVENERWDGVPFILRCGKALNERKAEVRLQFRDVAGDIFQRQCKRNELVIRVQPNEAVYTKMMTKKPGMFFNPEESELDLTYGNRYKDVKLPDAYERLILDVFCGSQMHFVRSDELREAWRIFTPLLHHIEKEKTQPIAYVYGSRGPPEADELMKRVGFQYEGTYKWVNPHKL

SEQ ID NO: 2652 - DNA, 1530 bp, Nostoc punctiforme
  CDS (1)..(1530)
atggttagtctgctagaaaatcccttgcgcgttggtctgcaacaacaagggatgcctgaaccccagattatagttatctttggcgcttctggtgatctcacctggcgcaaactagtgccagcactttacaaattgcggcgagaacggcgcattccaccagaaactactattgttggcgtagcacgtcgagaatggagccatgaatacttccgcgaacaaatgcagaagggcatggaagaggcacatcctgatgtcgatttaggggaactctggcaagacttctctcaaggtctcttctacagtcctggagatatagacaaccctgaaagctaccagaaactaaaaaccttactgagtgaattagacgaaaaacggggcacgcgaggcaatcgcatgttctacctatcggttgccccttcattctttcccgaagcaattaagcagctaggaagcggcgggatgctagaagatccctacaaacatcgtctagtaattgaaaaaccctttggtcgggacttggcttctgcccaaagccttaaccaagtggtacagaaatattgcaaagagcatcaagtatatcgtattgaccactacttgggtaaagaaacagtccagaatttgctggtgttccgctttgccaatgcgatttttgaacccttgtggaatcgtcaattcgttgaccacgtgcaaattaccgtagcagaaaccgtgggcgtagaagaccgggctggctactatgaaagcgccggcgcactgcgggatatgttgcaaaatcacctcatgcaactttactgcttaacggcgatggaagcacccaacgcaatggatgccgacagcatccgcacagaaaaagtgaaggtactccaagctactcgtttagctgatgttcacaatctgtcgcggtcagcagtccgtgggcaatacagtgctggctggatgaaaggtcaagcagtgccaggatatcgcacagaaccaggcgttgaccccaactccaccacacccacttatgtagcgatgaagtttttggtggataactggcgctggaaaggtgttcctttctacttgcggactggaaagcggatgccgaaaaaagtgagtgaaattgcaattcacttccgcgaagttccatctcggatgttccaatctgccgctcaacagacaaacgccaatattttgacgatgcggattcagccaaatgaaggtatttccctgcgttttgatgtcaaaatgccgggggcagaattccgcacccgttccgttgatatggactttagttatggttcctttggcatccaagcaacatccgatgcctacgatcgcttattccttgattgtatgatgggcgatcaaacattgttcacacgtgcagatgaagtagaagcagcttggcaagtagtgacaccagccctttccgtttgggatgcacccgccgatcctactactattccccagtacgaagccgggacttgggagccagaacaagcagaactcttaattaaccaggatggccgtcgctggcgcagactctaa

SEQ ID NO: 2653 - protein, 509 aa, Nostoc punctiforme
MVSLLENPLRVGLQQQGMPEPQIIVIFGASGDLTWRKLVPALYKLRRERRIPPETTIVGVARREWSHEYFREQMQKGMEEAHPDVDLGELWQDFSQGLFYSPGDIDNPESYQKLKTLLSELDEKRGTRGNRMFYLSVAPSFFPEAIKQLGSGGMLEDPYKHRLVIEKPFGRDLASAQSLNQVVQKYCKEHQVYRIDHYLGKETVQNLLVFRFANAIFEPLWNRQFVDHVQITVAETVGVEDRAGYYESAGALRDMLQNHLMQLYCLTAMEAPNAMDADSIRTEKVKVLQATRLADVHNLSRSAVRGQYSAGWMKGQAVPGYRTEPGVDPNSTTPTYVAMKFLVDNWRWKGVPFYLRTGKRMPKKVSEIAIHFREVPSRMFQSAAQQTNANILTMRIQPNEGISLRFDVKMPGAEFRTRSVDMDFSYGSFGIQATSDAYDRLFLDCMMGDQTLFTRADEVEAAWQVVTPALSVWDAPADPTTIPQYEAGTWEPEQAELLINQDGRRWRRL

SEQ ID NO: 2654 - DNA, 1476 bp, Rhizobium meliloti
  CDS (1)..(1476)
atgagcagccagatcattcccgtcgaaccgtttgactatgtggtgttcgggggcaccggcgatcttgcggagcgcaagctgctgccggcactttatcaccgtcagatggaaggtcagttcacggaaccgacgcggatcatcggcgcatcgcgcgcgagcctttcccatgacgaataccgcaggttcgcgagcgacgccctgaaagaacacctgaagtccggggagttcaacgaggcggaagtcgagaaattcacctcgcgtctctattacgtctccgtcgacgccaagtccgagcagggctgggacgatctgaagaagctcctggaagagggcaaggatcgtacccgtgccttctatctcgccgtcgggccggcgattttcagcgacatttccgaaaagatccgcgatcacaagcttatcacgaggaacacccgcatcgtcgtcgagaagccgatcggccgcgacctcgcttccgcgacggagctcaacgacacgatcggcaaggtcttccgcgaagagcagattttccgcatcgaccactatctcggcaaggaaacggtgcagaatctgatggcactgcgcttcgccaacgcactttacgagccattgtggaattccgcccacatcgaccacgtgcagatcaccgtttccgaagccgtcgggctcgagaatcgcgcaggctactacgacaaggcgggcgcgctgcgcgacatggtgcagaaccatatcctccagcttctctgtttcgtcgcaatggaggcgccgacgtcgatggacgcggaggccgtgcgcgacgagaagctcaaggtgcttcgcgcgctgaagccgatcaccgcctccaatgtcgagcaggtgacggtccggggccaataccgcgcgggcgcatcgtccggaggcccggtcaagggctatctcgaagagctcgaaggaggcgtttccaacacggaaaccttcgtcgcgatcaaggccgagatcagcaattggcgctgggcaggcgtgcccttctatctgcgtaccggaaagcgcatggcgggccgcatgtcggagatcgtcatcaccttcaagcagatcccgcactcgatcttcgatcagagtgccggccggatttcggccaaccagctgatgatccgcctgcagccgaatgaaggcgtcaagcagtcgctgatgatcaaggatcccggaccgggcggcatgcggctgaggaacgtgcccctcgacatgagcttcgccgaggccttcgcggtccgcaatgccgatgcctatgaacgcctgttgctggacgtcatccgcaacaaccagaccctgttcgtgcgccgcgacgaagtggaagcggcctggcaatggatcgacccgatcctcaaggcctgggaagcaaccggacagcaggtgcaaggatataccgccggaacctggggcccgagccagtcgatcgcgctgatcgagcgcgacggccgcacttggaacgatgcgatctag

SEQ ID NO: 2655 - protein, 491 aa, Rhizobium meliloti
MSSQIIPVEPFDYVVFGGTGDLAERKLLPALYHRQMEGQFTEPTRIIGASRASLSHDEYRRFASDALKEHLKSGEFNEAEVEKFTSRLYYVSVDAKSEQGWDDLKKLLEEGKDRTRAFYLAVGPAIFSDISEKIRDHKLITRNTRIVVEKPIGRDLASATELNDTIGKVFREEQIFRIDHYLGKETVQNLMALRFANALYEPLWNSAHIDHVQITVSEAVGLENRAGYYDKAGALRDMVQNHILQLLCFVAMEAPTSMDAEAVRDEKLKVLRALKPITASNVEQVTVRGQYRAGASSGGPVKGYLEELEGGVSNTETFVAIKAEISNWRWAGVPFYLRTGKRMAGRMSEIVITFKQIPHSIFDQSAGRISANQLMIRLQPNEGVKQSLMIKDPGPGGMRLRNVPLDMSFAEAFAVRNADAYERLLLDVIRNNQTLFVRRDEVEAAWQWIDPILKAWEATGQQVQGYTAGTWGPSQSIALIERDGRTWNDAI

SEQ ID NO: 2656 - DNA, 1731 bp, Arabidopsis thaliana
  CDS (1)..(1731)
atggcgacacattctatgatcattccttctccttcttcttcttcctcgtctctcgctactgctgcgtctccgtttaaagagactctaccactctttagtagatctctcacattcccgagaaaatccttgttttctcaggttcgcttgagattcttcgccgagaaacattctcagcttgatacttcaaatgggtgtgccactaatttcgcttctttacaagattctggagatcaacttacagaggaacatgttacaaaaggagagtctactcttagtattacagttgttggagcgtcaggggacttagccaagaagaagatatttcctgcattgtttgctctcttttatgagggttgtcttcctcaggacttttctgtttttggttatgctcggactaaactcactcatgaagagcttcgtgacatgattagtagtactttaacttgccggattgatcagagggaaaaatgtggggataagatggagcagttcttgaaaagatgcttttaccattcgggtcagtataactcggaagaggattttgcggaactaaacaagaagctcaaagagaaagaggcaggaaagatatcaaacaggctgtactatttgtcgatacccccaaacatattcgttgatgtggttaggtgtgcaagtcttagagcctcctcagagaatggctggacaagggtcattgtggaaaagccatttggtcgtgactctgaatcatccggagagttaactagatgtctgaaacagtatcttacagaggagcaaatcttcaggattgatcactatttgggaaaggagcttgttgagaacctttcagtgctccgattctcaaatcttgttttcgagcctctgtggtcaagaaattacatacgcaacgttcagctgattttttctgaggatttcggaacagaagggcgtggaggttactttgatcaatatggaatcatacgagacatcatgcaaaaccatctcttgcaaatacttgcactttttgcaatggagacgccagtgagcttagatgctgaggacataagaagtgaaaaggtgaaagttttgagatcaatgaaaccgttgcggcttgaagatgtggttgttggtcaatacaaaggccataacaagggaggaaaaacttatccaggttatacagacgatccaacggttccaaatcacagtctcactcctacatttgctgcagcagccatgttcatcaacaatgcgagatgggacggtgttccttttcttatgaaagctggaaaagctctccataccagaggagcagagatcagagttcagttcagacatgtcccaggaaacttgtacaagaaaagttttgctactaatttagacaatgcaacaaatgaactagtgattagagttcagcctgatgaagggatatacctgaggatcaacaacaaagttcctggtcttggaatgagactagatcgcagcgaccttaaccttctatatcgatccaggtatccaagagagataccagatgcatatgaaagactgcttctcgatgcaatcgaaggagagaggaggttgtttatcagaagtgatgagctagatgcagcatgggatctattcacaccggctttgaaggaactagaggagaagaaaatcattcctgagctctatccatatggaagcagaggtcctgttggtgcacattaccttgcatctaagtacaatgtgagatggggagatcttggagaagcttaa

SEQ ID NO: 2657 - protein, 576 aa, Arabidopsis thaliana
MATHSMIIPSPSSSSSSLATAASPFKETLPLFSRSLTFPRKSLFSQVRLRFFAEKHSQLDTSNGCATNFASLQDSGDQLTEEHVTKGESTLSITVVGASGDLAKKKIFPALFALFYEGCLPQDFSVFGYARTKLTHEELRDMISSTLTCRIDQREKCGDKMEQFLKRCFYHSGQYNSEEDFAELNKKLKEKEAGKISNRLYYLSIPPNIFVDVVRCASLRASSENGWTRVIVEKPFGRDSESSGELTRCLKQYLTEEQIFRIDHYLGKELVENLSVLRFSNLVFEPLWSRNYIRNVQLIFSEDFGTEGRGGYFDQYGIIRDIMQNHLLQILALFAMETPVSLDAEDIRSEKVKVLRSMKPLRLEDVVVGQYKGHNKGGKTYPGYTDDPTVPNHSLTPTFAAAAMFINNARWDGVPFLMKAGKALHTRGAEIRVQFRHVPGNLYKKSFATNLDNATNELVIRVQPDEGIYLRINNKVPGLGMRLDRSDLNLLYRSRYPREIPDAYERLLLDAIEGERRLFIRSDELDAAWDLFTPALKELEEKKIIPELYPYGSRGPVGAHYLASKYNVRWGDLGEA

SEQ ID NO: 2658 - DNA, 2112 bp, Arabidopsis thaliana
  CDS (142)..(1932)
gatctcaaaaggttctcttatttgcagtatcgccccttaaatcctttttcgatgtttcttatgttcatcattattttttaactaaaaatctcatctttagacaacaattcaatttgccatctctctgttgtatctttgacgatggcggctttgtcttcctccgtcaccacccgatcatatcattccggttatttggcttctttctcaccggttaacggtgaccgacatcgatcactctcgttcctgtctgcttctcctcaaggattgaatcctcttgacctctgtgttagattccagaggaagtctggtcgtgcttctgtctttatgcaagatggtgcaatagtcactaattcaaattcatcagagagtaaaacttctcttaagggattgaaagatgaggtgctatcagctttatctcaagaagcagccaaggttggagtagaatctgatggtcaaagccagtcaacagttagtattacggtggttggagcctctggtgatcttgctaagaagaagattttcccggctcttttcgccctttactatgaaggttgtctccctgagcattttacaatatttggatattctaggagtaagatgacagatgttgaacttagaaacatggtcagcaaaaccctcacttgcagaattgataagagggcaaactgtggtgaaaagatggaagaatttctcaagagatgtttttaccattctggtcagtatgattctcaggaacattttactgaattggataagaagctcaaggaacatgaggctggaagaatctcaaaccgcctcttttatttgtctatccctccaaatatatttgtagatgctgtgaaatgtgcaagcacttctgcttcatctgtcaatggatggactagggttatcgtcgagaaaccttttggtcgagattctgaaacctcggctgctttaacgaaatccctcaagcagtatttggaggaagatcaaatttttaggatagaccattacctaggaaaggagctagtcgagaacttatctgttcttcgattctcaaaccttatatttgagccgctatggtcaaggcagtacataaggaacgtgcaatttatattttctgaggatttcggcactgaaggacgtggagggtactttgacaattacggaataataagagatataatgcagaatcatctgcttcaaatcttagccctctttgccatggaaacgcctgttagtttggatgcagaggatatcagaaatgaaaaggttaaggtgttacgttcaatgaggccaattcgagttgaagatgtggtaataggacaatacaagagccacacaaagggaggagtcacatatcctgcctacaccgatgataaaactgtaccaaaaggtagtctgactccaacatttgcagctgctgctcttttcatcgacaatgcaagatgggacggtgtgccctttttaatgaaagcgggcaaagcactacacaccaggagtgcagagataagggtgcagttcaggcatgttccggggaatttgtataaccggaatactggttctgatcttgatcaagctacaaatgagcttgtgatccgtgtccaaccagatgaagcaatctatttgaaaatcaacaacaaggtccctggtttaggaatgagattagatcgcagtaacttgaatcttctatactcagcaaggtattcaaaggagataccagatgcatatgagaggcttctgttagatgcaatagaaggagaaagaagattgttcataagaagtgacgagcttgatgcagcttggtcgctattcactccattgcttaaagagattgaagagaagaagagaatccctgagtactatccttatggtagccgtggtcctgttggtgctcattatctagctgctaaacacaaggtgcaatggggtgacgtcagtattgaccagtaaaacattttcttgtttgtattctcttttttttacattgataatagatttatctaggattcaagctttttctacgcctctttttacagctttaatttgtgcaatttggttatgtaccatttaataaataaataaaccaaaggggtttctcttattctctacaaggaaaatgtcttcttttta

SEQ ID NO: 2659 - protein, 596 aa, Arabidopsis thaliana
MAALSSSVTTRSYHSGYLASFSPVNGDRHRSLSFLSASPQGLNPLDLCVRFQRKSGRASVFMQDGAIVTNSNSSESKTSLKGLKDEVLSALSQEAAKVGVESDGQSQSTVSITVVGASGDLAKKKIFPALFALYYEGCLPEHFTIFGYSRSKMTDVELRNMVSKTLTCRIDKRANCGEKMEEFLKRCFYHSGQYDSQEHFTELDKKLKEHEAGRISNRLFYLSIPPNIFVDAVKCASTSASSVNGWTRVIVEKPFGRDSETSAALTKSLKQYLEEDQIFRIDHYLGKELVENLSVLRFSNLIFEPLWSRQYIRNVQFIFSEDFGTEGRGGYFDNYGIIRDIMQNHLLQILALFAMETPVSLDAEDIRNEKVKVLRSMRPIRVEDVVIGQYKSHTKGGVTYPAYTDDKTVPKGSLTPTFAAAALFIDNARWDGVPFLMKAGKALHTRSAEIRVQFRHVPGNLYNRNTGSDLDQATNELVIRVQPDEAIYLKINNKVPGLGMRLDRSNLNLLYSARYSKEIPDAYERLLLDAIEGERRLFIRSDELDAAWSLFTPLLKEIEEKKRIPEYYPYGSRGPVGAHYLAAKHKVQWGDVSIDQ

SEQ ID NO: 2660 - DNA, 1909 bp, Arabidopsis thaliana
  CDS (1)..(1878)
atgtctctctccagttgcttgcttcccttttctcaatcagcgacggctccgtcttcctccgtctgctcttgccatctcgccgcctctttttctaattttccggtttcgtcaagagactatagtttctccagaagtggaagccttgttctcaacggaggaggctcgaatctctgccggagattctgtggtttgaaactgtggatacttaagagcttgaatcgtagacaaggcaacaacagaaaacatcagcctgtaaacgagcttacaacacactcaaagcacactttcctcagcgatgatgaacgaggttttgctgaagaaactagagctgaagatttacgaccagaagagaatattctgggaacggatttgaatgatgggtttcacaatgttggagacttaccacctgtgtcaaaacaactctcggatgatctttcagatgttcgaagaagggcctcactttgcattgctgttgtaggagccactggtgagctagcaagagggaagattttcccggcattgtttgcgttgtattatagcggctaccttcctgaggatgttgctatatttggggtttcaagaaagaatctgacagatgaagacctcagatccatcattgcatcaacgctgacttgccgtgttgatcatcaggagaattgtgggggcaagatggatgcatttcagagtagaacatactatatcaatggaggttataataacagggatgggatgtcccgacttgccgagagaatgaaacagattgagggagaatcagaagcaaatagaatcttttacctctcagtacctcaagaagctctggtggatgtggcatgcaccattggagataacgctcaggcaccacgaggctggactcgaataatagttgagaaaccttttggttttaactcacattcgtctcatcagttaacaaagtcacttctctctaagtttgaagagaagcaaatctacaggatagatcacatgttaggaagaaacctcattgaaaatctgacagtgttaaggttttcaaatctagtttttgaaccactatggaacagaacatacatacgcaatatacaggttattatatcagaatcaattgcgcaaacagaaaagttttctgatggatatggaataatacgggacatagtgcacagccatatacttcagacaatcgcattacttgccatggaacctccgataagtctcgatggtgaagatatccgaaatgaaaaggtgaaggttttaagatcaattcgcaagatagacccgcgtgatgtcatccttggccagtataaatccagttcccgagacaagaacggtgtgatcttgaacggtgtagaccctacatattgtgcagcagccttgtatattgataatgcacgttgggatggtgtacctttccttgtaagagttggcactggcctcattaaacacagagtggagattcatgtgcaattccggcatgttcctggaaacctataccgagaaaatattggaataaacatagatttggggacaaatgagcttattctacgtgacgaacctgatgaggccatcctggtgaaaatcaacaacaaggttcctggtttaggtcttcagctagacgcttctgaacttaacttgctctataaagacaggtataaaaccgaagtaccagactcatatgaacacctaattcatgatgtaattgacggagacaatcatctgttcatgagaagcgatgaggttgcagcagcatggaacattcttagtccggttctagaagagatagacaagcatcacacagctccggagttgtatgaatttggtggacgaggaccagttgcggcatactatctttgggccaagcacggtgtcccatgggcagatgactgaagaagaaacatagatgcagcaacaaacaaat

SEQ ID NO: 2661 - protein, 625 aa, Arabidopsis thaliana
MSLSSCLLPFSQSATAPSSSVCSCHLAASFSNFPVSSRDYSFSRSGSLVLNGGGSNLCRRFCGLKLWILKSLNRRQGNNRKHQPVNELTTHSKHTFLSDDERGFAEETRAEDLRPEENILGTDLNDGFHNVGDLPPVSKQLSDDLSDVRRRASLCIAVVGATGELARGKIFPALFALYYSGYLPEDVAIFGVSRKNLTDEDLRSIIASTLTCRVDHQENCGGKMDAFQSRTYYINGGYNNRDGMSRLAERMKQIEGESEANRIFYLSVPQEALVDVACTIGDNAQAPRGWTRIIVEKPFGFNSHSSHQLTKSLLSKFEEKQIYRIDHMLGRNLIENLTVLRFSNLVFEPLWNRTYIRNIQVIISESIAQTEKFSDGYGIIRDIVHSHILQTIALLAMEPPISLDGEDIRNEKVKVLRSIRKIDPRDVILGQYKSSSRDKNGVILNGVDPTYCAAALYIDNARWDGVPFLVRVGTGLIKHRVEIHVQFRHVPGNLYRENIGINIDLGTNELILRDEPDEAILVKINNKVPGLGLQLDASELNLLYKDRYKTEVPDSYEHLIHDVIDGDNHLFMRSDEVAAAWNILSPVLEEIDKHHTAPELYEFGGRGPVAAYYLWAKHGVPWADD

SEQ ID NO: 2662 - DNA, 1548 bp, Arabidopsis thaliana
  CDS (1)..(1548)
atgggatctggtcaatggcacgttgagaaaaggtctacgtttaggaatgattcgtttgtgagagaatatggtatagttccagaaactggttgtctttcaatcatagttcttggtgcttctggtgatcttgctaagaagaagacttttcctgctctttttaacttataccgtcagggatttctcaatccagatgaagttcatattttcgggtatgcgaggactaagatttctgatgaagagctgagagataggattcgtggatatcttgttgatgagaagaatgctgagcaagctgaagctttgtcaaagtttctgcagctgattaagtatgtgagtggcccttatgatgctgaggaggggttccagagattagacaaggcaatttcagagcacgaaatctccaaaaatagtactgaagggtcttccagaagactgttttatcttgcacttccaccgtctgtttatccttctgtatgcaagatgatcaagacgtgctgcatgaacaaatctgatcttggtggatggacacggattgttgtggagaagccatttggcaaggaccttgaatctgcagagcaactgagttctcagattggagagttatttgatgaatcacagatctatcgtatagaccattatcttgggaaggaattagttcaaaacatgttggtcctccggtttgcaaatcgctttttcttgccactttggaaccgtgacaatatcgagaacgtgcagattgttttcagggaagattttggaactgaagggcgtggcggatattttgacgaatatggaataatccgtgatattattcaaaaccatctgctacaggttctttgccttgttgccatggagaaaccaatatctcttaaacctgagcatatccgggatgagaaagtgaaggtgcttcaatctgtggttccgataagcgatgacgaggtagttcttggacaatacgaaggatatagggatgatgatactgttccaaacgactcaaacactccaacatttgccacaacaatccttcgcatacacaacgaaagatgggaaggtgttccatttatattaaaggccggaaaagcgttgaattcaaggaaggcagaaattcgcattcaattcaaggatgtcccaggcgacatattcagatgtcaaaagcaaggaaggaacgagtttgtgatacgcttgcaaccttcagaggcaatgtacatgaaactaactgttaagcaaccaggtctagatatgaatactgtgcaaagtgaactagacttgtcgtatgggcaacggtatcaaggtgtcgctatccctgaggcatacgagcgcttaattcttgacacaatcaaaggcgatcaacaacatttcgttcgtagagacgaattaaaggttgcgtgggagatcttcacgccgctactccacaggatcgacaaaggagaagtaaagtcaatcccatacaaaccaggaagccgaggaccgaaagaagctgatcagctactagagaaagctggttatcttcagactcacggctatatctggatccctcctacactataa

SEQ ID NO: 2663 - protein, 515 aa, Arabidopsis thaliana [sequence omitted]

SEQ ID NO: 2664 - DNA, 1719 bp, Drosophila melanogaster
  CDS (1)..(1719)
atgcaatatctatcactaatcttttttaaattacaactatttattcttggccaaaatttgacgttaccttgctttcttttattctctcaaaattatacttcaattaaattacccgaaatgatttccatggacccccacaatgaggaggcgtattccatcgtggtcttcggagcctcaggcggattggccaaaaagaaggtgtttccggcgctttgggctctcttccgggagaatcggctgccccagggcaccaaaatatttactttcacccggtccccgctgcagacgaagacgtaccggttgcagattcttccctatatggagctggacaagcatcgggaccccaagaagtacaacctcttttggacgaccgtgcactgtgtgcagggcgagtacgacaagccggagaactacgtggcactcacggaggcgatggtacaccaggagacaaagcacaatcaggtgcgcgcgaatcgaatcttctacctggcgctgccaccgatcgttttcgatcaggtgaccctcaatgtcagtcgaaaatgcagctcgaccacgggatggaaccgcataatagtggagaagcccttcgcgcgggacgacatctcctacaaggcctttcaaacctcgctgtgcaactgcttccgggagtcgcagatttacctgatggaccacctcctcagccggcaggtgatgcagaacttctttgcgctgcgctactcaaaccacttgtgggccgagaccctgaaccaccgccacgtggcggcggtgatgatatccataaagtgtgagctgccggtgtcggtgaatcgggcagactactttaatcagtttggcattattcgcgacctgatgaccaaccacatgatccagatgctggccatgctggctatggatcagccgtacgccaacactgctgacgacctgcgtgccgaacggctgaaggttcttcgccaggtgctaactcccaacataggcgacgtcgtcttggctcaataccgcaacaaccggcgggagactgaccccgcgaagtgcggctacacggagcacacctacatcccgaaggactcctttacgcccacattcgctctggtggtgctgcacatcaacaaccgccgttggaccggggtacccttcattctcagagcgggaaaagccttgaacgacaccaagtcggaggtgcgtatccagtacaagccggtggactgcgacaccttccacagcgacagtactgacattcgtaacgagctagtcctgagatccttccccacggaagaggtctttatgcgcatgcgcctcaagcggcagggcgaggatatctgccttcgggagagcgagatcaacctgcgagtggatgatcggggaccgaagggactccaaggactgcccggctacctgctcaacgtgtttcaaggcgaccagacgctcttcatgcgctccgatgagcagtgcgagatttggcgcatattctcccccgttctcgccaccatcgattcggatcgtccccgcccgttgcactatgactttggatcacggggtcctttgctggcctatcgcaaggccgagcgcgctggcttcgtattcttcgccacggacgagtggcatcagagcgaagagacgttagaatacacggtcaagaatagcaagcagctaatcggaccccataccgccctcaagccagtaagagatcctcggtccaagaggtcgaattccaatccttag

SEQ ID NO: 2665 - protein, 572 aa, Drosophila melanogaster
MQYLSLIFFKLQLFILGQNLTLPCFLLFSQNYTSIKLPEMISMDPHNEEAYSIVVFGASGGLAKKKVFPALWALFRENRLPQGTKIFTFTRSPLQTKTYRLQILPYMELDKHRDPKKYNLFWTTVHCVQGEYDKPENYVALTEAMVHQETKHNQVRANRIFYLALPPIVFDQVTLNVSRKCSSTTGWNRIIVEKPFARDDISYKAFQTSLCNCFRESQIYLMDHLLSRQVMQNFFALRYSNHLWAETLNHRHVAAVMISIKCELPVSVNRADYFNQFGIIRDLMTNHMIQMLAMLAMDQPYANTADDLRAERLKVLRQVLTPNIGDVVLAQYRNNRRETDPAKCGYTEHTYIPKDSFTPTFALVVLHINNRRWTGVPFILRAGKALNDTKSEVRIQYKPVDCDTFHSDSTDIRNELVLRSFPTEEVFMRMRLKRQGEDICLRESEINLRVDDRGPKGLQGLPGYLLNVFQGDQTLFMRSDEQCEIWRIFSPVLATIDSDRPRPLHYDFGSRGPLLAYRKAERAGFVFFATDEWHQSEETLEYTVKNSKQLIGPHTALKPVRDPRSKRSNSNP

SEQ ID NO: 2666 - DNA, 1503 bp, Xenopus laevis
  CDS (1)..(1503)
atgagggaagaacttttaagcgaacaagagttccaccagtctgagacgcacatattcattgtcgttggagcttcgggagatctggccaaaaagaagatctaccccactctgtggtggctttacaacgatggtttgctcccagaagacacctacatagtaggctttgcacgttcaaagctgacagtgcaggatatcaaaaagcagagcgagccgtacttcaaggtatctgcagaggatgctttgaaacttgacacatttttcaagcgcaactcatatatttctggacaatactcagatgcagcctccttccaaaaccttaaccagcacctgaattcattacccaatggggcaaaagccaaccgcctcttctacctagcactaccacccagtgtgtatcatgatgttacccgcaacatcaaagagacctgcatgagctctgtaggatggaaccgtgttattgtggagaaaccttttggcaaagatctggaaagttccaatcgtttgtcggaacacatctcctccttatacaaggaaaaccagatctatcgtatcgaccattacctgggcaaagagatggtacagaacctcatgatcttaagatttggtaacaggatattcagccccctctggtccagggatcacataagtgcagtggttctgacatttaaagagcctttcggaacacaggggcgtggaggatactttgacgaatttggcatcatccgggatgtcatgcaaaatcacttgctccaaatgatgtgtttgatggctatggagaagccggtctccaccaactcggatgatgttagagatgaaaaggtgaaagtgttgaaatcagtggctcccctcaatcttgataatctggtaatagggcagtatattgggaatccggacggacaaggcgaggcacaagaaggctatttggatgaccgcactgttccaaaaggatctttgacccccacatttgccactgcagtcctatatgtgcagaatgagcgttgggatggtgtcccctttatcatgcgctgtggcaaggccttgaacgagaggaaggcagaggcacgactgcagtttcgtgatgtgcctggagatatattccaaggccaatgcaaaaggaatgaactggtgatcagagtgcagccaaatgaagctgtgtacaccaagatgatgaccaagaagccaggaatgttctttaaccctgaggagtcagagctagacttaacatatggcagcagatacaaggatgtgaagttgccagacgcatatgagcggcttattttggatgtgttctgtggaaatcagatgcactttgtacgcagtgatgaactgagagaagcttggaggatcttcacccctgttctccatcagctggagagagaaaaaatcaaaccccatccttataaatatggaagccgtgggcccgcagaaagtgacgagctaatgcagaaggttggcttccattatgcaggaacctacaaatgggtgaacccaaacaagctctga

SEQ ID NO: 2667 - protein, 500 aa, Xenopus laevis
MREELLSEQEFHQSETHIFIVVGASGDLAKKKIYPTLWWLYNDGLLPEDTYIVGFARSKLTVQDIKKQSEPYFKVSAEDALKLDTFFKRNSYISGQYSDAASFQNLNQHLNSLPNGAKANRLFYLALPPSVYHDVTRNIKETCMSSVGWNRVIVEKPFGKDLESSNRLSEHISSLYKENQIYRIDHYLGKEMVQNLMILRFGNRIFSPLWSRDHISAVVLTFKEPFGTQGRGGYFDEFGIIRDVMQNHLLQMMCLMAMEKPVSTNSDDVRDEKVKVLKSVAPLNLDNLVIGQYIGNPDGQGEAQEGYLDDRTVPKGSLTPTFATAVLYVQNERWDGVPFIMRCGKALNERKAEARLQFRDVPGDIFQGQCKRNELVIRVQPNEAVYTKMMTKKPGMFFNPEESELDLTYGSRYKDVKLPDAYERLILDVFCGNQMHFVRSDELREAWRIFTPVLHQLEREKIKPHPYKYGSRGPAESDELMQKVGFHYAGTYKWVNPNKL

SEQ ID NO: 2668 - DNA, 1545 bp, Mycobacterium paratuberculosis
  CDS (1)..(1545)
atgagcccggctcgcaccgcgcagcaatggcataacccgttacgcgacaagcgcgacaagcggctcccgcgcatcgccgggccgtgcggaatggtgatcttcggcgtcaccggcgatctggcccgcaagaaggtcatgcccgccatctacgacctggccaaccgcgggctgctgccgcccagcttctcgctggtcggcttcgcccgaagggattggagcacccaggatttcggcaaggtggtatatgaggccgtcaaggagcactgccgcaccccgttccggcaggagaactgggatcggctggccgagggattccgtttcgtgccaggcgctttcgacgacgacgaggcgttcggccggctcgccgagacgctggacaaactcgacgccgagcggggcaccggcggtaatcacgccttctacctggccatcccgcccaagtccttccccgtcgtgtgcgaacaactgcacaagtccgggctggcccgcccgcagggcgaccgctggagccgagttgtcatcgagaagccgttcggccacgacctggagagcgcgcagagcctgaacaaggccgtcaacgccgtctttcccgaggagtcggtcttccgcatcgaccactacctgggcaaggagacggtccgcaacatcctggcgctgcggttcgccaaccagttgttcgacccgatctggaactcgcactacgtcgaccacgtgcagatcaccatggccgaggacatcggcctgggcgggcgggccggctactacgacggcatcggcgccgcgcgcgacgtcatccagaaccacctgatgcagctgctggcgctgaccgcgatggaagagccggtcagcttcagcccgttggcgctccaggccgagaagatcaaggtactctcggccacccacctcgcccacccgctcgacgagaccaccagccgcggccagtacaccgcgggctggcagggcggcgagaaggtggtcgggctgctcgacgaggagggcttcgccaaggactcgatcaccgagacgttcgccgccatcaccctcgaggtggacacccgccgctgggcgggggtgccgttctacctgcggaccggaaaacgcttgggccgcagggtgaccgagatagccctggtgttcaagcgcgcgccgcatctgccgttcgacgcgacgatgaccgatgagctgggcgccaacgccatggtgatccgggtgcagcccgacgagggtgtcacgctgcggttcggttccaaggtgccgggcaccgcgatggaggtccgcgacgtcaacatggacttctcctacgggtcggcgttcgccgaggaatcaccggaggcctacgagcagttgatcctcgacgtgctgctgggtgagccgtccctgttcccggtcaacgccgaagtcgaattggcttggcacatcctcgatcccgtgctcgacaactgggcgagcggcggcaggcccgagccctacgaggccggcacctggggcccggattcggcgttcgagatgctgcaccggacgggccgcgaatggcggcggccatga

SEQ ID NO: 2669 - protein, 514 aa, Mycobacterium paratuberculosis
MSPARTAQQWHNPLRDKRDKRLPRIAGPCGMVIFGVTGDLARKKVMPAIYDLANRGLLPPSFSLVGFARRDWSTQDFGKVVYEAVKEHCRTPFRQENWDRLAEGFRFVPGAFDDDEAFGRLAETLDKLDAERGTGGNHAFYLAIPPKSFPVVCEQLHKSGLARPQGDRWSRVVIEKPFGHDLESAQSLNKAVNAVFPEESVFRIDHYLGKETVRNILALRFANQLFDPIWNSHYVDHVQITMAEDIGLGGRAGYYDGIGAARDVIQNHLMQLLALTAMEEPVSFSPLALQAEKIKVLSATHLAHPLDETTSRGQYTAGWQGGEKVVGLLDEEGFAKDSITETFAAITLEVDTRRWAGVPFYLRTGKRLGRRVTEIALVFKRAPHLPFDATMTDELGANAMVIRVQPDEGVTLRFGSKVPGTAMEVRDVNMDFSYGSAFAEESPEAYEQLILDVLLGEPSLFPVNAEVELAWHILDPVLDNWASGGRPEPYEAGTWGPDSAFEMLHRTGREWRRP

SEQ ID NO: 2670 - DNA, 1410 bp, Mycobacterium paratuberculosis
  CDS (1)..(1410)
atggccgacgatgacagccatccatccgacctgctggtgatcttcggaatcaccggggacttggcgcgcaagatgacgttccgcgcgctctaccggctggagcgccgcgaggagctcgagcacccgatcatcggcgtggccagcgacgacatcaccctcgaccagctgctggaccgcgcccgggaggcgatcaaggccaccggtgagacgttcgacgacgcggtgttcgaccgcttggcgggccggctgtcctacctgtcgggcgacgtcaccgacgccgggctctacagcgagctcgccaagaagatcggtggcgattcgcgtccgctgtactacctggagatgccgccgtcgttgttcgcgccgatcgtggagaacctggccaaggccgacctactggaacgcgccagggtggcggtggaaaagccgttcggccacgacctggaatctgcgcgcgacctcaacgcccggctgcgcgcggtgctcgacgaagaccaaatcctgcgcgtagaccactttttgggcaaacagccggtcgaagaactgcaatacctgcggttcgccaacaacgccctggccaagctgtgggaccgcgacagcatctccgaaatccacatcaccatggccgaggacttcggcatcgaggaccgcggcaagttctatgacgccgtgggggcggtgcgcgacgtcgtgcaaaaccatctgctgcaggtgctcgcgctggtcgccatggaacccccggtgggggcgggcgccgacgacctcaacgacaagaaggccgaggtgttccgggccatgccgtcgctggacccggagcactgcgtgcgtggccagtatcgcggctacaccgaagtccccggtgtggcaaaggattccaccaccgagacctacgtcgcgctgagggccgagatcgacaactggcgctgggccggggtgccgatcttcctgcgcgccggcaaggcgttgccgcacaaggtcaccgaggtccggatgttcctgcatcacgtgcccggcttctccttcctgcccaaccgccgcccgcccgagcccaaccagatcgtgctgcgcatcgaccccgatcccgggatgcgcctgcagctgtccgctcaggtcggcgactcgtggcacgacgtgcacctggactcctcgttcgcggtggacctcggcgaaccggtgcggccctacgaacggctgctctacgccgcgttcaacggcgaccgccagctgtttgcccgcgaggacgccatcgaagagacctggcggatcgtgcagccggtgctggacaagccgagccgcatccaccaatacgagcaaggctcctggggacccgaggccgcgcaggcgctggtgcacggtcgccacgcctggcagcaaccgtggctgccgcagagcacgtccacgaaacgataa

SEQ ID NO: 2671 - protein, 469 aa, Mycobacterium paratuberculosis
MADDDSHPSDLLVIFGITGDLARKMTFRALYRLERREELEHPIIGVASDDITLDQLLDRAREAIKATGETFDDAVFDRLAGRLSYLSGDVTDAGLYSELAKKIGGDSRPLYYLEMPPSLFAPIVENLAKADLLERARVAVEKPFGHDLESARDLNARLRAVLDEDQILRVDHFLGKQPVEELQYLRFANNALAKLWDRDSISEIHITMAEDFGIEDRGKFYDAVGAVRDVVQNHLLQVLALVAMEPPVGAGADDLNDKKAEVFRAMPSLDPEHCVRGQYRGYTEVPGVAKDSTTETYVALRAEIDNWRWAGVPIFLRAGKALPHKVTEVRMFLHHVPGFSFLPNRRPPEPNQIVLRIDPDPGMRLQLSAQVGDSWHDVHLDSSFAVDLGEPVRPYERLLYAAFNGDRQLFAREDAIEETWRIVQPVLDKPSRIHQYEQGSWGPEAAQALVHGRHAWQQPWLPQSTSTKR

SEQ ID NO: 2672 - DNA, 1874 bp, Oryza sativa
  CDS (9)..(1742)
ggctccaaatggccggcaccggcttacgattccggcagggcgccatcttcttctcaggagctcatgctgctgctcatccaagaacaaggactcctcaccaccattgctcacctcagaggacgcacgatgcgagaggaaggtgccgcctcacggctaagtccgcaaatggacgcccacagatcagtgcctccttcagagatgtggcgatagatggggcacagtctgaagatggggcgccagagcagggaggatccaccgtcagcatcaccgtcgtcggcgcctccggcgatctcgccaagaagaagatctttcccgcgcttttcgccctgtactacgaggactgcctcccggagcattttacagtttttggttatgctcgtagcaagatgagcgatgaagagctcaggaacatgattagcttgactctgacatgccggattgatcagagggagaactgcagtgacaagatggaacagtttctgaagagatgcttttatcaatctgggcagtacaattcagaggaagggttttctgaactggacagaaagctaaaagaaaaggaggctggcaaggtaccaaacaggctcttttacctgtcgattccaccgaacatatttgtcgatgtggtgagatctgctagtcgcacagcatcatctcaagacggatggacaaggttcatagtggagaagccattcggccgcgattccgagtcgtcaggggagctcactcgaaacttgaagaagtacttggccgaggagcagatattcaggattgaccattatttggggaaggagctggttgagaacctctcggtgctccgtttctccaatctcgtcttcgagccactgtggtcgaggaactacatcaggaatgtgcagctcatattttctgaagatttcggcacggagggtcgaggcggccacttcgacaactacgggatcatcagggacataatgcagaaccacctgctgcagatcctggccctgttcgccatggagactccggtcagcctcgacgccgaggacatccgcaacgagaaggtgaaagtgctgaggtcgatgaggcagctgaggctggaggacgtggtggtgggtcagtacaaggggcacagcaagggcgggaagacgtacccggcgtacgtggacgacccgacggtgccgagcggcagcatcacgccgacgttcgccgccgccgccctcttcatcgacaacgcccgctgggacggcgtccccttcctcatgaaggccggcaaggccctgcacacgcgacgggcggagatcagggtgcagttccggcgggtgccggggaacctgtacgggcggcggagccggagcgtgggcggcggcgggacgacagcgacgagggagctggagaaggcgacgaacgagctggtgctgcgggtgcagcccgacgaggcgatctacctcaagatcaacagcaaggtgcccgggctggggatgaggctggacagcagcgacctcaacctgctctactccgagcgctaccccgccgagatccccgacgcctacgagcgcctgctgctcgacgccatcgagggcgagcgccgcctcttcatccgcagcgacgagctcgacgccgcctgggccatcttcacccccgtcctcgccgacctcgaggccaacaaggtggcacccgagctctacccgtacggcagccggggacccgtcggagcgcactacctcgccgccaaccacaacgtccgctggggtgacattagctagctcagaaaatgaaaagatcgatcggagtcgctgttaccgtgcttgctataatcttcatttaccatttgcattgatgaattctttattggactgctcagggacgaaattaataaaacaaagctctagtcattc

SEQ ID NO: 2673 - protein, 577 aa, Oryza sativa
MAGTGLRFRQGAIFFSGAHAAAHPRTRTPHHHCSPQRTHDARGRCRLTAKSANGRPQISASFRDVAIDGAQSEDGAPEQGGSTVSITVVGASGDLAKKKIFPALFALYYEDCLPEHFTVFGYARSKMSDEELRNMISLTLTCRIDQRENCSDKMEQFLKRCFYQSGQYNSEEGFSELDRKLKEKEAGKVPNRLFYLSIPPNIFVDVVRSASRTASSQDGWTRFIVEKPFGRDSESSGELTRNLKKYLAEEQIFRIDHYLGKELVENLSVLRFSNLVFEPLWSRNYIRNVQLIFSEDFGTEGRGGHFDNYGIIRDIMQNHLLQILALFAMETPVSLDAEDIRNEKVKVLRSMRQLRLEDVVVGQYKGHSKGGKTYPAYVDDPTVPSGSITPTFAAAALFIDNARWDGVPFLMKAGKALHTRRAEIRVQFRRVPGNLYGRRSRSVGGGGTTATRELEKATNELVLRVQPDEAIYLKINSKVPGLGMRLDSSDLNLLYSERYPAEIPDAYERLLLDAIEGERRLFIRSDELDAAWAIFTPVLADLEANKVAPELYPYGSRGPVGAHYLAANHNVRWGDIS

SEQ ID NO: 2674 - DNA, 1449 bp, Lactobacillus johnsonii
  CDS (1)..(1449)
atgaaaaatattccagttgttatgattatttttggtggctccggagatttagctcatagaaagctttatccagccttatttaatttgtatcaaaaaggtttaattcatgatcattttgctgtaattggtacagcgagaagaccttggagccatgaatatttgcaagaacaagtagttgaagcagttaaagaaagctgtgacaactttgatgaaaaagaagcaaaagaattcgcttcacatttttattaccagtctcacgatgtaactgatattggccactacattgccttgaaggaattagcagctaaacttgatgaaaaatatcaagcagaaggaaatcgaattttctacatggctatggcaccaagattttttggtacaattgctactcacattaatgatcaaaaattgcttggtagcggctttaaccgtttagtaattgaaaagccatttggtcatgatttagcttcagcagaaaagttaaaccgagaaattggcgaaagttttgatgaagagtcggtatatcgaattgaccactatcttggaaaagaaatggttcaaaatattatgcctctaagaatgactaatccaattgttaagaatatctggaataatgactatatcgcaaatatgcaagtaactttagcagaaagtctaggagtaggaactcgtggtggttactacgaaacatctggtgctttacgtgatatggttcaaaaccatatttttcaaattattacacttttagctatgcctgagcctaaaggacttgattcagaccatattcaccaagctaaacaagaattattagatagtctagtaattccaactccagaaatggttaaaaagcatttctcacgaggacaatatttagctgatgataatgaagtagagtatttaaaggcagatcaagttgcactagactctaaagtagaaacatttgtagctggagaagttaaattcaaaaagggtccagtagctgatgtgccaatttactttagaactggtaagaaaatgaaggataaggtttctcgcattgatattgttcttcaccatatgaataatttatacggtagcgcacattcaaataatatctcaattattattgatccaattagtgaaatttatttcacaattaatggaaagaagattacagctgaaggtttaagaagagaaaaccttagttataagttttctaaggaagaaatggagcaagttccagatggctacgaacgattgcttcacgatgtgtttgtagcagatagaactaactttactcactggtcagaattgaagcaatattggaagttcgttgatgcagttgaagatgtttggcaagatgaaaataaagatgttaagcagcttgaacaatatccaagtggtaagttcggtacggaatcaagtaatcatatttttgaaaaagatagcgagcactggatttaccgttaa

SEQ ID NO: 2675 - protein, 482 aa, Lactobacillus johnsonii
MKNIPVVMIIFGGSGDLAHRKLYPALFNLYQKGLIHDHFAVIGTARRPWSHEYLQEQVVEAVKESCDNFDEKEAKEFASHFYYQSHDVTDIGHYIALKELAAKLDEKYQAEGNRIFYMAMAPRFFGTIATHINDQKLLGSGFNRLVIEKPFGHDLASAEKLNREIGESFDEESVYRIDHYLGKEMVQNIMPLRMTNPIVKNIWNNDYIANMQVTLAESLGVGTRGGYYETSGALRDMVQNHIFQIITLLAMPEPKGLDSDHIHQAKQELLDSLVIPTPEMVKKHFSRGQYLADDNEVEYLKADQVALDSKVETFVAGEVKFKKGPVADVPIYFRTGKKMKDKVSRIDIVLHHMNNLYGSAHSNNISIIIDPISEIYFTINGKKITAEGLRRENLSYKFSKEEMEQVPDGYERLLHDVFVADRTNFTHWSELKQYWKFVDAVEDVWQDENKDVKQLEQYPSGKFGTESSNHIFEKDSEHWIYR

SEQ ID NO: 2676 - DNA, 1485 bp, Bacillus cereus
  CDS (1)..(1485)
atggaatcaatgacctttgttttatttggagcgacaggggacttagcgaaacgaaaaatttaccccgcactatataacttatatagagatcaaaagcttccaaagcaaatatccgttatcgggcttggaagacgccaagtatctcatgtagattttcaaggaagaataaaagaatcaatagagacattttcccgtcatagagaagaaggtactctagaacttgaaggttttttagataattttcgctattgtccattagatgtgagtaagccggaagactatgagagattattgcaagtcgttcgtgaaagggaagaagaactacatataaaagggaatagaatgttctatctttccgttgctcctgaatttttcgagaccattgctttaaatattaaggaaagcggacttgataaaacggatggatggaaacgcctaatgattgagaaaccgtttgggcacgatcttcaatctgctcgtgagttgaatgataagcttagtcgcacgtttgaagaagatgagatataccgtattgatcattatttaggtaagccgatgattcaaaaccttgaagcactagagtttgcaaatcctgttctccaatcgatttggaataaagaacatatagcgaatgtacaaattacagcgagtgaaacagttggggttgaagaaagagcaggatattatgatcaggcaggagccattcgagatatggttcaaaatcatatgttacaaatattaatgatgactgctatgaatctgccggaaaaggttaatgcatgtgaaattcgagaggaaaagcgaaaggtaatggagacgcttcgtaaagtgaaaaaagaagacgttcaaaaccatatcattcgcggacaatacgcttcaggagagataaaaggcgagcaagttgtagcatataaagaggagccaggagtaaatccttcttctaatatagacacatttgttgctgctcgtttatggatcgataatccgttttggactgacgttcccttctatatacgaacaggcaaacgaatgaaagaaaaatctactcgtattgtaatcgaatttaaaaatacgctaaaacagcaatatcaagataataatccaaatgcagcacctaacttattaataattgaaattagcccaggtgagaatgtttcattacagttaaatagtaaaaatccattgaaaaatggagaaattgaaccgatgcgtattaactttacttgcgagcaagcagatgtgggagtgcctgaagcgtatgaaagacttattcatgatgctgtaagtggagacgctacattctttgcacattggagagaagttgaattgtcatgggaatgggtacaaccaattcttgaagcattcgaggaaaacttattaccacttcatgaatatgagtctggttcatatggtccagatgcgtctcatgaattattgcaagaaagtggatttaaatggtggttagatcaagaaacggaaaaataa

SEQ ID NO: 2677 - protein, 494 aa, Bacillus cereus
MESMTFVLFGATGDLAKRKIYPALYNLYRDQKLPKQISVIGLGRRQVSHVDFQGRIKESIETFSRHREEGTLELEGFLDNFRYCPLDVSKPEDYERLLQVVREREEELHIKGNRMFYLSVAPEFFETIALNIKESGLDKTDGWKRLMIEKPFGHDLQSARELNDKLSRTFEEDEIYRIDHYLGKPMIQNLEALEFANPVLQSIWNKEHIANVQITASETVGVEERAGYYDQAGAIRDMVQNHMLQILMMTAMNLPEKVNACEIREEKRKVMETLRKVKKEDVQNHIIRGQYASGEIKGEQVVAYKEEPGVNPSSNIDTFVAARLWIDNPFWTDVPFYIRTGKRMKEKSTRIVIEFKNTLKQQYQDNNPNAAPNLLIIEISPGENVSLQLNSKNPLKNGEIEPMRINFTCEQADVGVPEAYERLIHDAVSGDATFFAHWREVELSWEWVQPILEAFEENLLPLHEYESGSYGPDASHELLQESGFKWWLDQETEK

SEQ ID NO: 2678 - DNA, 1539 bp, Ashbya gossypii
  CDS (1)..(1539)
atgatgtgtggagaagtgacgaggacagacgcttttgaaaaggatgtgataattacagtgtttggagcctcaggggatcttgccaagaagaagacgttcccagcactgtatggattgtatcgcgaggggtacctggacgacagcacgaagattattgggtatgctcggtcggagctatctgatgcggagctgcgggagcgcgtcaagccgtacttgagcaaaccagacgacgcagcgagtgaggccaagcaagccgagttcctggagaggatgagctacgtagctgggccttacgacaaggaggaggggtacgtgcagttgcgggagcagattgaggcttacgagcgcgaacggggcgttgagaaacctcacaggttgttctacttggcgcttcctcccagtgcgtttgtcagtgttgctgagaaaatcaagcagttcctctatgcggagggcggcgttacaaggttaattgtggaaaagccctttggccatgacctggagtcgtctcggaagttgcaaaagcagctggagcctctgttccgtgaggaggagatattccggattgaccactacttaggaaaggagatggtcaagaacctgctacctctgcggtttggtaatgcgttcttcaatgcctcctggaataaggaaaatatccagatgatccagatctcgttgaaggaaccatttgggacggaaggccgtggaggttactttgactccactggtattataagggacgtcatgcagaaccacttgctccaagtactaactttgctaaccatggagaggccagtatcttttgatccggagagcatacgtgacgagaaagtcaaggtgctgaaggccatcgttcctcttgaccacgaagacattttgattggacagtacggccgatctgaagatggtacaaagcctgcttacttagatgacgagactgtcagcaaggactctaagtgcgtgacatttgccgcgttgacctttaatatccagaatgagcggtgggatggagttcctattgtcatgcgtgcagggaaggcattgaacgaaggtaaggttgagatccgtattctatacaagcgcgtggcgcggggtatttttaacgatattccaaacaatgagctagttgtccgtgtccagccagatgaggccatatacttgaaattcaacgctaaaacaccggggttggattcgaattcccaaattacggagcttgatttgacttactcgaagaggtatagggactactggattccggaggcttacgaatctctgttgcgggatgctttgctgggcgatcattcgaattttgtgagagacgatgagttggatatcagctggaagctgttcacccctctcttaaattaccttgagggcccagacagccctcggcctgaaatttataagtatggttctcgtgggcctgatggtctaaccaagtacttggagaagcatcagtatgtcttcgaaaagagcgggctttaccagtggcctgtctcgtccccaaaagaaaaagcaagtttggagccacggttatga

SEQ ID NO: 2679 - protein, 512 aa, Ashbya gossypii
MMCGEVTRTDAFEKDVIITVFGASGDLAKKKTFPALYGLYREGYLDDSTKIIGYARSELSDAELRERVKPYLSKPDDAASEAKQAEFLERMSYVAGPYDKEEGYVQLREQIEAYERERGVEKPHRLFYLALPPSAFVSVAEKIKQFLYAEGGVTRLIVEKPFGHDLESSRKLQKQLEPLFREEEIFRIDHYLGKEMVKNLLPLRFGNAFFNASWNKENIQMIQISLKEPFGTEGRGGYFDSTGIIRDVMQNHLLQVLTLLTMERPVSFDPESIRDEKVKVLKAIVPLDHEDILIGQYGRSEDGTKPAYLDDETVSKDSKCVTFAALTFNIQNERWDGVPIVMRAGKALNEGKVEIRILYKRVARGIFNDIPNNELVVRVQPDEAIYLKFNAKTPGLDSNSQITELDLTYSKRYRDYWIPEAYESLLRDALLGDHSNFVRDDELDISWKLFTPLLNYLEGPDSPRPEIYKYGSRGPDGLTKYLEKHQYVFEKSGLYQWPVSSPKEKASLEPRL

SEQ ID NO: 2680 - DNA, 2074 bp, Oryza sativa
  CDS (138)..(1904)
gcggctagactttcgtcgatatccccgataaaatccacccgtctcccctcctccccactcgccttcgcctccatcctcctcctcctcctgccggcttgcatccgctcttccttcctccaggaggaaggcatacaggcatggcgctctcctgcatgaggtgctccccggccgccggcgccgtacgacgaggattggcatcggcggctccgccggcggcgctctccttcgccagatgcggcctccgtagagcggccgcgctcgggtggcgcgtcgccgccgtcaccactacgggagtgcagggtgccaaggatgctggtctggagaaggctgccagaagtgcttcccaatcaaaggtggaaaatggctcaccttcagaaatcattttagatgattttgaagacttgagccctctatcagaaaatgatgactccactgttagtatcactgtagtcggagcatctggtgaccttgccaagaagaagatatttcctgcactttttgctctatactatgaagattgtcttccaaagcatttcactatcttcggatatgcacgcagcaagatgacagatgctgaattgagaaacatggtcagcaaaacactgacatgcagaatagataaaagggaaaactgtaatgagaagatggaagagtttttaaagagatgcttctatcattcaggccaatatgattcagaggagcatttcatggaccttgacaagaagctgaaacaacatgagggttccagagtttctaaccgtcttttctacttgtcaataccaccaaatatattccttgatgttgtaaaatgtgcaagcaaatcagcatcatctgggaatggttggacaagggtaattgttgagaaaccttttggtcgtgactcagattcatcttctgcattaacaaggggtctgaagcagtacctggtagaggaccaaatcttcaggattgaccactacttgggaaaggaactagtggagaacctgtctgtccttcgcttctcaaatcttgtttttgaacctctatggtcaaggcagtatataaggaatgtgcagctgatattctcagaggatttcggcactgaaggacgaggagggtactttgataggtatggtattatccgtgacataatgcagaatcatcttcttcagatactagccctatttgcaatggaaactcctgttagcttggaggcagaggacataagaaacgaaaaggttaaagttctgcgttccatgaagcccctgcaactggaagatgtggtgataggacagtacaaaagtcatacaaagggtggtaccacataccctggatacactgaagataagacggtgcccaaggatagtgtaaccccaacatttgctgcagctgcacttttcataaataatgctagatgggatggagttccttttcttatgaaagctgggaaggctttacatacaaagggggctgagattagagtacagttccgacatgttcctggtaatctttataagaggagttttgggactgatcttgatacagccactaatgaacttgtcatacgtgtgcaacctgatgaagctatctacttgaagattaacaacaaaattcctggtcttggtatgagactagatagaagtaatttgaatcttcactatgcagcaaggtactccaaggagataccagatgcttatgagaggctcttacttgatgccattgaaggagagcgaaggctttttatccgttctgatgagttggatgccgcatgggagctcttcactcccttactcaaggagctggaagagaagcggatagcccctgagctatacccttatggaagccgcggtcctgtaggggctcactaccttgcagcaaagtacaacgtcagatggggtgatttgaccacagaacagaaggcatgagacagatgatatctattttcgctccttttttttcttttgccattgcatttctgtaagattgcatgctcagttagtgggacagatggaaaataaggcaatcagttagcttaggttgcaaggcctgtaaccattagactataaatagctttgtggtatattcactattgggt

SEQ ID NO: 2681 - protein, 588 aa, Oryza sativa
MALSCMRCSPAAGAVRRGLASAAPPAALSFARCGLRRAAALGWRVAAVTTTGVQGAKDAGLEKAARSASQSKVENGSPSEIILDDFEDLSPLSENDDSTVSITVVGASGDLAKKKIFPALFALYYEDCLPKHFTIFGYARSKMTDAELRNMVSKTLTCRIDKRENCNEKMEEFLKRCFYHSGQYDSEEHFMDLDKKLKQHEGSRVSNRLFYLSIPPNIFLDVVKCASKSASSGNGWTRVIVEKPFGRDSDSSSALTRGLKQYLVEDQIFRIDHYLGKELVENLSVLRFSNLVFEPLWSRQYIRNVQLIFSEDFGTEGRGGYFDRYGIIRDIMQNHLLQILALFAMETPVSLEAEDIRNEKVKVLRSMKPLQLEDVVIGQYKSHTKGGTTYPGYTEDKTVPKDSVTPTFAAAALFINNARWDGVPFLMKAGKALHTKGAEIRVQFRHVPGNLYKRSFGTDLDTATNELVIRVQPDEAIYLKINNKIPGLGMRLDRSNLNLHYAARYSKEIPDAYERLLLDAIEGERRLFIRSDELDAAWELFTPLLKELEEKRIAPELYPYGSRGPVGAHYLAAKYNVRWGDLTTEQKA

SEQ ID NO: 2682 - DNA, 1900 bp, Gluconobacter oxydans
  CDS (301)..(1767)
ttttgctttctgcatccatgtccggtttccttcctgaggcgtaagtcttggctgtattttccggcgctgcacgaacacagcatccgccgcgcggcttatcgtgatgagggccagacggtcaacggaattatgtgcacgtttcatgaacgcgtgaagatgacgaagcttttctcccgaggtcgtgcagggcccgtcccttgacaggaagggccctgacagggaactagacggtgcctgaaaaggcctgaaccctaacccttttttcccggtctgcgggttcgagaggtcagagagtcttccatggaacatttccagcaggtcgagcctttcgactatgtcatcttcggtgccactggcgatctcacgatgcgcaagctgctgcccgcgctctacaaccgccttcggatgggccagattccggatgatgcgtgcatcatcggagccgcccgtacggagctggaccgggaggcctatgtcgcgcgggcccgagacgcccttgagcggtttcttccctcagacatcctgggcccggggctggtcgagcgtttcctcgcccgtctcgattacgtgacgctggacagcagccgcgagggcccgcagtgggacgccctgaagtccctgctggccaaggcacagcctgaccgggtgcgcgtctatatttcgcaaccgcaccgcagcttacggcagcatctgcgagacctgaaccgctacgagctgatcacccccacgtcgcgggttgttctcgaaaagccgatcggtacgaacatggccaccgccaccgccatcaatgacggggtcggccagtattttccggaaaagcagatctaccggatcgatcattatctcgggaaagagacggtccagaacgttctcgccctgcgttttgcaaacccgctcatgaacgctgcctggtccggcgagcatatcgagagcgtgcagatcacggcggtcgagaccgtgggcgtcgaaggtcgtgcggcctattacgacacgtctggcgcgcttcgcgacatgatccagaaccacctgctccaggtactgtgtctggttgcgatggaagcccccgattcccttgaggccgatgccgtccgcaacgccaaactggccgtcctgaacgccctgcgccccatcacggatgccacagccgccaccgagacggtgcgcgcgcagtacacggcaggcgtggtcgatggcgagaatgttccgggttatcttgaagagctcggcaagcccagcgcgacggaaacctatgccgcaatccgcgcctgggtggacacgccgcgctggaagaacgtgccgttctacatccgcacggccaagcggtccggcaagaaggtcagcgagatcgtcgtgacgttccgcccggctgcgaccaccatgttcggcgccaccccggccagcaacaggctggtcctgcgcatccagcccaacgaaggcgtggacctgcgtctgaacgtcaagaaccctgcgctggatgtcttcaacctgcggacggcggatcttgatacctccatccgcatggaaggcggcctgcccttcccggattcctatgagcggcttcttctggatgccgtgcggggtgatccggtactgttcatccgccgcgacgaggtcgaggccgcatggcgctgggtcgagcccatccttgaggcctggaaacatgacaaggcgcccatgcagacctacagtgcgggttcctatgggccggaacaggcaacacaactgctcgccagccatggcgacacctggcatgaagcgtcggagtaaccgcatttgagcgacgataaaagcgcaacgccccgcctgggtcgcactccgggccggggcacgcgccggcagccccgcagcttcaaacagctccttctgcggcggcttctggtcgtcatcccggcttttctgc

SEQ ID NO: 2683 - protein, 488 aa, Gluconobacter oxydans
MEHFQQVEPFDYVIFGATGDLTMRKLLPALYNRLRMGQIPDDACIIGAARTELDREAYVARARDALERFLPSDILGPGLVERFLARLDYVTLDSSREGPQWDALKSLLAKAQPDRVRVYISQPHRSLRQHLRDLNRYELITPTSRVVLEKPIGTNMATATAINDGVGQYFPEKQIYRIDHYLGKETVQNVLALRFANPLMNAAWSGEHIESVQITAVETVGVEGRAAYYDTSGALRDMIQNHLLQVLCLVAMEAPDSLEADAVRNAKLAVLNALRPITDATAATETVRAQYTAGVVDGENVPGYLEELGKPSATETYAAIRAWVDTPRWKNVPFYIRTAKRSGKKVSEIVVTFRPAATTMFGATPASNRLVLRIQPNEGVDLRLNVKNPALDVFNLRTADLDTSIRMEGGLPFPDSYERLLLDAVRGDPVLFIRRDEVEAAWRWVEPILEAWKHDKAPMQTYSAGSYGPEQATQLLASHGDTWHEASE

SEQ ID NO: 2684 - DNA, 1515 bp, Rhodopseudomonas palustris
  CDS (1)..(1515)
atgaccacgcaagccaacagcaatcaggtccccgaaggctgcgcgttcgtcatcttcggcgccaccggcgacctcacccatcggctggtgattccggcgctctacaacctcgccgaagccaacctgctgcctgaaaaattctgcgtcgtcggcgtcacccgcaaggagatgtccagcgacgatctgcgcgacagcctgatgcagggcctgcgcaaatacgcgacccgcccggtcgacgacaaggtcgctgatcagcttctgtactgcgtcaccgcggtcagcgccgatcccagcgagccggcctcgttcgagcggttgcgcgagcggctggagaagctcgaggccaatcgcaacaccggcggcaaccggctgttctatctcgccacgccgcctgatgcgttcgcgccgatcgccaccgagctcggccgcgccgggctgcttaaggagaccagcggcgcctggcgccggctggtggtggagaagccgttcggcaccgacctcgcctcggccaaggcgctgaacgatcatctgctcagcatcatctccgagcacgagctgtaccggatcgatcactacctcggcaaagagacggtgcagaacatcctggtgctgcggttctccaacggcatgttcgagccgatctggaacagagagcacatcgaccacatccagatcaccgtcgaggaaaagctcggcgtcggccatcgcggcagcttctacgacaagaccggcgcgctgcgcgacatggtgccgaaccatctgtttcaactgctgtcgctggtggcgatggagccgccggcgcatttcaacgcccacgcggtgcgttcggccaaggccgacgtgctcgcggcgatccagatccaaaccgaagaggaagcgctgcgcaattcggtgcgcggccaatacacttcgggcaagatcggcgacaccgacatcccggactatcgcagcgccaaggacgtcgcggccgacagcaccaccgagaccttcgcggcgctgacactgtcgatcgacaattggcgctgggccggcgtgccgttctatctgcgcaccggcaaggcgctgtcgggcaagcgcaccgaggtggcgatcaaattcaaggaggcgccattctcgatgtttcgctgcaccccggtgcaggaactgtcgcagaactttctggtcattgggatcgaaccggtcgaaggcatctcgctgcagttcaacaccaaggtgccgggaccgatgatcgccatcgacggcgtcgagatgaccttccgctacaaggactacttcaaggtggcgccgagcaacggctacgagacgctgctgcacgactgcatgatcggcgacaacatcctgttccaacgcgccgacggtgtcgaagccggctggcgcgcggtacaacccttcctcgacgcctggaagaaggccggcgcgcacggccttcagatctatcgcgccggcagcgatggcccggaagacgccgacgaactgctggggcgcgacggtcgcaattggcggaagccgacctga

SEQ ID NO: 2685 - protein, 504 aa, Rhodopseudomonas palustris
MTTQANSNQVPEGCAFVIFGATGDLTHRLVIPALYNLAEANLLPEKFCVVGVTRKEMSSDDLRDSLMQGLRKYATRPVDDKVADQLLYCVTAVSADPSEPASFERLRERLEKLEANRNTGGNRLFYLATPPDAFAPIATELGRAGLLKETSGAWRRLVVEKPFGTDLASAKALNDHLLSIISEHELYRIDHYLGKETVQNILVLRFSNGMFEPIWNREHIDHIQITVEEKLGVGHRGSFYDKTGALRDMVPNHLFQLLSLVAMEPPAHFNAHAVRSAKADVLAAIQIQTEEEALRNSVRGQYTSGKIGDTDIPDYRSAKDVAADSTTETFAALTLSIDNWRWAGVPFYLRTGKALSGKRTEVAIKFKEAPFSMFRCTPVQELSQNFLVIGIEPVEGISLQFNTKVPGPMIAIDGVEMTFRYKDYFKVAPSNGYETLLHDCMIGDNILFQRADGVEAGWRAVQPFLDAWKKAGAHGLQIYRAGSDGPEDADELLGRDGRNWRKPT

SEQ ID NO: 2686 - DNA, 1650 bp, Corynebacterium diphtheriae
  CDS (1)..(1650)
atgcccaacgtgagtaaaccagtggctaacggaaacaccgtagaaagtaacaatgctgaacttgctttcggcggtgttgatttttcctattctgatacacatgagaattcgtgtagtagaacgtcaagcaaatgggtcaatcccctaagggatgctgaggacaagcgcctcccccgcatcgcgggcccgtgcggaatggttatttttggtgtaactggtgatctcgctcggaaaaagctcctgccagcgatctatgatcttgcacacaggggcctattgcctgcaggtttcagtcttgtcggctacggtcgacgaggctggtctaaggccgactttgaaaattacgtcaagcaagcagttgttgccggtgcccgtaccgatttccgcgaaaatgtttgggcacgacttgccgaaggtatgcacttcgttcaaggcaatttcgatgatgatgcagcatttgatagtttggcatcgcttttggcggatcttgatcagacccgtggaactgccggtaactgggccttttatctctctgttccaccagattatttttcggatgtttgccatcaacttcagcgctcaggcatggctacagccgagggcaattcatggcgtcgcgtcattgtggaaaagccttttgggcatgatcaagaatcagcacgtcagctaaacaacttgatcaattcagtattccctgaaaagtcagtatttcgtatcgaccactacttgggtaaagagacagtgcaaaatattatggcactgcgctttgcaaaccagctatttgatccgctctggaattctcactatgttgaccatgtccaaatcaccatggctgaggatatcggtctaggcggtcgcgctggttactatgatggaatcggcgccgctagagacgttatccaaaaccaccttattcagctgttggcgctggtagctatggaggaacccgtagcttttaccccacaagagcttcaggctgaaaaaatcaaggttcttcgtgccactcgcccagtagaaccttttgctaaaacaacagcccgagggcaatattcgcgcggttggcagggatctgagctcgtccaaggtctacgagaagaagacggatttgatcctaattccggaactgaaacttatgctgcctgcacactcgagataaattcgcgtcgttgggccggtgtgcccttttatcttcggactggaaagcgtttaggacgccgggtgactgagatcgcccttgtattcaaggatgcgcctcatcagccatttagcgaaggtagccgtcattcccaaggccgcaacgtcgtagtgatccgagtccagcctgatgagggtatgctgatgcgttttggttccaaggttcctggtaacacgatggaagtacgcgacgtcaacatggacttctcgtactcagaggcatttaccgaagaatcaccggaagcctacgaacgactcattctcgatgcacttctcgacgaagcaagtctcttcccaacaaatgaagaagttgagcttagctggcagatcctagatccgatattgaacttctggtctgatcgtgggcaaccggaagaataccccgctggcacctggggcccagctggtgcagacaagatgctggagcgcgaaggtcgcgcttggcgtcgaccttaa

SEQ ID NO: 2687 - protein, 549 aa, Corynebacterium diphtheriae
MPNVSKPVANGNTVESNNAELAFGGVDFSYSDTHENSCSRTSSKWVNPLRDAEDKRLPRIAGPCGMVIFGVTGDLARKKLLPAIYDLAHRGLLPAGFSLVGYGRRGWSKADFENYVKQAVVAGARTDFRENVWARLAEGMHFVQGNFDDDAAFDSLASLLADLDQTRGTAGNWAFYLSVPPDYFSDVCHQLQRSGMATAEGNSWRRVIVEKPFGHDQESARQLNNLINSVFPEKSVFRIDHYLGKETVQNIMALRFANQLFDPLWNSHYVDHVQITMAEDIGLGGRAGYYDGIGAARDVIQNHLIQLLALVAMEEPVAFTPQELQAEKIKVLRATRPVEPFAKTTARGQYSRGWQGSELVQGLREEDGFDPNSGTETYAACTLEINSRRWAGVPFYLRTGKRLGRRVTEIALVFKDAPHQPFSEGSRHSQGRNVVVIRVQPDEGMLMRFGSKVPGNTMEVRDVNMDFSYSEAFTEESPEAYERLILDALLDEASLFPTNEEVELSWQILDPILNFWSDRGQPEEYPAGTWGPAGADKMLEREGRAWRRP

SEQ ID NO: 2688 - DNA, 1602 bp, Nonomuraea sp
  CDS (1)..(1602)
atgacagacccggcagcacccgcggaggaggccgtcaccgtggcggcggccgtcgcgggcaccgccaccaccgaggctgtggcagccgccaacccgctgcgcgacccgcgtgacaagcggttgccccgggtggcgggaccgtgcgtgatggtgttgttcggcgtgacgggtgacctggccaagcgcaagctgctaccggcgatttacgacctgggcaaccgggggctgctgccgcccggcttctcgctggtcggcttcgcccggcgcgattggaaagaccaggatttcgcccagttgacgcacgacgccgtcaaggcgcatgcccggacacccttccgtgaggaggtctggaagcagatccgcgagggcatccatttcgttcccggcgagttctcggacgacggggcgttcgacgcgctggccatggcgttggcagagatcgacgagacccgcggcacgggcggaaactacgctttctacctgtcggtgccgccgaagttcttccccgtggtggtggagcagctcaagcgcaccgggctgtccgacgcgcccgacggctcgtggcggcgggtggtgatcgagaagccgttcgggcacgacctgcagtcggcccacgagctgaacgagatcaccacctcggccttcccggagagctcgatcttccggatcgaccactacctgggcaaggagaccgtccagaacatcatggcgctgaggttcgccaacaacctctacgagccgatctggaaccgcagcttcgtcgaccacgtacagatcacgatggccgaggacatcggcatcggcggccgggccggctactacgacggcatcggcgccgcccgcgacgtgatccagaaccacctgctccagctcctcgcgctcgtcgcgatggaggacccgacctccttcgaggccaactcgctgcggcgggagaaggagaaggtgctcaaggccgtgcggctgcccgcgaacctgggcctgaacaccgcgcgcggccagtactccgcgggctggcagggcggcgagaaggtcgtcggctacctccaggaggagggcatctcgcaggagtccaccaccgagacctacgccgccatcaagctggagatcgccaaccggcgctgggccggcgtgccgttctacctgcgcaccggcaagcgcctgggccgccgcgtcaccgaggtggccgtggtgttccagcgggcgccgcacctgccgttcagcaaggacgacaccgagatcctcggccagaacgcgctggtcgtccgggtccagccggacgagggcatcaccgtgcggttcggctcgaaggtgccggggacggcgatggaggtgcgtgacgtctccatggacttcgcctacggcgagtcgttcctggagtcgtcgccggaggcgtacgagcggctgctgctcgacgtgatgatcggcgatccgccgctcttcccgcaccagcgggaggtggagctgtcgtggaacatcctcgacccgatcgaggagttctgggccacgcaggggcagccggagccgtacgagtccggttcgtgggggcccgagtcggccgacgcgatgatggcccgcgacggccgcgtgtggaggaggctctag

SEQ ID NO: 2689 - protein, 533 aa, Nonomuraea sp
MTDPAAPAEEAVTVAAAVAGTATTEAVAAANPLRDPRDKRLPRVAGPCVMVLFGVTGDLAKRKLLPAIYDLGNRGLLPPGFSLVGFARRDWKDQDFAQLTHDAVKAHARTPFREEVWKQIREGIHFVPGEFSDDGAFDALAMALAEIDETRGTGGNYAFYLSVPPKFFPVVVEQLKRTGLSDAPDGSWRRVVIEKPFGHDLQSAHELNEITTSAFPESSIFRIDHYLGKETVQNIMALRFANNLYEPIWNRSFVDHVQITMAEDIGIGGRAGYYDGIGAARDVIQNHLLQLLALVAMEDPTSFEANSLRREKEKVLKAVRLPANLGLNTARGQYSAGWQGGEKVVGYLQEEGISQESTTETYAAIKLEIANRRWAGVPFYLRTGKRLGRRVTEVAVVFQRAPHLPFSKDDTEILGQNALVVRVQPDEGITVRFGSKVPGTAMEVRDVSMDFAYGESFLESSPEAYERLLLDVMIGDPPLFPHQREVELSWNILDPIEEFWATQGQPEPYESGSWGPESADAMMARDGRVWRRL

SEQ ID NO: 2690 - DNA, 1551 bp, Parachlamydia sp
  CDS (1)..(1551)
atgcataactcgcattattttgttaatcctttgaacgaaccgaatcggcccataaaaattccagaatcttgtattttagtcatttttggagcgaccggtgatttaacagctcgtaaactaattccagctttgtataacttagcgagagacggccaacttcctggtcattttgcctgtgtaggctttgctagaagggcaaaaacacatgatgagtttcgggaagaaatgttagaagcagttaacaaattttcaagatcgaaaccagttgaacaaggactctggaaacgctttcgtgaacaattgttttatcatcaatcagaatttgatgatgatgaagggtataaaagcttaaaccaatttttagaaaaactcgacacacaaatgggaactaaaggtaaccgagttttttatttatctatccagcctagctattttcctctcgttgttgaaaagcttagccaacaccaattgacatatccagttaaacaagtcaaagacaaatggagtcgtgtcattatagaaaagccttttggaagagatattgaatcagcaaaacaacttcaacaagatcttgtgcaacacctagatgaaagtcaaatttatcgaattgatcattatttgggaaaagaaactgtacaaaatttattagtttttagatttggtaatcccatctttgaatcagtttggaataaccatcatattgataatattcaaattactgttggtgaagaaattggaattggttctcgcggtcgattttgggaagaagcaggaatgttgcgagatattgtccaaaatcatgtgatgcaactcctttctcttgttgcgatggaacccccgacgagtctccaagccaactcagtccgcggcgaaaaagttaaagtcattgaagctattagacctatccccttcgattcaatggaacaatgcgttatccggggccaatatggatctggattcattaacggggaacccgttaaaggatatcgagacgaggaaaatgtagactctaaatcttttgttgaaacctacgttgccttgcaactttctatcgataactggcgttgggctggagttcccttctatttacgtgctggtaaacgcctacccaaacgagctactgaaattgcgattactttcaaaaaagcccccggatatctatttgaaggaacttcagctttgattgactcaaacgttttagtgattcgtattcaaccggatgaaggaatttcattgagaattaattgcaaagtccctgcattaaacacagtcattcaaccggtgaaaatggattttcgttacggatcttactttggtgccattcctcccgaagcttatgaaagattaatttgtgattgcatggccggggataatactttatttgctagagatgacgaagtcattatgtcttggaagttgctcacacctattttagaacattggcaagaaacatccccgacagattttccaaattatgccgcgggaacttgggggccagaccgagccgaagaaatgctaaaacgccaaggacgtcattggagacttatttaa

SEQ ID NO: 2691 - protein, 516 aa, Parachlamydia sp
MHNSHYFVNPLNEPNRPIKIPESCILVIFGATGDLTARKLIPALYNLARDGQLPGHFACVGFARRAKTHDEFREEMLEAVNKFSRSKPVEQGLWKRFREQLFYHQSEFDDDEGYKSLNQFLEKLDTQMGTKGNRVFYLSIQPSYFPLVVEKLSQHQLTYPVKQVKDKWSRVIIEKPFGRDIESAKQLQQDLVQHLDESQIYRIDHYLGKETVQNLLVFRFGNPIFESVWNNHHIDNIQITVGEEIGIGSRGRFWEEAGMLRDIVQNHVMQLLSLVAMEPPTSLQANSVRGEKVKVIEAIRPIPFDSMEQCVIRGQYGSGFINGEPVKGYRDEENVDSKSFVETYVALQLSIDNWRWAGVPFYLRAGKRLPKRATEIAITFKKAPGYLFEGTSALIDSNVLVIRIQPDEGISLRINCKVPALNTVIQPVKMDFRYGSYFGAIPPEAYERLICDCMAGDNTLFARDDEVIMSWKLLTPILEHWQETSPTDFPNYAAGTWGPDRAEEMLKRQGRHWRLI

SEQ ID NO: 2692 - DNA, 1500 bp, Photobacterium profundum
  CDS (1)..(1500)
atggttcagccagaaaataacgcgattgttatttttggtgcgtcaggcgatttgactcaccgaaaattgattccagcattttatcatctctatgctaatgggttattaccagaagattttgcaattttaggcgtaagtcgtactgaatatagtgaccaagattttcgtgaaaaactaaaaatttcactcacagaaacagaaaaggtaaacgaagaaacgctaattaaattttgtgagcatttatattaccaagcattgaatacgtcagaagtggctgaatatgcgctgttaaaacagcgtttgggtgatttgaatgataagcatcatacccaaggtaatactatttattacttggcaaccccaccaagcttgtatggtgttattcctgaatgtttgggtgcgcatggcttaaacgacgaaacgcacggttggaaaaaccttattgttgaaaagccatttggttacgatttagcatcagccaacgagcttgatgaacgtattcatgcgcatttcaaagagcaacaaatttaccgcattgaccactacttaggcaaagaaacagtacagaatctacttgtatttcgttttgctaatgggatgtttgaaccattatggaaccgtaatttcatcgaatacgttgagatcacggcagctgaatctttaggtgtcgaagagcgcggtggctattacgatggagccggtgctgtacgtgatatgttccaaaatcacttacttcaagtacttgctatggttggaatggaatcgccagcagcaatcaatgcagattctattcgtgatgaagttgtgaaggttatgcaaagctttcagcctttgtcagacaaagatttagaaaaaaatcttgtgctagggcaatacaccgattccacagtaagaggcgatcatctaccaggataccgagaagaacatggcgtagcagatgattctcgcacagaaacgtatgttggtatgaagatgtttatccagaactggcgttggaatggcgtgccattttacgttcgtactggtaagcgtttacccactcgcgtgacggaagtggtcattcactttaagaaaacaccacacccagtgttcggtaccaatgcaccagagaataagctgatcattcgtattcaacccgatgaaggtattctaatgagtttcggtttgaaaaagccaggggctggctttgaagctgaagaagtttctatggatttccattacggcgatttagaagaaacgaatatgcttaccgcttacgagcgattattgcttgactgtatgaagggtgatgccacgttgtttgcccgaactgatgcggtaaaagcgtgctggaaattcgtacaacccattcttgaatataaagaaaatcctgaccatttatttggttatgcggcaggtacttggggaccaaaagaagcggatgagttattacaaggcgacgaacgtaattggcgctttccgtgtaaaaacctgactaatactgactattgtgagttatag

SEQ ID NO: 2693 - protein, 499 aa, Photobacterium profundum
MVQPENNAIVIFGASGDLTHRKLIPAFYHLYANGLLPEDFAILGVSRTEYSDQDFREKLKISLTETEKVNEETLIKFCEHLYYQALNTSEVAEYALLKQRLGDLNDKHHTQGNTIYYLATPPSLYGVIPECLGAHGLNDETHGWKNLIVEKPFGYDLASANELDERIHAHFKEQQIYRIDHYLGKETVQNLLVFRFANGMFEPLWNRNFIEYVEITAAESLGVEERGGYYDGAGAVRDMFQNHLLQVLAMVGMESPAAINADSIRDEVVKVMQSFQPLSDKDLEKNLVLGQYTDSTVRGDHLPGYREEHGVADDSRTETYVGMKMFIQNWRWNGVPFYVRTGKRLPTRVTEVVIHFKKTPHPVFGTNAPENKLIIRIQPDEGILMSFGLKKPGAGFEAEEVSMDFHYGDLEETNMLTAYERLLLDCMKGDATLFARTDAVKACWKFVQPILEYKENPDHLFGYAAGTWGPKEADELLQGDERNWRFPCKNLTNTDYCEL

SEQ ID NO: 2694 - DNA, 26 bp, Primer
atgaaggataaagtgtataagcgtcc

SEQ ID NO: 2695 - DNA, 27 bp, Primer
ttaggcagcgttaattacaaactgttc

SEQ ID NO: 2696 - DNA, 1263 bp, Escherichia coli K12
  CDS (1)..(1263)
atgaaaacgttaattgcccggcataaagctggtgaacatatcggcatatgttcagtctgttctgcccatccgttggttatcgaagcggcgctggcatttgatcgcaacagcacgcgcaaagtgctgattgaagcaacgtcaaaccaggtcaatcaatttggcggttataccggaatgacaccggcagactttcgcgaatttgtttttacgattgccgataaagttgggtttgcacgcgaacgcattattctcggcggcgatcatctggggccaaactgctggcagcaagaaaatgcggatgcggcgatggaaaaatccgtcgagctggtaaaggaatatgttcgtgccggcttcagtaaaattcatcttgatgcgtcaatgtcctgcgcgggggatcccataccgttagcaccagaaacggttgcggaacgagctgctgtgctttgctttgctgcggaaagtgtggcgacagattgccagcgtgagcaactgagctatgtcattggcaccgaagttccggttccgggcggtgaggccagcgccattcagtcagtacacatcacccatgttgaagatgccgccaatactttacgtacgcatcaaaaggcctttattgcccgtgggctgacagaggcgttaacacgtgtgattgccatcgtggtgcagccgggtgtggaatttgatcacagcaatattatccattatcagccgcaggaagcgcagccgctggcgcaatggatagaaaacacccgaatggtttatgaagcacattctaccgattaccagacccggacggcttattgggaattagtccgcgatcactttgcaatattgaaagtcggtcccgcattaacctttgctttacgcgaggcgatatttgcactggcacaaattgagcaggaacttatcgcccctgaaaatcgcagcggttgcctggcggtaattgaagaagtgatgctcgacgaaccgcaatactggaaaaaatattatcgtacgggttttaacgattcattactggatattcgttacagcctgtcggatcgtattcgttattactggccgcatagtcggattaaaaatagcgtcgaaacgatgatggtgaatcttgaaggcgtggacatcccactgggcatgattagtcagtatcttcccaaacaatttgaacgcattcagtccggggaattatcagcaataccgcatcagctgattatggataaaatttatgatgttttgcgcgcctatcgctacggctgtgcggaataa

SEQ ID NO: 2697 - protein, 420 aa, Escherichia coli K12
MKTLIARHKAGEHIGICSVCSAHPLVIEAALAFDRNSTRKVLIEATSNQVNQFGGYTGMTPADFREFVFTIADKVGFARERIILGGDHLGPNCWQQENADAAMEKSVELVKEYVRAGFSKIHLDASMSCAGDPIPLAPETVAERAAVLCFAAESVATDCQREQLSYVIGTEVPVPGGEASAIQSVHITHVEDAANTLRTHQKAFIARGLTEALTRVIAIVVQPGVEFDHSNIIHYQPQEAQPLAQWIENTRMVYEAHSTDYQTRTAYWELVRDHFAILKVGPALTFALREAIFALAQIEQELIAPENRSGCLAVIEEVMLDEPQYWKKYYRTGFNDSLLDIRYSLSDRIRYYWPHSRIKNSVETMMVNLEGVDIPLGMISQYLPKQFERIQSGELSAIPHQLIMDKIYDVLRAYRYGCAE

SEQ ID NO: 2698 - DNA, 1278 bp, Agrobacterium tumefaciens
  CDS (1)..(1278)
atgaccgccattttggaaaatctcgccgccgcgcgccgcgccggcaaacctgcgggcatcacttcggtctgctcggcccaccccgttgtcctgcgcgccgcaatccgccgcgccgccgccagtcaaacggccgtactgatcgaggccacctgcaatcaggtcaatcatctcggtggttataccggcatgacaccgcgtgacttcgttgccttcgtcaacagcatcgccgcggaagaaggactgcccgccgaactgctgatctttggcggcgatcatctcggccccaatccctggcgcagggagaaggccgaggacgcgctgacaaaagccgccgccatggtcgacgcctatgtcacagctggttttcgcaagatccaccttgatgcatcgatgggctgcgccggtgagccggcagccctggatgacgtcaccatcgcccaccgcgccgcgaaactcacagccgttgccgaaaaggcagccactgaggctggcctgccaaaaccgctttatattctgggcaccgaagtgccggtgcccggcggtgccgaccatgtgcttgagaccgtcgcaccgaccgaaccgcaggcggcgcgcaacaccatcgatcttcatcgcgaaatctttgcgcagcacggtctttccgatgcgttcgaacgggtcatcgcctttgtcgtgcagccgggtgtggaattcggcagcgacaatgtcgtcgcttatgatccgcaggcagcgcagagcctgagcgccgtgctggatggcgaaccgcgactggtcttcgaagcccattcgaccgattaccagaccgagcctgcccttgcggcactggtacgcgacggatatccgatcctcaaagttggaccgggcctcaccttcgcttaccgggaagcgctttatgcactcgacatgatcgcctccgaaatggtcggcacctatggcgaccgaccgctggcgcggactatggaaaaattgatgttaagcgcgccgggcgactggcagggccattaccatggcgacgacatcacgctccgattgcaacgccattacagctacagcgaccgcatccgttactactggacgcgaccggaagcgctcgcggccgtttccaccttgcataaggcactggatgggaagacaattcccgaaaccctgctgcgccaatatctcggcgaattgccgctcgcggcggttgcgggaaaggaaccggaggaggttctggtcgcggcggtggatcaggtgctggcgacctatcacgcggcgacgggcgaaggccgccactga

SEQ ID NO: 2699 - protein, 425 aa, Agrobacterium tumefaciens
MTAILENLAAARRAGKPAGITSVCSAHPVVLRAAIRRAAASQTAVLIEATCNQVNHLGGYTGMTPRDFVAFVNSIAAEEGLPAELLIFGGDHLGPNPWRREKAEDALTKAAAMVDAYVTAGFRKIHLDASMGCAGEPAALDDVTIAHRAAKLTAVAEKAATEAGLPKPLYILGTEVPVPGGADHVLETVAPTEPQAARNTIDLHREIFAQHGLSDAFERVIAFVVQPGVEFGSDNVVAYDPQAAQSLSAVLDGEPRLVFEAHSTDYQTEPALAALVRDGYPILKVGPGLTFAYREALYALDMIASEMVGTYGDRPLARTMEKLMLSAPGDWQGHYHGDDITLRLQRHYSYSDRIRYYWTRPEALAAVSTLHKALDGKTIPETLLRQYLGELPLAAVAGKEPEEVLVAAVDQVLATYHAATGEGRH

SEQ ID NO: 2700 - DNA, 1281 bp, Sinorhizobium meliloti
  CDS (1)..(1281)
atgcaagagaaccatctcatcgacatcgcccggtggagcgagcgtcccggcccgcgcggaataccgtcgatctgttccgcgcacccgctcgtcatcgaagctgccatgctgcgcgcacaccgggagaaagcgccggtgctgatcgaagcgacctgtaaccaggtcaatcaggacggcggctatacgggcatgacgcctgaggatttcacccgcttcgtcggcgccatcgccgaccggatcgaattcccccgggagaagatcctgctcggcggcgaccatctcggccccaatccctggaagcatctccccgccgatgaggcgatggccaaggcagaggcgatgatcacggcctatgcgaaagccggcttcaccaagctgcatctcgacaccagcatgggatgcgccggcgaaccgacggcgttgcccgacgccaccacggcggcccgcgcggcgcggctggcggccgtcgccgaggatgccgtcggcggccgtgggggcgtactcccggtctacatcatcggcaccgaagtcccgataccgggcggcgcgctcgaggagctagacaccctcgaagtgactgctcccgaagctgccatcgagaccgtgcgcgtccatcgcgcggcgttcgaggaggccggcgccgccggggccttcagccgcgtcgttggcgccgtcgtccagccgggcgtggaattcggcaacgagaacgtcattgcctatgatcgtgccagggccgaaaagctcagcgccactctgggccaacttcacgggatggtcttcgaggcccattccaccgattaccagacgccggatgcgcttcgcgaactggtcgccgacggcttcgcgatcctgaaggtcggacccggcctcacctttgctcttcgcgaagccctctacggcctcgaccagatcgctgcctttctctttccggctgcgcgtgagcggacgcttgccgaagtcacggaagcggtgatgcgcgaggaaccggcgaactgggcaaaatactaccacggctcggcggaagagcagcgacttcagcggcacttctcctatagcgaccgcatccgctattactggccgcatccgaaggccgctgcagccgtcgacgaactcatgtctctgctcgacggcgtcgcgatcccggaaacgctgatcagccagtttctcgccggcagctacgcgcgcgttcgcaatggcgaggtcgcgccgcaggccaagccgttggcacttgccgccgtcgacgctgttctgcaggattatttcgcagcgtgccgggtctag

SEQ ID NO: 2701 - protein, 426 aa, Sinorhizobium meliloti
MQENHLIDIARWSERPGPRGIPSICSAHPLVIEAAMLRAHREKAPVLIEATCNQVNQDGGYTGMTPEDFTRFVGAIADRIEFPREKILLGGDHLGPNPWKHLPADEAMAKAEAMITAYAKAGFTKLHLDTSMGCAGEPTALPDATTAARAARLAAVAEDAVGGRGGVLPVYIIGTEVPIPGGALEELDTLEVTAPEAAIETVRVHRAAFEEAGAAGAFSRVVGAVVQPGVEFGNENVIAYDRARAEKLSATLGQLHGMVFEAHSTDYQTPDALRELVADGFAILKVGPGLTFALREALYGLDQIAAFLFPAARERTLAEVTEAVMREEPANWAKYYHGSAEEQRLQRHFSYSDRIRYYWPHPKAAAAVDELMSLLDGVAIPETLISQFLAGSYARVRNGEVAPQAKPLALAAVDAVLQDYFAACRV

SEQ ID NO: 2702 - DNA, 1281 bp, Escherichia coli
  CDS (1)..(1281)
atgaaacatctgacagaaatggtgagacagcacaaagcgggcaaaacaaatggaatttatgccgtttgttccgcacatccgctggtgctggaagctgcaatccgctacgccagtgcaaaccaaacgccgttactgattgaagcaacctccaatcaggtagaccagttcggcggttataccggaatgacgcccgccgattttcgcggctttgtttgtcagctcgccgactcgttgaatttcccgcaggatgcgttgattctgggtggtgaccatctggggccaaaccgctggcaaaacctgccggccgctcaggcaatggccaatgccgatgatttgattaaaagctacgttgcggcaggattcaaaaaaatccaccttgattgcagcatgtcctgtcaggacgatccgattcccttaactgatgacatcgtggctgaacgcgccgcccgtctggcgaaagtggcggaagaaacctgtcttgaacactttggcgaagccgatctggagtatgtcattggtaccgaagtgccggtacctggcggcgcgcatgaaaccttaagcgagctggcggtcaccacgccggatgccgcccgcgccacgctggaagcccatcgtcacgcctttgaaaagcaaggtttgaatgccatctggccacgcatcattgccctggtggttcaacccggcgtcgaattcgatcacaccaacgttattgattatcagcccgccaaagcgagcgccttaagccagatggtcgaaaactacgaaacgctgattttcgaagcgcactctaccgattatcaaacgccgcaatcgctgcgccagctggtgattgaccactttgccattctgaaagttggcccagcgctgaccttcgccctgcgtgaagctctgttctctctggcggcgattgaagaagaactggtgccagcgaaagcctgttctggtctgcgtcaggtgctggaagacgtgatgctcgaccgcccggaatactggcaaagccactaccacggtgacggcaacgcgcgtcgtctggcgcgtggttatagctactcggatcgcgtgcgctattactggccggacagccagattgatgacgctttcgctcatctggtacgtaatctggcggattcaccaattccgctgccgctgatcagccagtatctgccgctgcagtacgtgaaagttcgctccggcgagctgcagccaacgccacgggaactcattatcaaccatattcaggacatcctggcgcagtaccacacagcctgtgaaggccaataa

SEQ ID NO: 2703 - protein, 426 aa, Escherichia coli
MKHLTEMVRQHKAGKTNGIYAVCSAHPLVLEAAIRYASANQTPLLIEATSNQVDQFGGYTGMTPADFRGFVCQLADSLNFPQDALILGGDHLGPNRWQNLPAAQAMANADDLIKSYVAAGFKKIHLDCSMSCQDDPIPLTDDIVAERAARLAKVAEETCLEHFGEADLEYVIGTEVPVPGGAHETLSELAVTTPDAARATLEAHRHAFEKQGLNAIWPRIIALVVQPGVEFDHTNVIDYQPAKASALSQMVENYETLIFEAHSTDYQTPQSLRQLVIDHFAILKVGPALTFALREALFSLAAIEEELVPAKACSGLRQVLEDVMLDRPEYWQSHYHGDGNARRLARGYSYSDRVRYYWPDSQIDDAFAHLVRNLADSPIPLPLISQYLPLQYVKVRSGELQPTPRELIINHIQDILAQYHTACEGQ

SEQ ID NO: 2704 - DNA, 1308 bp, Streptomyces coelicolor
  CDS (1)..(1308)
atgcagagcccgttggacgaggtcgtccggcgtcagaaggccggacgaccacagggcatcacctccgtgtgctcggcccatccgctggtcatcgaggcggccgtgctgcaggcacgcgagaccggtggtccggtactggtggaggcgacctcgaaccaggtcgaccagtacggcggctacacgggcctgcggcccgcggacttccgtgacctcgtgtacggcatcgcgacggaacacggtctgccactggaccgcgtcgttctcggcggcgaccatctcggaccgaaccggtggcagtccctgacgcccgacgaggcgatggggcaggccgacgcactggtcgcggcctacgcggaggcgggcttcaccaagatccacctggactgcagcttcgcctgcgccggtgaccccgcaccactgaccgacgacgtggtcgccgaacgcgccgcgcgtctgatccgggtggccgaggacacggtgggcccggagcgggcggagcggatccggtatgtgatcggtaccgaggtgccgacgcccggcggcgcgcacgagacgctcggcgctctgctgcccaccacgcccgaggcggcgcgcacgaccctggagcagcaccggaaggcgttcgcccggcacggcgtcgaaggggcctggccccgcgtcatggccctggtggtgcagccggccgtggagttcgaccacctgcgggtcgtcgactaccggcgggaggcgaccgaggaactgcgcaaggtcctcgacgacgagcccaccatggtctacgaggcccactcgaccgactaccagaccgccgaggcgctcaccgcgctggtcgaggaccactgggcggtcctcaaggtgggccccggtctgaccttcgccctgcgcgaggccctgttcgccctcgccgcgatcgaggacgagctggtgccggccggcgagcggtcacggcttcccgaggtcgtcgagcggcggatgctcgccgagcccgcccagtgggagggctactaccccggcggcgacgccgagcagcgcctcgcacgccgctacagctacagcgaccggatgcgctactactggaccgaccccgagatcgaagcggcccaggcccgtctgctggccaacctcacggccgcggccgtcccgttgcccctgctcagcgcgcaccttccgctccagtacgcccgggtccgccgcggcgagctcgccccgcgcccgcgcgaactggccgtggaccacgtccgcgacgtcctgcgcgactacgaccgcgccgccgaccagaaccggaaccagaaccagagggagttcgtgtga

SEQ ID NO: 2705 - protein, 435 aa, Streptomyces coelicolor
MQSPLDEVVRRQKAGRPQGITSVCSAHPLVIEAAVLQARETGGPVLVEATSNQVDQYGGYTGLRPADFRDLVYGIATEHGLPLDRVVLGGDHLGPNRWQSLTPDEAMGQADALVAAYAEAGFTKIHLDCSFACAGDPAPLTDDVVAERAARLIRVAEDTVGPERAERIRYVIGTEVPTPGGAHETLGALLPTTPEAARTTLEQHRKAFARHGVEGAWPRVMALVVQPAVEFDHLRVVDYRREATEELRKVLDDEPTMVYEAHSTDYQTAEALTALVEDHWAVLKVGPGLTFALREALFALAAIEDELVPAGERSRLPEVVERRMLAEPAQWEGYYPGGDAEQRLARRYSYSDRMRYYWTDPEIEAAQARLLANLTAAAVPLPLLSAHLPLQYARVRRGELAPRPRELAVDHVRDVLRDYDRAADQNRNQNQREFV

SEQ ID NO: 2706 - DNA, 1296 bp, Photorhabdus luminescens
  CDS (1)..(1296)
atgcagtcgctattacaacttatccgtcgtcataaatcaggtgaagccgtggggatctattcggtctgttccgctcatccttgggtattggaaagtgctttgcgcgtcgctaaagagcgtaagacttcggtactgattgaagcaacctctaatcaggtcaatcagtttggtggttataccgggatgcaaccggctcaattccgggatgcagtttggcaacaggccgatcgcattggtttaccgcgtgatcgtgtctggttagggggcgatcatcttggacccaatgcttggcaggatcttcccgctgaacaggcaatgaaactggctgaaacgttgatacacgattatgtggcggcagggtttcgtaagatacatctcgattgttcaatgtcctgtttggatgatccaacgccgcttggcgacaaggaggttgcggtacgtgcggctcgtttgtgtcaggtagcagaacgttgttggcagcaggtggggggagaaccaccggtttatgtgataggtaccgaagtgccggtaccgggtggagcgaaagaagcattagcaggaatgcaagtcacgacgcctcaggctgcggcgacaacgttgagtgtacatcaacaagcctggcagttggctggattggaaccggtatggccacgggtgattgcgctggtggtgcaacccggggtggagttcgatcaccattgtatcgaacattatcaacctgaacgtgcagcggcactgagtcaatatattgaatctcaaccctatttagtctatgaagcccattccaccgattatcaaacggcgcaagcttaccgtgaattggtacgtgatcactttgccattctgaaagtcggtccggctttgacttttgctttacgtgaggcgctgttcgcactcgataaaatcgatggtgaatggaatggggaacagggcgcggctcatctgcgtgccacgctggaacaggtcatgcttgagcagccggagcactggaatcgctattaccacggtacaccacatcaacagtttattgatcgtcaatacagtttgagtgatcgcattcgttactactggccgcatccgcaggtacaacaggcagtgaataccttgatggataacctgcgtggtcgcccggtttccctttcactgctgagtcagtacctgccggagcaggcgcaggcggttaatgccggaaggttggataatgacccacactcatgggtgttggataagattcgttctgtgctcttgagctatgcgctggcttgtgagcccgaggtacaaggagttttagtatga

SEQ ID NO: 2707 - protein, 431 aa, Photorhabdus luminescens
MQSLLQLIRRHKSGEAVGIYSVCSAHPWVLESALRVAKERKTSVLIEATSNQVNQFGGYTGMQPAQFRDAVWQQADRIGLPRDRVWLGGDHLGPNAWQDLPAEQAMKLAETLIHDYVAAGFRKIHLDCSMSCLDDPTPLGDKEVAVRAARLCQVAERCWQQVGGEPPVYVIGTEVPVPGGAKEALAGMQVTTPQAAATTLSVHQQAWQLAGLEPVWPRVIALVVQPGVEFDHHCIEHYQPERAAALSQYIESQPYLVYEAHSTDYQTAQAYRELVRDHFAILKVGPALTFALREALFALDKIDGEWNGEQGAAHLRATLEQVMLEQPEHWNRYYHGTPHQQFIDRQYSLSDRIRYYWPHPQVQQAVNTLMDNLRGRPVSLSLLSQYLPEQAQAVNAGRLDNDPHSWVLDKIRSVLLSYALACEPEVQGVLV

SEQ ID NO: 2708 - DNA, 1281 bp, Shigella flexneri
  CDS (1)..(1281)
atgaaacatctgacagaaatggtgagacagcacaaagcgggcaaaacaaatgcaatttatgccgtttgttccgcacatccgctggtgctggaggctgcaatccgctacgccagtgcaaaccaaacgccgttactgattgaagcaacctccaatcaggtagaccagttcggcggttataccggaatgacgcccgccgattttcgcggctttgtttgtcagctcgccgactcgttgaatttcccgcaggatgcgctgattctgggtggtgaccatctggggccaaaccgctggcaaaacctgccagccgctcaggcaatggccaatgccgatgatttgattaaaagctacgttgcggcaggattcaaaaaaatccaccttgattgcagcatgtcctgtcaggacgatccaattcccttaactgatgacatcgtggctgaacgcgccgcccgtctggcgaaagtggcggaagaaacctgtcgcgaacactttggcgaagccgatctggagtatgtcattggtaccgaagtgccggtacctggcggcgcgcatgaaaccttaagcgagctggcggtcaccacgccggatgccgcccgcgccacgctggaagcccatcgtcacgcctttgaaaagcaaggtttgaatgccatctggccacgcattattgccctggtggttcaacccggcgtcgaattcgatcacaccaacgttattgattatcagcccgccaaagcgagcgccttaagccagatggtcgaaaactacgaaacgctgattttcgaagcgcactctaccgattatcaaacgccgcaatctctgcgccagctggtgattgaccactttgccattctgaaagttggcccggcgctgaccttcgccctgcgtgaagcccttttttctctggcggcgattgaagaagaactggtaccagcgaaagcctgttccggtctgcgtcaggtgctggaaaacgtgatgctcgaccgcccggaatactggcaaagccactaccacggtgacggcaacgcgcgtcgtctggcgcgtggttacagctactcagatcgcgtgcgctattactggccggacagccagattgatgacgctttcgctcatctggttcgtaatctggcggattcaccaattccgctaccgctcatcagccagtatctgccgctgcagtacgtgaaagttcgctccggcgagctgcaaccgacgccacgggaactcattataaaccatattcaggacatcctggcgcagtaccacacagcctgtgaaggccaataa

SEQ ID NO: 2709 - protein, 426 aa, Shigella flexneri
MKHLTEMVRQHKAGKTNAIYAVCSAHPLVLEAAIRYASANQTPLLIEATSNQVDQFGGYTGMTPADFRGFVCQLADSLNFPQDALILGGDHLGPNRWQNLPAAQAMANADDLIKSYVAAGFKKIHLDCSMSCQDDPIPLTDDIVAERAARLAKVAEETCREHFGEADLEYVIGTEVPVPGGAHETLSELAVTTPDAARATLEAHRHAFEKQGLNAIWPRIIALVVQPGVEFDHTNVIDYQPAKASALSQMVENYETLIFEAHSTDYQTPQSLRQLVIDHFAILKVGPALTFALREALFSLAAIEEELVPAKACSGLRQVLENVMLDRPEYWQSHYHGDGNARRLARGYSYSDRVRYYWPDSQIDDAFAHLVRNLADSPIPLPLISQYLPLQYVKVRSGELQPTPRELIINHIQDILAQYHTACEGQ

SEQ ID NO: 2710 - DNA, 1263 bp, Shigella flexneri
  CDS (1)..(1263)
atgaaaacgttaattgcccggcataaagctggtgaacatatcggcatatgttcagtctgttctgcccatccgttggttatcgaagcggcgctggcatttgatcgcaacagcacgcgcaaagtgctgattgaagcaacgtcaaaccaggtcaatcaatttggcggttataccggaatgacaccggcagactttcgcgaatttgtttttacgattgccgataaagttgggtttgcacgcgaacgcattattctcggcggcgatcatctgggaccaaactgctggcagcaagaaaatgcggatgcggcgatggaaaaatccgtcgagctggtaaaagcatatgttcgtgctggcttcagtaaaattcatcttgatgcgtcaatgtcctgcgcgggggataccataccgttagcaccagaaacggttgcggaacgagctgctgtgctttgctttgctgcggaaagtgtggcgacagattgccagcgtgagcaactgagctatgtcattggcactgaagttccggttccgggcggtgaggccagcgccattcagtcagtacacatcacccatgttgaagatgccgccaatactttacgtacgcatcaaaaggcctttattgcccgtgggctgacagaggcgttaacacgtgtgattgccatcgtggtgcagccgggtgtggaatttgatcacagcaatattatccattatcagccgcaggaagcgcaggcgctggcgcaatggatagaaaacacccgaatggtttatgaagcacattctaccgattaccagacccggacggcttattgggaattagtccgcgatcactttgcaatattgaaagtcggtcccgcattaacctttgctttacgcgaggcgatatttgcactggcacaaattgagcaggaacttatcgcccccgaaaatcgcagcggttgcctggcggtaattgaagaagtgatgctcgacgaaccgcaatactggaaaaaatattatcgcacgggttttaacgattcattactggatattcgttacagcctgtcggatcgtattcgttattactggccgcatagtcggattaaaaatagcgttgaaacgatgatggtgaatctgcaaggcgtggacatcccactgggcatgattagtcagtatcttcccaaacaatttgaacgcattcagtccggggaattatcagcaatgccgcatcagcttattatgaataaaatttatgatgttttgcgcgcctatcgctacggctgtgcggaataa

SEQ ID NO: 2711 - protein, 420 aa, Shigella flexneri
MKTLIARHKAGEHIGICSVCSAHPLVIEAALAFDRNSTRKVLIEATSNQVNQFGGYTGMTPADFREFVFTIADKVGFARERIILGGDHLGPNCWQQENADAAMEKSVELVKAYVRAGFSKIHLDASMSCAGDTIPLAPETVAERAAVLCFAAESVATDCQREQLSYVIGTEVPVPGGEASAIQSVHITHVEDAANTLRTHQKAFIARGLTEALTRVIAIVVQPGVEFDHSNIIHYQPQEAQALAQWIENTRMVYEAHSTDYQTRTAYWELVRDHFAILKVGPALTFALREAIFALAQIEQELIAPENRSGCLAVIEEVMLDEPQYWKKYYRTGFNDSLLDIRYSLSDRIRYYWPHSRIKNSVETMMVNLQGVDIPLGMISQYLPKQFERIQSGELSAMPHQLIMNKIYDVLRAYRYGCAE

SEQ ID NO: 2712 - DNA, 1308 bp, Vibrio vulnificus
  CDS (1)..(1308)
atgaaaacgctactttctttaattcagcaacacaaacaaggccacgcgaagggcatttactcagtgtgttccgcacaccctttggtgttggaagcggcgatcaaacaagcggcgcgtgatggtcagttggtgctgattgaagcaacctcaaaccaagtaaaccagtttggcggctacaccgggatgacaccacaagtgtttgccgactatgtaatgaccttagcggagcgtttgaatttcccgaaagcgcgtttggtgctgggtggggatcatcttggtccaaactgttggcagcatttacccgcaagacaagcgatggagtactccgcacaactgattcacgattacgtgatggcgggttttaacaaaattcacctcgattgctccatggcgtgtgaaggcgatgccattcccctcagtgagcaagtgatggccgagcgcgctgcgcagctctgtttagtcgccgagcaagcgtggcaagcgcgtgggggcgaagcgcctttgtatgttgtggggacggaagtgccaactccgggcggcgcgttggaatcgctgcaagaacatgagttgcaagtgaccaaaccagagcaagctttggcgacgcttgacgcgcatcaccaagcgttcagtgatttagggctgggctacgtgtggcctcgcgtgattggtttggtggtgcagccaggggtggagtttgatcaccaccatgtgcatcactatcaaagtgatcaagcacaagccctgagccagctgatcgacactcagccgcatttggtgtttgaagcacactcgaccgattaccaaaatccggcggcttatcatgagcttgttcgtgatcactttgcgattttgaaggtgggcccagcattaacgtttgcactgcgtgaagcgctatttgccctcgatcgcgctgaaaaagagtggctgggtgttcatcaggcctcacacctacgtgacaccattgaacaagtgatgcatgaacagcccaactattggcgttctcattatcaaagccaaggccatcaacagtttcttgattgcaattacagcttgagcgaccgcattcgctactactggacacacccagcggtgcaagcggcgcaacaagcgatgtttacgcaccttatttcccagcctctgccgacaacgctgctgagccaatatttgccagcgcaggcacgagccattgcccagaaccagatttgtaaccatcccgctgacatcatcattcacaaaattatggaggtcacgcagctctattccgacgcgtgttaccacaatgcagcggtatgcaaggagaccatctaa

SEQ ID NO: 2713 - protein, 435 aa, Vibrio vulnificus
MKTLLSLIQQHKQGHAKGIYSVCSAHPLVLEAAIKQAARDGQLVLIEATSNQVNQFGGYTGMTPQVFADYVMTLAERLNFPKARLVLGGDHLGPNCWQHLPARQAMEYSAQLIHDYVMAGFNKIHLDCSMACEGDAIPLSEQVMAERAAQLCLVAEQAWQARGGEAPLYVVGTEVPTPGGALESLQEHELQVTKPEQALATLDAHHQAFSDLGLGYVWPRVIGLVVQPGVEFDHHHVHHYQSDQAQALSQLIDTQPHLVFEAHSTDYQNPAAYHELVRDHFAILKVGPALTFALREALFALDRAEKEWLGVHQASHLRDTIEQVMHEQPNYWRSHYQSQGHQQFLDCNYSLSDRIRYYWTHPAVQAAQQAMFTHLISQPLPTTLLSQYLPAQARAIAQNQICNHPADIIIHKIMEVTQLYSDACYHNAAVCKETI

SEQ ID NO: 2714 - DNA, 1281 bp, Escherichia coli O6
  CDS (1)..(1281): y means t/u or c
atgaaacatctgacagaaatggtgagacagcacaaagcgggcaaaacaaatgggatttacgccgtttgttccgcacatccgctggtgctggaagctgcaatccgctacgccagtgcaaaccaaacgccgttactgattgaagcaacctccaatcaggtggaccagttcggcggttataccggaatgacgcccgccgattttcgcggctttgtttgtcagctcgccgactcgttgaatttcccgcaggatgcgctgattctgggtggtgaccatctggggccaaaccgctggcaaaacctgcctgccgctcaggcaatggccaatgccgatgatttgattaaaagctacgtggcggcaggattcaaaaaaattcaccttgattgcagcatgtcctgtcaggacgatccgattcccttaactgatgacatcgtggctgaacgcgccgcccgtctggcgaaagtggcggaagaaacctgtcttgaacactttggcgaagccgatctggagtatgtcattggtaccgaagtcccggtgcctggcggcgcgcatgaaaccttaagcgagctggcggtcaccacgccggatgccgcccgcgccacgctggaagcccatcgtcacgcttttgaaaagcagggtctgaatgccatctggccacgcatcattgccctggtggttcaacccggcgtcgaattcgatcacaccaacgttattgattatcagcccgccaaagcgaccgycttaagccagatggycgaaaactacgaaacgctgattttcgaagcgcactctaccgattatcaaacaccgcaatcgctgcgccagctggtgattgaccactttgccattctgaaagttggcccggcgctgacctttgctctgcgtgaagctctgttctctctggcggcgattgaagaagaactggtgccagcaaaagcctgttctggtctgcgtcaggtgctggaaaacgtgatgctcgaccgcccggaatactggcaaagccactaccacggtgacggcaacgcgcgtcgtctggcgcgtggttatagctactcggatcgcgtgcgctattactggccggacagccagattgatgacgctttcgctcatctggttcgtaatctggcggattcaccaattccgctgccgctgatcagtcagtatctgccgctgcagtacgtgaaagttcgctccggcgagctgcagccaacgccacgggaactcattatcaaccatattcaggacatcctggcgcagtaccacacagcctgtgaaggccaataa

SEQ ID NO: 2715 - protein, 426 aa, Escherichia coli O6
  misc_feature (246)..(246): Xaa can be Val or Ala
MKHLTEMVRQHKAGKTNGIYAVCSAHPLVLEAAIRYASANQTPLLIEATSNQVDQFGGYTGMTPADFRGFVCQLADSLNFPQDALILGGDHLGPNRWQNLPAAQAMANADDLIKSYVAAGFKKIHLDCSMSCQDDPIPLTDDIVAERAARLAKVAEETCLEHFGEADLEYVIGTEVPVPGGAHETLSELAVTTPDAARATLEAHRHAFEKQGLNAIWPRIIALVVQPGVEFDHTNVIDYQPAKATXLSQMXENYETLIFEAHSTDYQTPQSLRQLVIDHFAILKVGPALTFALREALFSLAAIEEELVPAKACSGLRQVLENVMLDRPEYWQSHYHGDGNARRLARGYSYSDRVRYYWPDSQIDDAFAHLVRNLADSPIPLPLISQYLPLQYVKVRSGELQPTPRELIINHIQDILAQYHTACEGQ

SEQ ID NO: 2716 - DNA, 1263 bp, Escherichia coli O6
  CDS (1)..(1263): n means a or g or c or t/u, w means a or t/u
atgaaaacgttaattgcccggcataaagctggtgaacatattggcatatgttcagtctgttctgcacatccgttggttatcgaagcggcgctggcatttgatcgcaacagcacgcgtaaagtgctgattgaagcaacgtcaaaccaggtcaatcaatttggcggttataccggaatgacaccggcagactttcgcgaatttgtttttgcgattgccgataaagtcggatttgctcgtgagcgtattattctcggcggcgaccatctgggaccaaactgctggcagcaagaaaatgcggatgcggcgatggaaaaatccgtcgagctggtaaaggcatatgttcgtgccggcttcagtaaaattcatcttgatgcgtcaatgtcctgcgctgacgattccataccgttagcgccagaaacggttgctgaacgtgccgctgtgctttgtctggcggcggaaagtgtggcgactgattgccagcgtgagcaactgaactatgtcattggcaccgaagttccggttccgggcggtgaggccagcgccattcagtcagtacacatcacccaggttgaagatgccgccaatactttacgcacgcatcaaaaggcctttattgcccgtggtctggcagaggcgttaacacgcgtgattgccatcgtggtgcagccgggtgtggaatttgaccatagcaatattattcattatcaggcgcaanaagctcaggcgttggcgcaatggatagaaaaaaccaaaatggtttatgaagcgcattccaccgattaccagactcagwcggcctatcgggaattagttcgcgatcattttgcaattttgaaagtcggtccggcattaacctttgcgttacgcgaggcgatatttgcgctggcacaaattgagcaggaactcatcgctccagaaaatcgtagccgttgtctggcggtgattgaagaagtgatgctcgacgaaccgcaatactggaaaaaatattatcgcacgggttttaacgattcattgctggatattcgttacagcctgtcggatcgtattcgttattactggccgcatagccggattaaaaatagcgtcgaaacgatgatggtgaatctggaaggcgtggacatcccactgggcatgattagtcagtatcttccgaaacaatttgaacgcattcagtccggggaattatcagcaataccgcatcagcttattatggataaaatttatgatgttttgcgcgcctatcgctacggctgtgcggaataa

SEQ ID NO: 2717 - protein, 420 aa, Escherichia coli O6
  misc_feature (239)..(239): Xaa can be any amino acid
  misc_feature (265)..(265): Xaa can be Ser or Thr
MKTLIARHKAGEHIGICSVCSAHPLVIEAALAFDRNSTRKVLIEATSNQVNQFGGYTGMTPADFREFVFAIADKVGFARERIILGGDHLGPNCWQQENADAAMEKSVELVKAYVRAGFSKIHLDASMSCADDSIPLAPETVAERAAVLCLAAESVATDCQREQLNYVIGTEVPVPGGEASAIQSVHITQVEDAANTLRTHQKAFIARGLAEALTRVIAIVVQPGVEFDHSNIIHYQAQXAQALAQWIEKTKMVYEAHSTDYQTQXAYRELVRDHFAILKVGPALTFALREAIFALAQIEQELIAPENRSRCLAVIEEVMLDEPQYWKKYYRTGFNDSLLDIRYSLSDRIRYYWPHSRIKNSVETMMVNLEGVDIPLGMISQYLPKQFERIQSGELSAIPHQLIMDKIYDVLRAYRYGCAE

SEQ ID NO: 2718 - DNA, 1260 bp, Klebsiella oxytoca
  CDS (1)..(1260)
atgaaagatattatttcccgccacaaagctggcgaacacatcggcatctgctcagtttgttccgcgcatccgctggttatcgaagccgcgctaagtttcgatctgcataccaacaacaaagttcttatcgaagcaacctctaatcaggttaaccagtttggcggctacaccggaatgagctgcgactttcgtgatttcgtgaataaaattgcccgcgaagtcggtttcccgtcagagcgtattattctcggcggcgaccatctcgggccgaactgctggcagggcgaacccgccgccgaagcgatggagaaatcggtcgatctgattaaagcctacgtcgccgcgggcttcagcaaaatccatctcgatgcctccatgtcctgcgctgacgatccggtaccgctggacccggccatcgtcgccgaacgtgccgctcgcctgtgccaggccgcggaagagacggcaaccgacgaacagaaacgccatctgacctatgtcatcggcaccgaggttccggttcccggcggcgaagccagcaccatcggcagcgtccacgtgacccgcgcccaggatgcggcggcaacgctggaaacccatgaagccgccttccgcaaactgggtcttaacgcagcgctggagcgcgtcattgctatcgtggtgcagcccggcgttgagttcgaccatacgcaaattattcattaccagccggaggccgccaaagcgctctccgcgtggatcgaaggcacgccgatggtctacgaagcgcactcaactgattaccagtctcgtcaggcctactgggcactggtgcgcgaccattacgccatcctgaaagtgggcccggcgctgaccttcgcgctgcgtgaagccattttttccctcgcgcaaatggaaaatgagctggtcgctccggagtcccgcagccgcgtaatggaagtaattgatgaagtgatgcttaacgagccgggctactggaaaaagtactaccgcccgacctggagccaggcaatggcggatattcacttcagcctgtccgaccgcattcgctactactggccgcatccacgtattcgccagagcgtggaaaagttaattgcaaacctgaccgaaactaagctaccgctgggccttataagccagtatatacccgtgcagtttgaacgactgtcgttaaacgaacttgccgccgtgccgcacgacctcatcctcgacaagattcaggatgtgctgcgagcttaccgttacggtcgtgccatctga

SEQ ID NO: 2719 - protein, 419 aa, Klebsiella oxytoca
MKDIISRHKAGEHIGICSVCSAHPLVIEAALSFDLHTNNKVLIEATSNQVNQFGGYTGMSCDFRDFVNKIAREVGFPSERIILGGDHLGPNCWQGEPAAEAMEKSVDLIKAYVAAGFSKIHLDASMSCADDPVPLDPAIVAERAARLCQAAEETATDEQKRHLTYVIGTEVPVPGGEASTIGSVHVTRAQDAAATLETHEAAFRKLGLNAALERVIAIVVQPGVEFDHTQIIHYQPEAAKALSAWIEGTPMVYEAHSTDYQSRQAYWALVRDHYAILKVGPALTFALREAIFSLAQMENELVAPESRSRVMEVIDEVMLNEPGYWKKYYRPTWSQAMADIHFSLSDRIRYYWPHPRIRQSVEKLIANLTETKLPLGLISQYIPVQFERLSLNELAAVPHDLILDKIQDVLRAYRYGRAI

SEQ ID NO: 2720 - DNA, 1356 bp, Ralstonia solanacearum
  CDS (1)..(1356)
atgcccggcctgacgaacacgctcgaacgcccgcgtgcctcgcacaccgaggcggtgctgcgcgtgatcttcgacgcgaatcgcggggacgcgcagcgcggcatctattcggtctgcagtgcgcacaccttcgtgctcgaagcggcgtgtgaagcggcgcgcgcggatggttcgccgctcctgatcgaagccacctgcaaccaggtcaaccatctcggcggctataccgggatgacgccggccgattttcgtcgcgacgtcgaggcgattgccgagcgttgcgggctcgctgcctcggcgctcgtgctcggtggcgaccatctcggcccgaatccatggcgcgaccgtccggcagccgaggcgatgcacgaggcgcagaccatggttgcggcgtatgtcgaggccggcttcacgaagatccatctcgatgcgagcatggcttgcgccgacgatgccagcccgctcgacgatcgcacgatcgcggatcgcgccgcgcggctgtgccgtgtcgccgaggcggccgccgcgcgcgtgggcacgcggccggtctatgtcatcggcaccgaggtgccgacaccgggcggcgagaccggcggtgacgcggacggtgtcagcgggatcgcacggatcgcggtcacacaggcggacagcatcgcggcgacgcttgcagcccaccgcgaggcgttcgatgcgctcggcctgcaggatgtgtggacgcgcgtgatcgcgatcgtcgcccagccgggtgtcgatttcgacgaccgccacgtgctcgactacgacagcgacaaggccgcggcgctcagcgcgagcatcctgcgcacgccggggctcgtgttcgaagcgcactcgaccgactaccagaccgacgcggcgctcaccgcgctcgtgcgcgaccatttcgcgatcctgaaggtcggcccggcgctgacgtttgcgctgcgcgaggcgctgttcgcgctcagctatatcgaggacgcgctgatcgacgatcctgcgcagcgttcgcggttgcgcgaggtcgtcgacgcggcgatgtgcgcgcagcccggctactgggcaccgtactatcgcggcgacgctgccgcgcagtcgcttgcgcggcggttcagctacagcgaccgcatccgctattactggccgcagccgcgggtcgcggccgcggtcgagcggctgctggccaacctcgatgctcagcgcgtgcccgagacgctggtcgcgcagtggctgcccgacgtgtacgcggcgttccggaagggcacgcttgcgccggacccgcgcgcgtgggtccgccaccggattcgcgacgtgattgcgcggtatgcgcgcgcgtgtggaatgcactggtcgggctga

SEQ ID NO: 2721 - protein, 451 aa, Ralstonia solanacearum
MPGLTNTLERPRASHTEAVLRVIFDANRGDAQRGIYSVCSAHTFVLEAACEAARADGSPLLIEATCNQVNHLGGYTGMTPADFRRDVEAIAERCGLAASALVLGGDHLGPNPWRDRPAAEAMHEAQTMVAAYVEAGFTKIHLDASMACADDASPLDDRTIADRAARLCRVAEAAAARVGTRPVYVIGTEVPTPGGETGGDADGVSGIARIAVTQADSIAATLAAHREAFDALGLQDVWTRVIAIVAQPGVDFDDRHVLDYDSDKAAALSASILRTPGLVFEAHSTDYQTDAALTALVRDHFAILKVGPALTFALREALFALSYIEDALIDDPAQRSRLREVVDAAMCAQPGYWAPYYRGDAAAQSLARRFSYSDRIRYYWPQPRVAAAVERLLANLDAQRVPETLVAQWLPDVYAAFRKGTLAPDPRAWVRHRIRDVIARYARACGMHWSG

SEQ ID NO: 2722 - DNA, 1272 bp, Salmonella typhimurium
  CDS (1)..(1272)
atgaaagaaataattgctcgtcataaagcaggagaacatctgggcatctgttcagtttgttctgctcatcccctggttatcgaatcagctctgcttttcgatctcaatactgacaacaaggtattgattgaagccacatccaatcaggtgaatcagtttggcggttataccggaatgaaaccggctgattttcgtgattttgtttatggcattgctcaggaagtgggatttccacgtgagcggttgattcttggtggcgatcatttagggcctaactgctggcagaacgaaccggcagcggcggcaatggaaaagtcggttgagttaataaaagcgtatgtcgccgctggttttagcaaaattcacctggacgcgtcaatgtcctgcgctgacgacccgacaccgttggatccgatggtcgttgcacgccgtgccgccgtgctttgtaaagcagcagaagggaccgcaaacgaagaacaaaaatgccatctgacttatgtcatcggcacggaagtgcccgttcctggcggtgaagccagtaccatcggcagcgttcatgtcacccgcgaagtcgatgctgcacgtacgctggaaactcaccaaatcgcgtttcgtgaatcaggtctggaagaagcactgtcacgcgtgatcgccattgtggtacagccgggcgttgaatttgatcatacccagattattcattatcagccgcaggcggcacaggcgctctccgcatggataaaagaaacgccgatggtctatgaagcgcattcgactgattatcagacgcggcaggcctaccgtgcgctggtacgcgatcattacgccattctgaaggtcggcccggcgctcactttcgcgctgcgcgaagccattttcgcacttgcgcaaatggaaaacgagctgatctccccggaacaacgtagtcgggtactggaggtcattgatgaagttatgctaaacgaaccgggctactggaaaaaatactaccgtccaacctggagccaggcgatggtcgacatccactttagtttgtctgaccgtattcgctattactggccgcacccgcgtattcgtcaaagcgtagagaagttaatcgccaatctgaacaacgtcacattgccgctgggattaattagccagtttatgcccgtacagtttgaacgcctgtctgagggcgtgctcacccctacgccgcataacctgattattgacaaaattcaggatgttctgcgcgcttatcgcttcggttgcacgccggatgtcgcctga

SEQ ID NO: 2723 - protein, 423 aa, Salmonella typhimurium
MKEIIARHKAGEHLGICSVCSAHPLVIESALLFDLNTDNKVLIEATSNQVNQFGGYTGMKPADFRDFVYGIAQEVGFPRERLILGGDHLGPNCWQNEPAAAAMEKSVELIKAYVAAGFSKIHLDASMSCADDPTPLDPMVVARRAAVLCKAAEGTANEEQKCHLTYVIGTEVPVPGGEASTIGSVHVTREVDAARTLETHQIAFRESGLEEALSRVIAIVVQPGVEFDHTQIIHYQPQAAQALSAWIKETPMVYEAHSTDYQTRQAYRALVRDHYAILKVGPALTFALREAIFALAQMENELISPEQRSRVLEVIDEVMLNEPGYWKKYYRPTWSQAMVDIHFSLSDRIRYYWPHPRIRQSVEKLIANLNNVTLPLGLISQFMPVQFERLSEGVLTPTPHNLIIDKIQDVLRAYRFGCTPDVA

SEQ ID NO: 2724 - DNA, 1284 bp, Rhizobium loti
  CDS (1)..(1284)
atgagccaggcgacggacaggctggcggccatcgcgacgcgtcgtgcggccggcgaacgctgcggcatcgcctcgatctgctcggcccatccgctggtcatcgaagcggcgctgcgccatggcaaggcgcgcgatgccgacgtgctgatcgaggccacctgcaaccaggtgaaccatgaaggcggctacaccggcatgacaccaggggatttccgcggcttcgtcgagacgatcgccggcaagatcggcttttccctcgacaggctgatgctcggcggcgaccatctcggccccaatccgtggaagcatctgccggcgcccgaggccatggccaaggcttcgcgcatggtcgacgcctatgccgaggccggcttcaccaagattcatctcgacgccagcatgggttgcgccggcgaaggcgccgcgccgcccgatgcgacgatcgccgcgcgcgccgccgaactggccgaggtggcggaggccgccgccgaacgaatgggcggcacaaagcctgtctatgtcatcggcaccgaagtgccggtgccgggcggcgccctggaagcgatggaccatctggcggtgacgacgcccgaggcgccacgagagacggttcgcatccaccgcgatgccttcagccagcgaggcctcgaccaggccttttcgcgggcgctcggtgtcgtcgtgcagccgggtgtcgaatttggcaatgccgaggtgatcacctataaaccggaacgcgcccgtgcattggccggcacgttgcgggatctgccgcaattcgtcttcgaggcgcattcgaccgattaccagccggcctcggctttgagtgcgctggtcgatgacggcttcgccatactcaaggtcgggccgtggctgaccttcgcgctgcgtgaagcgctctatggcctgagccacatcgccgacattctggctcccgatccggcgcgcgaaagcctgccggcggcgatggagcgcgtgatgctggcagcaccgggcaattggaagaactactatcacggctcggagaccgaacagcgcatcgaacgccatttctcctacagcgaccgcatccgctactactggccggcgcctgcagcccggcaggccaccgacgcgctgatgcaggcgctcggcgaccgcgacatccccctgcccctcatcagccagtatctcggccgcctgaacggtgcggtggcgaacggttcggttgcgccaaaagccggggagttgttgatcgccagcgtgacagaggttctcgacatcttcgccagcgcaaccggctga

SEQ ID NO: 2725 - protein, 427 aa, Rhizobium loti
MSQATDRLAAIATRRAAGERCGIASICSAHPLVIEAALRHGKARDADVLIEATCNQVNHEGGYTGMTPGDFRGFVETIAGKIGFSLDRLMLGGDHLGPNPWKHLPAPEAMAKASRMVDAYAEAGFTKIHLDASMGCAGEGAAPPDATIAARAAELAEVAEAAAERMGGTKPVYVIGTEVPVPGGALEAMDHLAVTTPEAPRETVRIHRDAFSQRGLDQAFSRALGVVVQPGVEFGNAEVITYKPERARALAGTLRDLPQFVFEAHSTDYQPASALSALVDDGFAILKVGPWLTFALREALYGLSHIADILAPDPARESLPAAMERVMLAAPGNWKNYYHGSETEQRIERHFSYSDRIRYYWPAPAARQATDALMQALGDRDIPLPLISQYLGRLNGAVANGSVAPKAGELLIASVTEVLDIFASATG

SEQ ID NO: 2726 - DNA, 1299 bp, Yersinia pestis
  CDS (1)..(1299)
atgcatcctttagaaaaactggttcagcgccataaagccggggaacaaattgggatttactcagtttgttctgcccatcctcttgtcattgaagctgcgctggagcaagcgttagaaaatgactcagaactgttaatcgaagccacctctaatcaggttgaccaatttggtggctacaccggtatgacgccggttgattttcgtgattacgtttttgctaaagctgatgctctgcatttccctctcgaaaaactcattttaggcggcgaccatttaggaccaaaccgttggcagcacttgcttgccaacgaagccatggcgcatgccgatgatctgatcgcggcgtatgtcgcggcgggcttcaaaaaaattcacctcgattgcagcatgtcctgcgcagatgatcccgttcccctctccgatgaaattgtagccgagcgtgctgcacgtctggccgccattgcagaagccacagaatatcaacacttcaatacacacaccgccgtttatgtcatcgggacagaagtgcctatccctggtggcgcgaccgaagagttggatgaaatcgaagtcacctcaccagaagccgcgcgtaaaacgattgaatgccaccaaaaagcatttgagaaatcaggtgttgctgagtgctggccacgggtgattggtctggtcgtgcagcctggtgttgagtttgatcacaccggtgtgattgatttctgtccagagaaagcccatgaactcagtaaagtcatggatgaatacgattatcaggtattcgaagcccactccaccgattatcagaccgatgatgcctatcgcgcactggttaaaggccattttgccattctgaaagtaggcccggcgctgacatttgctctgcgtgaagccctgttcagtttatgtcatatcgaagaagagttattcccggcagagcagtgctcccgcctccgtcaggtgatggaagacgtaatgctgaaatcgccggaatactggaagagatattacctcggtgatactgagcaagtgcgcttagcccgcgtttacagtttcagtgaccgcatgcgctattactggccaatggaagccgtgcaggctgcacaagaaaaactgtttgccaatctgaatagtgcaccgattccgctaccactcttgagccagtacatgccacgccaatttactgcagttcgcgaaggcactctgtcttttgaagccacggcattggtcaaacaacaaatcaaaaatacgcttattggctatgtcaatgcatgccacctttttaacgggaacacatcgaaatga

SEQ ID NO: 2727 - protein, 432 aa, Yersinia pestis
MHPLEKLVQRHKAGEQIGIYSVCSAHPLVIEAALEQALENDSELLIEATSNQVDQFGGYTGMTPVDFRDYVFAKADALHFPLEKLILGGDHLGPNRWQHLLANEAMAHADDLIAAYVAAGFKKIHLDCSMSCADDPVPLSDEIVAERAARLAAIAEATEYQHFNTHTAVYVIGTEVPIPGGATEELDEIEVTSPEAARKTIECHQKAFEKSGVAECWPRVIGLVVQPGVEFDHTGVIDFCPEKAHELSKVMDEYDYQVFEAHSTDYQTDDAYRALVKGHFAILKVGPALTFALREALFSLCHIEEELFPAEQCSRLRQVMEDVMLKSPEYWKRYYLGDTEQVRLARVYSFSDRMRYYWPMEAVQAAQEKLFANLNSAPIPLPLLSQYMPRQFTAVREGTLSFEATALVKQQIKNTLIGYVNACHLFNGNTSK

SEQ ID NO: 2728 - DNA, 1287 bp, Photobacterium profundum
  CDS (1)..(1287)
atgaacacccttctaaatctcgttcagcgccataaagcaggcgataaaaatggcatttattctgtctgctctgctcatccgctagttattgaagcggcgcttactcaggcgttgagcgatgattctttattattaattgaagctacctccaaccaagtagatcaatttggtggttatacaggtatgacacctgttgattttcgtaattttgttttagaacaagcggaagcgcttcactttccaacagaaaacctcattcttggtggcgatcaccttggtcctaaccgttggcagcatcttgttgctgaagaagcaatgaacaatgcagatgttttgattactgcatacgttgcggcaggttttaagaaaattcacctcgattgcagtatgtcttgtttaggggatccaatcccattatctgatgcaattgtcgcagagcgtgctgcccgtttagctaatattgctgaaaatacggcgattaatgtctttggtgtcagcgatctggtttacgttattggtaccgaagttcctgtacctggtggtgccgcggaagaattggctgagcttgaagtaacgtcagccgaggctgcaaacgaaacaattcgtagccacaaagaagcatttgcaaaagtcggtgtttccagttgctggtctcgggttataggccttgtcgtacaacctggagttgaatttgatcacacaggtgttatcgattattgctcagaaaaagcccaagcattaagtaacgtggttaatcatcacgatcaccttatttttgaagcacactcaaccgactatcaaaccgataaagcgtataaagcgctggttgatgatcattttgccattttgaaagtcggcccagcactcacctttgctatgcgtgaagcactcttcaatctgtgtgatatcgaagctgaaatagtgcctaaagcacactgctcaaacctgaaagaacagatagagaagcaaatgtgtgacgctcctgaatattggaataaatattatcagggcaatgagtcacagcagcgttttgctcgctgttatagctttagtgaccgtattcgctactactggccagatcaaaatatccatgcagcacaaggtaagttgttcgacaaccttacgcgtaccggtattccccttccattattgagccaatatcttcccgagcaatttcatgctgttcgtgaaggacaaataagcgcagatccaaaaacattggttcttgaaaaaattcgtcaggtacttcgtagttacgcgaaggcatgcaaactaaataaagattaa

SEQ ID NO: 2729 - protein, 428 aa, Photobacterium profundum
MNTLLNLVQRHKAGDKNGIYSVCSAHPLVIEAALTQALSDDSLLLIEATSNQVDQFGGYTGMTPVDFRNFVLEQAEALHFPTENLILGGDHLGPNRWQHLVAEEAMNNADVLITAYVAAGFKKIHLDCSMSCLGDPIPLSDAIVAERAARLANIAENTAINVFGVSDLVYVIGTEVPVPGGAAEELAELEVTSAEAANETIRSHKEAFAKVGVSSCWSRVIGLVVQPGVEFDHTGVIDYCSEKAQALSNVVNHHDHLIFEAHSTDYQTDKAYKALVDDHFAILKVGPALTFAMREALFNLCDIEAEIVPKAHCSNLKEQIEKQMCDAPEYWNKYYQGNESQQRFARCYSFSDRIRYYWPDQNIHAAQGKLFDNLTRTGIPLPLLSQYLPEQFHAVREGQISADPKTLVLEKIRQVLRSYAKACKLNKD

SEQ ID NO: 2730 - DNA, 22 bp, Primer
atgaaaacgttaattgcccggc

SEQ ID NO: 2731 - DNA, 22 bp, Primer
ttattccgcacagccgtagcga

SEQ ID NO: 2732 - DNA, 1062 bp, Escherichia coli K12
  CDS (1)..(1062)
atggctatcgacgaaaacaaacagaaagcgttggcggcagcactgggccagattgagaaacaatttggtaaaggctccatcatgcgcctgggtgaagaccgttccatggatgtggaaaccatctctaccggttcgctttcactggatatcgcgcttggggcaggtggtctgccgatgggccgtatcgtcgaaatctacggaccagaatcttccggtaaaaccacgctgacgttgcaggtgatcgccgcagcgcagcgcgaaggtaaaacctgtgcgtttatcgatgctgaacacgcgctggacccaatctacgcacgtaaactgggcgtcgatattgacaacctgctgtgctcccagccggataccggcgagcaggcactggaaatctgtgatgccctggcacgttctggcgcagtagacgttatcgtcgttgactccgtggcggcactgacgccgaaagcggaaatcgaaggcgaaatcggcgactctcacatgggccttgcggcacgtatgatgagccaggcgatgcgtaagctggcgggtaacctgaagcagtccaacacgctgctgatcttcatcaaccagatccgtatgaaaattggtgtgatgttcggtaacccggaaaccactaccggtggtaacgcgctgaaattctacgcctctgttcgtctcgacatccgtcgtatcggcgcggtgaaagagggcgaaaacgtggtgggtagcgaaacccgcgtgaaagtggtgaagaacaaaatcgctgcgccgtttaaacaggctgaattccagatcctctacggcgaaggtatcaacttctacggcgagctggttgacctgggcgtgaaagagaagcttatcgagaaagcaggcgcgtggtacagctacaaaggtgagaagatcggtcagggtaaagcgaatgcgactgcctggctgaaagataacccggaaaccgcgaaagagatcgagaagaaagtacgtgagttgctgctgagcaacccgaactcaacgccggatttctctgtagatgacagcgaaggcgtagcagaaactaacgaagatttttaa

SEQ ID NO: 2733 - protein, 353 aa, Escherichia coli K12
MAIDENKQKALAAALGQIEKQFGKGSIMRLGEDRSMDVETISTGSLSLDIALGAGGLPMGRIVEIYGPESSGKTTLTLQVIAAAQREGKTCAFIDAEHALDPIYARKLGVDIDNLLCSQPDTGEQALEICDALARSGAVDVIVVDSVAALTPKAEIEGEIGDSHMGLAARMMSQAMRKLAGNLKQSNTLLIFINQIRMKIGVMFGNPETTTGGNALKFYASVRLDIRRIGAVKEGENVVGSETRVKVVKNKIAAPFKQAEFQILYGEGINFYGELVDLGVKEKLIEKAGAWYSYKGEKIGQGKANATAWLKDNPETAKEIEKKVRELLLSNPNSTPDFSVDDSEGVAETNEDF

SEQ ID NO: 2734 - DNA, 1444 bp, Pseudomonas fluorescens
  CDS (156)..(1214)
gtcgacaaacggtaaaggccgcgctggagggcttgttgcgacgagctgcagcagaaatcgaaaatcaggggtaggcgatcccggatctttgtggaacaatactgtctacttatacaggtgttggccgtcagcttattgattacgtgaggactttaatggacgacaacaagaagaaagccttggctgcggccctgggtcagatcgaacgtcaattcggcaagggtgccgtaatgcgtatgggcgatcacgaccgtcaagcgatcccggctatttccactggctctctgggtctggacatcgcactcggcattggcggcctgccaaaaggccgtatcgttgaaatctacggtcctgaatcttccggtaaaaccaccctgaccctgtcggtgattgcccaagcgcaaaaaatgggcgccacctgtgcgttcgtcgacgccgagcacgcccttgacccggaatacgccggtaagctgggcgtcaacgttgacgacctgctggtttcccagccggacaccggtgagcaagccctggaaatcaccgacatgctggtgcgctccaacgccatcgacgtgatcgtggtcgactccgtggctgccctggtaccgaaagctgaaatcgaaggcgaaatgggcgacatgcacgtgggcctgcaagcccgcctgatgtcccaggcgctgcgtaaaattaccggtaacatcaagaacgccaactgcctggtgatcttcatcaaccagatccgtatgaagatcggcgtaatgttcggcagcccggaaaccactaccggtggtaacgcgctgaagttctacgcttcggtccgtctggacatccgccgtaccggcgcggtgaaggaaggtgacgaagttgttggtagcgaaactcgcgttaaagtcgtgaagaacaaggtcgctccgcctttccgtcaggcagagttccagattctctacggcaagggtatctacctgaacggcgagatgattgacctgggcgtactgcacggtttcgtcgagaagtccggtgcctggtatgcctacaacggcagcaagatcggtcagggcaaggccaactcggccaagttcctggcagacaacccggatatcgtcgccacgcttgagaagcagattcgcgacaagctgctgaccccagcgccagacgtgaaagctgccgccaaccgcgagccggttgaagaagtggaagaagctgacactgatatctgaagcaaacgatgactgtggtactggatacactcgtcgccgttcggcgcaccgcgatggacctgctcgctcgccgcgagcatggtcgagtcgagctgacgcgtaaactgcgtcagcgcggtgcagagcccgagatgatcgaaacagccctcgaccgtttgacggaagaggggctgctttccgaagcccgctatcttgaaagctttgtttcctaccgcgcgcgctccggctat

SEQ ID NO: 2735 - protein, 352 aa, Pseudomonas fluorescens
MDDNKKKALAAALGQIERQFGKGAVMRMGDHDRQAIPAISTGSLGLDIALGIGGLPKGRIVEIYGPESSGKTTLTLSVIAQAQKMGATCAFVDAEHALDPEYAGKLGVNVDDLLVSQPDTGEQALEITDMLVRSNAIDVIVVDSVAALVPKAEIEGEMGDMHVGLQARLMSQALRKITGNIKNANCLVIFINQIRMKIGVMFGSPETTTGGNALKFYASVRLDIRRTGAVKEGDEVVGSETRVKVVKNKVAPPFRQAEFQILYGKGIYLNGEMIDLGVLHGFVEKSGAWYAYNGSKIGQGKANSAKFLADNPDIVATLEKQIRDKLLTPAPDVKAAANREPVEEVEEADTDI

SEQ ID NO: 2736 - DNA, 1484 bp, Haemophilus influenzae
  CDS (278)..(1342)
agtacttctgatttcatttacatcatgaaatttttactacacctaaatataaatgtcagatttgtgagccagatcgtaaatttaaaatttatttttatctaaacgattggtttatatataaatatactatatttaaaacttttattttaagccttccccatcctctttactgaaatatataccccatatttttttattaatataaatatttttcttgacctgtacatcaatacagatataatcacaaaaatttgaacattcaaacaggattttaattatggcaactcaagaagaaaaacaaaaagccctagcggctgcactagggcaaatcgaaaaacaatttggtaaaggctcaattatgaaattaggcgataccaaaacgttggatgtagagtctatttctactggatcacttgggttagatgttgcgctagggattggtggtttgcctatgggtcgaattgtagaaattttcgggcctgaatcatcgggtaaaacaacattaactctttccgtcattgctcaagcgcaaaaagcaggaaaaacctgtgcatttattgatgcagaacacgcacttgatcctatttatgcagcaaaacttggtgtagatgtaaaagaactttttgtttctcaaccagataatggggaacaggcacttgaaatctgtgatgcattagttcgctcaggtgcaattgatgtaattattgtggactccgttgccgcactgacaccaaaagctgaaattgaaggcgatatgggcgattctcatatggggctgcaagcacgtttaatgtctcaagctttgcgtaaactcacaggtcaaattaaaaatgcaaactgtctagttgtgtttattaaccaaatccgtatgaaaataggcgtgatgtttggtaatcctgaaaccaccacaggcggtaatgcattaaaattctattcttctgttcgcttagatattcgccgtacaggttctgtaaaagacggggaaaatattattggaaatgaaacccgcgtaaaagtagtgaaaaacaaattagcggcaccgttccgccaagtggatttccaaattctctatggagaaggcatttcaaaagcaggtgaattattagaacttggtgtaaaacacaaacttgtagaaaaatcaggcgcttggtattcctacaatggtgaaaaaattggtcaaggaaaggctaattcaatgaaatggcttaacgaaaatatagagaaatcagatgaattagaagctcgtttacgtgctgaattagtggccaatccagaacaagccttaatggcggatattgaacaatctgaaaataatactgaatcagaaagtgattttgaataaagaaaattacaaatgccaaaagtgcggttaaaaatgaccgcactttatatcaactcaataaaaataaaggaatcattccttgtcatctcttgcttttaattacatagttaatcttctttcccgcagagaatatagtgaattc

SEQ ID NO: 2737 - protein, 354 aa, Haemophilus influenzae
MATQEEKQKALAAALGQIEKQFGKGSIMKLGDTKTLDVESISTGSLGLDVALGIGGLPMGRIVEIFGPESSGKTTLTLSVIAQAQKAGKTCAFIDAEHALDPIYAAKLGVDVKELFVSQPDNGEQALEICDALVRSGAIDVIIVDSVAALTPKAEIEGDMGDSHMGLQARLMSQALRKLTGQIKNANCLVVFINQIRMKIGVMFGNPETTTGGNALKFYSSVRLDIRRTGSVKDGENIIGNETRVKVVKNKLAAPFRQVDFQILYGEGISKAGELLELGVKHKLVEKSGAWYSYNGEKIGQGKANSMKWLNENIEKSDELEARLRAELVANPEQALMADIEQSENNTESESDFE

SEQ ID NO: 2738 - DNA, 1131 bp, Thermus aquaticus
  CDS (62)..(1084)
gagctcaagcctagggggcccgtctacaccattctggaaaagttccctttgcgaggtgagcatggaagagaacaagaggaagtcgctggaaaacgccctcaagaccattgaaaaggagtttggcaagggggccgtcatgcgcctgggggagatgcccaagctccaggtggacgtgatccccacgggctccttgggcctggacctggccctggggatcgggggcatcccccgggggcgggtcaccgagatctttgggccggagtcggggggcaagaccactttggccctgaccatcatcgcccaggcccagaaggggggcggggtggcggccttcgtggacgccgagcacgccctagaccccctttacgccaagaagctcggggtggacgtgcaggagcttctggtctcccagccggacaccggggagcaggctttggagatcgtggagcttctggcccgctcgggggcggtggacgtgatcgtggtggattcggtggccgctttggtgcccaaggcggagattgagggggagatgggggaccagcacgtgggcctccaggcccggctcatgagccaggccctgaggaagctgaccgccgtcctctccaagagcaacaccgccgccatcttcatcaaccaggtgcgggagaaggtgggggtcatgtacggcaaccccgagaccacgccgggcggccgggccctcaagttctactccagcgtgcgcctggacgtgcgcaaaagcggccagcccatcaaggtgggcaacgaggccgtgggcatcaaggtcaaggtcaaggtggtgaagaacaagctggccccgcccttccgggaggcggagctggagatctacttcggccggggcctggaccccgttatggacctggtcaacgtggccgtagcggcgggggtcattgagaaggccggctcctggttctcctacggcgagcaccgcctgggccagggcaaggagaaggcggccgagtacctgagggagcggccggagcttctggaggagatccgggccaaggtcctggagcgggcggacaaggtggtcctggccgccggcgaggaagagggggagtagatgacccttctggacctggtgcttttgctcctggtcctggcccttct

SEQ ID NO: 2739 - protein, 340 aa, Thermus aquaticus
MEENKRKSLENALKTIEKEFGKGAVMRLGEMPKLQVDVIPTGSLGLDLALGIGGIPRGRVTEIFGPESGGKTTLALTIIAQAQKGGGVAAFVDAEHALDPLYAKKLGVDVQELLVSQPDTGEQALEIVELLARSGAVDVIVVDSVAALVPKAEIEGEMGDQHVGLQARLMSQALRKLTAVLSKSNTAAIFINQVREKVGVMYGNPETTPGGRALKFYSSVRLDVRKSGQPIKVGNEAVGIKVKVKVVKNKLAPPFREAELEIYFGRGLDPVMDLVNVAVAAGVIEKAGSWFSYGEHRLGQGKEKAAEYLRERPELLEEIRAKVLERADKVVLAAGEEEGE

SEQ ID NO: 2740 - DNA, 1196 bp, Aquifex pyrophilus
  CDS (51)..(1097)
agagggaagacggattttttgtagttccgagagttgtggaggtgtaatagatggcaagggtttctgaaaacttatctgagaagatgaaggctcttgaggtagctttaagcagtattgagaagcgtttcggcaaaggggcggttatgccccttaaagctgttgagaccgttgaggttgaaactatacccactggctccatctcccttgatatagctacgggagtcggaggaatcccgaagggtagaataaccgagatattcggtgttgagagctccgggaaaacaaccctcgcacttcacgtaatagcggaagcccaaaaaaggggaggagtagcggtattcattgatgcggaacacgctcttgaccccaagtatgctaagaagcttggtgtggacgttgataatctttacatatcccagcccgactatggagagcaggcccttgaaatagcggagagtctaataaacagcggagcggttgatgttatagtcgttgactccgtagctgcactcgttcccaaggacgagcttgagggcgagatgggagaagcccaggtgggcaaacaggcaaggctcatgtcccaggcactgagaaagcttaaaggtgcggttcacagaagcaacaccgcactcatattcataaaccagataagggagaagataggagtgatgttcggaaatccggagacaacacccggtggaagggcattaaagttcttttccgatatgagacttgaagtgagaagactcggagacgttaaggaaggaggagaaaagaaaggctacagagtgaaggttagggttgttaagaataagctcgcgcccccattccaggaggcggagtttgacgttatatacggtgaaggaatatgcaggatatgcgatatcattgatactgctgcaaatctcggagttataacgaagagcggttcctggtacagctacggagaaaagaggctgggacagggaagggaacaggctaagaaatacctgcttgaacatcccgaaatgcttgaggaaatagagagaaaagtaagagaggtgtcgggacttgttagaccagatactgaaaacagcgttggagaaaagagcgagtgatattcacctcaaggtgggctcaaagccgtaatcaggactccaaacgggctggaaacccttgaggagtttccccctatttccatagaactttttgaaatc

SEQ ID NO: 2741 - protein, 348 aa, Aquifex pyrophilus
MARVSENLSEKMKALEVALSSIEKRFGKGAVMPLKAVETVEVETIPTGSISLDIATGVGGIPKGRITEIFGVESSGKTTLALHVIAEAQKRGGVAVFIDAEHALDPKYAKKLGVDVDNLYISQPDYGEQALEIAESLINSGAVDVIVVDSVAALVPKDELEGEMGEAQVGKQARLMSQALRKLKGAVHRSNTALIFINQIREKIGVMFGNPETTPGGRALKFFSDMRLEVRRLGDVKEGGEKKGYRVKVRVVKNKLAPPFQEAEFDVIYGEGICRICDIIDTAANLGVITKSGSWYSYGEKRLGQGREQAKKYLLEHPEMLEEIERKVREVSGLVRPDTENSVGEKSE

SEQ ID NO: 2742 - DNA, 1023 bp, Rickettsia prowazekii
  CDS (1)..(1023)
atgtcaaatatagacaaggaaagagccattgctgcggcactcgcacaaatagaaaaaagctacgggaaaggttccgtaatgaaattagggcaacgtccaaatgttgatatagaagcaatatcaacaggctcacttgggctagatatagcgcttgggatcggaggtgtacctaaaggcagaattatcgagatttttggacctgaaagctcaggtaaaactactttgacactacatttaattgcagaatctcaaaagaagggtggtacatgtgcttttattgatgcagagcatgccttagacccagcttatgcaaaaaaattaggcgtaaacattgatgagcttatcatttcacagcctgatacaggtgaacaagctctagaaattgctgatacgttaattcgctcaggcggtattgatatgataataatagatagtgttgcagctttagtaccaaaatcagaaattgaaggtgaaatgggtgatgctcaaatggcttctcaagcaagattaatgagccaagcacttcgtaaacttaccgcatcaattaatcgtacaaattgtattactgtttttatcaaccaaatcaggatgaaaataggtgtgatgtttggtagccctgaaactacaacaggtggtaatgctttaaaattctatgcttctgttagaattgatataagaagaattggctccattaaagataaagaagaagtgataggtagccaaactaaagtaaaagtagtcaaaaacaaagtatctcccccatttaaaactgcagattttgatataatgtatggttcaggtatttcaaaagaaggtgaaataatcgatcttggtgttaagcttgagattattgagaaatcagggtcgtggttttcttacaataaaatacgcatagggcaaggacgtgaaaacgtcaaacaatatttaaaagaacatccacaaatttccaacgaaattgagaaaataatacgagaaaaatcgtcagcaattactaatataaatcttgatcaaacggaggaataa

SEQ ID NO: 2743 - protein, 340 aa, Rickettsia prowazekii
MSNIDKERAIAAALAQIEKSYGKGSVMKLGQRPNVDIEAISTGSLGLDIALGIGGVPKGRIIEIFGPESSGKTTLTLHLIAESQKKGGTCAFIDAEHALDPAYAKKLGVNIDELIISQPDTGEQALEIADTLIRSGGIDMIIIDSVAALVPKSEIEGEMGDAQMASQARLMSQALRKLTASINRTNCITVFINQIRMKIGVMFGSPETTTGGNALKFYASVRIDIRRIGSIKDKEEVIGSQTKVKVVKNKVSPPFKTADFDIMYGSGISKEGEIIDLGVKLEIIEKSGSWFSYNKIRIGQGRENVKQYLKEHPQISNEIEKIIREKSSAITNINLDQTEE

SEQ ID NO: 2744 - DNA, 1329 bp, Myxococcus xanthus
  CDS (201)..(1229)
actgccggagtggcacgcgcacactccgcactcttggacacacagccacgtacccggacacctgtactcccatctctcagggggaggagcgggcggcacaggtgttgctcacctgtctgcccgccgcgctggcgcgccatgacggcgtccctagaggcggcatccaacacagcaagggcggcgagggagtgacagacgcgatgagcaagctggcggagaagctgaaggcagtggcggcggcggtagcgagcatcgagaagcagttcggacgaggctcggtgatgacgttgggcggggaagcacgcgaacagaaggtcgccgtcatcccctccggctcggtgggggtggaccgcgcgctgggcgtgggcggctatccccggggccgtgtggtggaggtcttcgggaacgagtcctcgggcaagacgacgctcaccctgcatgcgattgcacaggtgcaggcggcgggtggcgtagcggccttcatcgacgcggagcacgcgctggatgtgtcctacgcgcgcaagctgggcgtccgtgtggaggagttgctcgtgtcgcaacccgacaccggcgaacaggcgctggaaatcacggagcacctggtgcgctccggcgcggtggacctcatcgtcgtcgactcggtggcggccctggtgccacgggccgaaatcgagggcgagatgggggacgcgcacatgggcgtccaggcgaggctgatgagtcaggcgctgcgcaagctgacgggcgcggtgagccgctcgggcacgtgcatcatcttcatcaaccagattcggatgaagattggcgtgatgttcggcaatccggaaaccaccacgggtggcaatgcgctgaagttctacgcatccgtgcggatggagattcgccgcacgggcaacatcaaggacggtgatgccgtcgtgggctcgaaggcgcgcgtgaaggtggtgaagaacaaggtcgccccgcccttccaggaagcggagttcgacctcatgtacggcagcggcatccaccgcgtgggggaagtgctcgacctcggcgtggccacgggcctcatcgagaagtcggggagctacttcagcctgcgcggagagcgcatcggccagggccgggagcgcgccgccgagtggctgcgcgaacatcccgacgtgctggaagcgctgggcaaggagattacggggacttccgccctgccctcctcgcccgcgccggtggaggtcgcggcctagacggaggacgccaacacgtccagcttgaccgggacggcgacgttgcgctgaccgacattcagcacgagcccgccgtcgggcccttcttccaggagctgtc

SEQ ID NO: 2745 - protein, 342 aa, Myxococcus xanthus
MSKLAEKLKAVAAAVASIEKQFGRGSVMTLGGEAREQKVAVIPSGSVGVDRALGVGGYPRGRVVEVFGNESSGKTTLTLHAIAQVQAAGGVAAFIDAEHALDVSYARKLGVRVEELLVSQPDTGEQALEITEHLVRSGAVDLIVVDSVAALVPRAEIEGEMGDAHMGVQARLMSQALRKLTGAVSRSGTCIIFINQIRMKIGVMFGNPETTTGGNALKFYASVRMEIRRTGNIKDGDAVVGSKARVKVVKNKVAPPFQEAEFDLMYGSGIHRVGEVLDLGVATGLIEKSGSYFSLRGERIGQGRERAAEWLREHPDVLEALGKEITGTSALPSSPAPVEVAA

SEQ ID NO: 2746 - DNA, 1394 bp, Legionella pneumophila
  CDS (166)..(1212)
ttcatttttgaacaaatggttattccacgtagcttataataaaagactaatcatcagctatcgtatgctacttttatttagtaatacactaagattactgtttgctgctcgctcacatctgtgtgataattttgttcttgcacacattataatctggaataaattatggaagaaaataaacaaaaagcactatcagcggccgtttcgcaaattgaacgccaatttggcaaagggtctgtaatgcgtatgggagatagcacggtatcacgggatattgaagcaatctctacaggttcattaggtcttgatattgccttagggataggcggtttgccaaaaggccgtattgttgaaatttatggccctgagtcttctggtaaaaccacgctcactcttcaagtgatcgctgaatgtcaaaaaatgggtggtacagcagcatttatcgatgcggaacatgctctggatccaagctatgctcagaaacttggtgtgaaggtggatgagctgttggtttctcagccggatacaggcgagcaagctctggaaattactgatatgctggtgcgttctgcagcagttgatgtcgtaataattgactcggttgctgccttgactcccaaagcagaaattgagggagaaatgggcgattcccatgttggtttacaggcaagattgatgtcgcaagccctgcgtaaattgaccgctaacattaaacgttcgaacacactggttatttttattaatcaaatacgtatgaaaattggtgtgatgtttggtagccctgaaactactacagggggcaatgctttgaagttttatgcttcagttcgtttggatattcgccgtattggttcaattaaaaagggtgaagaaatattaggcagtgaaacccgagttaaagtagttaaaaataaggtagcgccaccgtttaaaatgactgagtttgatattttatataacgaaggtatatctcgtgagagtgaaattattaatctgggtgttcaattgaatttaattgagaaatcaggtgcctggtatagctacaaacaggaaaaaatcgggcagggcaaagaaaatgtcagattatatttgaaagaaaatccccaagtcgctgcagagcttgaacaacaaatccgtactgagctcttggaaaaaaagttatctgtgttggctagttcatcagaagatctttttgagactatagatgactaaagcattcgataggcccttgcgtctgttaaccaggcgcgagtatagcgctatggagttatgtgataaactgaagcagaaaggatttagcaccaatgatgttcaaaatgctttgtatgaatgccaacgtcttgggtatcaaagcgatgtgcgttttgtagaaaattatatcagagtacgaattc

SEQ ID NO: 2747 - protein, 348 aa, Legionella pneumophila
MEENKQKALSAAVSQIERQFGKGSVMRMGDSTVSRDIEAISTGSLGLDIALGIGGLPKGRIVEIYGPESSGKTTLTLQVIAECQKMGGTAAFIDAEHALDPSYAQKLGVKVDELLVSQPDTGEQALEITDMLVRSAAVDVVIIDSVAALTPKAEIEGEMGDSHVGLQARLMSQALRKLTANIKRSNTLVIFINQIRMKIGVMFGSPETTTGGNALKFYASVRLDIRRIGSIKKGEEILGSETRVKVVKNKVAPPFKMTEFDILYNEGISRESEIINLGVQLNLIEKSGAWYSYKQEKIGQGKENVRLYLKENPQVAAELEQQIRTELLEKKLSVLASSSEDLFETIDD

SEQ ID NO: 2748 - DNA, 1224 bp, Treponema pallidum subsp. pallidum (syphilis spirochete)
  CDS (1)..(1224): k means g or t/u
atgtcaaaagcccttaaaggggatgttcccgttagttcttcttttgaagaaaagatgaaggcgttggaggcggcgcgcctccagatcgaaaagcagtttggccaaggttccctcatgaagttagggaaggatgacgcagtccaaggtgttgaagttattcccacgggaaatattttgcttgacgaggcattaggtatcggcggttatccgcgcggtaggattattgaaatatttggtcctgagtcgtctggcaaaacaacccttgcgctgcacgcggttgcagaagcgcaaaagcgtggaggtatcgcagcctttatcgatgctgagcacgcgcttgacccacagtatgcgaaggatcttggcgtgtccgtcggtgatctgtggatatcgcagccagatacaggggagcaagcgttagagattgccgaaagtcttgtgcgttcaggtgcggtggatattatcgtggtggattctgttgccgcgctcacgcctcaggcagaaatacagggggatatgggggatgcccacgtaggtctgatcgcgcgtcttatgagtcaggcgttgcgtaagcttacttctatcatcaataagtcgaagtgtacgctcatttttattaatcagctccgcatgaaaatagggattatgtttgggaatcctgagactactaccggcggcattgcacttaagttttattcctccgtgaggatagaggttaggaaggtggaaacgctttcaagaggtgatgaggaagcgtggggcaataaggtaaggatccggatagtaaagaataagatggcaccccccttccgcaaggtagaaacggagattctctttgggaagggtttttctgccttttcgtgtttgctggatgcagcggttaagcaggaaattatcgaaaaaaaaggggcgtggtacgcgtaccgagaagaaaagatcggacaggggcgtgacaatgccgtgggctttctgcagcagaatatggacatcaccttggagatcgaacgggcagtgcgtacgaagctttttcctaagcaggcgtttatatccagctttcaggaacatcgtcctgctctctctcttgaggcgtctccggaggagtcggacgcaaaaacgttgcggcgttktgcaagcaggggtgcgggcgcgtcgagtagtcgggtgcaggagggatctgcagcgaatgaccattttcaggacgaatcgaccacggcgaaactcctttag

SEQ ID NO: 2749 - protein, 407 aa, Treponema pallidum subsp. pallidum (syphilis spirochete)
  misc_feature (375)..(375): Xaa can be Cys or Phe
MSKALKGDVPVSSSFEEKMKALEAARLQIEKQFGQGSLMKLGKDDAVQGVEVIPTGNILLDEALGIGGYPRGRIIEIFGPESSGKTTLALHAVAEAQKRGGIAAFIDAEHALDPQYAKDLGVSVGDLWISQPDTGEQALEIAESLVRSGAVDIIVVDSVAALTPQAEIQGDMGDAHVGLIARLMSQALRKLTSIINKSKCTLIFINQLRMKIGIMFGNPETTTGGIALKFYSSVRIEVRKVETLSRGDEEAWGNKVRIRIVKNKMAPPFRKVETEILFGKGFSAFSCLLDAAVKQEIIEKKGAWYAYREEKIGQGRDNAVGFLQQNMDITLEIERAVRTKLFPKQAFISSFQEHRPALSLEASPEESDAKTLRRXASRGAGASSSRVQEGSAANDHFQDESTTAKLL

SEQ ID NO: 2750 - DNA, 1050 bp, Clostridium acetobutylicum
  CDS (1)..(1050)
atggataatgaaaaattaaaagccattgatgcggctatgagtcagatagagaaacaatttggaaaaggcgctataatgaaacttggtgagcaagacatcttaaatattgatgcaatttcaacaggatgtttatctttagatatagcacttggaataggtggagttccacgtggaagagtagttgagatatatggacctgaatcatcaggtaaaactacagttgcacttcatatattagctgaagcccaaaagaagggtggagctgctgcatttattgatgccgagcatgctttagatcctcaatatgcaagagctttaggagtagatatagataacttagttgtatctcaaccagatactggtgagcaggcacttgaaattgctgaagcacttgttaggtcaggtgcaattgatgtaattgttgtagattctgtagcagcacttgtaccaaaagctgaaattgaaggtgaaatgggagattctcatgtaggtcttcaggcaagacttatgtcacaagctcttagaaaattaacaggttctataaacaagtctaaatgtatagctatatttataaaccaacttagagaaaaagttggaataatgtttggaaatcctgaaactactcctggaggaagagctcttaagttttatgcttctgtaagaatggatataagaaaaatagacactataaaacagggcgaagaaatgattggaaatagagtaagagtaaaggtagttaaaaataaagtggctcctccatttaaacaagcagaatttgatattatgtataatgaaggtatatctcgtgaaggaaatatagttgatgtaggagttaaagaaaatatcatccaaaaaagtggtgcatggttctcatatggtgatataagacttggtcagggaagagaaaatgctaaattattctttaaagaaaatatagatattagatctgaagttgaaaataaaataagagaaaagtacgatttacctatacaaaaagttaaaaatgaaaagccaaagattgaaaaaggaactgaaaataatacaaaataa

SEQ ID NO: 2751 - protein, 349 aa, Clostridium acetobutylicum
MDNEKLKAIDAAMSQIEKQFGKGAIMKLGEQDILNIDAISTGCLSLDIALGIGGVPRGRVVEIYGPESSGKTTVALHILAEAQKKGGAAAFIDAEHALDPQYARALGVDIDNLVVSQPDTGEQALEIAEALVRSGAIDVIVVDSVAALVPKAEIEGEMGDSHVGLQARLMSQALRKLTGSINKSKCIAIFINQLREKVGIMFGNPETTPGGRALKFYASVRMDIRKIDTIKQGEEMIGNRVRVKVVKNKVAPPFKQAEFDIMYNEGISREGNIVDVGVKENIIQKSGAWFSYGDIRLGQGRENAKLFFKENIDIRSEVENKIREKYDLPIQKVKNEKPKIEKGTENNTK

SEQ ID NO: 2752 - DNA, 1047 bp, Listeria innocua
  CDS (1)..(1047)
atgaatgatcgtcaagcggcattagaccaagcattaaaacaaattgaaaaacaattcggtaaaggttccattatgaaattaggggaacattcagaccaaaatatatctactatttctagtggctcattagcattagatattgctttaggagttggcggatatccgcggggacgtattattgaagtatacggacctgagagttctggtaaaacaactgttgcactacatgcgattgcagaagtccaagcacaaggtggaacagcagcatttatcgacgccgaacatgctctagatccagcttatgcaaaaaatctaggtgtaaacattgatgagctattactatcgcaaccggatacaggggaacaagctttagaaatcgctgaagcactagttagaagtggcgctgttgatatgttagttattgactctgttgcagctcttgtaccacgcgctgaaattgaaggcgagatgggagatgcccacgttggtttgcaagcacgtttaatgtcccaagctttaagaaaactttcaggtgttattaataaatcaaaaacgattgctatcttcatcaaccaaattcgtgaaaaagttggtgttatgttcgggaatcctgaaatcactcctggtggccgtgcgcttaaattctattctactgtccgtttagaagtaagacgtgctgagcagttgaagcaaggtactgatgtaatgggtaacaaaacaaaaataaaagttgtaaaaaataaagtagctccaccattccgtatcgctgaagtggatattatgtacggagaaggtatttcacgtgaaggtgaacttgttgatatggctgctgaagttgatgtaattaacaagagtggttcttggtattcttataaagaagaacgtatcggacaaggtcgtgaaaatgcaaaacaatatctaaaagaacacacagacattcgagacgaaatctctaaacgcgttcgcgaagaatacgaaattgatggcactaacaaagaacctttagacgaaaatgaagaaacattaagtttgcttgatgatgaataa

SEQ ID NO: 2753 - protein, 348 aa, Listeria innocua
MNDRQAALDQALKQIEKQFGKGSIMKLGEHSDQNISTISSGSLALDIALGVGGYPRGRIIEVYGPESSGKTTVALHAIAEVQAQGGTAAFIDAEHALDPAYAKNLGVNIDELLLSQPDTGEQALEIAEALVRSGAVDMLVIDSVAALVPRAEIEGEMGDAHVGLQARLMSQALRKLSGVINKSKTIAIFINQIREKVGVMFGNPEITPGGRALKFYSTVRLEVRRAEQLKQGTDVMGNKTKIKVVKNKVAPPFRIAEVDIMYGEGISREGELVDMAAEVDVINKSGSWYSYKEERIGQGRENAKQYLKEHTDIRDEISKRVREEYEIDGTNKEPLDENEETLSLLDDE

SEQ ID NO: 2754 - DNA, 1137 bp, Brucella melitensis
  CDS (1)..(1137)
atgtggcaacgagcctgccgggcttctagcgagacaagaggatggtgtaagatgtctcaaaattcattgcgacttgttgaggataattcagtggacaagacaaaagctctcgacgcggcattgtcgcaaatcgaacgggcgttcggcaaaggctcaatcatgcgtctgggccagaacgatcaggtggtcgaaatcgaaaccgtatcgaccggctcgctctcgctcgatattgccttgggggttggcggcttgcccaagggacgtatcgtggaaatctatgggccggaaagttccggtaaaaccacgcttgccttgcacaccatcgctgaagcgcagaagaagggcggcatctgcgcattcgtcgatgcggaacatgcgcttgacccggtctatgcgcgcaagctcggtgtcgatcttgaaaatcttctgatctcgcagcccgatacgggtgaacaggcgcttgaaatcaccgatacgctcgtgcgctctggcgccatcgacgttctcgttgtcgactcggtcgcagccctgacgccgcgtgctgaaatcgaaggtgaaatgggggattccctgccgggccttcaggcccgtctcatgagccaggcgctgcgcaagcttactggctccatttcccgttcaaactgcatggtgatcttcatcaaccagatccgcatgaagatcggtgtcatgttcggctcgccggaaacgacaacgggcggcaatgcgctcaagttctatgcttcggttcgcctcgatattcgccgtatcggctccatcaaggagcgcgacgaagtggtgggcaaccagacccgcgtgaaggtggtgaagaacaagctcgctcctccgttcaagcaggtcgaattcgatatcatgtatggcgcgggcgtttccaaggtgggcgagctggtcgatcttggtgtcaaggccggtgtggttgagaagtctggtgcctggttctcctataattcccagcgtctcgggcaggggcgcgagaacgccaagcaatatctcaaggataatccggaagtcgcgcgtgaaatcgaaaccacgcttcgccagaatgccggcctgatcgccgagcagttccttgacgatggcggaccggaagaagatgctgccggcgcggcggaaatgtaa

SEQ ID NO: 2755 - protein, 378 aa, Brucella melitensis
MWQRACRASSETRGWCKMSQNSLRLVEDNSVDKTKALDAALSQIERAFGKGSIMRLGQNDQVVEIETVSTGSLSLDIALGVGGLPKGRIVEIYGPESSGKTTLALHTIAEAQKKGGICAFVDAEHALDPVYARKLGVDLENLLISQPDTGEQALEITDTLVRSGAIDVLVVDSVAALTPRAEIEGEMGDSLPGLQARLMSQALRKLTGSISRSNCMVIFINQIRMKIGVMFGSPETTTGGNALKFYASVRLDIRRIGSIKERDEVVGNQTRVKVVKNKLAPPFKQVEFDIMYGAGVSKVGELVDLGVKAGVVEKSGAWFSYNSQRLGQGRENAKQYLKDNPEVAREIETTLRQNAGLIAEQFLDDGGPEEDAAGAAEM

SEQ ID NO: 2756 - DNA, 1062 bp, Salmonella enterica subsp. enterica serovar Typhi
  CDS (1)..(1062)
atggctatcgacgaaaacaaacagaaagcgttggcggcagcactgggccaaattgaaaagcaatttggtaaaggctccatcatgcgtctgggtgaagaccgttctatggatgtggaaactatctccaccggttcgctttcactggacatcgcactcggtgcgggcggtctgccgatggggcgtatcgtcgaaatttacgggccggaatcttccggtaaaacgaccctgacgctgcaggtgattgccgctgcgcagcgtgaaggtaaaacctgtgcgtttatcgatgcggaacacgcgcttgaccctgtttacgcacgcaagctgggcgtcgatatcgataacctgctctgctctcagccggataccggcgagcaggcgctggaaatctgtgacgcgctggcgcgttcaggcgcggtggacgtcattgtggtcgactccgtagcggcgctaacgccgaaagcggaaatcgaaggcgaaatcggcgactctcacatgggcctcgcggcgcgtatgatgagccaggcgatgcgtaagctggcggggaacctgaaacagtccaacacgctgttgattttcatcaaccagatccgtatgaagattggcgtgatgttcggtaacccggaaaccaccaccggcggtaacgcgctgaaattctacgcctctgttcgtcttgatatccgtcgtattggcgcggtgaaagagggcgataatgtcgtgggtagcgaaacgcgtgtgaaagtggtgaaaaacaaaatcgccgcgccgtttaagcaggccgagttccagatcctctacggtgaaggcatcaacttctatggcgaactggttgacctgggcgtgaaagagaagctgatcgagaaagcgggcgcatggtacagctacaacggcgagaagattggccagggtaaagcgaacgcgactacctggctgaaagagaacccggcgacagcgaaagagatcgagaaaagggttcgtgaattactgttgagtaatcagaatgccacgcccgatttcgccgttgacgatagcgaaggcgttgcagaaaccaacgaagatttttaa

SEQ ID NO: 2757 - protein, 353 aa, Salmonella enterica subsp. enterica serovar Typhi
MAIDENKQKALAAALGQIEKQFGKGSIMRLGEDRSMDVETISTGSLSLDIALGAGGLPMGRIVEIYGPESSGKTTLTLQVIAAAQREGKTCAFIDAEHALDPVYARKLGVDIDNLLCSQPDTGEQALEICDALARSGAVDVIVVDSVAALTPKAEIEGEIGDSHMGLAARMMSQAMRKLAGNLKQSNTLLIFINQIRMKIGVMFGNPETTTGGNALKFYASVRLDIRRIGAVKEGDNVVGSETRVKVVKNKIAAPFKQAEFQILYGEGINFYGELVDLGVKEKLIEKAGAWYSYNGEKIGQGKANATTWLKENPATAKEIEKRVRELLLSNQNATPDFAVDDSEGVAETNEDF

SEQ ID NO: 2758 - DNA, 1074 bp, Nostoc sp. PCC 7120
  CDS (1)..(1074)
atggctatcaataccgatacttctggcaagcaaaaagcgctgacaatggtactcaaccagattgagcgcagcttcggtaaaggagcaatcatgcgcctgggcgatgctacccggatgcgggtagaaacaatctctactggcgcgctcaccttggatttagcattgggaggcggtttacccaaggggcgggtgattgagatttatggcccggaaagttccggtaaaacaacagtagcactccacgcgatcgcagaagtgcaaaaagaaggtggaatagctgccttcgtcgatgctgaacacgcccttgaccccacctacgcctcagctttaggtgtagatattcaaaacttgctggtttcccaaccagacacaggtgaatccgcattggaaattgttgatcaacttgtacgctccgccgccgttgatattgtagttattgactctgtagcagctttggttccccgtgcagaaatcgaaggcgatatgggtgatgcccacgtcggtttacaagcgagattaatgagccaagctctacgtaaaattactggcaatattggtaaatctggttgtacagtaattttcattaaccagttgcggcaaaaaattggtgttacctacggtagcccggaaacgacaactggcggtaacgcattaaagttctatgcttcagtacgcttagatattcgtcggattcaaaccttgaaaaaaggtactgatgaatttggtaaccgagttaaagtcaaagttgcgaaaaataaagttgcaccgccttttagaatcgcagagtttgacattatttttggtaaaggtgtttcgactctaggttgtttagtagatttagcggaagaaactggtattctcatccgtaaaggagcttggtacagttacaacggtgataatatttctcaaggtcgagataacgctatcaaatacctggaagaaaaaccagaatttagtgaacaaatcaaacaacaggtgcgtgaaaaattagataagggagctgttgtttctgcaaactcggtagctaaaaacaacgaagacgatgaagatgaagatgtagaagaggaagaataa

SEQ ID NO: 2759 - protein, 357 aa, Nostoc sp. PCC 7120
MAINTDTSGKQKALTMVLNQIERSFGKGAIMRLGDATRMRVETISTGALTLDLALGGGLPKGRVIEIYGPESSGKTTVALHAIAEVQKEGGIAAFVDAEHALDPTYASALGVDIQNLLVSQPDTGESALEIVDQLVRSAAVDIVVIDSVAALVPRAEIEGDMGDAHVGLQARLMSQALRKITGNIGKSGCTVIFINQLRQKIGVTYGSPETTTGGNALKFYASVRLDIRRIQTLKKGTDEFGNRVKVKVAKNKVAPPFRIAEFDIIFGKGVSTLGCLVDLAEETGILIRKGAWYSYNGDNISQGRDNAIKYLEEKPEFSEQIKQQVREKLDKGAVVSANSVAKNNEDDEDEDVEEEE

SEQ ID NO: 2760 - DNA, 1044 bp, Xylella fastidiosa
  CDS (1)..(1044)
atggatgagaacaagaaacgcgccctttctgtcgctttaagccagattgaaaaacagttcggcaaggggtccgtgatgcggatgggcgatcgcgtgatcgaggccgtagaggcgatcccgacaggttcgctcatgttggatctggccctggggatcggtggtttgccaaagggacgtgtcgtggaaatctatgggccggaatcttctgggaagaccacattgactttgcaggcgatcgctcaatgccagaagaagggaggtacagcagcgttcattgatgctgagcatgccttggatccgatttatgcgggcaagttaggcgtcaatgttgatgatttgttgttgtctcagccagatactggggagcaggctctggaaatcgctgacatgctggtgcgctcggggtcgatcgatatcatggtcattgattcggttgcggcactcacgccaagggcggagattgagggtgagatgggagatcagttgcccggtcttcaggcgcgcttgatgagccaggcactgcgtaaattgaccggcaatatcaagcgctctaatacgctggtgatctttatcaaccagttgcgtatgaaaattggggtcatgatgccgggtcaaagccctgaaactacgacagggggtaatgcgctgaagttctatgcttcagtgcgtttggatattcgccgtattggcgcgatcaagaagggtgacgaaattatcgggaatcaaaccaaaatcaaggttgttaaaaacaagttggcgcctcccttcaaacaagtcgtgactgagattctctatggtgaaggcatcagtcgtgaaggggaattgattgagatgggcgtggaggccaagttggttgagaaagccggcgcttggtatagctacggtggtgagcggatcgggcaaggaaaagataatgcgcgcggctatctacgtgaaaacccgcatcttgcggccaagcttgaggctgatttgcgtgagaaatttgagccgaccgagctttctcgagaagagggcgatgaagatacgctcgaagatacaatgtaa

SEQ ID NO: 2761 - protein, 347 aa, Xylella fastidiosa
MDENKKRALSVALSQIEKQFGKGSVMRMGDRVIEAVEAIPTGSLMLDLALGIGGLPKGRVVEIYGPESSGKTTLTLQAIAQCQKKGGTAAFIDAEHALDPIYAGKLGVNVDDLLLSQPDTGEQALEIADMLVRSGSIDIMVIDSVAALTPRAEIEGEMGDQLPGLQARLMSQALRKLTGNIKRSNTLVIFINQLRMKIGVMMPGQSPETTTGGNALKFYASVRLDIRRIGAIKKGDEIIGNQTKIKVVKNKLAPPFKQVVTEILYGEGISREGELIEMGVEAKLVEKAGAWYSYGGERIGQGKDNARGYLRENPHLAAKLEADLREKFEPTELSREEGDEDTLEDTM

SEQ ID NO: 2762 - DNA, 1164 bp, Lactococcus lactis subsp. lactis
  CDS (1)..(1164)
atggcaacaaagaaaaaaacaaattttgatgatattaccaaaaaatatggcgctgaacgtgacaaagctttggcagatgcacttgctctgattgaaaaagactttgggaaaggttcacttatgcgacttggcgaagcagccaaccagaaagtgtcagtagtaagttcaggctcacttgcacttgatattgcgcttggtgcaggtggatatcctaaaggacgtatcgttgaaatctacggaccagaatcttctggtaaaacaacagtcgctcttcatgccgttgcagcggttcaaaaagaaggtggaattgcagcctttatcgatgctgaaaatgcgcttgacccagaatatgcaaaagcgctcggtgtcaatatcgatgaacttttactttcacaaccagactatggtgaacaagggcttcaaattgctgaaaaattgattacatctggtgcagttgacttagttgttattgactcagttgcagctttggtacctaaagccgaaattgatggtgaaattggtgacagttcagttgggcttcaagctcgtatgatgtcacaagccatgcgtaaacttgcaggacatattaataaaacaaaaacaacagctattttcatcaaccaattgcgtgaaaaagttggggttatgtttggttcgccagaaacaacacctggtggtcgtgcattgaaattctacgcttctgtacgtcttgatgtacgtggttcaacaaaaatcgaagaaggttctggagataacaagacccaaatcggtaaaatcacaaaaatcaaagtcgttaaaaataaagtggctccaccattcaaggttgctctcgtagatatcatgttcggtgaaggaatttcaagaaccggtgaacttttaaacattgctgttgatgaaggaatcatcaaaaaatcaggcgcttggtttgcttacaatgacgaaaaaattggtcaaggagcagaaaaagcgaagaactatctcaaagaacatcaagaaatctttgatgaaattgaccataaagttcgtaccgcacacggtcttcttgatgaagcagaagtagcagaaactacagaagatacttcaacaaaagctaaggcaactaaagctaaaaaagaagaaaaagtagtcgaaactgaagaaattgaactcgaacttgaagattaa

SEQ ID NO: 2763 - protein, 387 aa, Lactococcus lactis subsp. lactis
MATKKKTNFDDITKKYGAERDKALADALALIEKDFGKGSLMRLGEAANQKVSVVSSGSLALDIALGAGGYPKGRIVEIYGPESSGKTTVALHAVAAVQKEGGIAAFIDAENALDPEYAKALGVNIDELLLSQPDYGEQGLQIAEKLITSGAVDLVVIDSVAALVPKAEIDGEIGDSSVGLQARMMSQAMRKLAGHINKTKTTAIFINQLREKVGVMFGSPETTPGGRALKFYASVRLDVRGSTKIEEGSGDNKTQIGKITKIKVVKNKVAPPFKVALVDIMFGEGISRTGELLNIAVDEGIIKKSGAWFAYNDEKIGQGAEKAKNYLKEHQEIFDEIDHKVRTAHGLLDEAEVAETTEDTSTKAKATKAKKEEKVVETEEIELELED

SEQ ID NO: 2764 - DNA, 2025 bp, Borrelia burgdorferi (Lyme disease spirochete)
  CDS (25)..(1122)
aatttagctaggaaaaatttaagaatgtcaaagttaaaggaaaaaagagaaaaagctgttgttggcatagaaagggcaagtaaagaggaagctattgagcttgcaagagttcaaatagaaaaagcttttggaaagggaagtcttattaagatgggggaatctcctgttggacaaggtataaaaagtatgtcaagtggatctattgtattagatgaggctctcggcattggcggatatcctagggggcgcataatagaaatttttggccccgagtcgtctggcaagactactttaactcttcaagcgattgctgaggtgcaaaaagaaggtgggatagctgcttttattgatgctgagcatgctcttgatcctgtttatgcaaaagctttaggtgttaatgttgcagaactttggcttagtcagcctgataccggagagcaagctcttgagattgctgagcatttaatcagaagtggtggtgttgatttgattgtagttgattctgtagcggctttaacccctaaattagagatagatggagaaatgggagattctcagattggtcttcaagcaaggctaatgagcaaagctcttagaaagattaccggtatactttctaaatccaatacttgcattatgtttattaatcaaataaggatgaggattggtgttatgtttggcaatcccgagaccactaccggtgggaatgctttaaaattttattcatctcttagacttgaggttcgaaagatcgaacaagtaactagatcgggctcaagcgatgatgttattggcaataagattagagttaagattgtaaagaacaaggttgctccaccttttcgtaaagtagaattgataatttattttgggaaaggtatttcaagagaagctggcattttagatgctgctattaagcataatttaatacaaaaaacaggctcatggtattcattgggagataataagttgggacaggggagagagagtgttattgagtatcttagcaaagaagtagaacttgcaaataatttggataagaggcttagaaaaataatttttaataattttgatcaagagaatgataattttattgaatttaaagaagatgaatctgagtaatatggaaaatttaaatgtctgaattgggtagttactctatcagccttgataattttacaggcggaatagagcttttttttgaatatgttagtatgaataggcatgttttgagaactttgagttttaaaatcaaaataattgaagaatttatagttgtttcaggtgatcttaatataagtattaggggattgatcgattttctttatcttgctaataatttgtcttattggaaaactcaaatttcattcccactgaagtttgaatgcaaagataaagctgagcgcaaagttgtggaaagattaatatgttatagcaagaatagagaaaatgaaaaattacaattaaaccaagcgaaaaattttaaattctatgactcaaaaattattgaagagtttatttttggcgatagtggcaattttattaaaaatattaatgctactgctaatgataataataaaaaagaaaaatttgaagagaaagtcttgtacattgaagaaaaaagttgttaataaaaattttttgtgtgataaaaaatttaaagctgtttacaataaatatgaattgaaaatttttgagaaaaagatgaaaattatttctattttaaataaagagagtagcgtaatttttgattctcttttagattttaatgccgataattattcttttgagagattttcttattttttagtatctcttgagtgtaaaatcgttaatatttgtaaatttcagggatatttgaataataaattagtattgtatccgaggtttgtaaaattaatgattgcacttaaagcccctagagttcacgtttttttagctgaaaagggagtggggtcaagaagattttgcgaggaactgataagaaagaaacttgtaagagttaataacactattgctaagctt

SEQ ID NO: 2765 - protein, 365 aa, Borrelia burgdorferi (Lyme disease spirochete)
MSKLKEKREKAVVGIERASKEEAIELARVQIEKAFGKGSLIKMGESPVGQGIKSMSSGSIVLDEALGIGGYPRGRIIEIFGPESSGKTTLTLQAIAEVQKEGGIAAFIDAEHALDPVYAKALGVNVAELWLSQPDTGEQALEIAEHLIRSGGVDLIVVDSVAALTPKLEIDGEMGDSQIGLQARLMSKALRKITGILSKSNTCIMFINQIRMRIGVMFGNPETTTGGNALKFYSSLRLEVRKIEQVTRSGSSDDVIGNKIRVKIVKNKVAPPFRKVELIIYFGKGISREAGILDAAIKHNLIQKTGSWYSLGDNKLGQGRESVIEYLSKEVELANNLDKRLRKIIFNNFDQENDNFIEFKEDESE

SEQ ID NO: 2766 - DNA, 1728 bp, Deinococcus radiodurans
  CDS (399)..(1490)
aggacctgccaccgctgcaagtcaacctgcgtggcactggctacttcccgaacgagggcagcccgcgcgtctggttcgtcaagaccgagcagagggcctgaccgaactcgcggaaaacctgcagggccggcatccgtgagctgggcatcggcaccgacgacctcgcgttcaaggcgcacatcaccctcgcccgcaagaaggggcccgcgccccgcctccctcccctcattttcgaccagagctggacaggccccaggactgagctttacccactcgatcctgcgtaagaccggcccgatctacgaagttcagagcacgttccgtttccgggggtcagcttcccagacctccgccgaatccgcccccactgctgcgccgagcgcgccccaggagcacccatgagcaaggacgccaccaaagaaatctccgcccccaccgacgccaaggaacgcagcaaggccatcgaaacagccatgagccagatcgaaaaggccttcggcaagggctcgatcatgaaactgggcgccgagagcaaactcgacgtgcaggtcgtcagcaccggcagcctcagccttgacctcgcactgggcgtgggcggcattccgcgtggccgcatcaccgagatctacggccccgagtcgggcggcaagaccaccctggccctcgccatcgtcgcgcaggcccagaaagcgggcggcacctgtgcgtttatcgacgccgagcacgcgctcgacccggtgtacgcccgcgccctgggcgtgaacaccgacgaactgctggtgtcgcagcccgacaacggcgagcaggcgctcgaaatcatggaactgctggtgcgttcgggcgcgattgatgtggtggtcgtggactcggtggctgctctgaccccccgcgccgaaatcgagggcgacatgggcgacagcctgcccggtcttcaggcccgcctgatgtcgcaggcgctgcgcaagctgacggcgattctctccaagaccggcaccgccgccatcttcatcaaccaggttcgcgagaaaatcggcgtgatgtacggcaaccccgaaaccaccaccgggggccgggcgctgaagttctacgccagcgtgcgcctcgacgtgcgtaagatcggccagcccaccaaggtcggcaacgacgcggtcgccaacaccgtcaagatcaagaccgtgaagaacaaggtcgccgcccccttcaaggaagtcgaactcgcgctggtctacggcaagggcttcgaccagctcagcgacctcgtgggcctggccgccgacatggacatcatcaagaaggccggcagcttctactcctacggcgacgagcgcatcggccagggcaaggaaaagaccatcgcctacatcgccgagcgccccgagatggagcaggaaatccgcgaccgcgtgatggccgccatccgcgcgggcaacgcgggcgaagcaccggccctggcccccgcgcctgccgcgcccgaagccgccgaagcgtaaacctcctcttgctgcgtgccccccgtctggggggttttgttttctctgcgccttttggcggatggccggcgcgtgtcggggcgtcagactgtgttcacgcttcgggccgggcactcactgtgggcgcatcgacaaccggcccgaaggcgagtcccctgtccgggtgaagacaggggagtttttacgtcttgagctgcccgacgagttgcacgtcacccgcgctgaccgtttccagccc

SEQ ID NO: 2767 - protein, 363 aa, Deinococcus radiodurans
MSKDATKEISAPTDAKERSKAIETAMSQIEKAFGKGSIMKLGAESKLDVQVVSTGSLSLDLALGVGGIPRGRITEIYGPESGGKTTLALAIVAQAQKAGGTCAFIDAEHALDPVYARALGVNTDELLVSQPDNGEQALEIMELLVRSGAIDVVVVDSVAALTPRAEIEGDMGDSLPGLQARLMSQALRKLTAILSKTGTAAIFINQVREKIGVMYGNPETTTGGRALKFYASVRLDVRKIGQPTKVGNDAVANTVKIKTVKNKVAAPFKEVELALVYGKGFDQLSDLVGLAADMDIIKKAGSFYSYGDERIGQGKEKTIAYIAERPEMEQEIRDRVMAAIRAGNAGEAPALAPAPAAPEAAEA

SEQ ID NO: 2768 - DNA, 1071 bp, Caulobacter crescentus
  CDS (1)..(1071)
atgacaagtcaggcggctttgaaactcgtggccaaggaagaaggcgataagcaacgcgcgctagaggcggctctcgcccagatcgaccgcgcgttcggcaagggctcggtgatgaagctgggcgagaagggcaaggtcgagatcgagtcggtctccaccgggtcgctcggcctcgacatcgcgctgggcatcggcggcctgcccaagggccggatcgtcgaggtctatggtccggaaagctcgggcaagaccaccctggccctgcacgtcgtggccgaggtccagaaggccggcggcaccgccgccttcgtcgacgccgagcatgcgctcgatccgtcctacgcctacaagctgggcgtcaatctcgataatctcctggtctctcagcccgacaacggcgaacaggccctggagatcaccgacaccctggtgcgctcgggcgccgtcgacatcgtggtcgtcgactcggtggcggccctgacgcccaaggccgaaatcgaaggcgagatgggcgacagcctgccgggtcttcaggcccgtctgatgagccaggcgctgcgcaagctgacggcctcgatcaacaaggccaacaccatcgtcatcttcatcaaccagatccgtcacaagatcggggtgatgtacggcagccccgaaacgaccacgggcggcaacgcgctgaagttctacgcttcagtgcgcctggatatccgccgcaccggctcggtgaaggcgcgtgacgagatcgtcggcaacaatgtccgcgtgaaggtggtcaagaacaaggtggccccgccgttccgcgaggtcgagttcgacatcatgtacggcgagggcatctccaagctgggcgaagtcatcgacctaggcgtcaaagccgggatcatcgacaaggccggctcgtggttctcgtacggcagccagcggatcggccagggccgcgacaatgtccgcgagttcctgaagaacaacccggacgtcgccgccgacatcgaaaaggctgtccgcaagtcgtcgcagaagatcgaagaagagcttctggtcggcggcccggaagagggcgaagaggactag

SEQ ID NO: 2769 - protein, 356 aa, Caulobacter crescentus
MTSQAALKLVAKEEGDKQRALEAALAQIDRAFGKGSVMKLGEKGKVEIESVSTGSLGLDIALGIGGLPKGRIVEVYGPESSGKTTLALHVVAEVQKAGGTAAFVDAEHALDPSYAYKLGVNLDNLLVSQPDNGEQALEITDTLVRSGAVDIVVVDSVAALTPKAEIEGEMGDSLPGLQARLMSQALRKLTASINKANTIVIFINQIRHKIGVMYGSPETTTGGNALKFYASVRLDIRRTGSVKARDEIVGNNVRVKVVKNKVAPPFREVEFDIMYGEGISKLGEVIDLGVKAGIIDKAGSWFSYGSQRIGQGRDNVREFLKNNPDVAADIEKAVRKSSQKIEEELLVGGPEEGEED

SEQ ID NO: 2770 - DNA, 1199 bp, Thermotoga maritima
  CDS (67)..(1137)
ttaactccgacagtcccatctacaaagttctctacgaatgtcagtttgaaggaggattgatcaggtatgcctgaggaaaaacagaaaaagagtgtcctggagaaagcgttgaagagaatagaagaaaactttggaaagggttccataatgatcctgggtgatgaaacccaggttcagcctgtagaggtgataccaacagggtccctcgccatcgatatcgcaacgggtgttggaggatatccaagaggaaggatcgtggaaatctttggtcaggaatcgagtggaaaaactacccttgcactccacgccatagcagaggcccagaagatgggaggagtggctgctttcatagacgcagaacacgcactggaccctgtttacgcgaaaaaccttggagtggatctgaagagtcttctcatctctcagcctgatcatggagagcaagcactcgaaatagtggatgaactcgtaagaagtggtgtggttgacctcatagttgttgattccgttgcggctctcgttcccagagcggaaatagaaggtgccatgggagacatgcaggtgggtcttcaggcacgtctcatgtcgcaggcactgagaaagatcgcgggaagtgtgaacaaatcaaaggcggtagtgatattcacgaaccagatcagaatgaagataggtgttatgtttgggagcccggaaaccacaaccggtggactcgccttgaaattctacgcaaccatgaggatggaagtcaggaggggtgaacctataaaggaaggaaaagatgtgataggcaacgtgataagtgtaaagatcgtgaagaacaaggttgctcctccgttcaaaaccgcacagacgtacatcatatacggaaaaggaatcgatagagagtacgagctgttcaatatcgctgtaaatgaagggatagtagacagaaaaggtagctggtattactacaccactctcaaaggtgaggaagtttctcttgggcagggaagctcgaacgccgttcagtttctcaaagacaaccctgaaatagcaggagagatcgaaaggagaataagagaaaaatatggattactatcagtggagaaagaagaacagaggaaagaaaagaaatcttcaggcgaagaagcctcttaattatgcgttgaggctcctcaaatatcgagtcagatttgaagacgaacttcgcgaacgattga

SEQ ID NO: 2771 - protein, 356 aa, Thermotoga maritima
MPEEKQKKSVLEKALKRIEENFGKGSIMILGDETQVQPVEVIPTGSLAIDIATGVGGYPRGRIVEIFGQESSGKTTLALHAIAEAQKMGGVAAFIDAEHALDPVYAKNLGVDLKSLLISQPDHGEQALEIVDELVRSGVVDLIVVDSVAALVPRAEIEGAMGDMQVGLQARLMSQALRKIAGSVNKSKAVVIFTNQIRMKIGVMFGSPETTTGGLALKFYATMRMEVRRGEPIKEGKDVIGNVISVKIVKNKVAPPFKTAQTYIIYGKGIDREYELFNIAVNEGIVDRKGSWYYYTTLKGEEVSLGQGSSNAVQFLKDNPEIAGEIERRIREKYGLLSVEKEEQRKEKKSSGEEAS

SEQ ID NO: 2772 - DNA, 1662 bp, Arabidopsis thaliana (mouse-ear cress)
  CDS (368)..(1498)
gaaacccaaaaaaaatagttgaaacggagggaaacgaaaacctaaaaccctaaaaaactcttccttttttttttccagtgaaatttctcttcttctccgttttcatacaagtctgacttctgggtagttggaattttccagtttttggtttgtttctgtatctgtggtttaaaaaagtggagaagaagctttttagtgcttttctatggcgaggattctccgaaacgtttattcactgagaagctctctgttttcgtcagagttacttagaagaagtgtggttggaacatcgtttcagctccgaggctttgctgccaaagctaaaaagaaatccaagtcagatggaaatggatcatctgaagaaggtatgtcgaaaaaggagattgctcttcagcaagcacttgatcagattaccagttcatttggcaaagggtccataatgtatctcggtcgtgctgtttctcctagaaatgtcccggttttctctaccggatcttttgcccttgatgtagctttgggagttggtggccttcctaaggggcgtgttgtggagatatatggtcctgaagcatcgggaaagacaacacttgctcttcatgttattgcagaagcacaaaaacaaggaggaacctgtgtctttgtagatgctgagcatgctcttgattcgtcacttgctaaggcaatcggtgtaaatacagaaaatctgcttctatcacagcctgattgtggcgaacaggcccttagtcttgtggatactttaatccgaagtggttcagttgatgttattgtagttgacagtgtggctgctcttgtacctaaaggagaacttgagggcgagatgggtgatgcacatatggctatgcaagccagattgatgagccaagctttgcgtaaattgagccattctttatcgttatcgcaaacacttctgatctttataaatcaggtgagatcaaaactatctacgtttggaggatttggaggtccaacagaagttacttgtggtggaaatgctttgaagttttatgcttctatgcgtttgaatatcaagcgaattggacttatcaagaaaggcgaagagacaacgggaagtcaagtctccgtgaagatagtgaagaacaaactcgctccgccgtttagaactgctcagtttgagcttgaattcggcaaaggaatctgcaagatcacggagataatcgacctgagcataaagcacaagttcatcgcgaaaaacggaacattctacaatctcaacggtaaaaactaccatggaaaagaggctttaaagagattccttaaacagaacgaatctgatcaagaagagctcatgaagaagctccaagacaagctcatcgccgatgaagctgcagataaggaaactgaatctgaatctgaggaagaagattccctgagagttgtggtttcacctgacaacacagatgatgaatcaccagctcttgttgttggagctgctgcagtggttgttgaggcagcatgattagcgacctccggtttagtataatattcttcctttggcctagagttttccggtttaacgcggtttggattcggtttccttctcctcatgtaatttatgtgctagttaaatcacatttacatataaccgttgttgtgggtgagaaaattttgtagtttttatgg

SEQ ID NO: 2773 - protein, 376 aa, Arabidopsis thaliana (mouse-ear cress)
MSKKEIALQQALDQITSSFGKGSIMYLGRAVSPRNVPVFSTGSFALDVALGVGGLPKGRVVEIYGPEASGKTTLALHVIAEAQKQGGTCVFVDAEHALDSSLAKAIGVNTENLLLSQPDCGEQALSLVDTLIRSGSVDVIVVDSVAALVPKGELEGEMGDAHMAMQARLMSQALRKLSHSLSLSQTLLIFINQVRSKLSTFGGFGGPTEVTCGGNALKFYASMRLNIKRIGLIKKGEETTGSQVSVKIVKNKLAPPFRTAQFELEFGKGICKITEIIDLSIKHKFIAKNGTFYNLNGKNYHGKEALKRFLKQNESDQEELMKKLQDKLIADEAADKETESESEEEDSLRVVVSPDNTDDESPALVVGAAAVVVEAA

SEQ ID NO: 2774 - DNA, 1038 bp, Aquifex aeolicus
  CDS (1)..(1038)
atgtccgagaacttatctgagaagaagaaggctttagaagttgcactttcaaacatcgaaaaacgtttcggtaaaggggcagttatgcccctcaaatccgttgaaaaggttcaggtagaaacaatacccaccggatcactggctctcgacatagcaacgggagtgggaggaatcccgaagggaagaattacggaaatcttcggcgttgagagttcaggaaagactacactagccctccatgtcatagcggaagcccaaaagaggggaggagttgcggtattcatagacgcggaacacgcccttgatccgaagtacgccaaaaaacttggagttgacgttgaaaacttgtacatctcacaaccagactatggtgaacaggctctggaaatagcagaaagcttaataaacagtggtgcggtggacgtaatagttgtagactcggttgcagctcttgttccgaaagacgaactcgaaggagaaatgggtgaagcacaggtcggaaaacaggcaaggcttatgtctcaggctctcagaaagctaaaaggagctgttcacaaaagcaatactgcattaatatttatcaaccaaataagagaaaaaataggtgtaatgtttggaaaccctgagacaacacccggaggaagggcactaaagttcttctcagatatgagacttgaagtaaggagactgggagacgtaaaagaaggcggagaaaaaaagggctacagggtaaaagtgagagtagttaaaaacaaacttgcaccgcctttccaggaagcggagtttgacataatctacggtgaaggtatatgtaaactatgtgatctgatagaagttgcaactaatttgggaatttttacaaagagcggttcctggtacagttacggtgataagagacttggtcaaggcaaggagcaagtgaaaaagtaccttcaagaacaccccgaattaattgatgaaatagatcaaaaagtaagggaggctgcaggacttgctggatcaaatattgaggaaagcactggagaagaaggcaagtga

SEQ ID NO: 2775 - protein, 345 aa, Aquifex aeolicus
MSENLSEKKKALEVALSNIEKRFGKGAVMPLKSVEKVQVETIPTGSLALDIATGVGGIPKGRITEIFGVESSGKTTLALHVIAEAQKRGGVAVFIDAEHALDPKYAKKLGVDVENLYISQPDYGEQALEIAESLINSGAVDVIVVDSVAALVPKDELEGEMGEAQVGKQARLMSQALRKLKGAVHKSNTALIFINQIREKIGVMFGNPETTPGGRALKFFSDMRLEVRRLGDVKEGGEKKGYRVKVRVVKNKLAPPFQEAEFDIIYGEGICKLCDLIEVATNLGIFTKSGSWYSYGDKRLGQGKEQVKKYLQEHPELIDEIDQKVREAAGLAGSNIEESTGEEGK

SEQ ID NO: 2776 - DNA, 1062 bp, Chlamydophila pneumoniae, Chlamydia pneumoniae
  CDS (1)..(1062)
atgaatttacctgatagaaaaaaggctctagaagctgctgttgcttatattgaaaagcaattcggcgctgggtccatcatgagtttaggaagacactctgccacacatgaaatctccaccatcaaaacaggagctttatctttagacttagctcttggaattcatggggtccccaaaggacgggtgatcgaaatctttggtcctgaatcctcagggaaaacgacactagctacccatattgtcgcgaatgctcaaaaaatgggcggtgttgctgcctatatagatgctgaacatgctttagatcctagttatgcatctcttattggcgtcaatatcgatgatcttatgatttctcaacccgactgtggtgaagatgcattaagcatagcagaattgctcgcgcgttcaggagctgtcgatgttatcgttattgactctgtagccgctttagttcctaaaagcgaactcgaaggagacatcggtgatgtacacgtaggcctacaagctcgtatgatgtctcaagcattacgcaagctcaccgctaccctatcacgtagccaaacctgtgcagtgttcattaaccaaatccgagagaaaatcggtgttagcttcggaaacccagaaactactacgggaggacgtgccttaaaattctactcttcaatacgattagatattcgccgtataggttcaataaaaggcagtgataactctgacatcggaaatcgaattaaagtgaaggtagctaaaaataaacttgctcctccattcagaatcgcagaatttgacatcctattcaatgaagggatttcttctgcaggttgtatcctagatcttgctgtcgaatataatattattgagaaaaaaggttcttggttcaactatcaagagaagaagttaggacagggaagagaatttgttcgtgaagaacttaaacgtaatagaaagctttttgaggaaattgagaagcgcatctacgatgtaattgcagcgaataaaactccctctgttcatgctaatgaaacacctcaggaagttcctgctcaaacagtagaagcttaa

SEQ ID NO: 2777 - protein, 353 aa, Chlamydophila pneumoniae, Chlamydia pneumoniae
MNLPDRKKALEAAVAYIEKQFGAGSIMSLGRHSATHEISTIKTGALSLDLALGIHGVPKGRVIEIFGPESSGKTTLATHIVANAQKMGGVAAYIDAEHALDPSYASLIGVNIDDLMISQPDCGEDALSIAELLARSGAVDVIVIDSVAALVPKSELEGDIGDVHVGLQARMMSQALRKLTATLSRSQTCAVFINQIREKIGVSFGNPETTTGGRALKFYSSIRLDIRRIGSIKGSDNSDIGNRIKVKVAKNKLAPPFRIAEFDILFNEGISSAGCILDLAVEYNIIEKKGSWFNYQEKKLGQGREFVREELKRNRKLFEEIEKRIYDVIAANKTPSVHANETPQEVPAQTVEA

SEQ ID NO: 2778 - DNA, 1047 bp, Neisseria meningitidis
  CDS (1)..(1047)
atgtcagacgacaaaagcaaagcacttgccgccgcactggcgcaaatcgaaaaaagtttcggcaaaggcgccatcatgaaaatggacggcagccagcaggaagaaaacctcgaagtcatttccaccggatcgctcggattagacctcgccctcggagtcggcggtctgccgcgcgggcgcatcgtcgaaatcttcggccccgaatcctccggcaaaaccaccctctgcctcgaagccgtcgcccaatgccagaaaaacggcggcgtgtgcgcctttgtcgatgccgaacacgcctttgatcccgtttacgcccgcaaactcggcgtaaaagtcgaagagctttacctgtcccagcccgataccggcgaacaggctttggaaatctgcgacacactcgtccgttcgggcggcatagatatggtagtcgtcgattccgtagccgcactcgtccccaaagccgaaatcgaaggcgatatgggggacagccatgtcggactgcaggcgcgcctgatgagccaggctttgcgcaaactgaccggacacatcaaaaaaaccaacacgctggttgtgttcatcaaccaaatccggatgaagatcggcgtaatgttcggcagccccgaaaccaccaccggcggcaacgcgctgaaattctattcttccgtccgcctcgacatccgccgcaccggatccatcaaaaaaggcgaagaggtattgggcaacgaaacccgcgtcaaagtcatcaaaaacaaagtcgcccccccgttccgtcaggcagagtttgacatcctctacggagaaggcatcagttgggaaggcgaattgatcgacatcggcgtgaaaaacgacatcatcaacaaatccggcgcgtggtacagctacaacggcgcgaaaatcggtcagggcaaagacaacgtccgcgtctggctgaaggaaaatcccgaagtcgccaatgaaatcgacgcaaaaatccgcgccctcaacggcgtagaaatgcacatcaccgaagggacgcaggacgaaaccgacggcgaacgccccgaagaataa

SEQ ID NO: 2779 - protein, 348 aa, Neisseria meningitidis
MSDDKSKALAAALAQIEKSFGKGAIMKMDGSQQEENLEVISTGSLGLDLALGVGGLPRGRIVEIFGPESSGKTTLCLEAVAQCQKNGGVCAFVDAEHAFDPVYARKLGVKVEELYLSQPDTGEQALEICDTLVRSGGIDMVVVDSVAALVPKAEIEGDMGDSHVGLQARLMSQALRKLTGHIKKTNTLVVFINQIRMKIGVMFGSPETTTGGNALKFYSSVRLDIRRTGSIKKGEEVLGNETRVKVIKNKVAPPFRQAEFDILYGEGISWEGELIDIGVKNDIINKSGAWYSYNGAKIGQGKDNVRVWLKENPEVANEIDAKIRALNGVEMHITEGTQDETDGERPEE

SEQ ID NO: 2780 - DNA, 1032 bp, Campylobacter jejuni
  CDS (1)..(1032)
atggatgataataaaagaaaatctctagacgctgccctaaaaagtttagataaaacctttggaaaaggcactattttaagactaggggataaagaagtcgagcaaatcgatagcataggcacaggttcagttgggcttgatcttgctttaggtataggcggtgttccaaaaggaagaattatagaaatttatggacctgaaagttcaggtaaaaccactctaactttacatattatcgcagaatgccaaaaagcaggtggagtttgtgcttttatcgatgcagaacatgcgcttgatgtaaaatatgctaaaaatttgggtgtaaatacagatgatttgtatgtttctcagcctgattttggagaacaagccttagaaattgtagaaactatagcaagaagtggcgcagtagatcttatcgtagtagatagcgttgcagcacttactccaaaagcagaaattgaaggcgatatgggcgatcaacatgtaggacttcaagcaagacttatgtctcaagctctaagaaaacttacaggtatagttcataaaatgaataccacagtaatttttatcaaccaaattcgtatgaaaatcggtgctatgggttatggtactcctgaaaccacaacaggtggaaatgcattaaaattttatgcttctgtgcgtttagatgttagaaaagtagcaaccttaaaacaaaacgaagaacctataggaaaccgcgttaaagtaaaagtagttaaaaataaagttgctcctccattcagacaagctgaatttgatgtgatgtttggagagggtttaagccgtgaaggtgaattgatcgattatggtgtaaaacttgatatcgtagataaaagtggtgcgtggttttcttataaagataaaaaacttggacaaggtagagaaaattcaaaagctttcttaaaagaaaaccctgaaattgcagatgaaatcacaaaagcaattcaaaattctatgggaatagaaggtatgatcagcggtagcgaagatgacgaaggagaagaataa

SEQ ID NO: 2781 - protein, 343 aa, Campylobacter jejuni
MDDNKRKSLDAALKSLDKTFGKGTILRLGDKEVEQIDSIGTGSVGLDLALGIGGVPKGRIIEIYGPESSGKTTLTLHIIAECQKAGGVCAFIDAEHALDVKYAKNLGVNTDDLYVSQPDFGEQALEIVETIARSGAVDLIVVDSVAALTPKAEIEGDMGDQHVGLQARLMSQALRKLTGIVHKMNTTVIFINQIRMKIGAMGYGTPETTTGGNALKFYASVRLDVRKVATLKQNEEPIGNRVKVKVVKNKVAPPFRQAEFDVMFGEGLSREGELIDYGVKLDIVDKSGAWFSYKDKKLGQGRENSKAFLKENPEIADEITKAIQNSMGIEGMISGSEDDEGEE

SEQ ID NO: 2782 - DNA, 1065 bp, Chlamydia muridarum, Chlamydia trachomatis MoPn
  CDS (1)..(1065)
atgagcgttcccgacagaaaaagggctttggaagctgccattgcttacatcgagaagcaatttggcgcaggatctatcatgagtttagggaagcattcttctgctcatgagatatcaactattaaaactggcgcattgtcgttagatttagctctgggaataggaggagttcctaaaggaagaattatagagatttttggcccagagtcttcagggaaaacgactctagcaacgcatatcgtggctaatgcccaaaaaatggggggtgtggcagcttatattgatgctgagcacgccttagatcctaattatgctgcgctaattggtgctaatattaatgatttaatgatctcccagcccgattgtggagaggatgctttgagtattgcagagcttctggctcgatcgggagctgttgatgtcatcgttatcgattcggtggcagccttggttccaaagagcgaattggaaggagaaattggagatgtgcatgtgggtttacaagcacgcatgatgtctcaggctttacgaaaattaacggcgacgttggcacgaacgaacacttgtgcgatttttattaaccaaattcgagagaagataggtgttagcttcgggaatcctgagaccacaacaggggggcgggcacttaaattttactcttctattcgtatggatattcgtcgtatcggtgctatcaaaggaggcgaaaacttcgatataggaaaccgaattaaggtgaaggtcgcaaaaaataaattagctcctccatttcgaactgctgaatttgatattttgttcaatgaagggatttcttctgcgggatgcattattgaccttgctgtagaaaaaaacattattgataagaaaggatcttggttcaattaccaagatcgtaagttgggtcaaggccgagaggctgtgcgcgaagagctgaaaaggaataaagagttattccaagagttagagcgccgtatttatgagtctgtacaagcttcctcatcacaggcgctagcatctgcttgcttggaccaggaggctcgagaagtagcagaagcagcgaaataa

SEQ ID NO: 2783 - protein, 354 aa, Chlamydia muridarum, Chlamydia trachomatis MoPn
MSVPDRKRALEAAIAYIEKQFGAGSIMSLGKHSSAHEISTIKTGALSLDLALGIGGVPKGRIIEIFGPESSGKTTLATHIVANAQKMGGVAAYIDAEHALDPNYAALIGANINDLMISQPDCGEDALSIAELLARSGAVDVIVIDSVAALVPKSELEGEIGDVHVGLQARMMSQALRKLTATLARTNTCAIFINQIREKIGVSFGNPETTTGGRALKFYSSIRMDIRRIGAIKGGENFDIGNRIKVKVAKNKLAPPFRTAEFDILFNEGISSAGCIIDLAVEKNIIDKKGSWFNYQDRKLGQGREAVREELKRNKELFQELERRIYESVQASSSQALASACLDQEAREVAEAAK

SEQ ID NO: 2784 - DNA, 1050 bp, Bacillus halodurans
  CDS (1)..(1050)
atgagtgatcgtaaagcagcgttggacatggcgttacgacaaattgaaaagcaattcggaaaaggctcgatcatgaagctgggagaacaagcagaacaacgtgtatctaccatttccagcggtgctcttgcccttgacatcgcccttggtgttggcggataccctcgtggaagagttattgaagtgtatggtccagaatcatctggtaaaacgaccgttgccctccatgcgattgcagaggtgcaaagaaatggtggtcaagctgcgtttattgatgcggaacatgcccttgatccggtttatgcgaaaaagctaggtgtaaacattgatgagcttttattgtcacagcctgataccggagaacaagcgttggaaatcgctgaagcgttagttcgcagcggggccattgacgtcattgtcatcgacagtgtggcagctcttgtaccgaaagcggaaatagaaggggagatgggtgacagccatgttggcttgcaagcacgcctaatgtctcaagcgcttcggaagctttcaggtgcgatcaataagtcaaaaacaattgcgattttcattaaccaaattcgtgaaaaagttggtgttatgttcggaaacccggaaacgacaccggggggaagagcgcttaagttctattcctctgttcgtctcgaagtgcgccgtgcagagacgttaaagcaaggaaacgatatggtcggtaacaagacgaaaattaaagtcgtgaaaaacaaagtggctcctccgtttaaacaagcggaagtggatattatgtacggtgaagggatttcccgtgaaggctcgattttagatattgcttctgagcttgatattgtgcaaaaaagcggagcttggtattccttcaatgacgagcgtctcggtcaagggcgcgagaatgcgaaacaatttttaaaggaaaaccctgaagctgcggaggaaattgaaagccgaattcgcgagcattacggtttgaacggagagattgaggtggaggctccatcggaagaggagtttgaagatctcccactcgatttgaaataa

SEQ ID NO: 2785 - protein, 349 aa, Bacillus halodurans
MSDRKAALDMALRQIEKQFGKGSIMKLGEQAEQRVSTISSGALALDIALGVGGYPRGRVIEVYGPESSGKTTVALHAIAEVQRNGGQAAFIDAEHALDPVYAKKLGVNIDELLLSQPDTGEQALEIAEALVRSGAIDVIVIDSVAALVPKAEIEGEMGDSHVGLQARLMSQALRKLSGAINKSKTIAIFINQIREKVGVMFGNPETTPGGRALKFYSSVRLEVRRAETLKQGNDMVGNKTKIKVVKNKVAPPFKQAEVDIMYGEGISREGSILDIASELDIVQKSGAWYSFNDERLGQGRENAKQFLKENPEAAEEIESRIREHYGLNGEIEVEAPSEEEFEDLPLDLK

SEQ ID NO: 2786 - DNA, 1229 bp, Streptococcus pneumoniae
  CDS (26)..(1192)
gatcattagaatgtaggagaatagaatggcgaaaaaaccaaaaaaattagaagaaatttcaaaaaaatttggggcagaacgtgaaaaggccttgaatgacgctcttaaattgattgagaaagactttggtaaaggatcaatcatgcgtttgggtgaacgtgcggagcaaaaggtgcaagtgatgagctcaggttctttagctcttgacattgcccttggctcaggtggttatcctaagggacgtatcatcgaaatctatggcccagagtcatctggtaagacaacggttgcccttcatgcagttgcacaagcgcaaaaagaaggtgggattgctgcctttatcgatgcggaacatgcccttgatccagcttatgctgcggcccttggtgtcaatattgacgaattgctcttgtctcaaccagactcaggagagcaaggtcttgagattgcgggaaaattgattgactcaggtgcagttgatcttgtcgtagtcgactcagttgctgcccttgttcctcgtgcggaaattgatggagatatcggagatagccatgttggtttgcaggctcgtatgatgagccaggccatgcgtaaacttggcgcctctatcaataaaaccaaaacaattgccatttttatcaaccaattgcgtgaaaaagttggagtgatgtttggaaatccagaaacaacaccgggcggacgtgctttgaaattctatgcttcagtccgcttggatgttcgtggtaatacacaaattaagggaactggtgatcaaaaagaaaccaatgtcggtaaagaaactaagattaaggttgtaaaaaataaggtagctccaccgtttaaggaagccgtagttgaaattatgtacggagaaggaatttctaagactggtgagcttttgaagattgcaagcgatttggatattatcaaaaaagcaggggcttggtattcttacaaagatgaaaaaattgggcaaggttctgagaatgctaagaaatacttggcagagcacccagaaatctttgatgaaattgataagcaagtccgttctaaatttggcttgattgatggagaagaagtttcagaacaagatactgaaaacaaaaaagatgagccaaagaaagaagaagcagtgaatgaagaagttccgcttgacttaggcgatgaacttgaaatcgaaattgaagaataagctgttaaagcagtggagaaatccgctactttttcga

SEQ ID NO: 2787 - protein, 388 aa, Streptococcus pneumoniae
MAKKPKKLEEISKKFGAEREKALNDALKLIEKDFGKGSIMRLGERAEQKVQVMSSGSLALDIALGSGGYPKGRIIEIYGPESSGKTTVALHAVAQAQKEGGIAAFIDAEHALDPAYAAALGVNIDELLLSQPDSGEQGLEIAGKLIDSGAVDLVVVDSVAALVPRAEIDGDIGDSHVGLQARMMSQAMRKLGASINKTKTIAIFINQLREKVGVMFGNPETTPGGRALKFYASVRLDVRGNTQIKGTGDQKETNVGKETKIKVVKNKVAPPFKEAVVEIMYGEGISKTGELLKIASDLDIIKKAGAWYSYKDEKIGQGSENAKKYLAEHPEIFDEIDKQVRSKFGLIDGEEVSEQDTENKKDEPKKEEAVNEEVPLDLGDELEIEIEE

SEQ ID NO: 2788 - DNA, 1251 bp, Agrobacterium tumefaciens
  CDS (1)..(1251)
atgggccgggcacggaaaaacgaaagcagaacaaactacttatcgttatttgttttcaatatgctggctcagccttgcgaaatgagaacaaatagagtacataccgtttccatactgcttcgttgcctgtgcggcttcaataacctaaaggtggttcggatggcacaaaattctttgcgtctcgtagaggataaatcggtggataaaagcaaggcactggaagcggcgctctcccagatcgaacggtcgttcggcaagggatcgatcatgaagctcggttccaatgaaaatgtggttgaagtggaaaccgtttcgacgggctcgctcagcctggatatcgcgctcggcatcggcggcttgccgaaggggcgtatcattgagatttacggcccggaaagctccggtaaaacgacgctggcgctgcagacgatcgcggaagcccagaagaagggcggcatctgcgccttcgtggacgccgaacacgcgctcgatccggtttatgcccgcaagctcggtgtggatttgcagagccttctgatctcgcagcccgataccggcgagcaggcgcttgagatcaccgatacgctggtgcgttcgggcgctgtggacgttcttgtcatcgattcggttgcggccttgacgccgcgggcggaaatcgaaggtgaaatgggcgatagcctgccgggtcttcaggcccgtctgatgagccaggcgctgcgcaagctgaccgcctcgatctccaagtcgaagtgcatggtgatcttcatcaaccagattcgcatgaagatcggcgtcatgtttggttcgccggaaacgacgacgggcggtaacgctctcaagttctatgcgtccgtccgcctcgacatccgccgtatcggcgccgtcaaggagcgcgaagaggttgtcggcaaccagacgcgcgtcaaggtcgtcaagaacaagatggcgccgcccttcaaacaggttgaattcgacatcatgtatggcgaaggtgtttccaagaccggtgagctggtcgatctcggcgtgaaggccggtatcgtcgagaagtccggcgcatggttctcctataacagccagcgtctggggcaggggcgtgaaaacgccaagacctttctgcgcgacaatccggatacggccaatgagatcgaactggcgttgcgccagaatgccggtctgattgccgaccgcttcctgcagaatggtggcccggacgccggtgaaggcgacgacggcagcgacgagggctga

SEQ ID NO: 2789 - protein, 416 aa, Agrobacterium tumefaciens
MGRARKNESRTNYLSLFVFNMLAQPCEMRTNRVHTVSILLRCLCGFNNLKVVRMAQNSLRLVEDKSVDKSKALEAALSQIERSFGKGSIMKLGSNENVVEVETVSTGSLSLDIALGIGGLPKGRIIEIYGPESSGKTTLALQTIAEAQKKGGICAFVDAEHALDPVYARKLGVDLQSLLISQPDTGEQALEITDTLVRSGAVDVLVIDSVAALTPRAEIEGEMGDSLPGLQARLMSQALRKLTASISKSKCMVIFINQIRMKIGVMFGSPETTTGGNALKFYASVRLDIRRIGAVKEREEVVGNQTRVKVVKNKMAPPFKQVEFDIMYGEGVSKTGELVDLGVKAGIVEKSGAWFSYNSQRLGQGRENAKTFLRDNPDTANEIELALRQNAGLIADRFLQNGGPDAGEGDDGSDEG

SEQ ID NO: 2790 - DNA, 1044 bp, Staphylococcus aureus
  CDS (1)..(1044)
atggataacgatcgtcaaaaagctttagatacagtaattaaaaatatggagaaatctttcggtaaaggtgccgtaatgaagttgggtgacaatataggtcgccgagtttcaactacatcaactggttcagttacattagataatgcgctaggtgtaggtggctatcctaaaggacgaattattgaaatttatggtcctgaaagttctggtaagacaacagtagcgcttcacgctattgctgaagtacaaagtaatggcggggtggcagcatttatcgatgctgaacatgctttagatccagaatatgctcaagcattaggcgtagatatcgataatttatatttatcgcaaccggatcatggtgaacaaggtcttgaaatcgccgaagcatttgttagaagtggtgcagttgatattgtagttgtagactcagttgctgctttaacacctaaagctgaaattgaaggagaaatgggagacactcacgttggtttacaagctcgtttaatgtcacaagcgttacgtaaactttcaggtgctatttctaaatcaaatacaactgctattttcatcaaccaaattcgtgaaaaagttggtgttatgttcggtaatccagagactacaccaggtggacgtgcattaaaattctatagttcagtaagactagaagtacgtcgtgcagaacagcttaaacaaggacaagaaattgtaggtaatagaactaaaattaaagtcgttaaaaataaagtggcaccaccatttagagtagctgaagttgacattatgtatggacaaggtatttctaaagagggtgaacttattgatttaggtgttgaaaacgacatcgttgataaatcaggagcatggtattcttacaatggcgaacgaatgggtcaaggtaaggaaaatgttaaaatgtacttgaaagaaaatccacaaattaaagaagaaattgatcgtaaattgagagaaaaattaggtatatctgatggtgatgttgaagaaacagaagatgcaccaaagtcattatttgacgaagaatag

SEQ ID NO: 2791 - protein, 347 aa, Staphylococcus aureus
MDNDRQKALDTVIKNMEKSFGKGAVMKLGDNIGRRVSTTSTGSVTLDNALGVGGYPKGRIIEIYGPESSGKTTVALHAIAEVQSNGGVAAFIDAEHALDPEYAQALGVDIDNLYLSQPDHGEQGLEIAEAFVRSGAVDIVVVDSVAALTPKAEIEGEMGDTHVGLQARLMSQALRKLSGAISKSNTTAIFINQIREKVGVMFGNPETTPGGRALKFYSSVRLEVRRAEQLKQGQEIVGNRTKIKVVKNKVAPPFRVAEVDIMYGQGISKEGELIDLGVENDIVDKSGAWYSYNGERMGQGKENVKMYLKENPQIKEEIDRKLREKLGISDGDVEETEDAPKSLFDEE

SEQ ID NO: 2792 - DNA, 1506 bp, Acinetobacter calcoaceticus
  CDS (403)..(1452)
aaagaaaaactgttgttgtaaaagcattatctaatatgcggggacctgcacctatagcacaacagctctatgatgaaactgaagttagtattgcaaaaagagagttgattgcttcgcaaagaaaattgcataatttagcccgaccagatcatcgtccttctaaaaaagatcgacgacagattcatcggtttaaacaagaaaatgatcagaattttgagcagtcgtggtcatataatgatgattaaattttttgaattatgcgcgtcatgttatgtcgtagtgacataatattgacatagaatagtgaaaataaatctgtcactatacttcggtggaacaaggttgaaattcaatacatccactttgaatgaaaaagtgatattacagttttgaggttgtaagatggatgataataaaagcaaggcattacaagctgctttaagtcagattgaaaaacaatttggcaaaaatacagtaatgcgtttaggtgataataccgttcaagctgttgaagccgtttcgacaggctctcttactctagatattgcattaggtattggtggcttacctaaagggcgtattgtagagatttacggtcctgaatcttctggtaaaacaaccatgactttgcaagcaattgcacaatgtcagaaagcaggtggtacctgtgcttttattgatgcagaacatgcattagaccctcagtatgcccgtaagctgggtgtagacatagacaatcttttggtatcgcagcctgatcatggtgaacaagctctggaaattgcagatatgcttgtacgctctggtgcgattgatctgattgtagtcgactctgtagcagcattaaccccaaaagccgaaattgaaggtgaaatgggcgactcccacatgggtttacaagcccgcttaatgagtcaagccttacgtaaaatcacgggtaatgctaaacgttcgaattgcatggtaatcttcattaaccagattcgtatgaaaattggcgtaatgtttggcagcccagaaaccacaactggtggtaatgcactaaaattctatgcatctgtacgtctagatatacgccgtattggtcaagttaaagaaggtgatgaaatcattggttctgaaaccaaagtcaaagtcgttaaaaataaaatggcccctcctttccgtgaagcaatcttccaaattttatatggcaagggtgtcaatcaacttggcgaattggttgatcttgcagttcaacaaaatattgtacaaaaagctggtgcttggtattcataccaaggcaataaaattggtcagggtaagaataacgtgattcgttatcttgaagagaaccctcagatttctacagaaattgaagcggttatccgtgaacaattattgactaaggcatcagatcagaccgctgctcacgatgaaactgaagaagaaccagatttactggaaagttaatctaagcatccaattaaagcccaaatgcgttttttcatttgaactatcagaaca

SEQ ID NO: 2793 - protein, 349 aa, Acinetobacter calcoaceticus
MDDNKSKALQAALSQIEKQFGKNTVMRLGDNTVQAVEAVSTGSLTLDIALGIGGLPKGRIVEIYGPESSGKTTMTLQAIAQCQKAGGTCAFIDAEHALDPQYARKLGVDIDNLLVSQPDHGEQALEIADMLVRSGAIDLIVVDSVAALTPKAEIEGEMGDSHMGLQARLMSQALRKITGNAKRSNCMVIFINQIRMKIGVMFGSPETTTGGNALKFYASVRLDIRRIGQVKEGDEIIGSETKVKVVKNKMAPPFREAIFQILYGKGVNQLGELVDLAVQQNIVQKAGAWYSYQGNKIGQGKNNVIRYLEENPQISTEIEAVIREQLLTKASDQTAAHDETEEEPDLLES

SEQ ID NO: 2794 - DNA, 1479 bp, Brucella abortus
  CDS (316)..(1398)
ggttcctgttttaacggattgaatgctctattgcgaaacatccaatgccaatatggcagcgcagccctcttatatcgggcagcgccttttttcttgccgaatcgataatgccggatttcgtgcagattgcagaagttcgtggatagttccattattttcggaattgctgatattagggaacaagaatggaacaaaattgcgaaatatatattaatcaatatgttatccctgtcgccaaataagaacaaaacagatacaaatagtttgtggcaacgagcctgccgggcttctagcgagacaagaggatggtgtaagatgtctcaaaattcattgcgacttgttgaggataattcagtggacaagacaaaagctctcgacgcggcattgtcgcaaatcgaacgggcgttcggcaaaggctcaatcatgcgtctgggccagaacgatcaggtggtcgaaatcgaaaccgtatcgaccggctcgctctcgctcgatattgccttgggggttggcggcttgcccaagggacgtatcgtggaaatctatgggccggaaagttccggtaaaaccacgcttgccttgcacaccatcgctgaagcgcagaagaagggcggcatctgcgcattcgtcgatgcggaacatgcgcttgacccggtctatgcgcgcaagctcggtgtacatcttgaaaatcttctgatctcgcagccgataacgggtgaacaggcgcttgaaatcaccgatacgctcgtccgctctggcgccatcgacgttctcgttgtcgactcggtcgcagccctgacgccgcgtgctgaaatcgaaggtgaaatgggggattcccatggccttcaggcccgtctcatgagccaggccgtgcgcaagcttactggctccatttcccgttcaaactgcatggtgatcttcatcaaccagatccgcatgaagatcggtgtcatgttcggctcgccggaaacgacaacgggcggcaatgcgctcaagttctatgcttcggttcgcctcgatattcgccgtatcggctccatcaaggagcgcgacgaagtggtgggcaaccagacccgcgtgaaggtggtgaagaacaagctcgctcctccgttcaagcaggtcgaattcgatatcatgtatggcgcgggcgtttccaaggtgggcgagctggtcgatcttggtgtcaaggccggtgtggttgagaagtctggtgcctggttctcctataattcccagcgtctcgggcaggggcgcgagaacgccaagcaatatctcaaggataatccggaagtcgcgcgtgaaatcgaaaccacgcttcgccagaatgccggcctgatcgccgagcagttccttgacgatggcggaccggaagaagatgctgccggcgcggcggaaatgtaaggcgctgttcatgtgtgaattttcaaggcctcgtgcacttcgcgcggggctttgtttttattctgacaggcagaaattgct

SEQ ID NO: 2795 - protein, 360 aa, Brucella abortus
MSQNSLRLVEDNSVDKTKALDAALSQIERAFGKGSIMRLGQNDQVVEIETVSTGSLSLDIALGVGGLPKGRIVEIYGPESSGKTTLALHTIAEAQKKGGICAFVDAEHALDPVYARKLGVHLENLLISQPITGEQALEITDTLVRSGAIDVLVVDSVAALTPRAEIEGEMGDSHGLQARLMSQAVRKLTGSISRSNCMVIFINQIRMKIGVMFGSPETTTGGNALKFYASVRLDIRRIGSIKERDEVVGNQTRVKVVKNKLAPPFKQVEFDIMYGAGVSKVGELVDLGVKAGVVEKSGAWFSYNSQRLGQGRENAKQYLKDNPEVAREIETTLRQNAGLIAEQFLDDGGPEEDAAGAAEM

SEQ ID NO: 2796 - DNA, 981 bp, Streptococcus pyogenes
  CDS (1)..(981)
atgcgttcaggaagtctagctcttgatattgcttggatagctggtggttatcctaaaggacgtatcatcgaaatctatggtccagagtcttccggtaaaacgactgtggctttacatgctgtagcacaagctcaaaaagaaggtggaatcgcagcctttatcgatgccgagcatgcgcttgatccagcttatgctgctgcgcttggggttaatattgatgaacttctcttgtctcaaccagattctggagaacaaggacttgaaattgcaggtaaattgattgattctggtgcggttgacctggttgttgtcgattcagtagcagctttagtgccacgtgctgaaattgatggtgatattggcgatagccatgtcggattgcaagcacgtatgatgagtcaggccatgcgtaaattatcagcttctattaataaaacaaaaactatcgcaatctttatcaaccaattgcgtgaaaaagttggtgtgatgtttggaaatcctgaaacaacaccaggtggtcgagctttgaaattctatgcttctgttcggctggatgtgcgtggaaacaaccaaattaaaggaactggtgaccaaaagatagccagcattggtaaggagaccaaaatcaaggttgttaaaaacaaggtcgctccgccatttaaggtagcagaagttgaaatcatgtatggggaaggtatttctcgtacaggggagcttgtgaaaattgcttctgatttggacattatccaaaaagcaggtgcttggttctcttataatggtgagaagattggccaaggttctgaaaatgctaagcgttatttggccgatcatccacaattgtttgatgaaatcgaccgtaaagtacgtgttaaatttggtttgcttgaagaaagcgaagaagaatctgctatggcagtagcatcagaagaaaccgatgatcttgctttagatttagataatggtattgaaattgaagattaa

SEQ ID NO: 2797 - protein, 326 aa, Streptococcus pyogenes
MRSGSLALDIAWIAGGYPKGRIIEIYGPESSGKTTVALHAVAQAQKEGGIAAFIDAEHALDPAYAAALGVNIDELLLSQPDSGEQGLEIAGKLIDSGAVDLVVVDSVAALVPRAEIDGDIGDSHVGLQARMMSQAMRKLSASINKTKTIAIFINQLREKVGVMFGNPETTPGGRALKFYASVRLDVRGNNQIKGTGDQKIASIGKETKIKVVKNKVAPPFKVAEVEIMYGEGISRTGELVKIASDLDIIQKAGAWFSYNGEKIGQGSENAKRYLADHPQLFDEIDRKVRVKFGLLEESEEESAMAVASEETDDLALDLDNGIEIED

SEQ ID NO: 2798 - DNA, 1349 bp, Leptospira biflexa
  CDS (107)..(1270)
gggttcatccttgagagagtcggttcataagagtttttttggaaccaactgacccagtcccctacctagtctttcggaacaccgattttaggagaacgtttgattcatgaaaaaagagaaagctgacaaggctcaagaaaaagaaaccgaccaaagaaagcaggcaattgatgcagcgctcggccaaatcgaaaaacaattcggtaagggttccatcatgcgccttggtgccgatacacgtatggcagaaatgaacgttgtatccactggatctttggatttagacattgccttggggataggcgggtttccttccggtcgtatcgtagaaatctacggaccagaatcttctggtaaaacaacactcactctttctgcgattgcagaaacgcaaaaaaaaggaggcattgctgccttcattgatgcggaacatgctttagatccatcttatgctaaaaaattaggggtcaatgtagacgacctactggttgcccaaccagataatggggaagaggctctggaaatttgtgaatcactcgttcgttccaacgccatcgatctcatcgtcatcgactctgtagccgcacttgttcctaaggccgagatcgaaggagatatgggagattctcacatgggactccaagcgcgtctgatgtcccaagccctccgtaaactcacgggaaccatttcaaaatccaataccactgtcatcttcatcaaccaaatccgtatgaagattggggttatgtttggaagtcctgaaaccactactggtggaaacgcgttaaaattctatgcttccattcgattggacattcgtcgcatcgaaactctaaaagaaaaagaagaacctgttggtaaccgtgtgcgagtgaaagttgtaaaaaacaaatgcgctcctcctttccgacaagcagagtttgacatcatgtatgcgaacggaatcaacagagaaagttctctcattgatctagcggttcgccacgacctagttgcaaaagcaggttcttggtattcttacggtggagagaaaatcggacaaggaaaggaacaagtgaaaaacttttttctcgaaaatccagatatcgcatttaaaattgaaaaccaagttcgagatctcaatagcctcccactcatggaccaatccaaaatccaaaccagagaagtgaaatccattgaaagggaccctaaggaaactaaagaaacaaaatctaaacaacctgttagtttctctaccgaagcagaagtagatattgctgttggagaataaaaccattcggctttctttttaggaaccattgaccggttcggggtttcccgggccggtttttttttggtaaaactaaaaa

SEQ ID NO: 2799 - protein, 387 aa, Leptospira biflexa
MKKEKADKAQEKETDQRKQAIDAALGQIEKQFGKGSIMRLGADTRMAEMNVVSTGSLDLDIALGIGGFPSGRIVEIYGPESSGKTTLTLSAIAETQKKGGIAAFIDAEHALDPSYAKKLGVNVDDLLVAQPDNGEEALEICESLVRSNAIDLIVIDSVAALVPKAEIEGDMGDSHMGLQARLMSQALRKLTGTISKSNTTVIFINQIRMKIGVMFGSPETTTGGNALKFYASIRLDIRRIETLKEKEEPVGNRVRVKVVKNKCAPPFRQAEFDIMYANGINRESSLIDLAVRHDLVAKAGSWYSYGGEKIGQGKEQVKNFFLENPDIAFKIENQVRDLNSLPLMDQSKIQTREVKSIERDPKETKETKSKQPVSFSTEAEVDIAVGE

SEQ ID NO: 2800 - DNA, 1762 bp, Xanthomonas campestris pv. campestris
  CDS (159)..(1190)
atgcatgcgctggcgtttccgagccggtagcgcagaatttcccgtgccgccaccaggttggcctccctaatctaagtgtgtcgcaggcagtctcagtccgtgcgatacaccgccgctacattagccccataccgaaatcactgacgaggatcacccagatggatgagaacaagaagcgcgccctttccgccgccctgagccagatcgaaaagcaattcggcaaaggctcggtgatgcgcatgggcgaccgggtcatcgaggccgtcgaggtcatcccgaccggttcgctgatgctggacatcgcactggggatcggcggcctgccgaagggccgcgtggtcgagatctacgggccggaatcctcgggcaagaccaccctcaccctgcaggccattgccgaatgccagaagctgggcggcaccgcggccttcatcgacgccgagcatgcgctggacccgatctatgccgccaagctgggcgtcaatgtcgatgacctgctgctgtcgcagccggataccggtgagcaggcgctggaaatcgccgacatgctggtgcgttcgagctcggtggacatcgtggtgatcgactcggttgccgcgctgaccccaaaggccgaaatcgaaggcgagatgggcgatcagctgcccggcctgcaggcccgtttgatgagccaggcgctgcgcaagctcaccggcaacatcaagcgctccaacacgttggtggtcttcatcaaccagctgcgcatgaagatcggcgtgatgatgccgggccagagcccggaagtgaccaccggcggcaatgcgctgaagttctacgcctcggtccgcctggacatccgccgcatcggtgcgatcaagaagggtgacgagatcatcggcaaccagaccaagatcaaggtggtcaagaacaagctggcgcctccgttcaagcaggtcatcaccgagatcctgtacggcgaaggcatcagccgcgagggtgagctgatcgatatgggcgtggaagccaagctggtcgacaaggcaggtgcctggtacagctacggcgacgagcgcatcggccagggcaaggacaacgcccgtgggtatctgcgcgacaacccgcaggtggcgatcaagctcgaagccgagctgcgcgagaagttccagcccgccgaggcgccgcgtgaagccggcgagaccgagagcgagtgagttttccctatcgcggggacggcggagtcagtgccgtcgctcctcgcggtagttctatcgaaagccaggagggcggcgcacggacggcgcatttacttcgggacacgtcacgatgagtgagcaagcgccgcaccgaagcggacgtcgtcagacagacgcgtcacgtgcactggatactgtgcacgtgacatcaaagagtgacgcagtgcagcgcgtgcatcgagccgagcgcacaggcgcgtgagcggctgcaggcgaggctgcagacgatgtacgctttgcagcctcggtggtcgtaaccggccagttcggctatgggccgttgcacatccgcgcagaacttggaacccacggcctggatagcgacgcggtcagtgcagcgatggcaaccttcgaaggggactggaccgaaaacgcactcgatctgatacgtcgtcgtttcggcgaggatgggccggttgacttggcacagcggcgcaaggctgccgacctgctggcgcggcgcggcttcgatggcaacagcattcggctggcaacacgcttcgaccttgaggactgagggcgtcaggcct

SEQ ID NO: 2801 - protein, 343 aa, Xanthomonas campestris pv. campestris
MDENKKRALSAALSQIEKQFGKGSVMRMGDRVIEAVEVIPTGSLMLDIALGIGGLPKGRVVEIYGPESSGKTTLTLQAIAECQKLGGTAAFIDAEHALDPIYAAKLGVNVDDLLLSQPDTGEQALEIADMLVRSSSVDIVVIDSVAALTPKAEIEGEMGDQLPGLQARLMSQALRKLTGNIKRSNTLVVFINQLRMKIGVMMPGQSPEVTTGGNALKFYASVRLDIRRIGAIKKGDEIIGNQTKIKVVKNKLAPPFKQVITEILYGEGISREGELIDMGVEAKLVDKAGAWYSYGDERIGQGKDNARGYLRDNPQVAIKLEAELREKFQPAEAPREAGETESE

SEQ ID NO: 2802 - DNA, 1212 bp, Aeromonas salmonicida
  CDS (151)..(1212)
tgaccggcgtcaggtacgccagcaggcggtcagacaggccttgtccggactcttggccctgctcagataaattgggcttgatactgtatgaatagacagtatacttagcccaacttcacttattactcacgatttccagcggagattggcatggatcagaacaaacagaaggcactggcggctgcgctgggtcagattgaaaagcagttcggcaaaggctccatcatgcttctgggcgacagcaagaccatggatatcgaagccatctctaccggttccctctccctggacgtggcgctgggtatcggcggtctgccgtgcggccgtatcgtcgagatctatggcccggaatcttccggtaaaaccaccctcaccctgcaggtgattgcggaagcccagaagaaaggcaaggtctgtgcatttatcgatgcagagcatgccctcgaccccatctatgcagccaagctgggtgtcaacgtcgatgacctgctgatctcccagtcggataccggtgagcaggcgctggaaatctgcgacatgctggtgcgttccaacgccgttgacgtcatcatcgtcgactcggtggccgctctgacgccgaaagcagaaatcgaaggcgagatgggtgattcccacgtcggcctgcaggctcgtctgatgtcccaggcgctgcgcaagctgaccgccaacatcaagaacgccaactgcctctgtatcttcatcaaccaaatccggatgaagattggtgtcatgttcggcagcccggaaaccactaccggtggtaacgcgctcaagttctacgcctcagtacgtctggacatccgtcgcatcggcgccatcaaggaaggtgacgaagtggtcggtaacgagacccgcgtcaaggtggtcaagaacaaggttgcccctcccttcaagcaggctgaattccagattttctacggtgtcggtatttccaaggaaggtgagctggtggatctcggcgtcaagcacaagctgatcgacaaggccggtgcctggtacagctataacggcgagaagataggtcagggcaaggccaacgtgatgaagctgttcaccgagaacaaggtgatggcggccgaggtggaagccagactgcgtgagttgctgctctccggcgatgtgccggccgagaagccggtcgtggcggatgccgacgagctcgaagccgaaagcgaacaagagttcgaataa

SEQ ID NO: 2803 - protein, 353 aa, Aeromonas salmonicida
MDQNKQKALAAALGQIEKQFGKGSIMLLGDSKTMDIEAISTGSLSLDVALGIGGLPCGRIVEIYGPESSGKTTLTLQVIAEAQKKGKVCAFIDAEHALDPIYAAKLGVNVDDLLISQSDTGEQALEICDMLVRSNAVDVIIVDSVAALTPKAEIEGEMGDSHVGLQARLMSQALRKLTANIKNANCLCIFINQIRMKIGVMFGSPETTTGGNALKFYASVRLDIRRIGAIKEGDEVVGNETRVKVVKNKVAPPFKQAEFQIFYGVGISKEGELVDLGVKHKLIDKAGAWYSYNGEKIGQGKANVMKLFTENKVMAAEVEARLRELLLSGDVPAEKPVVADADELEAESEQEFE

SEQ ID NO: 2804 - DNA, 1433 bp, Azotobacter vinelandii
  CDS (311)..(1360)
tgccggccccgatggcggctcgccggaaaccccggtcggcaccgtctggctggccgggcagatggcgagcgcttgttgcggtgcgccagcagtttcccggcgaccgcggcgaggtacgtcgacggacggtgcaggccgccctggccggtctgatccgcctggttgccgatgggacgctcgaatgaggtgctggacatcacggaaatggatcggcccaggggtaggcgcccgagcttttcctatgctctaatactgtctacttatacagtgtatggcgccgcaaggccctcctgaatacgtgaggtcttcaatggacgagaacaagaagcgcgccttggctgcggccttgggccagatcgaaaagcagttcggcaagggcgcggtgatgcgcatgggcgatcacgagcggcaggcgattccggccatttccaccggttccctggggctggacatcgcgctcggcatcggcggcctgcccaaggggcggatcgtcgagatctacggccccgaatcctccggcaagaccaccctgaccctgtcgaccatcgccgaggctcagaagcagggtgccacctgcgccttcgtcgacgccgagcacgcgctcgatccggactacgccgccaagctcggggtgaacgtcgacgacctcctggtttcccagcccgataccggcgagcaggcgctggagatcaccgacatgctggtgcgttccaacgcggtggacgtgatcatcgtcgactccgtggcggcgctggtgcccaaggcggagatcgagggcgagatgggcgaccagcacgtcggtctgcaggcccgtctgatgtcccaggccctgcgcaagatcaccggcaacatccagaacgccaactgcctggtcatcttcatcaaccagatccgcatgaagatcggtgtgatgttcggcaacccggaaaccaccaccggcgcgaatgccctgaagttctacgcctcggtgcgtctggacatccgccgcaccggcgcggtgaaggagagcgacgaggtgatcggcagcgagacccgcgtcaaggtggtgaagaacaaggtggcgccgccgttccgtcaggccgagttccagattctctacggcaagggcatctaccgtaacggtgagatcatcgacctcggtgtgcaactcggcctgctggagaagtccggcgcctggtacagctaccagggcagcaagatcggccagggcaaggccaatgcggccaagtttctcgaggacaacccggaggtcgccgcagcggtcgagaagagcatccgcgatcagttgctcgccgcgccggccagcgcccgtccggcagccttggccgacgagccggccgacgcggatctcgattattgatgagtgcgtcgatgccggggctcgacagtcccgccgccgtgcgccgggccgccatggacctgctggcgcgtcg

SEQ ID NO: 2805 - protein, 349 aa, Azotobacter vinelandii
MDENKKRALAAALGQIEKQFGKGAVMRMGDHERQAIPAISTGSLGLDIALGIGGLPKGRIVEIYGPESSGKTTLTLSTIAEAQKQGATCAFVDAEHALDPDYAAKLGVNVDDLLVSQPDTGEQALEITDMLVRSNAVDVIIVDSVAALVPKAEIEGEMGDQHVGLQARLMSQALRKITGNIQNANCLVIFINQIRMKIGVMFGNPETTTGANALKFYASVRLDIRRTGAVKESDEVIGSETRVKVVKNKVAPPFRQAEFQILYGKGIYRNGEIIDLGVQLGLLEKSGAWYSYQGSKIGQGKANAAKFLEDNPEVAAAVEKSIRDQLLAAPASARPAALADEPADADLDY

SEQ ID NO: 2806 - DNA, 1108 bp, Acetobacter polyoxogenes
  CDS (35)..(1081)
gaattcatcttctcaagcatcagggtaggcaacgatggcacaggctccgggtatagacaaaagcaaggccctggaaggggccttgagccagatcgaacgtgcgtttggcaagggttcgatcatgcgcatgggcgaacgcccgaccgagcaggtggacgtgatttccaccgggtcgctgggtctggatatcgccctgggaattggcggcctgccgcgcggccgtatcatcgagatctatggtcccgaaagctcgggcaagaccaccatggcgctgcacgccattgcggaagcccagcgcaaggggggcacctgcgccttcatcgacgccgagcacgcgcttgaccccggttatgcccgcaagctgggggtggatgtcgacaacctgctgatcagccagcccgatgcgggtgagcaggcgctggaaattgccgacacgctggtgcgttccggcgcggttgacgtgctggtggtcgacagtgtggccgccctcgtgccgcgtgcggaactggaaggcgacatgggcgacagccatgtgggcctgcatgcgcgcctgatgagccaggcgctgcgcaagctgacgggttccgtctcgcgttccaacaccatgctgatcttcctcaaccagatccggctcaagatcggcgtgatgttcggcagccccgaaagcaccacgggtggcaacgcgctgaaattctatgcatccgtgcgcatggacatccgtcgtatcggctcgatcaaggacaaggacgaggtcacgggcaaccagacgcgcgtaaaagtggtcaagaacaagatggccccccccttccgtcaggtcgaattcgacatcatgtatggcgaagggatcagcaaggtcggtgaactgatcgaccttggcgtaaaggcgggcattgttgaaaagtccggcgcgtggttctcctgtgacagccagcgcatcgggcaggggcgtgaaaacgccaagcagttcctgcgtgaccaccctgaaatggccgccgatatcgaacgccgcgtgcgtgagcaggcgggtgtcgtggcggaagccatgctggtcggccccgatgaggacggcgccgagcattgatccccttggcctgccccgttatggcag

SEQ ID NO: 2807 - protein, 348 aa, Acetobacter polyoxogenes
MAQAPGIDKSKALEGALSQIERAFGKGSIMRMGERPTEQVDVISTGSLGLDIALGIGGLPRGRIIEIYGPESSGKTTMALHAIAEAQRKGGTCAFIDAEHALDPGYARKLGVDVDNLLISQPDAGEQALEIADTLVRSGAVDVLVVDSVAALVPRAELEGDMGDSHVGLHARLMSQALRKLTGSVSRSNTMLIFLNQIRLKIGVMFGSPESTTGGNALKFYASVRMDIRRIGSIKDKDEVTGNQTRVKVVKNKMAPPFRQVEFDIMYGEGISKVGELIDLGVKAGIVEKSGAWFSCDSQRIGQGRENAKQFLRDHPEMAADIERRVREQAGVVAEAMLVGPDEDGAEH

SEQ ID NO: 2808 - DNA, 1230 bp, Neisseria gonorrhoeae
  CDS (133)..(1179)
cggcattcggtctgaagcggatggtagcccccgaaaggcaaacatgcgataatgaccgaccgattcatattccgcgccgcagcccgtgttgcgccgcagcccacataccgcatttgttccggagtaacccccatgtcagacgacaaaagcaaagcccttgccgccgcactggcgcaaatcgaaaaaagtttcggcaaaggcgccatcatgaaaatggacggcagccagcaggaagaaaacctcgaagtcatttccaccggatcgctcggattagacctcgccctcggagtcggcggcctgcgccgcgggcgcatcgtcgaaatcttcggccccgaatcctccggcaaaaccacactctgcctcgaagccgtcgcccaatgccagaaaaacggcggcgtgtgcgcctttgtcgatgccgaacacgccttcgatcccgtttacgcccgcaaactcggcgtaaaagtcgaagagctttacctgtcccagcccgataccggcgaacaggctttggaaatctgcgacacgctcgtccgttcgggcggcatagatatggtagtcgtcgattccgtagccgcactcgtccccaaagccgaaatcgaaggcgatatgggggacagccacgtcggactgcaggcgcgcctgatgagtcaggctttgcgcaaactgaccggacacatcaaaaaaaccaatacgctggttgtgttcatcaaccaaatccgaatgaagatcggcgtaatgttcggcagccccgagaccacgaccggcggcaacgcgctgaaattctattcttccgtccgcctcgacatccgccgcaccggatccatcaaaaaaggcgaagaagtattgggcaacgaaacccgcgtcaaagtcatcaaaaacaaagtcgcccccccgttccgtcaggcagagtttgacatcctctacggagaaggcatcagttgggaaggcgaattgatcgacatcggcgtgaaaaacgacatcatcaacaaatccggcgcgtggtacagctacaacggcgcgaaaatcggtcagggcaaagacaacgtccgcgtctggctgaaagaaaaccccgaaatttccgacgaaatcgacgcaaaaatccgcgccctcaacggcgtagaaatgcacatcaccgaagggacgcaggacgaaaccgacggcgaacgacccgaagaataaaactgaaatcccgataaacggtacttcctgctgcgaagtaccgtttttttt

SEQ ID NO: 2809 - protein, 348 aa, Neisseria gonorrhoeae
MSDDKSKALAAALAQIEKSFGKGAIMKMDGSQQEENLEVISTGSLGLDLALGVGGLRRGRIVEIFGPESSGKTTLCLEAVAQCQKNGGVCAFVDAEHAFDPVYARKLGVKVEELYLSQPDTGEQALEICDTLVRSGGIDMVVVDSVAALVPKAEIEGDMGDSHVGLQARLMSQALRKLTGHIKKTNTLVVFINQIRMKIGVMFGSPETTTGGNALKFYSSVRLDIRRTGSIKKGEEVLGNETRVKVIKNKVAPPFRQAEFDILYGEGISWEGELIDIGVKNDIINKSGAWYSYNGAKIGQGKDNVRVWLKENPEISDEIDAKIRALNGVEMHITEGTQDETDGERPEE

SEQ ID NO: 2810 - DNA, 1649 bp, Bacteroides fragilis
  CDS (351)..(1307)
cggcgtaagtgtagacaatgaaaagtcacaccagaaatttattgagaaaaacaatctgccattcaccctgattgccgatactgataaaaaattggtagagcaatttggagtatggggagaaaaaaagctatatggccgtgcttatatgggtactttacgtacaactttccttatcaatgaagagggagttatcgaacggatcatcggacccaaagaagtaaagaccaaagaacacgcttcacaaattttataaatcgatcattatggcaaagaaagaagacgaattaaactttgaaacagataataataaaatggcatcaagcgaaaaattaaaagccttacaggctgccatggacaagatagagaaaagcttcggtaaaggttctatcatgaaaatgggtgaagaagtggtagaacaagtagaagtaattccaacaggttcgatagcactgaatgctgcattaggcgtaggcggttatccccgtggaagaatcattgaaatttatggtccggaatcatccggtaaaacgacactggccatccacgccattgcagaagcacaaaaagccggtggaattgccgctttcattgatgcggaacatgcttttgaccgcttctatgcggctaaactgggagtagatgtggataacctgttcatctcgcaacccgataacggagaacaggcgttggaaattgcagaacaattgatacgctcttcagctattgacatcatcgtagtggactctgtagccgccttgactccgaaagctgaaattgaaggggatatgggtgacaacaaagtgggcttgcaagcccgcctaatgtcacaggcattacgtaagttaacatcagctgtaagcaagactcgtacaacctgtatcttcatcaaccagttgcgtgagaaaatcggtgtaatgttcggtaatccggaaacaacaaccggtggtaatgcattaaaattctatgcttccgtacgtttggatatccgcggttcacagcagatcaaagacggtgaagaagtgattggtaagcagacgaaagtcaaagttgtgaaaaataaggtagctcctcctttccgcaaggcagaattcgatattatgtttggtgaaggcatatcacattcgggagaaatcattgacctgggagcggatttgggaattatcaagaaaagcggttcatggtatagctacaacgacaccaaattgggccaaggtcgtgatgcagcaaaacaatgtatcgccgacaatccagaacttgccgaagaactggaaggactgatctttgaaaagttgagagagcacaagtaagtgtaatcaataaacaacgatcggcagtgttctatcgaacaaccgccgatcgtttattatatatcttaattcatcatattccgtttttccaatgccaacggattaatatttattcagcagcatagcccactccgctaccaactcgataggtatgcccggaccattttcatcgttagattcggcaaacatccttaaccggtcgtccaagataaccaaacgtcgtatctccggctctctctcacctaatacttctacaataatgtccaaattttgttgtttcattttgactcatagtatctatttttaattcagtcattaaaagtacatctttttcgccaaaga

SEQ ID NO: 2811 - protein, 318 aa, Bacteroides fragilis
MDKIEKSFGKGSIMKMGEEVVEQVEVIPTGSIALNAALGVGGYPRGRIIEIYGPESSGKTTLAIHAIAEAQKAGGIAAFIDAEHAFDRFYAAKLGVDVDNLFISQPDNGEQALEIAEQLIRSSAIDIIVVDSVAALTPKAEIEGDMGDNKVGLQARLMSQALRKLTSAVSKTRTTCIFINQLREKIGVMFGNPETTTGGNALKFYASVRLDIRGSQQIKDGEEVIGKQTKVKVVKNKVAPPFRKAEFDIMFGEGISHSGEIIDLGADLGIIKKSGSWYSYNDTKLGQGRDAAKQCIADNPELAEELEGLIFEKLREHK

SEQ ID NO: 2812 - DNA, 1349 bp, Methylobacillus sp
  CDS (293)..(1327)
aggagatggccctgggcgcgctggcctacagcaccgccgacattagtgcttcctacacgggcatcgctgggccgatggcggaagcgagcaaaaaccggtcggtaccgtatgctttggctgggcccatcgcgatggccggatcatcacccaaacccaccacttcctgggcgagagacgccgtgcgcagacagtctgtcaaaaccgcattaaccggcttgttgcagcttactttacccactgatttatgaaataattgcaggctttagcaggcaactcgaaaaggtattcactgatggatgaaaacagaagcaaagcgctagccgccgccctctcgcaaatcgagaaacaatttggcaaaggctctatcatgcgcatgggcgacaccgatgtcgctgctgacatccaggcagtttctaccggctccctgggcctggacatcgccctgggtattggcggcttgccgcgcggccgcatcgtcgagatttacggcccggaatcctccggcaagaccacgctgacattgtctgtgatcgcgcagatgcaaaagctgggcggcacggcagcattcatcgacgcagaacacgcgctcgacccggtctacgcgcagaagctcggtgtcaatgtttccgatctgctcatctcccagcccgacaccggcgaacaggcgctcgagatcgccgacatgctggtgcgttccggctcggtagatgtcgtggtggtcgactccgtcgctgcgctgacgcccaaggccgaaatcgaaggcgaaatgggcgactcgcacatgggcctgcaggcccgcctgatgtcgcaggcactgcgcaagctcaccgccaacatcaagcgcaccaacaccttggtcatcttcatcaaccagatccgcatgaagatcggcctgatgttcggcaaccccgagaccaccaccggcggcaatgcactcaagttctacgcctccgtgcgcctggacatccgccgcaccggcgcgatcaagaagggggacgaggtcacgggatcagaaacccgggtcaaggtagtgaagaacaacgtggcccctccgttcaagctagcggaattcgacatcctctatggcgaaggtatctcgcgcgagggcgaaatcatcgaactcggcgtcaaccttaaattgatcgagaaggccggtgcctggtacagctacaagggcgagaagatcggccagggcaaggacaacgcgcgcgagttcctcagggagcacccggaaatcgccaatgagatcgacgccaagattcgcgagcattccaatctggccaacgccgcgatgacgacggcaccggatgaagaaagcgacgaataagcctaccaccatgaatgcgaga

SEQ ID NO: 2813 - protein, 344 aa, Methylobacillus sp
MDENRSKALAAALSQIEKQFGKGSIMRMGDTDVAADIQAVSTGSLGLDIALGIGGLPRGRIVEIYGPESSGKTTLTLSVIAQMQKLGGTAAFIDAEHALDPVYAQKLGVNVSDLLISQPDTGEQALEIADMLVRSGSVDVVVVDSVAALTPKAEIEGEMGDSHMGLQARLMSQALRKLTANIKRTNTLVIFINQIRMKIGLMFGNPETTTGGNALKFYASVRLDIRRTGAIKKGDEVTGSETRVKVVKNNVAPPFKLAEFDILYGEGISREGEIIELGVNLKLIEKAGAWYSYKGEKIGQGKDNAREFLREHPEIANEIDAKIREHSNLANAAMTTAPDEESDE

SEQ ID NO: 2814 - DNA, 1320 bp, Vibrio anguillarum
  CDS (166)..(1212)
tggtgagtcactttttatcgcagccaaattgaacctagtcgaaattttttcgacacagctatagacactgtatgaatcaacagtataattaaccccaattggcgactaaagagtcgataaaaaatttaacgagccgctacccacagcgacagtttggagaaagtaatggacgaaaataagcagaaggcgctagccgcagcactgggtcaaattgaaaagcaatttggtaaaggttcgatcatgcgccttggtgacaaccgtacaatggatgttgaaaccatttctaccggttcactttctttggatattgcattgggtgctggcggtttaccaatgggacgtatcgttgaagtctacggccctgaatcatcaggaaaaacaacgttaacgctggaattgatcgcagcagcacaacgagtgggtaaaacctgtgcttttatcgatgcagaacatgcccttgacccaatttatgctaaaaaactgggtgtaaacatcgatgagctgttggtttcacaacctgatacgggcgaacaagcgcttgaaatttgtgatgccttggcccgttctggtgccattgatgttatcgtcattgactctgtggctgcactgacaccaaaagctgaaattgaaggtgaaatgggcgatagccacatgggtctacaagcccgtatgctttctcaagcgatgcgtaagttaacgggtaacctaaaacagtccaactgcatgtgtatcttcatcaaccagatccgtatgaaaattggtgtgatgtttggtaaccctgaaaccacaacaggtggtaatgcccttaaattctacgcttcagttcgtttagatattcgtcgtacaggctctattaaagagggtgacgaagctgtgggtaatgaaacgcgtattaaagtggttaagaacaaaatcgcggctccctttaaacaagcggatactcaaattctttacggacaaggttttaaccgtgaaggtgaattggttgatcttggcgtgaaacataaattggttgagaaagcgggcgcttggtatagctataacggtgataaaattggtcaaggtaaagcaaacgcctgtaaattcttgagagagaatccagccgccgccatggctcttgatactaagttacgtgaaatgctgctcaatccagccgagttaattgttgaagaacctattttgagcgaaatgcctcaagaagaagagttgtaatcttctccacgtttatatttccaacaaagcccctgcaatgcagggctttgttttatccatgaccaatagggacagtatgtattcctctaaattcaaatcgacgttacg

SEQ ID NO: 2815 - protein, 348 aa, Vibrio anguillarum
MDENKQKALAAALGQIEKQFGKGSIMRLGDNRTMDVETISTGSLSLDIALGAGGLPMGRIVEVYGPESSGKTTLTLELIAAAQRVGKTCAFIDAEHALDPIYAKKLGVNIDELLVSQPDTGEQALEICDALARSGAIDVIVIDSVAALTPKAEIEGEMGDSHMGLQARMLSQAMRKLTGNLKQSNCMCIFINQIRMKIGVMFGNPETTTGGNALKFYASVRLDIRRTGSIKEGDEAVGNETRIKVVKNKIAAPFKQADTQILYGQGFNREGELVDLGVKHKLVEKAGAWYSYNGDKIGQGKANACKFLRENPAAAMALDTKLREMLLNPAELIVEEPILSEMPQEEEL

SEQ ID NO: 2816 - DNA, 1394 bp, Anabaena variabilis
  CDS (125)..(1201)
ttgtcaaagttactttttaatttgagaagccctatactagaattttccggctaaaatagtatatctgttctactcaaactccaaaccccacactccttaaatccatacatttttagaggcagtaatggctatcaataccgatacttcaggcaagcaaaaagcgctaacaatggtactcaaccagattgagcgcagcttcggtaaaggagcaatcatgcgcctgggcgatgctacccggatgcgggtagaaacgatttccacaggagcgctcaccttggatttagcattgggtggcggtttgccaaggggccgggtgattgagatttatggcccggaaagttccggtaaaacaacagtagcactccacgcgatcgccgaagtacaaaaagaaggcggaattgctgcttttgtggatgctgaacaagcccttgaccccacctacgcctcagccttaggtgtagatattcaaaacttgctggtctcccaaccagacacaggtgaatccgcgttggaaattgttgatcagctggtaccgtccgccgccgttgatattgtagttattgactcagtagcagcgttggttccccgtgcagaaatcgaaggcgatatgggtgatgcccatgttggtttacaagcgagattaatgagccaagctctacgtaaaattactggcaatattggtaaatctggttgtacagtaattttcattaaccagttgcggcaaaaaattggtgttacctacggtagcccggaaacaaccactggtggtaacgccttaaagttctatgcttcagtgcgtttagatattcgtcggattcaaaccttgaaaaaaggtactgatgaatttggtaaccgagttaaagttaaagttgcgaaaaataaagttgcaccgccttttagaattgcggaatttgacattatttttggtaaaggtgtttccactctaggttgtttagtagatttagctgaagaaactggtatcttactccgtaagggagcatggtatagttacaatggcgataatatttctcaaggtcgagataacgctatcaagtatctggaagaaaaaccagaatttgctgaacagattaaacaacaagtgcgtgaaaaattggacaagggcgctgttgtttctgcaaactcggtagccaaagctaacgaagaagatgaagaagatgttgacttagacgaggaagaataatattgatagtgtgatgaactaggtaaatatcattccttaaactacgtaatcacactaccgcaatccgcaactatctataaaatgatatgattcatctgaagattactccatatggggtaatctctcttaatttatggattttttaataaaacaggacttacggcaacttgtatattaagtaggttgtcagaca

SEQ ID NO: 2817 - protein, 358 aa, Anabaena variabilis
MAINTDTSGKQKALTMVLNQIERSFGKGAIMRLGDATRMRVETISTGALTLDLALGGGLPRGRVIEIYGPESSGKTTVALHAIAEVQKEGGIAAFVDAEQALDPTYASALGVDIQNLLVSQPDTGESALEIVDQLVPSAAVDIVVIDSVAALVPRAEIEGDMGDAHVGLQARLMSQALRKITGNIGKSGCTVIFINQLRQKIGVTYGSPETTTGGNALKFYASVRLDIRRIQTLKKGTDEFGNRVKVKVAKNKVAPPFRIAEFDIIFGKGVSTLGCLVDLAEETGILLRKGAWYSYNGDNISQGRDNAIKYLEEKPEFAEQIKQQVREKLDKGAVVSANSVAKANEEDEEDVDLDEEE

SEQ ID NO: 2818 - DNA, 1334 bp, Bacillus subtilis
  CDS (215)..(1258)
tacggctgccatttaatcttaaagcttttagagcaaaaataatattttcagcacattatcctcctaagaaaacatgatttctctgatacattatgatattttgataggaatcacgccaagaaaaaatccgaatatgcgttcgcttttttcttggcaaatcccttcaaacagggtatagtatatgtagtggtaacataaaggaggaaaaaatagaatgagtgatcgtcaggcagccttagatatggctcttaaacaaatagaaaaacagttcggcaaaggttccattatgaaactgggagaaaagacagatacaagaatttctactgtaccaagcggctccctcgctcttgatacagcactgggaattggcggatatcctcgcggacggattattgaagtatacggtcctgaaagctcaggtaaaacaactgtggcgcttcatgcgattgctgaagttcagcagcagcggacaagcgcgtttatcgatgcggagcatgcgttagatccggtatacgcgcaaaagctcggtgttaacatcgaagagcttttactgtctcagcctgacacaggcgagcaggcgcttgaaattgcggaagcattggttcgaagcggggcagttgacattgtcgttgtcgactctgtagccgctctcgttccgaaagcggaaattgaaggcgacatgggagattcgcatgtcggtttacaagcacgcttaatgtctcaagcgcttcgtaagctttcaggggccattaacaaatcgaagacaatcgcgattttcattaaccaaattcgtgaaaaagtcggtgttatgttcgggaacccggaaacaacacctggcggccgtgcgttgaaattctattcttccgtgcgtcttgaagtgcgccgtgctgaacagctgaaacaaggcaacgacgtaatggggaacaaaacgaaaatcaaagtcgtgaaaaacaaggtggctccgccgttccgtacagccgaggttgacattatgtacggagaaggcatttcaaaagaaggcgaaatcattgatctaggaactgaacttgatatcgtgcaaaaaagcggttcatggtactcttatgaagaagagcgtcttggccaaggccgtgaaaatgcaaaacaattcctgaaagaaaataaagatatcatgctgatgatccaggagcaaattcgcgaacattacggcttggataataacggagtagtgcagcagcaagctgaagagacacaagaagaactcgaatttgaagaataaaaataaaataagtttcaaatgatacaaaaggctgagtgaaaaactcagcttttttgtattttaaaaaatgataaaa

SEQ ID NO: 2819 - protein, 347 aa, Bacillus subtilis
MSDRQAALDMALKQIEKQFGKGSIMKLGEKTDTRISTVPSGSLALDTALGIGGYPRGRIIEVYGPESSGKTTVALHAIAEVQQQRTSAFIDAEHALDPVYAQKLGVNIEELLLSQPDTGEQALEIAEALVRSGAVDIVVVDSVAALVPKAEIEGDMGDSHVGLQARLMSQALRKLSGAINKSKTIAIFINQIREKVGVMFGNPETTPGGRALKFYSSVRLEVRRAEQLKQGNDVMGNKTKIKVVKNKVAPPFRTAEVDIMYGEGISKEGEIIDLGTELDIVQKSGSWYSYEEERLGQGRENAKQFLKENKDIMLMIQEQIREHYGLDNNGVVQQQAEETQEELEFEE

SEQ ID NO: 2820 - DNA, 1348 bp, Proteus mirabilis
  CDS (151)..(1218)
tttctctttaaaatcaattcttaaagaaattattaataattaacttgatactgtatgattatacagtataatgagtttcaacaagcaaaatcatatacgttttaatggtagtgacccatctttatgcttcactgcccagagggagataacatggctattgatgaaaacaaacaaaaagcattggccgcagcacttggtcaaattgaaaagcaatttggtaaaggttctatcatgcgtctgggcgaagaccgttccatgaacgtagaaactatctctacaggatctttatcattagacgttgctttaggtgcaggtggattgccacgtggccgtattgttgaaatctatggccctgaatcttctggtaaaacaaccttgactctacaagttattgcctctgctcagcgtgaaggaaaaatttgtgcatttattgatgctgaacatgcattagacccaatttatgctcaaaagctaggtgtcgatatcgataatctactctgctctcaacctgacacaggtgaacaagctctggaaatttgtgatgcattatctcgctctggtgcggtcgatgttattgtcgtggactccgtggcagcattaacaccaaaagctgaaattgaaggtgaaattggtgattcacacgttggtttagccgcacgtatgatgagccaagctatgcgtaaactagcgggtaaccttaaaaactctaatacactgctgattttcattaaccaaattcgtatgaaaatcggtgttatgtttggtaacccagaaaccacgaccggtggtaatgcgcttaaattctatgcttctgttcgtttagacattcgtcgcattggctctgtcaaaaatggtgatgaagtcattggtagtgagactcgcgttaaagttgttaaaaataaagtggctgcaccgtttaaacaagctgaattccaaattatgtacggtgaaggtattaatacctatggcgaactgattgatttaggtgttaaacataagttagtagagaaagcaggtgcttggtatagctacaatggcgaaaaaattggtcaaggtaaagctaacgcaaccaattacttaaaagaacatcctgaaatgtacaatgagttaaacactaaattgcgtgaaatgttgttaaatcatgctggtgaattcacaagtgctgcggattttgcaggtgaagagtcagacagtgatgctgacgacacaaaagagtaattagctggttgtcatgctgtttgtgtgaaaatagaccttaaatcattggctattatcacgacagcatcccatagaataacttgtttgtataaattttattcagatggcaaaggaagccttaaaaaagctt

SEQ ID NO: 2821 - protein, 355 aa, Proteus mirabilis
MAIDENKQKALAAALGQIEKQFGKGSIMRLGEDRSMNVETISTGSLSLDVALGAGGLPRGRIVEIYGPESSGKTTLTLQVIASAQREGKICAFIDAEHALDPIYAQKLGVDIDNLLCSQPDTGEQALEICDALSRSGAVDVIVVDSVAALTPKAEIEGEIGDSHVGLAARMMSQAMRKLAGNLKNSNTLLIFINQIRMKIGVMFGNPETTTGGNALKFYASVRLDIRRIGSVKNGDEVIGSETRVKVVKNKVAAPFKQAEFQIMYGEGINTYGELIDLGVKHKLVEKAGAWYSYNGEKIGQGKANATNYLKEHPEMYNELNTKLREMLLNHAGEFTSAADFAGEESDSDADDTKE

SEQ ID NO: 2822 - DNA, 1384 bp, Pseudomonas aeruginosa
  CDS (145)..(1185)
cccgggctagccgcgcctgcgggcaaccgttcggaacattcttcccgtcgggggtaggcgagcgacttagccctgtggaataatactgtctacttatacagttgttcgtggccgtccggccgccctgacttcgcgaggacttcaatggacgagaacaagaagcgcgccctggccgcggccctgggacagatcgaacgccaattcggcaaaggcgcggtcatgcgcatgggcgaccatgagcgccaggcgatcccggccatctccaccggctccctgggtctggacatcgccctcggcatcggcggcctgcccaagggccggatcgtcgagatctacggtccggaatcctcgggcaagaccaccctgaccctctcggtgatcgccgaggcccagaaacagggcgccacctgtgccttcgtcgacgccgagcacgcgctcgatcccgactatgccggcaagctgggcgtcaacgtcgacgacctgctggtctcccagccggacaccggcgagcaggccctggaaatcaccgacatgctggtgcgctccaacgcggtcgacgtgatcatcgtcgactccgtggccgcgctggtacccaaggccgagatcgaaggcgagatgggcgacgcccacgtcggcctgcaggcacgcctgatgtcccaggcgctgcgcaagatcaccggcaatatcaagaacgccaactgcctggtcatcttcatcaaccagatccgcatgaagatcggcgtcatgttcggcaacccggaaaccaccaccggcggtaacgcactgaagttctacgcctcggtccgcctggacatccgtcgtaccggcgcggtgaaggaaggcgacgaggtggtgggtagcgaaacccgcgtcaaggtggtgaagaacaaggtttccccgccgttccgccaggccgagttccagatcctctacggtaagggcatctaccgtaccggcgagatcatcgatctgggcgtgcaattgggcctggtcgagaagtccggcgcctggtacagctaccagggcagcaagatcggccagggcaaggcgaacgccgccaagtacctggaagacaatccggaaatcggttcggtactggagaagaccattcgcgaccagttgctggccaagagcggcccggtgaaggccgacgccgaagaagtggctgacgccgaagccgattgaggccaatggcgatcgtgctcgatacgcccgtcgccgtgcggcgggcggccatggatctgctggcgcgccgtgagcacgggcgcgccgagctttcccgcaagttgcgccagcgtggcgcgtctgccgagttgatcgatcctgccctcgaccgcctggccgaggaaggtctgctcgacgaatcccgctatctcgaaagctt

SEQ ID NO: 2823 - protein, 346 aa, Pseudomonas aeruginosa
MDENKKRALAAALGQIERQFGKGAVMRMGDHERQAIPAISTGSLGLDIALGIGGLPKGRIVEIYGPESSGKTTLTLSVIAEAQKQGATCAFVDAEHALDPDYAGKLGVNVDDLLVSQPDTGEQALEITDMLVRSNAVDVIIVDSVAALVPKAEIEGEMGDAHVGLQARLMSQALRKITGNIKNANCLVIFINQIRMKIGVMFGNPETTTGGNALKFYASVRLDIRRTGAVKEGDEVVGSETRVKVVKNKVSPPFRQAEFQILYGKGIYRTGEIIDLGVQLGLVEKSGAWYSYQGSKIGQGKANAAKYLEDNPEIGSVLEKTIRDQLLAKSGPVKADAEEVADAEAD

SEQ ID NO: 2824 - DNA, 1352 bp, Pseudomonas cepacia
  CDS (223)..(1266)
aattcgcatgttgctgaccgatgccggcagggcgttcgcgccggcgcggctgtctccgaagttattcgtgcacaacgcgctgcattgcgggcttgcacaaaacactgtttttttatacagtgtctgcattcgtgggcagcgcttgaaaggggcgcgcctccaacagacgctgctcatcatagcaaaggacgattcatggaagatagcaagaagggctccgggatgaccgccgagaagagcaaggcgctggcggccgcgctcgcgcagatcgaaaagcagttcggcaagggctcgatcatgcggatgggcgacggcgaagcggccgaggatatccaggtcgtctccacggggtcgctgggtctcgacatcgcgctgggcgtcggcggcttgccgcgcggccgggtggtcgagatctacggtccggaatcgtccggtaagaccacgctcacgctgcaggtcatcgccgagctgcagaaactgggcggcaccgcggcgttcatcgacgccgagcacgcgctcgacgttcaatatgccgcgaagctcggcgtgaacgtgccggagctgctgatctcgcagccggacaccggcgagcaggccctcgaaatcaccgatgcgctggtgcgctcgggctcgatcgacatgatcgtcatcgactcggtcgcggcgctcgtgccgaaggccgaaatcgaaggcgagatgggcgattcgctgccgggtctgcaggcccgcctgatgtcgcaggcgctgcgcaagctgaccggcacgatcaagcgcacgaactgcctcgtgatcttcatcaaccagatccggatgaagatcggcgtgatgttcggcaacccggaaaccacgacgggcggtaacgcactgaagttctactcgtcggtgcgtctcgatatccgccggatcggctcgatcaagaagaacgacgaggtgatcggcaacgaaacccgcgtgaaggtcgtcaagaacaaggtgtcgccgccgttccgcgaagcgatcttcgacatcctgtacggcgaaggcatttcgcgtcagggcgagatcatcgatctcggcgtgcaggcgaagatcgtcgacaaggcgggcgcctggtacagctacaacggcgagaagatcggccagggcaaggacaacgcgcgtgaattcctgcgcgaaaatccggaaatcgcgcgcgagatcgagaaccgcatccgcgaatcgctcggcgtcgtcgcaatgcccgatggcgcaggcaacgaagccgaggcgatggacgaagaagagtgatggttgcgcgccgaggtcaggccggcgagccggaggagcacgacacgcccgaaacggcgggtcgctccggccggcgaggcggatcc

SEQ ID NO: 2825 - protein, 347 aa, Pseudomonas cepacia
MTAEKSKALAAALAQIEKQFGKGSIMRMGDGEAAEDIQVVSTGSLGLDIALGVGGLPRGRVVEIYGPESSGKTTLTLQVIAELQKLGGTAAFIDAEHALDVQYAAKLGVNVPELLISQPDTGEQALEITDALVRSGSIDMIVIDSVAALVPKAEIEGEMGDSLPGLQARLMSQALRKLTGTIKRTNCLVIFINQIRMKIGVMFGNPETTTGGNALKFYSSVRLDIRRIGSIKKNDEVIGNETRVKVVKNKVSPPFREAIFDILYGEGISRQGEIIDLGVQAKIVDKAGAWYSYNGEKIGQGKDNAREFLRENPEIAREIENRIRESLGVVAMPDGAGNEAEAMDEEE

SEQ ID NO: 2826 - DNA, 1047 bp, Synechococcus sp
  CDS (1)..(1047)
atgtcagccatcagcaataatcccgacaaagaaaaggccctaaacctagtgctcaaccaaattgagcgtaactttggtaagggggcgattatgcggttgggggatgccgcccagatgaaggtcgcaaccattcccagtggggctttgaccctagatcaggcgatgggcggtgggtttccgcgtgggagaattgtggaaatctatggcccggagagttctgggaaaacgacggttgctctccatgcgatcgccgaagtccaaaaagcgggtggcgtcgctgcttttattgacgctgaacatgccctggatcccacctattccgcggccttgggagttgatattgaaaacctgctggtggcccaacccgataacggcgaatctgctttagaaattgccgaccaattggttcgctcggcggctgtggatctaatcgtgattgactcggtggcggcccttgtgcccagggcagagatcgaaggagaaatgggcgatgtgcaggtgggtctccaggcccgtctcatgagtaaagccctccgtaaaattgccgggaatatggggcgttcgggttgtacggtgatttttctcaatcaattgcgccaaaaaattggcattagttacggcaatccagaggtaaccaccgggggaaccgccctcaaattttatgcctctgtgcgcctagatatccgccgcatccaaaccctcaagaaagggagcgaaggggaatttggcatccgcgccaaggttaaagtggcgaaaaataaagttgctccaccgttccgcattgccgaatttgacattatttttggcaaaggaatctcccgtgtgggctgcatgctagacctcgcggaacaaacaggtgtcattacccgcaaaggcgcttggtacagctatgaaggggataacattgcccagggtcgcgacaatgcagtgaagtatctagaggaaaatccggacgttgcggcgatcgtcacccaaaaagtccgggaaaatctggatatgagttccatgggtttcggggatgagcaccacaccaccgaagaagaataa

SEQ ID NO: 2827 - protein, 348 aa, Synechococcus sp
MSAISNNPDKEKALNLVLNQIERNFGKGAIMRLGDAAQMKVATIPSGALTLDQAMGGGFPRGRIVEIYGPESSGKTTVALHAIAEVQKAGGVAAFIDAEHALDPTYSAALGVDIENLLVAQPDNGESALEIADQLVRSAAVDLIVIDSVAALVPRAEIEGEMGDVQVGLQARLMSKALRKIAGNMGRSGCTVIFLNQLRQKIGISYGNPEVTTGGTALKFYASVRLDIRRIQTLKKGSEGEFGIRAKVKVAKNKVAPPFRIAEFDIIFGKGISRVGCMLDLAEQTGVITRKGAWYSYEGDNIAQGRDNAVKYLEENPDVAAIVTQKVRENLDMSSMGFGDEHHTTEEE

SEQ ID NO: 2828 - DNA, 1190 bp, Aquaspirillum magnetotacticum
  CDS (112)..(1146)
ttctcctctcgttcgtgtacggtattcctcattgcggaaccgccggttcgggatagatgaaggggaacggccatgtctcaggctgcattgcgtctcgtggacaaggataccatggatagacagaaggctttggaagctgccgtcagccagatcgagcgggcattcggcaagggctccatcatgaagctgggcggcaaggatcaggtggtcgagaccgaagtggtctccacccggatcctgggccttgatgtggcgctcggcatcggcggcgttccgcgcggccgtatcatcgaggtctatggcccggaaagctcgggcaagaccaccctggcgctgcacatcatcgccgaggcgcagaagaagggcggcacctgcgccttcgtcgatgccgaacacgcgcttgacccctcctatgcccgtaagctgggcgcgctggacgagctgctgatcagcgagcccgacgctggcgagcaggccctggaaatcgccgacaccctggtacgccccggcgccgtggacgttctggtggtggattcggtggccgcattggtgccccgcggcgagctggaaggcgagatgggcgacaaccatatgggcctgcacgcccgcctgatgagccaggcgctgcgcaagctgaccggttcggtatccaagtccaaaaccatcgtcatcttcatcaaccagatccgcatgaagatcggcgtgatgttcggcaatcccgagaccaccaccggcggcaacgcgctcaagttctacgcctcggtgcgcatggagatccgccgggtcggcgccatcaaggacagggacgaggtcgtgggcaaccagacccgcgtcaaggtggtgaagaacaagctggctccgccgttcaaggtggtggacttcgacatcatgtatggcgaaggcatctccaagatgggtgagctcatcgatctgggcgtcaaggccaatgtggtgaagaaatcgggggcctggttctcctacaactccacccgcatcggccagggccgcgagaacgccaagcagttcctgcgcgacaatccggccatggccgccgagatcgaaggcgccatccgccagaatgccggcctcatctccgaggccctggccgcggtcccggacctggacggcacgccggtcgcggaataaccctcgcgcgggtgcgaaaaccacagggccacccgcggcaacac

SEQ ID NO: 2829 - protein, 344 aa, Aquaspirillum magnetotacticum
MDRQKALEAAVSQIERAFGKGSIMKLGGKDQVVETEVVSTRILGLDVALGIGGVPRGRIIEVYGPESSGKTTLALHIIAEAQKKGGTCAFVDAEHALDPSYARKLGALDELLISEPDAGEQALEIADTLVRPGAVDVLVVDSVAALVPRGELEGEMGDNHMGLHARLMSQALRKLTGSVSKSKTIVIFINQIRMKIGVMFGNPETTTGGNALKFYASVRMEIRRVGAIKDRDEVVGNQTRVKVVKNKLAPPFKVVDFDIMYGEGISKMGELIDLGVKANVVKKSGAWFSYNSTRIGQGRENAKQFLRDNPAMAAEIEGAIRQNAGLISEALAAVPDLDGTPVAE

SEQ ID NO: 2830 - DNA, 1841 bp, Rhizobium leguminosarum bv. viciae
  CDS (32)..(1087)
gaattcattgcggctggtagaggacaaatcgatggacaaaagcaaggcgcttgaagcggcactctcacagatagagcggtcgttcggcaagggctcgatcatgaaactcggctccaacgagaatgttgtcgagatcgagacgatctcgaccggctcgcttggtctcgatattgcactcggcgttggtggcctgccgaggggccgcatcatcgaaatctacgggccggaaagctccggtaagacgacgcttgcactgcagacgattgccgaagcgcagaagaagggcggcatctgcgccttcgtcgatgccgaacatgcgctcgatcccgtctatgcccgcaagcttggcgtcgacctgcagaaccttctgatctcgcagcccgataccggcgagcaggcgcttgaaatcaccgatacgctggtgcgctccggccgcgtcgacgttctcgtcgtcgactcggttgcggcattgacgccgcgcgccgaaatcgaaggcgaaatgggcgacaccgttcccggcctgcaggcacgattgatgagccaggcgctgcgcaagctcaccgcttcgatctcgaagtcgaacactatggtgatcttcatcaaccagatccgcatgaagatcggcgtcatgttcggctcgccggaaacgacgacaggcggcaatgcgctgaaattctatgcttccgtgcgccttgacatccgccgcatcggcgctgtcaaggagcgcgaagaggtgatcggcaaccagacccgcgtcaaggtcgtcaagaacaagatggcgccacccttcaagcaggtcgagttcgacatcatgtatggcgagggtgtttccaagaccggcgaactggtcgatctcggcgtcaaggccggcatcgtcgaaaagtcgggcgcctggttctcctataacagccagcgtctcggccagggccgtgaaaacgccaagactttcctgcgcgacaatccggacctcgcccgcgagatcgaactgtcgctgcgccagaatgccggcctgatcgccgaccgtttcctgcagaacggtggaccggaccccgatgacggcgatggcgatgccactgcggaaatgtaattttcgcgcctaaactcatcggacagttccagccggccgcattcctgatgagaatgcggccggttttgtttgtctgctggacagcggcgggggtgaacgttaaaagccgatgaatttaaattacctgcctccgggcattgaagggcatagcatgagcggtgtgaacgatatccggtcgaccttcctcgactatttcaagaagaacggccatgagatcgttccgtcgagcccgctcgtgccgcgcaacgacccgacgctgatgttcaccaatgccggcatggtgcagttcaagaacgtcttcaccggcctcgaaaagcgttcctattcgacggcgacgacttcgcagaaatgcgtgcgcgtcggcggcaagcacaacgacctcgacaatgtcggttatactgcacgtcacctgaccttcttcgagatgctcggcaacttctccttcggcgactatttcaaggagaatgcgatcgagcttgcctggaagctcgttaccgaaggcttcgaccttccgaagcaccgtctgctggtgaccgtctattccgaggacgaggaagctgcgacgctgtggaagaagatcgccggcttttccgacgacaagatcatccgcatctcgacctccgacaatttctggcagatgggcgataccggcccctgcggcccgtgctcggaaatcttcatcgaccagggtgagaatgtttggggcggccctccgggctcaccggaggaagatggcgaccggttcctggaattc

SEQ ID NO: 2831 - protein, 351 aa, Rhizobium leguminosarum bv. viciae
MDKSKALEAALSQIERSFGKGSIMKLGSNENVVEIETISTGSLGLDIALGVGGLPRGRIIEIYGPESSGKTTLALQTIAEAQKKGGICAFVDAEHALDPVYARKLGVDLQNLLISQPDTGEQALEITDTLVRSGRVDVLVVDSVAALTPRAEIEGEMGDTVPGLQARLMSQALRKLTASISKSNTMVIFINQIRMKIGVMFGSPETTTGGNALKFYASVRLDIRRIGAVKEREEVIGNQTRVKVVKNKMAPPFKQVEFDIMYGEGVSKTGELVDLGVKAGIVEKSGAWFSYNSQRLGQGRENAKTFLRDNPDLAREIELSLRQNAGLIADRFLQNGGPDPDDGDGDATAEM

SEQ ID NO: 2832 - DNA, 1047 bp, Rhizobium meliloti
  CDS (1)..(1047)
atggacaaaagcaaggcacttgaagcggctctttcccagatcgaacgttcgttcggcaagggatcgatcatgaagctcggagcgaaggacagcgtagttgagatcgaaaccgtctccaccggttcgctcggcctcgatatcgcgctcggcatcggcggcctgccgaagggccgtatcatcgagatctatggtccggaaagctcgggcaagacgacgctggcgctgcagaccattgccgaggcacagaagaagggcggcatctgcggcttcgtcgatgccgagcatgcactcgatccggtctatgcacgaaagctcggggtcgatctcgaaaatctcctgatttcgcagcctgatacgggcgagcaggcgctggaaatcaccgatacgctggtccgttcgggtgcgatcgacattctcgtcatcgattcggtggccgcactcgtgccgcgcgccgaaatcgagggcgagatgggcgacagtctgccgggcatgcaggcgcgcctcatgagccaggcgctgcgcaagcttacggcatcgatctccaagtcgaactgcatggtgatcttcatcaaccagatccgcatgaagatcggcgtgatgttcggctcgccggaaacgacgacgggcggcaatgcgctcaagttctacgcttcggtgcgcctcgacattcgccgcatcggttcggtcaaggagcgcgaggaagtggtcggcaaccagacccgcgtcaaggtcgtcaagaacaagatggcaccgcccttcaagcaggtcgagttcgacatcatgtatggcgaaggcgtttcgaagacgggcgaattgatcgatctcggcgtcaaggcgggcatcgtcgagaaatcgggcgcctggttctcctataacagccagcggctcggccagggacgggaaaacgccaagctcttcctgcgggagaatcccgaactgttgcgcgaaatcgaaacggctctgcggcagaatgcgggtctcatcgccgaccggttcctggagaatggcgggccggaaagcgacggcgacgaagccgccgatatgtaa

SEQ ID NO: 2833 - protein, 348 aa, Rhizobium meliloti
MDKSKALEAALSQIERSFGKGSIMKLGAKDSVVEIETVSTGSLGLDIALGIGGLPKGRIIEIYGPESSGKTTLALQTIAEAQKKGGICGFVDAEHALDPVYARKLGVDLENLLISQPDTGEQALEITDTLVRSGAIDILVIDSVAALVPRAEIEGEMGDSLPGMQARLMSQALRKLTASISKSNCMVIFINQIRMKIGVMFGSPETTTGGNALKFYASVRLDIRRIGSVKEREEVVGNQTRVKVVKNKMAPPFKQVEFDIMYGEGVSKTGELIDLGVKAGIVEKSGAWFSYNSQRLGQGRENAKLFLRENPELLREIETALRQNAGLIADRFLENGGPESDGDEAADM

SEQ ID NO: 2834 - DNA, 2762 bp, Mycobacterium tuberculosis
  CDS (311)..(2683)
ctgcgacgccgaaaggtcagatccgggccggtgagcacgccggatccggccaggctagcggtgttgagcagatcgtcggtgatccggaccagccgcgcacgcaagtcgggccgcaccgccgccagggcgttcgacgcgccgacgagcgcggacgcgatgttgccacacgcggcgtgtcacacttgaatcgaacaggtgttcggctactgtggtgatcattcggagcagccgacttgtcagtggctgtctctagtgtcacggccaaccgaccgataccggtcaatcgaacaccgaccacaggagaggcaccatgacgcagacccccgatcgggaaaaggcgctcgagctggcagtggcccagatcgagaagagttacggcaaaggttcggtgatgcgcctcggcgacgaggcgcgtcagccgatttcggtcattccgaccggatccatcgcactagacgtggccctgggcattggcggcctgccgcgtggccgggtgatagagatatacggcccggagtcgtcgggtaagaccaccgtggcgctgcacgcggtggccaacgctcaggccgccggtggtgttgcggcgttcatcgacgccgagcacgcgctggatccggactatgccaagaagctcggtgtcgacaccgattcgctgctggtcagccagccggacaccggggaacaggcactcgagatcgccgacatgctgatccgctcgggtgcgcttgacatcgtggtgatcgactcggtggcggcgctggtgccgcgcgcggagctcgaaggcgagatgggcgacagccacgtcgggctgcaggcccggctgatgagccaggcgctgcggaaaatgaccggcgcgctgaataattcgggcaccacggcgatcttcatcaaccagctccgcgacaagatcggagtgatgttcgggtcgcccgagacgacaacgggcggaaaggcgttgaagttctacgcgtcggtgcgcatggacgtgcggcgagtcgagacgctcaaggacggtaccaacgcggtcggcaaccgcacccgggtcaaggtcgtcaagaacaagtgcctcgcagagggcactcggatcttcgatccggtcaccggtacaacgcatcgcatcgaggatgttgtcgatgggcgcaagcctattcatgtcgtggctgctgccaaggacggaacgctgcatgcgcggcccgtggtgtcctggttcgaccagggaacgcgggatgtgatcgggttgcggatcgccggtggcgccatcgtgtgggcgacacccgatcacaaggtgctgacagagtacggctggcgtgccgccggggaactccgcaagggagacagggtggcgcaaccgcgacgcttcgatggattcggtgacagtgcgccgattccggcggatcatgcccggctgcttggctacctgatcggagatggcagggatggttgggtggggggcaagactccgatcaacttcatcaatgttcagcgggcgctcattgacgacgtgacgcgaatcgctgcgacgctcggttgcgcggcccatccgcaggggcgtatctcactcgcgatcgctcatcgacccggtgagcgcaacggtgtggcagacctttgtcagcaggccggtatctacggcaagctcgcgtgggagaagacgattccgaattggttcttcgagccggacatcgcggccgacattgtcggcaatctgctcttcggcctgttcgaaagcgacgggtgggtgagccgggaacagaccggggcacttcgggtcggttacacgacgacctctgaacaactcgcgcatcagattcattggctgctgctgcggttcggtgtcgggagcaccgttcgagattacgatccgacccagaagcggccgagcatcgtcaacggtcgacggatccagagcaaacgtcaagtgttcgaggtccggatctcgggtatggataacgtcacggcattcgcggagtcagttcccatgtgggggccgcgcggtgccgcgcttatccaggcgattccagaagccacgcaggggcggcgtcgtggatcgcaagcgacatatctggctgcagagatgaccgatgccgtgctgaattatctggacgagcgcggcgtgaccgcgcaggaggccgcggccatgatcggtgtagcttccggggacccccgcggtggaatgaagcaggtcttaggtgccagccgccttcgtcgggatcgcgtgcaggcgctcgcggatgccctggatgacaaattcctgcacgacatgctggcggaagaactccgctattccgtgatccgagaagtgctgccaacgcggcgggcacgaacgttcgacctcgaggtcgaggaactgcacaccctcgtcgccgaaggggttgtcgtgcacaactgttcgccccccttcaagcaggccgagttcgacatcctctacggcaagggaatcagcagggagggctcgctgatcgacatgggtgtggatcagggcctcatccgcaagtcgggtgcctggttcacctacgagggcgagcagctcggccagggcaaggagaatgcccgcaacttcttggtggagaacgccgacgtggctgacgagatcgagaagaagatcaaggaaaagcttggcattggtgccgtggtgaccgatgatccctcaaatgacggtgtcctgcccgcccccgtcgacttctgagcgcgaagagcaggcgcgggcactgtgcctgcgcctgctcaccgcgcgatcccgcacccgcgccgagttagccggccag

SEQ ID NO: 2835 - protein, 790 aa, Mycobacterium tuberculosis
MTQTPDREKALELAVAQIEKSYGKGSVMRLGDEARQPISVIPTGSIALDVALGIGGLPRGRVIEIYGPESSGKTTVALHAVANAQAAGGVAAFIDAEHALDPDYAKKLGVDTDSLLVSQPDTGEQALEIADMLIRSGALDIVVIDSVAALVPRAELEGEMGDSHVGLQARLMSQALRKMTGALNNSGTTAIFINQLRDKIGVMFGSPETTTGGKALKFYASVRMDVRRVETLKDGTNAVGNRTRVKVVKNKCLAEGTRIFDPVTGTTHRIEDVVDGRKPIHVVAAAKDGTLHARPVVSWFDQGTRDVIGLRIAGGAIVWATPDHKVLTEYGWRAAGELRKGDRVAQPRRFDGFGDSAPIPADHARLLGYLIGDGRDGWVGGKTPINFINVQRALIDDVTRIAATLGCAAHPQGRISLAIAHRPGERNGVADLCQQAGIYGKLAWEKTIPNWFFEPDIAADIVGNLLFGLFESDGWVSREQTGALRVGYTTTSEQLAHQIHWLLLRFGVGSTVRDYDPTQKRPSIVNGRRIQSKRQVFEVRISGMDNVTAFAESVPMWGPRGAALIQAIPEATQGRRRGSQATYLAAEMTDAVLNYLDERGVTAQEAAAMIGVASGDPRGGMKQVLGASRLRRDRVQALADALDDKFLHDMLAEELRYSVIREVLPTRRARTFDLEVEELHTLVAEGVVVHNCSPPFKQAEFDILYGKGISREGSLIDMGVDQGLIRKSGAWFTYEGEQLGQGKENARNFLVENADVADEIEKKIKEKLGIGAVVTDDPSNDGVLPAPVDF

SEQ ID NO: 2836 - DNA, 1249 bp, Methylomonas clara
  CDS (123)..(1151)
gaattcatggcttcgccatttcactgatggtcgatttatgaaataattagaagttattgtttggattatatagcgtttgtataaacagcgcatttttatcgctaataaagaaggtaatcagcatggatgacaacaaaagcaaagcgctcgccgccgcactttcccaaattgaaaaacagttcggcaaaggctccattatgcgcatgggcgatgctgatatcggcgaagacctgcaagtggtttccaccggctccctgggtctggatatcgcactgggggtgggtggcttgccacgtggccgtattatcgaaatttatggccctgagtcttcaggtaaaaccacattgaccttgtctgccattgccgaaatgcaaaagctgggtggtgtcgcagcatttatcgacgcggacgatgccctggacccgcaatacgcgtccaagctgggcgtgaatgtgccagagttgttgatttcacagccagacaccggcgaacaggcgctggaaatcgccgatatgctggtgcgctccggttccgtggatatcgtggtggtggactcggtagctgccttgactccgcgtgccgaaattgaaggtgaaatgggcgacagccatatgggtttgcaggcacgcttgatgtcacaggcattgcgtaaactgactggtaacatcaagcgtaccaatacgctggtgatttttattaaccagatccgtatgaagatcggtgtcatgttcggcaatccggaaacgaccaccggcggtaacgcgctcaagttttactcctcagtccgtctcgatatccgccgtaccggtgcgattaaaaaaggcgacgaggtcattggctccgagaccaaggtgaaggtgatcaagaacaaggttgcgccgccgttcaagcaggctgaatttgacatcatgtacggcgaaggtatttcccgtctgggcgaaatcattgagttgggtacaaatttgaaactggttgagaaatcaggtgcgtggtacagctacaacggtgaaaaaatcggccagggtaaagaaaacgctaaagagttcctgcgcgagaatccagcgattgcggcagaaattgaagccaagattcgcgacaactctaatgtgctggcagatagcatgactgcggccagaagtgaggacgattaagcagcttgcgccagccgattgaaaagtctctgcgtcagcgtgcgctggagtatttgagcaagcgggaatattctgcggtcgaattggcgcaaaagctt

SEQ ID NO: 2837 - protein, 342 aa, Methylomonas clara
MDDNKSKALAAALSQIEKQFGKGSIMRMGDADIGEDLQVVSTGSLGLDIALGVGGLPRGRIIEIYGPESSGKTTLTLSAIAEMQKLGGVAAFIDADDALDPQYASKLGVNVPELLISQPDTGEQALEIADMLVRSGSVDIVVVDSVAALTPRAEIEGEMGDSHMGLQARLMSQALRKLTGNIKRTNTLVIFINQIRMKIGVMFGNPETTTGGNALKFYSSVRLDIRRTGAIKKGDEVIGSETKVKVIKNKVAPPFKQAEFDIMYGEGISRLGEIIELGTNLKLVEKSGAWYSYNGEKIGQGKENAKEFLRENPAIAAEIEAKIRDNSNVLADSMTAARSEDD

SEQ ID NO: 2838 - DNA, 1065 bp, Enterobacter agglomerans
  CDS (1)..(1065)
atggctattgatgagaacaagcaaaaagcgttagctgcagcactgggccagattgaaaagcaattcggtaaaggctccatcatgcgtctgggtgaagatcgctctatggacgtcgaaacgatctctaccggctctttgtctttggatatcgcgttaggtgctggcggcttgccaatgggccgtatcgttgaaatttatggtccggaatcctccggtaaaaccacgctgactctgcaggttatcgctgctgcacagcgtgaaggcaaaacctgtgcgttcatcgatgcagaacacgcgctggaccctatctacgctaaaaaactgggcgtcgatatcgataacctgctgtgttctcagccagataccggtgaacaggctctggaaatctgtgatgcgctgacccgttcaggcgccgttgacgttatcatcgttgactccgttgccgcactgacgccaaaagctgaaatcgaaggcgaaattggtgactctcacatgggcctcgcagctcgtatgatgagccaggcgatgcgtaagcttgcgggtaacctgaaaaacgccaataccctgctgatcttcatcaaccagatccgtatgaaaatcggtgtgatgttcggtaacccggaaaccaccaccggcggtaacgccctgaaattctatgcctctgtacgtctggatatccgtcgtatcggcgctatcaaagaaggtgatgtggttgtcggtagtgaaacacgtgtgaaagtcgtgaagaacaaaatcgccgcaccatttaaacaagctgaattccagatcctgtacggcgaaggtatcaacatcaacggcgaactgatcgacctgggcgttaagcacaaactgatcgagaaagcgggtgcatggtacagttacaacggcgagaagattggtcagggtaaagcgaactcttgtaactacctcaaagaaaacccgaaagttgctgctgaactggacaaaaaactgcgtgatatgctgctgagcggcaccggtgaattgagcgttgcgactactgctgaagacgctgacgacaacatggaaaccagcgaagagttttaa

SEQ ID NO: 2839 - protein, 354 aa, Enterobacter agglomerans
MAIDENKQKALAAALGQIEKQFGKGSIMRLGEDRSMDVETISTGSLSLDIALGAGGLPMGRIVEIYGPESSGKTTLTLQVIAAAQREGKTCAFIDAEHALDPIYAKKLGVDIDNLLCSQPDTGEQALEICDALTRSGAVDVIIVDSVAALTPKAEIEGEIGDSHMGLAARMMSQAMRKLAGNLKNANTLLIFINQIRMKIGVMFGNPETTTGGNALKFYASVRLDIRRIGAIKEGDVVVGSETRVKVVKNKIAAPFKQAEFQILYGEGININGELIDLGVKHKLIEKAGAWYSYNGEKIGQGKANSCNYLKENPKVAAELDKKLRDMLLSGTGELSVATTAEDADDNMETSEEF

SEQ ID NO: 2840 - DNA, 1125 bp, Streptomyces lividans
  CDS (1)..(1125)
atggcaggaaccgaccgcgagaaggccctggacgccgcgctcgcacagattgaacggcaattcggcaagggcgcggtcatgcgcatgggtgaccggaccaacgagcccatcgaggtcatcccgaccgggtctaccgcgctcgacgtggccctcggcgtcggaggcatcccgcgtggccgtgtcgtggaggtctacggccccgagtcctcgggcaagacgaccctgaccctgcacgcggtggcgaacgcgcagaaggccggcggccaggtcgcgttcgtggacgccgagcacgccctcgaccccgagtacgcgaagaagctcggtgtcgacatcgacaacctgatcctgtcccagccggacaacggtgagcaggccctggagatcgtggacatgctggtccgctccggcgccctcgacctcatcgtcatcgactccgtcgccgcgctcgtcccgcgcgcggagatcgagggcgagatgggcgacagccacgtcggtctgcaggcccggctgatgagccaggccctgcggaagatcaccagcgcgctcaaccagtccaagaccaccgcgatcttcatcaaccagctccgcgagaagatcggcgtgatgttcggctccccggagaccacgaccggtggccgggcactgaagttctacgcctcggtgcgactcgacatccggcgtatcgagacgctgaaggacggcaccgacgcggtcggcaaccgcacccgcgtcaaggtggtcaagaacaaggtcgcgccgcccttcaagcaggccgagttcgacatcctctacggccagggcatcagccgcgagggcggtctgatcgacatgggcgtggagaacggcttcgtccgcaaggccggcgcctggtacacgtacgagggcgaccagctcggtcagggcaaggagaacgcgcgcaacttcctgaaggacaaccccgacctggccaacgagatcgagaagaagatcaagcagaagctgggcgtcggcgtgcaccccgaggagtcggccaccgagcccggcgcggacgccgcctccgccgccccggccgacgccgcaccggcggtgcccgcacccacgaccgccaaggccaccaagtccaaggccgcggcagccaagagctga

SEQ ID NO: 2841 - protein, 374 aa, Streptomyces lividans
MAGTDREKALDAALAQIERQFGKGAVMRMGDRTNEPIEVIPTGSTALDVALGVGGIPRGRVVEVYGPESSGKTTLTLHAVANAQKAGGQVAFVDAEHALDPEYAKKLGVDIDNLILSQPDNGEQALEIVDMLVRSGALDLIVIDSVAALVPRAEIEGEMGDSHVGLQARLMSQALRKITSALNQSKTTAIFINQLREKIGVMFGSPETTTGGRALKFYASVRLDIRRIETLKDGTDAVGNRTRVKVVKNKVAPPFKQAEFDILYGQGISREGGLIDMGVENGFVRKAGAWYTYEGDQLGQGKENARNFLKDNPDLANEIEKKIKQKLGVGVHPEESATEPGADAASAAPADAAPAVPAPTTAKATKSKAAAAKS

SEQ ID NO: 2842 - DNA, 1347 bp, Rhodobacter sphaeroides
  CDS (220)..(1251)
cccgggtgccaagtacccgcggccttaaactagcccttaaccgctttggtcgaaagctgcatctgccggagaaaccggttgcaatgttcgccttatgatcccatattgcttcggaacatagggcgaactcgcgaagcgattgctgccttggcgcggctatggaataaggaacaggacatggcgacggcgaacctgctcgacttgaacggaaggcgcgagatggacaaggcgaaggcgctcgaaagcgcgctggcacagatcgaacggcagttcggcaagggctcgatcatgaaactgggggccaacagcccggtcatggagatcgaggcgacttcgacgggctcgctgggtctcgatatcgcgctcggcatcggcggtctgcccaaggggcgaatcatcgagatctacggccccgaaagctcgggcaagaccacgctgaccctgcatgtggtggcggaagagcagaagaagggtggcgtctgcgccttcgtggacgccgaacatgctctcgacccgcaatatgccaagaagctcggcgtcaacctggacgaactcctcatcagccagcccgacacgggcgagcaggcgctcgagatcgtcgacacgctggtccggtccggcgcggtgaacctgatcgtggtcgactcggtggcggcgctgacgcccaagtccgagatcgagggcgacatgggcgacatgcagatgggctcgcaggcccgcctgatgagccaggccatgcggaagctgaccgcatccatcggccggtcgaactgcatggtgatcttcatcaaccagatccgcatgaagatcggcgtgatgttcggcaaccccgagacgacgacgggcggcaacgcgctgaagttttacgcctccgtgcgcctcgacattcgccggaccggtgccatcaaggaccgcgacaatgtcatcggcaacacgacgaaggtgaaggtggtcaagaacaaggtggccccgcccttccgcgaggtcgagttcgacatcatgtatggcgagggcatttcgaagacgggcgagctcgtcgatctcggcgtcaaggccggcgtggtcgagaagtcgggctcctggtattcctacggcgacgagcggatcgggcaggggcgcgagaatgccaaggccttcctgcgcgcgaaccccacggttgccggcgatatcgaagatcggattcgcgcctcgcatgggctggacttctcgaccggggaagacggcaagggcgacgatctggtggacatgtgacgctcgcgcgcgtcgaggtggacagcctcggcgcgcagggctaaacgagacggcgaaccgcagatctgcctgacagaggcttcctcatgccgtcct

SEQ ID NO: 2843 - protein, 343 aa, Rhodobacter sphaeroides
MDKAKALESALAQIERQFGKGSIMKLGANSPVMEIEATSTGSLGLDIALGIGGLPKGRIIEIYGPESSGKTTLTLHVVAEEQKKGGVCAFVDAEHALDPQYAKKLGVNLDELLISQPDTGEQALEIVDTLVRSGAVNLIVVDSVAALTPKSEIEGDMGDMQMGSQARLMSQAMRKLTASIGRSNCMVIFINQIRMKIGVMFGNPETTTGGNALKFYASVRLDIRRTGAIKDRDNVIGNTTKVKVVKNKVAPPFREVEFDIMYGEGISKTGELVDLGVKAGVVEKSGSWYSYGDERIGQGRENAKAFLRANPTVAGDIEDRIRASHGLDFSTGEDGKGDDLVDM

SEQ ID NO: 2844 - DNA, 1065 bp, Vibrio cholerae
  CDS (1)..(1065)
atggacgagaataaacagaaggcacttgcggccgccctcggtcaaattgaaaagcaatttggtaaaggctccatcatgcacttaggcgacaaccgcgcgatggatgtagaaaccatttcgaccggttctctgtctctggatatcacgttgggttctggtggtctacccatgggacgtatcgttgagatcctcggccctgaatcttcgggtaaaacgacactgactctggaactgattgctgctgcacaacgtgaaggtaaaacctgtgcgtttatcgataccgagcacgcactggatccggtttatgccaaaaaattgggcgtgaatatcgatgagctactggtttctcagccagataccggcgagcaagcactggaaatttgtgatgcactggctcgctctggtgctgtggatgtcatcgttgttgactcagtagcggctttgacaccaaaagcggaaattgaaggcgaaatgggcgatagccacatgggtctgcaagcgcgtatgttgtcgcaagcaatgcgtaaactgacgggtaacctcaagcaatccaactgtatgtgtatcttcatcaaccaaattcgtatgaagattggtgtgatgtttggtaacccagaaactaccactggcggtaacgcactgaaattctacgcttctgttcgtttggatattcgccgtactggcgcaatcaaagaaggcgaagaagtggtgggtaacgaaacccgtatcaaggttgtgaagaacaagattgctgcgccgtttaaagaagcgaacactcagatcatgtatggccaaggtttcaatcgtgaaggtgaattgatcgatcttggtgtgaaacacaaaatggttgagaagtcaggcgcttggtacagctataacggcgataaaatcggccaaggtaaagcgaatgcctgcaagtatctgaaagaaaacccagaaattgcgaaaactctagataaaaaactgcgtgaaatgctgttaaacccagaaaacatgcagctgatcgctgaaacatcttctgcggcggatgacgtcgaatttggcgcggtgccagaagagttttaa

SEQ ID NO: 2845 - protein, 354 aa, Vibrio cholerae
MDENKQKALAAALGQIEKQFGKGSIMHLGDNRAMDVETISTGSLSLDITLGSGGLPMGRIVEILGPESSGKTTLTLELIAAAQREGKTCAFIDTEHALDPVYAKKLGVNIDELLVSQPDTGEQALEICDALARSGAVDVIVVDSVAALTPKAEIEGEMGDSHMGLQARMLSQAMRKLTGNLKQSNCMCIFINQIRMKIGVMFGNPETTTGGNALKFYASVRLDIRRTGAIKEGEEVVGNETRIKVVKNKIAAPFKEANTQIMYGQGFNREGELIDLGVKHKMVEKSGAWYSYNGDKIGQGKANACKYLKENPEIAKTLDKKLREMLLNPENMQLIAETSSAADDVEFGAVPEEF

SEQ ID NO: 2846 - DNA, 1068 bp, Rhodobacter capsulatus
  CDS (1)..(1068)
atggcaacgacgggcttgttcgagatgaacgacaaaggcaaggcagacaagcaaaaggcgctggaatgcgcccttgcgcagatcgaacggcagttcggcaagggctcgatcatgaagcttggcggcgacaccccgccgccggagatcgaggccacctcgaccggctcgcttggcctggacattgcgcttggcatcggcggtctgccgaaggggcggatcgtcgagatctacgggccggaaagctcggggaagaccacgctgacgctgcattgcattgcggaagaacagaaaaagggcggagtctgcgcctttgtcgacgccgaacatgcgcttgacccctattatgcgaagaagctaggcgtcagtctggaagatctgctgatctcgcagcccgacaccggggaacaggcgctggaaatcgtcgacacgctggtgcgctcgggcgcggtgagcctggtcgtcgtcgactcggtggcggcgctgacgccgaaggccgagatcgagggcgacatgggcgatgcgaccgtgggcgcgcaggcccggctgatgagccaggcgatgcggaaactgaccgcctcgatcggtcggtcgaactgcatggtgatcttcatcaaccagatccggatgaagatcggcgtgatgttcggctcgcccgagacgacctcgggcggcaatgcgctgaaattctacgcttcggtgcgtctggacatccgccgcaccggcgcgatcaaggaccgcgacgaggtgatcggcaaccagacccgggtcaaggtggtgaagaacaaggtggcgccgcccttccgcgaggtcgaattcgacatcctttacggcgagggcatttccaaggtcggcgagctggtcgatctgggcgtcaaggcgggcgtggtggcgaaatcgggcgcctggtattcctatggcgacgagcgcatcggccagggccgcgagaatgccaagcaattcctgcgcgacaatcccgacatcgcctatgagatcgaggacaagatccgggccagccacgggctggaattcggtgtcgatccgaccgcggaagatctgaccgaagagtaa

SEQ ID NO: 2847 - protein, 355 aa, Rhodobacter capsulatus
MATTGLFEMNDKGKADKQKALECALAQIERQFGKGSIMKLGGDTPPPEIEATSTGSLGLDIALGIGGLPKGRIVEIYGPESSGKTTLTLHCIAEEQKKGGVCAFVDAEHALDPYYAKKLGVSLEDLLISQPDTGEQALEIVDTLVRSGAVSLVVVDSVAALTPKAEIEGDMGDATVGAQARLMSQAMRKLTASIGRSNCMVIFINQIRMKIGVMFGSPETTSGGNALKFYASVRLDIRRTGAIKDRDEVIGNQTRVKVVKNKVAPPFREVEFDILYGEGISKVGELVDLGVKAGVVAKSGAWYSYGDERIGQGRENAKQFLRDNPDIAYEIEDKIRASHGLEFGVDPTAEDLTEE

SEQ ID NO: 2848 - DNA, 1533 bp, Helicobacter pylori
  CDS (275)..(1318)
aagcttatcgcgctcacatcataagtgttttttagggcttcttggtttagggtttcaatatcaagggcaatgttgtggaatgttttattcttaatggggcaatctatccagccaaacttaatcgcataatacatgaaaatatcatcagcatcagggctatgagcgacactaatcaaagtaaaatccttttgtgatagggtaagtccttttattataatagattttaggctaggatttgatagaataaacaaatcaaattcaataaggtaatttaatggcaatagatgaagacaaacaaaaagcgatttctttagcgatcaaacaaattgataaggtttttggtaagggggcgttggtgcgccttggggataagcaagtagaaaagattgacgctatttctacaggctcgttaggattggatttagctttagggattgggggcgttccaaagggcaggatcattgaaatttatgggccagagtcaagcgggaagaccactttaagcttgcatattatcgcagaatgccaaaaaaatggcggcgtgtgcgcattcattgacgctgagcatgccctagatgtgcattatgctaagagactaggcgtggatacgcaaaatctactcgtttcccaacctgatacaggcgagcaagctttagagattttagaaacgatcacaagaagcggagggattgatttagtggtggtggattcggtggcggcccttacgcctaaagcagagattgatggggatatgggcgatcagcatgtgggcttgcaagcaaggcttatgagccatgcgttaagaaaaatcaccggtgttttgcacaagatgaacactactctcatttttatcaatcaaatcaggatgaagattggcatgatgggttatgggagtccagagactacaaccgggggtaatgccttaaaattctatgcgagcgttaggattgatattagaagaatcgccactttaaaacaaaacgaacagcatattggcaatagggctaaagccaaagtggttaaaaataaagtcgctccgccctttagagaagcggaatttgacatcatgtttggggaagggatttctaaagagggcgaaatcattgattatggcgtgaaattagacattgtggataagagtggggcatggcttagctaccaggataaaaagctagggcaaggcagagaaaacgctaaagccctactcaaagaagataaagccttagcggatgaaatcactcttaagattaaagagagtattggctctaatgaagagatcatgcctttacccgatgagcctttagaagaaatggaataaaaaggattttgatgctaaccattaaagacattcatgctttagaagtgatggatagtaggggcaatcctaccattcaagccagcgtgattttaagcgataacactaaggcgagtgcgattgtgcctagcggggcgagcaccggtaaaagagaagcgttagaattaagggataatgacaaaacccgttttttgggtaaaggggttttgagggcatgc

SEQ ID NO: 2849 - protein, 347 aa, Helicobacter pylori
MAIDEDKQKAISLAIKQIDKVFGKGALVRLGDKQVEKIDAISTGSLGLDLALGIGGVPKGRIIEIYGPESSGKTTLSLHIIAECQKNGGVCAFIDAEHALDVHYAKRLGVDTQNLLVSQPDTGEQALEILETITRSGGIDLVVVDSVAALTPKAEIDGDMGDQHVGLQARLMSHALRKITGVLHKMNTTLIFINQIRMKIGMMGYGSPETTTGGNALKFYASVRIDIRRIATLKQNEQHIGNRAKAKVVKNKVAPPFREAEFDIMFGEGISKEGEIIDYGVKLDIVDKSGAWLSYQDKKLGQGRENAKALLKEDKALADEITLKIKESIGSNEEIMPLPDEPLEEME

SEQ ID NO: 2850 - DNA, 1065 bp, Synechocystis sp
  CDS (1)..(1065)
atggccagcaccaacatttccgaccgtgaaaaagccctcaacgccgccctagcccagattgagcggagcttcgggaagggagcgattatgcgcttgggagatgccacccaaatgcgagttgaaaccatttccactggggctctaactttggatttggccctggggggcggtttgcccaagggtcggattgtggaaatttacggcccggaaagttccgggaagaccaccttggccctccatgcggtggcggccacccaacaggcggggggagtcgcggcctttgtcgatgcagaacacgcccttgaccccgtttattccaaagccctgggggtggacattgataatttattggtggcccaaccagataacggcgaatcagccttggaaattgttgaccagttggtgcgttccactgcggtggatatcattgtggtggattccgtggcggccctagtgccccgggcggaaattgaaggggaaatgggggatacttcggtgggttcccaagctcgcttgatgagtaaagccatgcggaaaattgctggtaatatcgggcgatcgggttgtttggtaattttcctcaaccagttacggcaaaaaattggtgtgacctacggcagtcccgaagtgaccaccggaggtaatgccctgaaattctacgcctccgtacgtttagatattcgccgcattcaaaccctgaaaaaaggcaccgaaggggaatacggtatccgagccaaagtgaaagtggctaaaaacaaagtggctccccccttccgcatcgctgaatttgacattatttttggccagggcatttcccgcatgggttgcaccatcgacctggcggaaaaatgcgaagtcatcacccgcaaaggggcttggtatagctataacggcgaaaacattgcccagggtcgggataatgccatgaaatatttagaggaaaatcctgaaatcgccgctaccatcgaccaacaggtgcgggaaaaattatctttagttaatgcggttttcccggtggaaacagaggatggagcggaagagcagggggaagatggggatttttag

SEQ ID NO: 2851 - protein, 354 aa, Synechocystis sp
MASTNISDREKALNAALAQIERSFGKGAIMRLGDATQMRVETISTGALTLDLALGGGLPKGRIVEIYGPESSGKTTLALHAVAATQQAGGVAAFVDAEHALDPVYSKALGVDIDNLLVAQPDNGESALEIVDQLVRSTAVDIIVVDSVAALVPRAEIEGEMGDTSVGSQARLMSKAMRKIAGNIGRSGCLVIFLNQLRQKIGVTYGSPEVTTGGNALKFYASVRLDIRRIQTLKKGTEGEYGIRAKVKVAKNKVAPPFRIAEFDIIFGQGISRMGCTIDLAEKCEVITRKGAWYSYNGENIAQGRDNAMKYLEENPEIAATIDQQVREKLSLVNAVFPVETEDGAEEQGEDGDF

SEQ ID NO: 2852 - DNA, 1351 bp, Arabidopsis thaliana (mouse-ear cress)
  CDS (1)..(1320)
atggattcacagctagtcttgtctctgaagctgaatccaagcttcactcctctttctcctctcttccctttcactccatgttcttctttttcgccgtcgctccggttttcttcttgctactcccgccgcctctattctccggttaccgtctacgccgcgaagaaactctcccacaaaatcagttctgaattcgatgacagaatcaacggcgctctctctcccgacgctgattcccgcttcctcgaccgccaaaaggctttagaggcagctatgaatgacattaacagttcatttggtaaaggaagtgtaacaagattggggagtgctggtggagcattagtggagaccttttcgagtggtattttgactcttgatcttgctttaggtggaggcctaccaaagggtcgggtagtcgaaatatatggaccagaaagtagtggcaagaccacgctagcactccatgctattgctgaagtgcagaagcttggaggcaatgcaatgcttgttgatgcagagcatgcctttgatccagcgtattctaaagcattaggtgttgatgtagaaaatttgatagtgtgccagccagataatggcgagatggctttagaaactgcagaccgtatgtgtcgctcaggtgcggttgaccttatatgtgttgattctgtttcagcacttactccacgagctgagattgaaggtgagattggaatgcagcaaatgggtttgcaagctcgtcttatgagtcaagctcttcgtaaaatgtcaggaaacgcctctaaagctgggtgtactcttattttcctaaaccaaataagatacaagattggtgtgtactatgggaatccagaggtgactagcggaggaattgcgttaaagttcttcgcgtcggtccgtctagaaattcgttctgctgggaagatcaaatctagcaaaggggatgaagatattggtcttcgggctcgtgtaagagtgcagaagagcaaggtttcaagaccgtataagcaagcagagtttgagattatgtttggggaaggagtcagtaaactgggatgcgttcttgattgtgctgaaattatggaagttgtggtcaagaaaggttcctggtacagctacgaagaccaaaggctcgggcaaggaagagagaaagcactgcagcacttaagggaaaaccctgctcttcaagacgaaattgagaagaaagtgagattgttgatgttagatggagaagttcatcgatcaactcctttgatgagcagcagctcttcctcggcttcacatcgcgaagaagaagaagaagactcgcttgacgatttccaatgacataacacttaagcttgagactttcggatct

SEQ ID NO: 2853 - protein, 439 aa, Arabidopsis thaliana (mouse-ear cress)
MDSQLVLSLKLNPSFTPLSPLFPFTPCSSFSPSLRFSSCYSRRLYSPVTVYAAKKLSHKISSEFDDRINGALSPDADSRFLDRQKALEAAMNDINSSFGKGSVTRLGSAGGALVETFSSGILTLDLALGGGLPKGRVVEIYGPESSGKTTLALHAIAEVQKLGGNAMLVDAEHAFDPAYSKALGVDVENLIVCQPDNGEMALETADRMCRSGAVDLICVDSVSALTPRAEIEGEIGMQQMGLQARLMSQALRKMSGNASKAGCTLIFLNQIRYKIGVYYGNPEVTSGGIALKFFASVRLEIRSAGKIKSSKGDEDIGLRARVRVQKSKVSRPYKQAEFEIMFGEGVSKLGCVLDCAEIMEVVVKKGSWYSYEDQRLGQGREKALQHLRENPALQDEIEKKVRLLMLDGEVHRSTPLMSSSSSSASHREEEEEDSLDDFQ

SEQ ID NO: 2854 - DNA, 1392 bp, Pseudomonas putida
  CDS (111)..(1178)
cgagtaaatcgacgacaggggtttgcgtgagcgccggcctgtggaataatactggctacttatacaggtattccggccgtcagggccacgtcgaacacgtgaggatttcaatggacgacaacaagaagcgcgccttggctgcggccctgggtcagatcgaacgccaattcggtaaaggcgcagtcatgcgcatgggcgaccacgagcgccaggcgatcccggccatctccaccggttcgctgggcctggacatcgcactgggcattggcggcctgccaaaaggccgtatcgtcgagatctacggcccggaatcgtcgggtaaaaccacgctgaccctgtcggtcatcgccgaagcccagaaaaacggcgccacctgcgccttcgtcgacgccgagcacgccctcgaccctgaatacgcgggcaagctgggcgtcaacgtagacgacctgctggtttcgcagccggacaccggcgaacaggccctggaaatcaccgacatgctggtgcgttccaacgcggttgacgtgatcatcgtcgactccgtggccgccctggtgccgaaggccgagatcgaaggcgaaatgggtgacatgcacgtgggcctgcaggctcgcctgatgtcccaggcgctgcgcaaaatcaccggtaacatcaagaacgccaactgcctggtcatcttcatcaaccagatccgtatgaagatcggcgtaatgttcggcagcccggaaaccaccaccggtggtaacgccctgaaattctacgcctcggtgcgcctggacatccgtcgaacgggtgcggtcaaggaaggcgacgaggtggtcggcagcgaaacccgcgtcaagatcgtcaagaacaaggtttcgccaccgttccgtcaggccgagttccagatcctctacggcaagggtatctaccgcaatggcgaaatcatcgacctgggtgtttcccaaggtctggtcgagaagtccggtgcctggtatgcctatcaaggcaacaagattggacaaggtaaagccaacgccgccaagtacctggctgagaacccggcgattggtgccgagatcgagaagcagattcgcgacaagttgctgacttctggcgctgtcgctgcggctggcaaagctgcggctgtcgaagcagatgccgatgacatggccgacgctgacgccggttattgattgcgcggtagatagctgaacatgtccgccgtactcgacacccccgtcgccattcggcggacagccatggacctgctcgcgcgacgtgagcacggtcgcgttgagctgacgcgcaagctgcgtcagcgcggcgcttcggatgagctgatcgagcctgagctcgatcggctcgccgaagaagggctgctgagtgaagcccgctaccttgaaagct

SEQ ID NO: 2855 - protein, 355 aa, Pseudomonas putida
MDDNKKRALAAALGQIERQFGKGAVMRMGDHERQAIPAISTGSLGLDIALGIGGLPKGRIVEIYGPESSGKTTLTLSVIAEAQKNGATCAFVDAEHALDPEYAGKLGVNVDDLLVSQPDTGEQALEITDMLVRSNAVDVIIVDSVAALVPKAEIEGEMGDMHVGLQARLMSQALRKITGNIKNANCLVIFINQIRMKIGVMFGSPETTTGGNALKFYASVRLDIRRTGAVKEGDEVVGSETRVKIVKNKVSPPFRQAEFQILYGKGIYRNGEIIDLGVSQGLVEKSGAWYAYQGNKIGQGKANAAKYLAENPAIGAEIEKQIRDKLLTSGAVAAAGKAAAVEADADDMADADAGY

SEQ ID NO: 2856 - DNA, 1053 bp, Mycobacterium tuberculosis
  CDS (1)..(1053)
atgacgcagacccccgatcgggaaaaggcgctcgagctggcagtggcccagatcgagaagagttacggcaaaggttcggtgatgcgcctcggcgacgaggcgcgtcagccgatttcggtcattccgaccggatccatcgcactagacgtggccctgggcattggcggcctgccgcgtggccgggtgatagagatatacggcccggagtcgtcgggtaagaccaccgtggcgctgcacgcggtggccaacgctcaggccgccggtggtgttgcggcgttcatcgacgccgagcacgcgctggatccggactatgccaagaagctcggtgtcgacaccgattcgctgctggtcagccagccggacaccggggaacaggcactcgagatcgccgacatgctgatccgctcgggtgcgcttgacatcgtggtgatcgactcggtggcggcgctggtgccgcgcgcggagctcgaaggcgagatgggcgacagccacgtcgggctgcaggcccggctgatgagccaggcgctgcggaaaatgaccggcgcgctgaataattcgggcaccacggcgatcttcatcaaccagctccgcgacaagatcggagtgatgttcgggtcgcccgagacgacaacgggcggaaaggcgttgaagttctacgcgtcggtgcgcatggacgtgcggcgagtcgagacgctcaaggacggtaccaacgcggtcggcaaccgcacccgggtcaaggtcgtcaagaacaagtgttcgccccccttcaagcaggccgagttcgacatcctctacggcaagggaatcagcagggagggctcgctgatcgacatgggtgtggatcagggcctcatccgcaagtcgggtgcctggttcacctacgagggcgagcagctcggccagggcaaggagaatgcccgcaacttcttggtggagaacgccgacgtggctgacgagatcgagaagaagatcaaggaaaagcttggcattggtgccgtggtgaccgatgatccctcaaatgacggtgtcctgcccgcccccgtcgacttctga

SEQ ID NO: 2857 - protein, 350 aa, Mycobacterium tuberculosis
MTQTPDREKALELAVAQIEKSYGKGSVMRLGDEARQPISVIPTGSIALDVALGIGGLPRGRVIEIYGPESSGKTTVALHAVANAQAAGGVAAFIDAEHALDPDYAKKLGVDTDSLLVSQPDTGEQALEIADMLIRSGALDIVVIDSVAALVPRAELEGEMGDSHVGLQARLMSQALRKMTGALNNSGTTAIFINQLRDKIGVMFGSPETTTGGKALKFYASVRMDVRRVETLKDGTNAVGNRTRVKVVKNKCSPPFKQAEFDILYGKGISREGSLIDMGVDQGLIRKSGAWFTYEGEQLGQGKENARNFLVENADVADEIEKKIKEKLGIGAVVTDDPSNDGVLPAPVDF

SEQ ID NO: 2858 - DNA, 1053 bp, Wolinella succinogenes
  CDS (1)..(1053)
atggcactagatgagaacaaacgcaaagcgatcgatctagcgatcaaacagattgacaaggcctttggcaaaggcgccctcgtgcgacttggcgaaaaacccgtggaaaagatcgattcgattagcacgggctcattagggctcgacattgccctaggaatcggaggaatcccccaaggaagaatcatcgaaatctatggacctgagagctctggaaagaccacgctcgcacttcaagtgatcgctgagtgtcaaaaaaagggcggaatctgcgcttttatcgatgccgagcacgccctagatgtctcctacgccaaacgccttggggtggatgcagagaatcttcttgtctcccagcctgattatggtgaacaggcgttagagattctagagaccctcacacgaagcggagcggtcgatctcatcgtggtcgattcggtggctgccctcacccccaaaagtgaaattgatggcgatatgggcgatcaacacgtagggctccaagcacgcctcatgagccaagccctgcgaaaagtcacgggcgtgctccacaagatgaacaccaccgtgattttcatcaaccaaatccgtatgaaaatcggaatgatgggctatggaagccctgagacgaccacaggcggaaatgcgctcaaattctatgctagcgtgagaatcgatgtaagaagaatcgcctccctcaaacagggcgaacagcacattgggaatcgcgtcaaagccaaagtggtcaaaaacaaagtcgcgcccccctttagagaagcagaatttgacattatgtttggtgagggaatcagccaagaaggcgagctcatcgactatggcgtgaaactggacattgtcgataagagcggctcatggctcagttatggtgacaaaaaattaggtcaaggcaaagagaatgccaaagcctttttgaaagaaaacaaagaaattgcaaatgaaattcaggctaaaattatcggcgccatcggctcaagtgatgaaatcactacttttggggacgatgaagacgaatcagaaaacctagaatcataa

SEQ ID NO: 2859 - protein, 350 aa, Wolinella succinogenes
MALDENKRKAIDLAIKQIDKAFGKGALVRLGEKPVEKIDSISTGSLGLDIALGIGGIPQGRIIEIYGPESSGKTTLALQVIAECQKKGGICAFIDAEHALDVSYAKRLGVDAENLLVSQPDYGEQALEILETLTRSGAVDLIVVDSVAALTPKSEIDGDMGDQHVGLQARLMSQALRKVTGVLHKMNTTVIFINQIRMKIGMMGYGSPETTTGGNALKFYASVRIDVRRIASLKQGEQHIGNRVKAKVVKNKVAPPFREAEFDIMFGEGISQEGELIDYGVKLDIVDKSGSWLSYGDKKLGQGKENAKAFLKENKEIANEIQAKIIGAIGSSDEITTFGDDEDESENLES

SEQ ID NO: 2860 - DNA, 1110 bp, Vibrio vulnificus
  CDS (1)..(1110)
atgtcgaccctatttcgacataattacctatcacctgagagtgactatctggagagagtaatggacgagaacaaacagaaggcactggccgccgcactaggtcaaattgaaaagcagttcggtaaaggttcaatcatgcgcctaggtgacaaccgtgcgatggatgttgaaaccatctcgacaggttcactatctctggatattgcgctgggtgctggtggcttaccaatgggccgtatcgttgaaatttttggtccagaatcttcaggtaaaaccacgttgacccttgagctgatcgctgcggctcaacgtgaaggcaaaacttgtgcgtttatcgatgccgagcacgcgttggatcctgtgtatgcgaagaagcttggcgttaatatcgaccagttgttggtatctcagcctgacaccggtgaacaagcattggaaatctgtgatgctcttgctcgctcaggtgcggttgacgttattgttgtcgactctgttgcagcattgacgccaaaggcagaaatcgaaggtgagatgggcgactcgcacatgggtcttcaagctcgtatgctatctcaagcgatgcgtaagttaacgggtaacctaaagcagtctaactgtatgtgtatcttcatcaaccagatccgtatgaagatcggtgtgatgtttggtaacccagaaaccacaacgggtggtaatgctctgaaattctacgcttctgttcgtcttgatattcgccgtactggtgcgatcaaagaaggtgatgaggtcgtgggtaacgaaacgcgcatcaaagtggtgaagaataagatcgctgcgccgtttaaagaagccaacactcaaattatgtacggccaaggctttaaccgcgaaggtgaactgattgacctaggcgtgaaatgtaagctgattgaaaaatcaggcgcttggtacagctataacggcgacaaaattggccaaggtaaagcgaacgcttgtaaatacctgaaagaaaacgtagatgtcgcaaaagtactggatacgaaattgcgtgaaatgttgctttctccagcaaacatcaacgatgaatcggcagagttagtcgaagaaatgccagagcaagaagagttttaa

SEQ ID NO: 2861 - protein, 369 aa, Vibrio vulnificus
MSTLFRHNYLSPESDYLERVMDENKQKALAAALGQIEKQFGKGSIMRLGDNRAMDVETISTGSLSLDIALGAGGLPMGRIVEIFGPESSGKTTLTLELIAAAQREGKTCAFIDAEHALDPVYAKKLGVNIDQLLVSQPDTGEQALEICDALARSGAVDVIVVDSVAALTPKAEIEGEMGDSHMGLQARMLSQAMRKLTGNLKQSNCMCIFINQIRMKIGVMFGNPETTTGGNALKFYASVRLDIRRTGAIKEGDEVVGNETRIKVVKNKIAAPFKEANTQIMYGQGFNREGELIDLGVKCKLIEKSGAWYSYNGDKIGQGKANACKYLKENVDVAKVLDTKLREMLLSPANINDESAELVEEMPEQEEF

SEQ ID NO: 2862 - DNA, 1068 bp, Photorhabdus luminescens
  CDS (1)..(1068)
atggctattgatgaaaataaacaaaaagcactagcagcggcactcggccaaattgaaaaacagtttggtaaaggttccatcatgcgtttgggcgaagaccgttcaatggacgttgaaactatctccacgggttcattatcactggatattgcattaggtgctggtggtctgccgatggggcgtattgttgaaatctatggcccggaatcttcgggtaagacaacgctgacattacaggttattgctgcggcacaacgtgaaggtaaaacctgtgcgtttattgatgctgaacacgctcttgatcccatctatgctaagaagttgggtgttgatattgataacttgttgtgttctcaacccgatacgggggaacaggctcttgagatctgtgatgcgttgactcgctccggcgctgttgatgtcattatcgtagactccgttgccgctttaacgccaaaagccgaaatagaaggagaaattggtgattctcatatggggctggccgctcgaatgatgagtcaggcaatgcgtaaactggccggtaacttgaaaagttctaatacgttgttgatctttatcaaccagattcgtatgaaaattggtgtcatgtttggtaaccctgaaactaccaccggtggtaacgcgctgaaattctatgcttctgttcgtctggatattcgccgcattggttctgtgaaaaatggtgaagaggtcgttggtagcgagacccgtgttaaggtggtaaaaaacaaagtggcagcgccatttaagcaagcagaattccagattatgtatggtgaaggcattaacacttatggtgaattaatcgatttaggtgtgaagcataaactggtggaaaaagcaggcgcatggtacagctataatggcgataaaattggtcaaggcaaagcgaatgctaccatctatctgaaagagcatcctgaagttgctactgagctggataaaaaattacgtgaaatgctgttgcacaatgccggcgaattcaatagtgctgcttctgattatgaagacaatgaaaatgaagagatgaataacgaagaattctaa

SEQ ID NO: 2863 - protein, 355 aa, Photorhabdus luminescens
MAIDENKQKALAAALGQIEKQFGKGSIMRLGEDRSMDVETISTGSLSLDIALGAGGLPMGRIVEIYGPESSGKTTLTLQVIAAAQREGKTCAFIDAEHALDPIYAKKLGVDIDNLLCSQPDTGEQALEICDALTRSGAVDVIIVDSVAALTPKAEIEGEIGDSHMGLAARMMSQAMRKLAGNLKSSNTLLIFINQIRMKIGVMFGNPETTTGGNALKFYASVRLDIRRIGSVKNGEEVVGSETRVKVVKNKVAAPFKQAEFQIMYGEGINTYGELIDLGVKHKLVEKAGAWYSYNGDKIGQGKANATIYLKEHPEVATELDKKLREMLLHNAGEFNSAASDYEDNENEEMNNEEF

SEQ ID NO: 2864 - DNA, 1110 bp, Gloeobacter violaceus
  CDS (1)..(1110)
atggcccgcaccacagacgattccaaaaaggccgcccccgcggccggtaccgccgacgaagcccaaaagcaaaaagcgctcaagatggtgctcacccagatcaagcgcaacttcggcgaaggggcaatcatgcgcctgggcgagaacacgcgcattcgggtggagacggtgccgagcggcgccatcaccctcgatctggccctgggaggcggtctgcccagaggtcgggtcatcgaaatttatggtcctgagtcctcgggcaagacgacgctggctttgcatgccatcgccgagatccaaaaaaccggcggtgtggcggccttcgtggacgccgagcacgccctcgatccggcctacgccaaggtgctgggcgtcaatgtagatgatctcatcatctcccagcccgacaccggcgagatggctatggagatcgtcgatcagctggtacgctcggccgccatcgacgtcatcgtcatcgactcggtggccgccctggtgccgcgcgccgagatcgaaggcgagatgggcgacgcccacgtcggtctgcaggcgcggctgatgagccaggctttgcgcaagatcacaggcaacatcggcaagaccggctgcatggtgattttcctcaaccagctgcgctccaaaattggcgtgatgtacggcaaccccgagaccaccaccggcggcaatgccctcaagttctacgcctcggtgcgcctggatatccgcaaggccgagaccctcaaaaaaggccaggacgagtacggcaaccgcgtgcgggtcaaggtggtcaaaaacaaggtcgccccgccgttccgcaaagccgagttcgacatcatcttcggcaagggcatctcctcgctgggctgcatcctcgatctggccgtcgagatggagatcgtcgagcgcaagggcgcctggtactcctacggcagcgagcggctcggccaaggccgcgagaacgtgctggcgctccttgaggagaatgccgcccaggcccaggagatcgagatcaaggtgcgcgagaagatcgcgagcggtgccgccgttccggccgctgctgtggctgctccggacgagggcgacgacgatctgggcgacgaagaagtctag

SEQ ID NO: 2865 - protein, 369 aa, Gloeobacter violaceus
MARTTDDSKKAAPAAGTADEAQKQKALKMVLTQIKRNFGEGAIMRLGENTRIRVETVPSGAITLDLALGGGLPRGRVIEIYGPESSGKTTLALHAIAEIQKTGGVAAFVDAEHALDPAYAKVLGVNVDDLIISQPDTGEMAMEIVDQLVRSAAIDVIVIDSVAALVPRAEIEGEMGDAHVGLQARLMSQALRKITGNIGKTGCMVIFLNQLRSKIGVMYGNPETTTGGNALKFYASVRLDIRKAETLKKGQDEYGNRVRVKVVKNKVAPPFRKAEFDIIFGKGISSLGCILDLAVEMEIVERKGAWYSYGSERLGQGRENVLALLEENAAQAQEIEIKVREKIASGAAVPAAAVAAPDEGDDDLGDEEV

SEQ ID NO: 2866 - DNA, 1053 bp, Chromobacterium violaceum
  CDS (1)..(1053)
atggcttccgaagacaagagcaaggcgctggccgctgccctggcccagattgaaaagcaatttggcaagggctcgatcatgcgcatgagcgacaaccagatcaccgaaaacctgcaagtgatctccaccggctcgctgaccctggacctggcgctgggcgtcggcggcctgccgcgcggccgcgtggtcgaaatctacggcccggagtcgtcgggtaaaaccaccttgtgtctgcaggccgtggccgaggcgcaaaaactgggcggcacctgcgcctacatcgacgccgaaaacgcgctggacccggtttacgcgcagaagctgggcgtcaacgtcgaagacctgctgatctcgcagccggacaccggcgagcaggcgctggaaatctgcgacatgctggttcgctccagcggcgtggacgtgatcgtggtcgactccgtcgccgcgctggtgcccaaggctgaaatcgagggcgagatgggcgacagccacgtcggcctgcaggcccgcctgatgagccaggcgctgcgcaagctgaccggcaacatcaagcgcaccaacaccctggtgatcttcatcaaccagatccgcatgaagatcggcgtgatgttcggcaacccggaaaccaccaccggcggcaacgcgctgaagttctacgcctccgtgcgcctggacatccgccgcaccggcggcatcaagaagggcgacgaagtgatcggcaacgacactcgcgtcaaagtggtgaagaacaaggtgtccccgccgttccgccaggccgatttcgaaatcctgtacggcgagggcatctcgcgccagggcgaaatcatcgagctgggcgtcaagcacggcttcatcgacaagtccggcgcctggtacgcgtacaacggccagaagatcggccagggcaaggacaacacccgcgaatggctgaaagccaacccggccatcgccgacgagatcgagcgcaagatccgcgaagcggtgggcgtgaagatcgaaatcaacgaaaaccagggcgacgaagagttcgccgacgacgccttcgacgcctga

SEQ ID NO: 2867 - protein, 350 aa, Chromobacterium violaceum
MASEDKSKALAAALAQIEKQFGKGSIMRMSDNQITENLQVISTGSLTLDLALGVGGLPRGRVVEIYGPESSGKTTLCLQAVAEAQKLGGTCAYIDAENALDPVYAQKLGVNVEDLLISQPDTGEQALEICDMLVRSSGVDVIVVDSVAALVPKAEIEGEMGDSHVGLQARLMSQALRKLTGNIKRTNTLVIFINQIRMKIGVMFGNPETTTGGNALKFYASVRLDIRRTGGIKKGDEVIGNDTRVKVVKNKVSPPFRQADFEILYGEGISRQGEIIELGVKHGFIDKSGAWYAYNGQKIGQGKDNTREWLKANPAIADEIERKIREAVGVKIEINENQGDEEFADDAFDA

SEQ ID NO: 2868 - DNA, 1128 bp, Synechococcus sp
  CDS (1)..(1128)
atgcctgcagagatgaaatccgccgcctccggttccgatccccgttcctccggcgagcgtgacaaggcgctgaatctggtgcttggccagatcgagcgcaacttcggcaaggggtcgatcatgcgccttggtgatgcctcccggatgcgggtggaaaccatctccaccggtgccctcacccttgatctggccctcggcggtggctatcccaaggggcgtgtggttgagatctacggaccggagagctccggtaagacgaccctcaccctgcatgccatcgcagaagtgcagaagcgcggcggtgtggccgccttcgtcgacgctgagcatgccctcgatccggtttacgccgcctccctcggcgtggatgtggaaaatctgctcgtgtcccagccggataccggcgagatggcgctggagatcgtcgatcaattggtgcgctcagcggcagttgacatcgttgtgatcgactcggtggccgccctgacgccgcgggctgagatcgaaggtgagatgggagatctggcggttggaagtcaggctcgtctgatgagtcaggcgatgcggaagatcaccggcaacatcggcaagtccggttgcaccgtgatcttcctcaaccagttgcgcctcaagatcggcgtcacctacggcaaccctgaaaccaccacaggtggtaatgcgctcaagttctatgcctccgttcgactggacatccgtcggatccagacgctgaagaaaggaacggaggaattcgggatccgggcgaaggtcaaggtcgccaagaacaaggtggctccgccgttccgcatcgctgagttcgacatcctgttcggccgcggcatcagcaccctcggttgtctgctggatctggcggaagaaaccggtgtggtgatccgcaagggggcctggtacagctacgagggcgacaacatcggccagggtcgggacaacaccatcacctggatggaagagaaccctgaagccgccatcaccatcgagcagctggtgcgtcagaagctcaccgagggatctgaagtgaaggccaactcgatgaaaccgcttgcagcagcagctcgcacggcggcggccgcggcgccgaaggccactgcggatgaggcggcggcctga

SEQ ID NO: 2869 - protein, 375 aa, Synechococcus sp
MPAEMKSAASGSDPRSSGERDKALNLVLGQIERNFGKGSIMRLGDASRMRVETISTGALTLDLALGGGYPKGRVVEIYGPESSGKTTLTLHAIAEVQKRGGVAAFVDAEHALDPVYAASLGVDVENLLVSQPDTGEMALEIVDQLVRSAAVDIVVIDSVAALTPRAEIEGEMGDLAVGSQARLMSQAMRKITGNIGKSGCTVIFLNQLRLKIGVTYGNPETTTGGNALKFYASVRLDIRRIQTLKKGTEEFGIRAKVKVAKNKVAPPFRIAEFDILFGRGISTLGCLLDLAEETGVVIRKGAWYSYEGDNIGQGRDNTITWMEENPEAAITIEQLVRQKLTEGSEVKANSMKPLAAAARTAAAAAPKATADEAAA

SEQ ID NO: 2870 - DNA, 1128 bp, Rhodopirellula baltica
  CDS (1)..(1128)
atggtaaagaaaccacgcatggcaacgcccgcagcatccaagggcgtcaagctggatccagggatgaagaccattctggaaaaagaacccggtctgaagacgacgcttcaacagatcgaaaaatcgtttggcgacggtgcgatcatgccgctgggagcatcccaaaagctgaccatcgattgtatctccacaggcagcctcagcctcgacatggctctgggtggaaagggcatcccgcgaggccgaatcatcgaagtcttcggaccggaatcttccggtaagacgacgttggctctgcacatcggtgccgaagctcaaaagtctggcgggatcgcggcaatcatcgatgccgagcatgcctttgaccccagttgggccaagaagctgggcgttgaactggacagcctgctggtcagccaacccagcagcggtgaagaggcgatgcagatctgcgagatgctagtcaaatccaacgctgtcgacgtcatcatcatcgactccgtcgcggccttggtgcccaaggcggaactcgaaggcgagattggcgacagccacgtgggcctgcaagctcgtttgatgagccagtcgatgcggaagctgaccggtgcgatcgccaaaagcaaatcggccgtcgtcttcatcaaccagatccgcgaaaaggtcggcgtgatgttcggcagtcccgaaaccacacccggcggtcgtgccctcaaattctattgctcgtgccgaatcgatgttcgtcggattggcagcctgaaggacggcgaagagcaagtcggtcaacgcgtcaaagccaagatcgtcaagaacaaggtcgcacctccgttccgcatcgctgaatttgacatgatgcactccaatggcatcagtttcgaaggagatttgctggatctgggaaccgagaacaaggtcgtcaaccgcagcggttcctggttcaagtacggcgacacttatctgggacaaggcaaagagaaggctcgcaacttcttgatcgagaaccccgacgtctccgatgagatcaagcaaaaggtcttggcagccggcggctttgtcgcgccgcttgaagtggacgccgacgagagtgaagaagcagtcgaagacggagaagccgtcgccaacagctga

SEQ ID NO: 2871 - protein, 375 aa, Rhodopirellula baltica
MVKKPRMATPAASKGVKLDPGMKTILEKEPGLKTTLQQIEKSFGDGAIMPLGASQKLTIDCISTGSLSLDMALGGKGIPRGRIIEVFGPESSGKTTLALHIGAEAQKSGGIAAIIDAEHAFDPSWAKKLGVELDSLLVSQPSSGEEAMQICEMLVKSNAVDVIIIDSVAALVPKAELEGEIGDSHVGLQARLMSQSMRKLTGAIAKSKSAVVFINQIREKVGVMFGSPETTPGGRALKFYCSCRIDVRRIGSLKDGEEQVGQRVKAKIVKNKVAPPFRIAEFDMMHSNGISFEGDLLDLGTENKVVNRSGSWFKYGDTYLGQGKEKARNFLIENPDVSDEIKQKVLAAGGFVAPLEVDADESEEAVEDGEAVANS

SEQ ID NO: 2872 - DNA, 1113 bp, Prochlorococcus marinus subsp
  CDS (1)..(1113)
atgagtttagaagaaagaagaaaaaaggattcaaaggaatcctcatctgaagagaaaaacaaagcattaaatctagtcttaggacaaatagaaagaaactttggcagaggatcaataatgaggcttggagatgcctccagaatgaaagtagaaacaatatctacaggagctcttacattagacttagcattaggagggggatatccaaagggaagagtggttgaagtttacggacctgaaagttcagggaaaacaaccctaactcttcacgcaatagcagaagtacagaaaaatggaggaatagcagcatttgttgatgctgaacatgctttagatccagtctatgcggcttctctaggagtggatgtcgaaaatttactagtttcgcagccagatacaggtgaaatggctttagaaatagttgatcaactcataaggtcaactgccgtagaccttgttgttgttgactcagtagcagcattaactcctagagcagaaatagaaggtgaaatgggagatcacgttataggaagccaagcaagactaatgagtcaagcaatgagaaaaataactggtaatattggcaaatcaggatgtacagtgatattcctcaatcaattacgcttaaaaatcggagttacatatggaaatccagagacaactacaggaggtaatgcattaaagttttatgcttcagtaagacttgacattaggagaattcagactcttaaaagaggtacagaagaatatggaataagagcaaaagttaaagtagcaaaaaataaagtagcccctccatttagaattgcagagtttgatattctattcggcaaaggaataagtacgacaggatgtttattagatttagcagaagagactaatataataattaggagaggtgcttggtatagttacgaaggagaaaacattggacaaggaagagataacacaattatttggttggatcagaacttagaaataaagaataaagtagaatctattgtcaaaacgaaactaacagaaggtactgaagtaagttctaattcgatgaaagcattaaataataatccagaaaatgatgtgattgctaataacatcaaaaaaatagcttag

SEQ ID NO: 2873 - protein, 370 aa, Prochlorococcus marinus subsp
MSLEERRKKDSKESSSEEKNKALNLVLGQIERNFGRGSIMRLGDASRMKVETISTGALTLDLALGGGYPKGRVVEVYGPESSGKTTLTLHAIAEVQKNGGIAAFVDAEHALDPVYAASLGVDVENLLVSQPDTGEMALEIVDQLIRSTAVDLVVVDSVAALTPRAEIEGEMGDHVIGSQARLMSQAMRKITGNIGKSGCTVIFLNQLRLKIGVTYGNPETTTGGNALKFYASVRLDIRRIQTLKRGTEEYGIRAKVKVAKNKVAPPFRIAEFDILFGKGISTTGCLLDLAEETNIIIRRGAWYSYEGENIGQGRDNTIIWLDQNLEIKNKVESIVKTKLTEGTEVSSNSMKALNNNPENDVIANNIKKIA

SEQ ID NO: 2874 - DNA, 1140 bp, Prochlorococcus marinus
  CDS (1)..(1140)
atgtcagttgacgtgaaatcagcccaatcctctaagtctgattccctccaggttgaaccccgtccaggtgagcgggacaaagctctcaatttggtgcttggtcagattgaacgcaattttggcaagggttcgatcatgcgcttgggggatgcctctcggatgcgggtggagaccttccctacaggggcgctgacccttgatcttgcccttggcggtgggtacccgaaaggacgagtcgtggaggtgtacggcccggagagttccggtaaaaccacccttaccctgcatgccatcgccgaggtacagcgtcgtggtggcgtcgcagcttttgtggatgccgagcatgcgctcgatccggtctacgcagcctctttaggagtggatattgagaacctgctggtctcgcagccggacacgggggagatggctctggagatagtcgaccagcttgtgcgctctgccgccgttgatatcgttgttgtggattccgttgctgcgctcactcctcggtctgagatcgaaggtgaaatgggcgatttagctgtgggtagccaggcccgtctgatgagtcaggcgatgcgcaagatcactggcaacatcggcaaatctggctgcacggtcatttttctcaaccagttgcgtctcaagataggcgtcacttacggcaacccggagacgacgactggtggcaatgctctcaagttttacgcctccgtacgtctcgatatccgtcgtattcaaacgctcaaacgcggcacggaggagtatggaattcgtgccaaggtgaaggtggctaaaaataaggtagcccctccgtttcgtattgctgagttcgatattctttttggtcgtggcatcagtaccttgggttgcttgcttgacctagctgaagaaaccggtgttgttatccgtaagggtgcctggtacagctatgagggcgacaatatcggtcagggacgtgacaacacgattacttggcttgagcagaattctgaagcccaggagcagattgaagttcttgtgcgtcagaaactcactgaagggtctgaggtgaccgctaattccatgcgtccgttggcggctgcggcgcgcactgcggctaaaaaacctgccgtcagcttggcatctgaagctgcttaa

SEQ ID NO: 2875 - protein, 379 aa, Prochlorococcus marinus
MSVDVKSAQSSKSDSLQVEPRPGERDKALNLVLGQIERNFGKGSIMRLGDASRMRVETFPTGALTLDLALGGGYPKGRVVEVYGPESSGKTTLTLHAIAEVQRRGGVAAFVDAEHALDPVYAASLGVDIENLLVSQPDTGEMALEIVDQLVRSAAVDIVVVDSVAALTPRSEIEGEMGDLAVGSQARLMSQAMRKITGNIGKSGCTVIFLNQLRLKIGVTYGNPETTTGGNALKFYASVRLDIRRIQTLKRGTEEYGIRAKVKVAKNKVAPPFRIAEFDILFGRGISTLGCLLDLAEETGVVIRKGAWYSYEGDNIGQGRDNTITWLEQNSEAQEQIEVLVRQKLTEGSEVTANSMRPLAAAARTAAKKPAVSLASEAA

SEQ ID NO: 2876 - DNA, 1140 bp, Prochlorococcus marinus
  CDS (1)..(1140)
atgtcaaacgaaattaagtcaatctcatcttccaactcatcctgtcctccaaatgaagcacgttctggagaaagagataaagctctcagccttgtactaggtcaaatagaacgaaactttggcaaaggctccatcatgcgcttaggggatgcttccaaaatgcgtgtggagacaatctctactggagcactgactcttgatcttgccttaggcggtggatatcccaaaggtagggtcgtagaagtctatggtccagaaagttctggtaaaacaacgctgacattacatgctatcgccgaggttcaaaaacggggtggagtagccgcttttgttgatgcagaacatgctctagaccctgtatatgcagcatctctaggagttgacattgaaaaccttttggtctcacaacccgatacaggagaaatggcgctagagattgttgatcaattaattcgatcatcagctgttgaccttgtggttgttgattcagtagcagcactcacgcctcgatcagaaattgaaggggaaatgggcgatcatgcagtaggtagccaagcgagattaatgagtcaagcaatgcgaaaaattacggggaatatagggaaatcaggctgtactgtgatctttctaaatcaattacgactcaaaattggagttacctatggaaaccctgaaacgactacaggtgggaatgctctaaaattttatgcctctgtgcgactcgatatcaggcgaattcaaaccctgaaaagaggcacagaggaatatgggatacgtgccaaagtaaaggttgcaaaaaacaaagttgctcctccatttcgaattgctgaatttgatattttatttggaaaaggcattagcacattaggatgtctacttgatatggcagaagaaacaaatattgtcacccgcaaaggtgcttggtatagctatgaaggagataatataggtcaagggcgagacaatacaattacttggctagaagaaaattcagaagcaaaagagaaaatagaaaaattagttcgtcaaaagttaaccgaaggttcagaagtgagcgctaattccatgaaacctctggcatcagcagctcgtgcagcaaatacaccacctgtcatgaaaaaaatatctaatgctgcataa

SEQ ID NO: 2877 - protein, 379 aa, Prochlorococcus marinus
MSNEIKSISSSNSSCPPNEARSGERDKALSLVLGQIERNFGKGSIMRLGDASKMRVETISTGALTLDLALGGGYPKGRVVEVYGPESSGKTTLTLHAIAEVQKRGGVAAFVDAEHALDPVYAASLGVDIENLLVSQPDTGEMALEIVDQLIRSSAVDLVVVDSVAALTPRSEIEGEMGDHAVGSQARLMSQAMRKITGNIGKSGCTVIFLNQLRLKIGVTYGNPETTTGGNALKFYASVRLDIRRIQTLKRGTEEYGIRAKVKVAKNKVAPPFRIAEFDILFGKGISTLGCLLDMAEETNIVTRKGAWYSYEGDNIGQGRDNTITWLEENSEAKEKIEKLVRQKLTEGSEVSANSMKPLASAARAANTPPVMKKISNAA

SEQ ID NO: 2878 - DNA, 1038 bp, Helicobacter hepaticus
  CDS (1)..(1038)
atggtagatgaaaaaaggcaaaaagcgattgaacttgctttaaagcaaattgataaagcatttggtaaaggtgctttggtgcgtttgggtgataagcaagttgaaaaaattgatagtatttctacgggttcacttggacttgatatggcacttggaatcggtggtgtgcctaagggaaggattattgagatttatggtccagaatccagcggtaaaacaacacttagcttacaaattgtagcagaatgtcaaagaaacgggggaatttgtgcctttattgatgccgaacacgctcttgatgtatattatgccaagcgtttgggtgtggatacagagaatcttcttgtatctcaacctgacacaggtgagcaggctcttgaaattttagaaacccttacacgtagtggtgcagtggatttaatagtgattgattcggtagcagcgctcactcctaaggcagaaattgaaggagatatgggagatcagcacgtagggcttcaagcacgacttatgagtcacgcattgcgcaaaattacaggcgtgcttcacaagatgaatgcaacattaatttttattaaccaaattcgtatgaaaattggcactatggggtatggtagtccagagacaactacgggcggtaatgcactcaagttttatgcaagtgtgcgtattgatgtgcgccgtgttgctacacttaagcaaaatgaccagcaaattggtaatcgcacaaaagcaaaagttgtaaaaaataaggttgccccacctttccgcgaagcagaatttgatattatgtttggtgaggggattagtaaggaaggtgaaattattgactatggtatcaagcttgatattattgataaaagcggtgcgtggttaagctataatgataaaaagcttggacaagggcgtgagaatgctaaaattgttttaaaagaaaacaaatctcttgctgatgagattacagctaaaattaaagagcaaattggctcaaaggacgagattttacctttgcctgatgaaccagaaactgatgagtag

SEQ ID NO: 2879 - protein, 345 aa, Helicobacter hepaticus
MVDEKRQKAIELALKQIDKAFGKGALVRLGDKQVEKIDSISTGSLGLDMALGIGGVPKGRIIEIYGPESSGKTTLSLQIVAECQRNGGICAFIDAEHALDVYYAKRLGVDTENLLVSQPDTGEQALEILETLTRSGAVDLIVIDSVAALTPKAEIEGDMGDQHVGLQARLMSHALRKITGVLHKMNATLIFINQIRMKIGTMGYGSPETTTGGNALKFYASVRIDVRRVATLKQNDQQIGNRTKAKVVKNKVAPPFREAEFDIMFGEGISKEGEIIDYGIKLDIIDKSGAWLSYNDKKLGQGRENAKIVLKENKSLADEITAKIKEQIGSKDEILPLPDEPETDE

SEQ ID NO: 2880 - DNA, 1119 bp, Haemophilus ducreyi
  CDS (1)..(1119)
atggcagcggataaaaaagcccaaaagaatacagcaactaaacagattgatcccgaacaaaaagaaaaagcattagcagcagcactggctcaaattgaaaagcaatttggtaaaggatctattatgcgtttgggcgatacgcaagcacttgatattgaagcagtttccaccggttcaattggtttagatgctgcattaggtattggtggtttgccaatgggacgaattgtagaaatctacggccccgaatcatcagggaaaaccacgttaactttatctgtcattgctcaagcgcaaagaataggcaaaacttgtgcatttattgatgctgaacatgcgctggatcccgtttatgcacgtaaattaggcgtagatatcgatgccttacttatttcacaacctgataatggcgaacaagcgcttgaaatttgtgatgcattagtccgctcaggtgcggttgacgtcattattgttgactcagttgccgcattaacaccaaaagctgaaattgaaggcgatatgggtgattcgtatatgggcttacaagctcgtttaatgtcacaagcattacgaaaattaaccgctaatattaaagccactaattgcctagtcgttttcattaatcaaattcggatgaaaatcggcgtaatgtttggtaatccagaaacgacgacaggcggtaatgcacttaaattctatgcctctgtccgccttgatattcgtcgttcgggtgttgtaaaagatggtgatgaagtggttggcagtgaaaccaaagttaagatcgttaaaaataaagtagcaccgccattccgtgaagtacaatttgatattatgtacggagaaggcattgctcgaatgaatgaattacttattcttgctgaagcgaatggctttattcaaaaagcaggagcatggttctcatataatggtactaaaattggtcaaggcaaaaataatgcaattaaatggttgaaagaaaatcctgaagtggcagagaaaattgaacaagagattcgcaatttattaattttaacaccagatcagccagcttctgaaaaacttgagttagatgtaaatgacgaaagtgattttgatgaagcgtttgaggagcaagaataa

SEQ ID NO: 2881 - protein, 372 aa, Haemophilus ducreyi
MAADKKAQKNTATKQIDPEQKEKALAAALAQIEKQFGKGSIMRLGDTQALDIEAVSTGSIGLDAALGIGGLPMGRIVEIYGPESSGKTTLTLSVIAQAQRIGKTCAFIDAEHALDPVYARKLGVDIDALLISQPDNGEQALEICDALVRSGAVDVIIVDSVAALTPKAEIEGDMGDSYMGLQARLMSQALRKLTANIKATNCLVVFINQIRMKIGVMFGNPETTTGGNALKFYASVRLDIRRSGVVKDGDEVVGSETKVKIVKNKVAPPFREVQFDIMYGEGIARMNELLILAEANGFIQKAGAWFSYNGTKIGQGKNNAIKWLKENPEVAEKIEQEIRNLLILTPDQPASEKLELDVNDESDFDEAFEEQE

SEQ ID NO: 2882 - DNA, 1048 bp, Campylobacter lari
  CDS (9)..(1043)
ggaaattaatggatgataataaaagaaaatcacttgatgcagccttaaaaagtcttgataaaacctttggaaaaggcaccatattaagacttggcgataaagaagttgaaaaaattgattctattcctacaggttctgttggacttgatttagctttaggaattggtggggttccaaaaggaagaattatagaaatttatggacctgaaagttcaggtaaaactacacttaccttacacatcatagcagaatgtcaaaaaaaaggtggagtttgtgcgtttattgatgctgaacacgctcttgatgtaagatatgcaaaaaatttaggcgttgatacagaaaatctttacatctctcaaccagattttggagaacaagccttagaaattgttgaaactatagcaagaagtggagccattgatctaatagtggtagatagcgttgctgcacttactccaaaagcagaaattgaaggtgatatgggagatcaacatgtaggtcttcaagcaagattaatgagccaagctttaagaaaattaaccggtatcgttcataaaatgaacactactgtaattttcatcaatcaaattcgtatgaaaataggcatgatgggctatggcactcctgaaacaactaccggcggaaatgctttaaaattttatgcttcagtgcgtttagatgtaagaaaaacagccaccttaaaacaaaatgatgagcctattggaaaccgtgttaaagtaaaagtggctaaaaacaaagtagcccctccttttaaacaagctgaatttgatgtgatgtttggtgagggtgtaagtcgtgaaggcgagctaatagattatggtgtaaaacttgatattattgataaaagtggtgcatggttttcttacaaggcttctaaacttggtcaaggtagagaaaatgctaaagcctttttaaaagaaaatccagctattgcagatgaaattactcaagctatacaaaactcaatcggtatagatagtatgattttgggcgcaaaagaagacgatgaaggagacgactaatgctg

SEQ ID NO: 2883 - protein, 344 aa, Campylobacter lari
MDDNKRKSLDAALKSLDKTFGKGTILRLGDKEVEKIDSIPTGSVGLDLALGIGGVPKGRIIEIYGPESSGKTTLTLHIIAECQKKGGVCAFIDAEHALDVRYAKNLGVDTENLYISQPDFGEQALEIVETIARSGAIDLIVVDSVAALTPKAEIEGDMGDQHVGLQARLMSQALRKLTGIVHKMNTTVIFINQIRMKIGMMGYGTPETTTGGNALKFYASVRLDVRKTATLKQNDEPIGNRVKVKVAKNKVAPPFKQAEFDVMFGEGVSREGELIDYGVKLDIIDKSGAWFSYKASKLGQGRENAKAFLKENPAIADEITQAIQNSIGIDSMILGAKEDDEGDD

SEQ ID NO: 2884 - DNA, 1077 bp, Burkholderia fungorum
  CDS (1)..(1077)
atggaagaaagcaagaaaggctcggctggactgactgctgaaaagagcaaggcactcgctgccgcactcgcgcagatcgaaaagcagttcggcaaagggtcggtcatgcggctcggcgcaggtgaggtaatcgaagacatccaggtggtctcaaccggatcgctcggtctcgacatcgcgctgggcgtcggcggtttgccgcgtggccgtgtggtcgaaatctatggcccggaatcatccggtaaaaccacgctgacgctgcaagtcattgccgaaatgcagaagatcggcggcacggcggcgtttatcgacgcggaacacgcgctggatatccagtacgcgagcaagctcggcgtgaacgtgaacgacctgctggtttcgcagcccgacacaggcgagcaggcgctcgaaattgctgacgcactggtgcgttcgggctcgatcgacatgatcgtgatcgactcggtcgcggcactcgtgccgaaggctgaaatcgaaggcgaaatgggcgactcgctgccgggtctgcaagcgcgtctcatgtcgcaggcgctgcgcaagctcaccggcacgatcaagcgcacgaactgtctcgtgatcttcatcaaccagatccgcatgaagatcggtgtgatgttcggcaatccggaaaccaccacgggcggtaacgcgctgaagttctacgcatcggtgcgtctggacattcgccgcatcggttcgatcaagaagaacgacgaagtgatcggcaacgaaacgcgcgtgaaggttgtcaagaacaaggtatcgccaccgttccgggaagcgattttcgacattctgtacggcgaaggcatctcgcgtcagggcgaaatcatcgacttgggcgtacaggccaagatcgtcgacaaggccggcgcgtggtacagctacagcggcgaacggatcggtcagggcaaggacaacgcgcgtgaattcctgcgtgaaaatccggatatcgctcgcgagatcgaaaaccgtatccgcgaatcgctgggcgtgaatgctatggctgaagccgcgaccgtcgcaagcgctgaagtcgcggacgaagaagagtaa

SEQ ID NO: 2885 - protein, 358 aa, Burkholderia fungorum
MEESKKGSAGLTAEKSKALAAALAQIEKQFGKGSVMRLGAGEVIEDIQVVSTGSLGLDIALGVGGLPRGRVVEIYGPESSGKTTLTLQVIAEMQKIGGTAAFIDAEHALDIQYASKLGVNVNDLLVSQPDTGEQALEIADALVRSGSIDMIVIDSVAALVPKAEIEGEMGDSLPGLQARLMSQALRKLTGTIKRTNCLVIFINQIRMKIGVMFGNPETTTGGNALKFYASVRLDIRRIGSIKKNDEVIGNETRVKVVKNKVSPPFREAIFDILYGEGISRQGEIIDLGVQAKIVDKAGAWYSYSGERIGQGKDNAREFLRENPDIAREIENRIRESLGVNAMAEAATVASAEVADEEE

SEQ ID NO: 2886 - DNA, 963 bp, Mycobacteriophage CJW1
  CDS (1)..(963)
atgtcactcaaggaagccctggccgaggtcgataaacgcttcggcgccggatcggctatgaagctgggtgacaagccacagactgtggacgtcattcccaccggctctatcgctctggacggcgctctgggcatcggggggtacccgaggggccgggtggtggaaatctacggcccagaatcttcagggaagtcaactctgtgtctccacgcggtggccaatgcgcagaaggccggtggcaacgccgcctacatcgacgctgagcactccctggaccccgagtacgccaaggcgctcggtgtggacctcgacaacctcgtggtggttcagccggacactggcgagcaggccctggagatcgttgacctcctcgtcaagtctggcgagctgtccatcgtcgtcgttgactctgtggcggccctggtgccgcgcgccgagctcgaaggcgacatcggggacagtcacgtcggcctgcacgcgcgcctcatgtcgcaggccatgcgcaagctcactggcaccatctccagcaccaacacgctgacgctctgggtcaaccagttgcgcgagaagatcggcaacgtgggctacggcccgaatgagaccaccacgggcggaaaggctttgaggttctacgcctcagtccgcatggatgtccgtcgcatcgccaccgagaaggaaggcgatgaggctgtcggcaaccgcacccgggtgaaagtcgtcaagaacaagctggccccgccgcaccgcaacgccgagttctccgtcgtgtacggggagggcatctcgcgtgaggtcgaactcctcgacctggccgtgtcgcagggcctggtgaagaagtcgggcgcctggttcaagtacggggacaagaacgtcgctcagggcaagcccaaggccgtccagtggctcaaggccaacccggacatcaccgactccatcgaacaagccatcaggggagcgcggtga

SEQ ID NO: 2887 - protein, 320 aa, Mycobacteriophage CJW1
MSLKEALAEVDKRFGAGSAMKLGDKPQTVDVIPTGSIALDGALGIGGYPRGRVVEIYGPESSGKSTLCLHAVANAQKAGGNAAYIDAEHSLDPEYAKALGVDLDNLVVVQPDTGEQALEIVDLLVKSGELSIVVVDSVAALVPRAELEGDIGDSHVGLHARLMSQAMRKLTGTISSTNTLTLWVNQLREKIGNVGYGPNETTTGGKALRFYASVRMDVRRIATEKEGDEAVGNRTRVKVVKNKLAPPHRNAEFSVVYGEGISREVELLDLAVSQGLVKKSGAWFKYGDKNVAQGKPKAVQWLKANPDITDSIEQAIRGAR

SEQ ID NO: 2888 - DNA, 1563 bp, Zymomonas mobilis
  CDS (231)..(1250)
ctgtttttcagctttctcggtagtagaaaaacaagttttaaattctgtcagttaagacttgctattctgtttctgctctctatgttcaccttatgttcttcatgctgttccggtatattcgacgcaatcctgacattatgccggttgatgccttaagagagacgttataggagaaggggggtagcgatgctccgcaaaataaggttacgacttccggtaaggataataatatggacaagcaaaaagcccttgaagcggctttagctcagattgaccgcgcttttggtaaaggttcggttatgcgcttggggtctcgtgagaaaatcgagattgatacaatttccagcggatcacttggccttgatattgcgctgggcattggcggcttgccccgtggccgtatcgtcgaaatctatggtcctgaaagctcgggtaaaacaactttagccctccatgctatcgctgaagcacaaaaagcaggtggaacagcggcctttgtcgatgctgaacatgcgcttgatccggtctatgccaaaaaactgggcgttaatacggatgatctaatcgtctctcagcccgatacgggtgagcaggctctggaaattacagataccctgatccgttctaacgctgttgatatattggttgtcgattctgttgcggccttaacaccccgcgctgaaatcgaaggcgaaatgggcgatagtcacgttggtttgcaagcccgtttgatgagtcaggcgcttcgcaaaattaccggatcaatcaaccgctctcaaactttggttatttttatcaaccaagtccggatgaaaatcggggtaatgtatggcaaccctgaaacgacaacgggcggtaatgctttgaaattctatgccagcgttcggcttgatatccgtcgtgtaggacaaattaaagatcgcgatgaaatcgttggtaatgccacccgtgtcaaagtggtaaaaaacaagctggctccgcgtttcaagcaggttgaattcgatatcatgtatggagaaggtgtctccaagatgggcgaaattctcgatctgggcgtaaaagccggtattatcgacaagtcaggctcatggttcagtcatgattccgttcgcatcggtcagggacgtgaaaatgccaaaacgttcttgcgtgaacatcctgaaatgactgaaaaaattgaaaaaatgattcgtcataatacggctgaaattgccgacgaaatgctggatccatctatccctgaagattaggtttttgaccaaaaatctaatcttgaaaagaggtcagttttatctgacctcttttttgtattgattcatcagtaaaatggaaaagatcagcatcattaaaaaatgccttgaagcggcatattcagggctaaaacggtcattgattatgccttgccgcctcgctgcccaaattgtggcgcggtcattctggctgatcatagttttgtgttgaatgttggcagtctcttcacttcttggttgagcctgcctgtattcaatgcggctttcctctgccgagagatcaacatatgagcctcttgtggccgttgttaac

SEQ ID NO: 2889 - protein, 339 aa, Zymomonas mobilis
MDKQKALEAALAQIDRAFGKGSVMRLGSREKIEIDTISSGSLGLDIALGIGGLPRGRIVEIYGPESSGKTTLALHAIAEAQKAGGTAAFVDAEHALDPVYAKKLGVNTDDLIVSQPDTGEQALEITDTLIRSNAVDILVVDSVAALTPRAEIEGEMGDSHVGLQARLMSQALRKITGSINRSQTLVIFINQVRMKIGVMYGNPETTTGGNALKFYASVRLDIRRVGQIKDRDEIVGNATRVKVVKNKLAPRFKQVEFDIMYGEGVSKMGEILDLGVKAGIIDKSGSWFSHDSVRIGQGRENAKTFLREHPEMTEKIEKMIRHNTAEIADEMLDPSIPED

SEQ ID NO: 2890 - DNA, 1038 bp, Bacillus megaterium
  CDS (1)..(1038)
atgaacgatcgtcaagcagcccttgatatggctttaaaacaaattgaaaagcaatttggtaaaggttcaattatgaaattaggtgaacaaacggaaaaaagaatttctacaattccaagtggttcattagcgttagatatagccttaggtgtaggtggatatccacgtggacgtgtagttgaagtatatggtccagaaagctcaggtaaaacaacagttgctcttcatgcgattgcagaagttcaacagcagggcggacaggctgcatttatcgatgcggagcacgcgttagatcctgtatatgctcaaaaattaggtgtgaatattgatgagctattattatctcagcctgatacgggagaacaagctttagaaatcgctgaagctttagttcgaagcggtgcagtagatattatcgttgttgactcagtagcagcattagtgccaaaagcggaaattgaaggagaaatgggagactctcacgtgggtctacaagctcgtttaatgtctcaagcattgcgtaaactatctggagctatcaataagtctaaaacaatcgctatctttattaaccaaattcgtgaaaaagtcggcgttatgtttggtaatcctgaaacaactcctggtggacgtgcgcttaaattctattcttcagtgcgtctagaagtgcgtcgtgcagagcagttaaagcaaggaaacgatattgtaggtaacaaaacaagaattaaagttgtgaaaaacaaagtagcgccgcctttccgtgctgctgaagtagatattatgtacggagaaggtatttcaaaagagggtgaaattttggatatcgcttctgaactagatattgttcaaaaaagtggatcttggtattcatataatgacgagcgtctaggtcaaggccgtgaaaatgcaaaacaattcttaaaagaaaatactgatattcgtcaggaaattgcgggacaagttcgtgaacatcatggtttagatcaagatggagagccagctcctgaggatgacgatcaaggcgatttaaatatttaa

SEQ ID NO: 2891 - protein, 345 aa, Bacillus megaterium
MNDRQAALDMALKQIEKQFGKGSIMKLGEQTEKRISTIPSGSLALDIALGVGGYPRGRVVEVYGPESSGKTTVALHAIAEVQQQGGQAAFIDAEHALDPVYAQKLGVNIDELLLSQPDTGEQALEIAEALVRSGAVDIIVVDSVAALVPKAEIEGEMGDSHVGLQARLMSQALRKLSGAINKSKTIAIFINQIREKVGVMFGNPETTPGGRALKFYSSVRLEVRRAEQLKQGNDIVGNKTRIKVVKNKVAPPFRAAEVDIMYGEGISKEGEILDIASELDIVQKSGSWYSYNDERLGQGRENAKQFLKENTDIRQEIAGQVREHHGLDQDGEPAPEDDDQGDLNI

SEQ ID NO: 2892 - DNA, 1038 bp, Bacillus megaterium
  CDS (1)..(1038)
atgaatgataaaaaagcagcactagatatggctctaaaacaaattgaaaaacaattcggtacaggatcaattattaaaatgggagaaggcacacatacaaaagttgaggcatctagctcaggctcattagctttagatatagctcttggaattaatggttatcccaaaggaagaattatggaagtttacgggcccgaaagttcaggtaaaacaaccgtttccttacacgcaattgcagaagtacaaaaaaatggaggccgagctgcctttattgatgctgaacacgcacttgatccagtttatgcaagaaaactaggtgtagatattgatgagttactgttatctcaaccagatactggtgaacaggcacttgaaattgctgaagcattagttagaagtggtgctgtagatattattgttgttgactcagtagcagcattagttccgcaaaaagaaattgaaggagaaatgggagattctcacgtaggtttacaagctcgtttgatgtctcaagctcttcgtaaactatctggagcaatcaataagtccaaaaccattgctatcttcatcaaccaaatcagggagaaagtaggcgttatgtttggaaacccggaaacaacgccaggtggaagggcactaaaattctattcttccgttcgtcttgaggttcgccgcgctgaacaacttaaactaggaaatgacatagttgggaataaaacaagaattaaagtagtcaaaaataagatggcacctcctttccgcattgctgaagtagatattatgtatggagaaggtatctcaaaagaaggagaaatcttagacattggttctgaagtagatattgttcaaaagtctggatcttggttttcatataatgaggagcgtttaggtcagggacgagaaaacgctaagattttcttaaaagaaaaccctgaaattagagaagaaattagaaaaagaattattgatttcaaatatggtgataatattaataacgataatgttatagataacgatagcgaaaacgaaaaccaataa

SEQ ID NO: 2893 - protein, 345 aa, Bacillus megaterium
MNDKKAALDMALKQIEKQFGTGSIIKMGEGTHTKVEASSSGSLALDIALGINGYPKGRIMEVYGPESSGKTTVSLHAIAEVQKNGGRAAFIDAEHALDPVYARKLGVDIDELLLSQPDTGEQALEIAEALVRSGAVDIIVVDSVAALVPQKEIEGEMGDSHVGLQARLMSQALRKLSGAINKSKTIAIFINQIREKVGVMFGNPETTPGGRALKFYSSVRLEVRRAEQLKLGNDIVGNKTRIKVVKNKMAPPFRIAEVDIMYGEGISKEGEILDIGSEVDIVQKSGSWFSYNEERLGQGRENAKIFLKENPEIREEIRKRIIDFKYGDNINNDNVIDNDSENENQ

SEQ ID NO: 2894 - DNA, 1044 bp, Bacillus amyloliquefaciens
  CDS (1)..(1044)
atgagtgatcgtcaggcagccttagatatggctcttaagcaaatagaaaaacaattcggcaaaggttccatcatgaagctcggagaaaaaacggatacaagaatttcaacggtgccgagcggttcccttgcacttgataccgctctcggaataggcggatacccgcgcggacggattattgaagtatacggacctgaaagctcaggtaaaacgactgtagcgcttcacgcaatcgctgaggttcaggaaaaaggcggacaggcagcatttattgatgccgagcatgctcttgatcctgtgtacgcgcaaaagctcggtgtcaatatcgaagagctgctgctttctcagccggatacgggagagcaggcgctggagattgctgaagcgctggtgcgaagcggagctgtcgatatcgtagtcgttgactctgttgcggcgcttgttccaaaagctgaaattgaaggtgacatgggtgattcacacgtcggtttacaggcgcgtctcatgtctcaggcgctccgtaagctttccggcgccatcaataaatctaaaacaatcgcaatctttattaaccagattcgtgaaaaagtcggcgttatgttcggaaatccggagacgacaccgggcggccgcgcgctgaaattctattcttccgtgcgtcttgaagtgcgccgtgccgagcaattaaagcagggcaacgacgttatggggaataaaacgagaattaaagtcgtaaaaaacaaagtcgctcctccgttccgtacggctgaagtggacattatgtacggtgaaggaatctccaaagaaggggaaatcatcgaccttggaactgaacttgatatcgtgcagaaaagcggctcgtggtattcttatgaagaagaacgcctcggacagggccgtgaaaacgccaagcagttcttaaaagaaaataaagacatcatgctgatgattcaagaacaaatccgtgaacattacggtttggacaataacggtgttacggaaaaagcggaagaagttcaggaagagcttgaattcgaagaataa

SEQ ID NO: 2895 - protein, 347 aa, Bacillus amyloliquefaciens
MSDRQAALDMALKQIEKQFGKGSIMKLGEKTDTRISTVPSGSLALDTALGIGGYPRGRIIEVYGPESSGKTTVALHAIAEVQEKGGQAAFIDAEHALDPVYAQKLGVNIEELLLSQPDTGEQALEIAEALVRSGAVDIVVVDSVAALVPKAEIEGDMGDSHVGLQARLMSQALRKLSGAINKSKTIAIFINQIREKVGVMFGNPETTPGGRALKFYSSVRLEVRRAEQLKQGNDVMGNKTRIKVVKNKVAPPFRTAEVDIMYGEGISKEGEIIDLGTELDIVQKSGSWYSYEEERLGQGRENAKQFLKENKDIMLMIQEQIREHYGLDNNGVTEKAEEVQEELEFEE

SEQ ID NO: 2896 - DNA, 1047 bp, Listeria monocytogenes
  CDS (1)..(1047): m means a or c
atgaatgatcgtcaagcggcattagaccaagctttaaaacaaattgaaaaacaattcggtaaaggctccattatgaaattaggggaacattcagatcaaaatatatctactatttctagtggttcattagcgttagatattgctttaggagttggcggataccctcgtggacgtattatcgaagtatacggaccagagagttccggtaaaacaactgttgcgcttcatgcaattgcggaagtacaagcacaaggcggaacagcagcatttatcgatgctgagcatgcgttggatccggcttatgctaaaaacctaggtgtaaatattgatgaattattactatctcaaccagatacaggagaacaagctttagagattgctgaagctttagttagaagtggtgcagttgatatgttagtaattgactccgttgcagcacttgtaccacgtgctgaaatcgaaggcgagatgggcgatgctcatgttggattacaagcacgtttaatgtcccaagcattgcgtaaactttctggtgttattaataaatcaaaaaccattgctattttcattaaccaaattcgtgaaaaagttggtgttatgtttggtaacccagaaatcacaccaggtggacgtgcgcttaaattctattctactgtacgtttagaagtaagacgtgcggaacmactgaagcaaggtacagatgtaatgggtaacaaaacaaaaatcaaagttgtaaaaaataaagtagcgccaccattccgtattgccgaagtagatattatgtatggtgaaggtatttcgcgtgaaggtgagcttgttgatatggctgctgaagtggatgtaatcaataagagtggttcgtggtattcttataaagaagaacgcatcggtcaaggccgtgagaatgcaaaacaatatctgaaagaacacacagatattcgtgatgagatttctaagcgcgttcgtgaagaatatgaaattgatggaagcagcaaagagcctcttgacgaaaaagaagaaacattaagtttactagatgatgaataa

SEQ ID NO: 2897 - protein, 348 aa, Listeria monocytogenes
  misc_feature (228)..(228): Xaa can be Pro or Gln
MNDRQAALDQALKQIEKQFGKGSIMKLGEHSDQNISTISSGSLALDIALGVGGYPRGRIIEVYGPESSGKTTVALHAIAEVQAQGGTAAFIDAEHALDPAYAKNLGVNIDELLLSQPDTGEQALEIAEALVRSGAVDMLVIDSVAALVPRAEIEGEMGDAHVGLQARLMSQALRKLSGVINKSKTIAIFINQIREKVGVMFGNPEITPGGRALKFYSTVRLEVRRAEXLKQGTDVMGNKTKIKVVKNKVAPPFRIAEVDIMYGEGISREGELVDMAAEVDVINKSGSWYSYKEERIGQGRENAKQYLKEHTDIRDEISKRVREEYEIDGSSKEPLDEKEETLSLLDDE

SEQ ID NO: 2898 - DNA, 1035 bp, Oryza sativa
  CDS (1)..(1035)
atgtggcttggtcgttctgaaggtcgtagagaagtacctgttgtgtcaactgggtctttctctttggatttggcattgggaactggtggacttccaaagggtcgtgttatagaggtgtatggtccagaagcttcaggcaagacaactcttgcacttcacgttattgcagaagcacaaaagcatggcggttattgtgccttcgtagatgcagagcatgccttagatccagctctggctgaatcaattggggtcaacaccagtaatttacttctctctcagccagactgtggcgagcaggcactcagtcttgtggacacactgattcgaagcggctctgttgatgttgttgttgttgatagtgtagcagctcttgtccctaagagtgagcttgacggggagatgggtgatgcacatgttgctctccaggctagattgatgagccaagctcttcgcaagctgagccactctctctcactttcccagacaattttgttattcattaaccagatcaggtctaaagtgaccacatttggaggatttggaggtccaatggaggttacttctggtggaaatgcccttaaattctatgcttccgttagaatgaacatcaagcgtattggtttggtaaagaaaggcgaagagactataggtagtcaagtgcttgtgaagattgtgaaaaacaagcatgccccaccgttcaagacagcacagtttgagctggaatttggtaaagggatatgccgcagttcagagcttattgaacttggattaaagcacaagcttgtcaaaaagttgggtggtgcattttattctttcaacgaagagtcatatcgtggtaaagatgcccttaaatcttacctcaacgaaaatgaaagtatcgcaaaagaactggagacgaatttaaggaaattgatggaaactcaagcacctaaaaagcaggaggatgaaggtgatttcctgagtgatctgcctgaagagagtctcgccactgaaacatcctccgaggaggaactggcagctgtaatagaagcttaa

SEQ ID NO: 2899 - protein, 344 aa, Oryza sativa
MWLGRSEGRREVPVVSTGSFSLDLALGTGGLPKGRVIEVYGPEASGKTTLALHVIAEAQKHGGYCAFVDAEHALDPALAESIGVNTSNLLLSQPDCGEQALSLVDTLIRSGSVDVVVVDSVAALVPKSELDGEMGDAHVALQARLMSQALRKLSHSLSLSQTILLFINQIRSKVTTFGGFGGPMEVTSGGNALKFYASVRMNIKRIGLVKKGEETIGSQVLVKIVKNKHAPPFKTAQFELEFGKGICRSSELIELGLKHKLVKKLGGAFYSFNEESYRGKDALKSYLNENESIAKELETNLRKLMETQAPKKQEDEGDFLSDLPEESLATETSSEEELAAVIEA

SEQ ID NO: 2900 - DNA, 1035 bp, Campylobacter lari
  CDS (1)..(1035)
atggatgataataaaagaaaatcacttgatgcagccttaaaaagtcttgataaaacctttggaaaaggcactattttaagacttggcgataaagaagttgaaaaaattgattctattcctacaggttctgttggacttgatttggctttgggtataggcggggttccaaaaggaagaattatagaaatttatggacctgaaagttcaggtaaaactacacttaccttacacatcatcgcagaatgtcaaaaaaaaggtggagtttgtgcgtttatcgatgctgaacacgctcttgatgtgagatatgcaaaaaatttaggtgttgatacagaaaatctttacatctctcaaccagattttggagagcaagccttagaaatcgttgaaactatagcaagaagcggggctattgatctaatagtagtagatagtgttgctgcgcttactccaaaagcagaaattgaaggtgatatgggagatcagcatgtaggtcttcaagcaagattaatgagccaagctttaagagaattaaccggtatcgttcataaaatgaacactactgtgattttcatcaatcaaattcgtatgagaataggtatgatgggctatggcacacctgaaacaaccactggtggaaatgcattaaaattttatgcttcagtgcgtttagatgtaagaaaaacagcaactttaaaacaaaacgatgagcctattggaaaccgcgttaaagtaaaagtagctaaaaacaaagtagcccctccttttaaacaagctgaatttgatgtaatgtttggcgagggtgtaagtcgtgaaggcgagctaatagattatggtgtaaaacttgatattattgataaaagtggtgcatggttttcttacaaggcttctaagcttggtcaaggtagagaaaacgccaaagcctttttaaaagaaaatccagctattgcagatgaaatcactcaagctatacaaaactcaatcggtatagatagtatgattttgggcgcaaaagaagacgatgaaggagacgagtaa

SEQ ID NO: 2901 - protein, 344 aa, Campylobacter lari
MDDNKRKSLDAALKSLDKTFGKGTILRLGDKEVEKIDSIPTGSVGLDLALGIGGVPKGRIIEIYGPESSGKTTLTLHIIAECQKKGGVCAFIDAEHALDVRYAKNLGVDTENLYISQPDFGEQALEIVETIARSGAIDLIVVDSVAALTPKAEIEGDMGDQHVGLQARLMSQALRELTGIVHKMNTTVIFINQIRMRIGMMGYGTPETTTGGNALKFYASVRLDVRKTATLKQNDEPIGNRVKVKVAKNKVAPPFKQAEFDVMFGEGVSREGELIDYGVKLDIIDKSGAWFSYKASKLGQGRENAKAFLKENPAIADEITQAIQNSIGIDSMILGAKEDDEGDE

SEQ ID NO: 2902 - DNA, 2035 bp, Borrelia hermsii
  CDS (256)..(1326)
ttcaaaagctctgttgttgggtttggaacaaaagttactatgattaataaagatacaggaagggaagagttttatttgatatttggaccttgggagtcaaatcctgatgaaggcattatatcttataaatctccttttggagaaaatttgttagatgcaaaagaaggcgacaatcttgattttgtaataaatgatactcgtttccaatattatgttaaaaagatagaacctgccagaattaattaaagaggtaagatgtcaaaattaaaagataacccagataattctttaaatgacagattaaatagagaaaaggccattgagcttgctagagttcaaatagagaaagattttggtaaaggcagtcttattaagatgggagagtctcctgttggtaaaggcatagagagcatatctagtggttctattttgcttgatgaggcaattggtgttgggggatatccaaggggaagaataatagaaatttttggtcctgaatcttccggtaagactactttgactcttcaagcaattgctgaggttcaaaaaaatggtggaatagcagcttttattgatgctgaacatgctcttgatcctgcttatgcaaaagctttgggtgttaatattgatgaactttggattagtcagcctgacacaggagaacaagctcttgagattgctgaatatttaattagaagtggtggagttgatttaattgttgttgattctgttgcagctttgacaccacaggcagagattgatggagagatgggcgattctcagattgggcttcaagcaagattaatgagtaaggctttaagaaagattacaggcatactctcaaaatctaatacttgtattatgtttattaatcaactaagaatgaaaatcggtgtaatgtttggcaatccagagactactactggaggaaatgctttaaaattttattcttctcttcgtcttgaagttaggaagattgatcaggtaacggggagttctgcggatgatattgttggtaataaaataagaattaaggttgtaaaaaataaagtagcacctccttttcgtaaagtagaacttgtgatttattttggaaaaggcatttcgcgtgaagctagtatactagatgcttcagttaagtataatttgatacaaaaaacaggttcttggtattctatgggagacgataagttaggacaaggcagagagcatgctgttagttatttagttaaagaaaaagaggtgactgatgaacttgagagtaagcttagaaaaataatttttgaggatcccaatcaagattttcttgaagttggtaccacctgatgctaagaaagataaaaaataaaatggtaggtttagatgattatttgattgtttgtaatgattttaaaggtggaatagaaattttttttgattacgtaagaaataaaagagagattttaaagacttttaatttaaataaaataatagaagattttttgacattttctgagagcattgaaatagatgttaaagacttaattaagttttattctttttcaaccagtttgctttatttaaagacacaaattctttatccagtaaaattaaaggataaaaaattagttgaaagggagatagtgcagaaattaataaattacagtgaaaaatctgcagagatcaggagcgcaactcataatttaaaagacggtgtatgcctaaatgtatttaaatcttctttttttagagaaaatggtacctttttagaaagtgtggataatattcaggattgcaagatcgagattaataaggttaagagcacagtcagggtggcaagggtagagagaaagcatgatgatattcctcgtaatattaaattaaggtctaatgttattttaggcacatatgatgctaagtttttggataaaaaaacaagaattattgcccttttaactaaggaagataatttaatttttgaatttttattggattttgatgataaattttacttttttgagagattttgttattttgatgaactactgtaccatct

SEQ ID NO: 2903 - protein, 356 aa, Borrelia hermsii
MSKLKDNPDNSLNDRLNREKAIELARVQIEKDFGKGSLIKMGESPVGKGIESISSGSILLDEAIGVGGYPRGRIIEIFGPESSGKTTLTLQAIAEVQKNGGIAAFIDAEHALDPAYAKALGVNIDELWISQPDTGEQALEIAEYLIRSGGVDLIVVDSVAALTPQAEIDGEMGDSQIGLQARLMSKALRKITGILSKSNTCIMFINQLRMKIGVMFGNPETTTGGNALKFYSSLRLEVRKIDQVTGSSADDIVGNKIRIKVVKNKVAPPFRKVELVIYFGKGISREASILDASVKYNLIQKTGSWYSMGDDKLGQGREHAVSYLVKEKEVTDELESKLRKIIFEDPNQDFLEVGTT

SEQ ID NO: 2904 - DNA, 1487 bp, Chlamydomonas reinhardtii
  CDS (121)..(1365)
cgtagacgcacctgccaggacggatttgcgagctcgcttccaacgcacaacgagagagaacaaagtcacgtcaatttttccgcgacccgctagctccttttactcggttcgcttgaagccatgcagaccgcaattcaaatgcctagtggtggctgcttgagcagtggggcccgggcccggagcagcgcacgggccactcaacagattctttgcgcgccacgtcgcgacgtcgttgcgaaggcgcggcgcaccaaaactgccacgacaacctatactcagggcgaacgcccggatgccgataccaaggccaagctcttcaacgagacagtcgaccgcatcactcgccgctttggtgacgggtccatcatgcgtctcagcgacagcgtcacggcgaacattgagaccttccccagcggctcactcacgctggacgcggccctgggcggcggctacccccgcggccgcattatcgaggtgtacggtccggaggccagcggcaagaccacgctggccatgcacggctgcggcgagatccagcgcctgggcggcacggtcgcctacatagacgtggagcacgccttcgaccgcacctacgcgagcgctgggcatcacctgaacaacttctggtacgcgcagcccatgacgggcgaggaggcgctggaggtgatggacgagctgtgccgcagcaacgtgtgcgacctggtggtcatcgactcggtggcggcgctggtgccgagggccgagctggagggagacatcggcagcgtgcagatcggcagccaggcccgcctgctgagccaggccctgcgcaagctgtccgcctccgcctccaaaagcaagaccaccctgttcttcatcaaccagctgcggaacaagattggcgtcatgttcggcaaccccgagaccacctcgggcggcaacgcgctcaagtactacagcagcgtgcgcatcgacatccgcaagaaggagacactcagcgagtcggaccaggcctacgccaaccgggtccgcgccaaggtggtgaagaacaaggtggcctcgccgcataaggaggctctgtttgagatctactacggccgtggcattgacttcctgggcggactcatcgacaccgcggagcgcctcaaggtgctcacccgccgcggtgccttctactactacggcgaccagcggctgggccagggccgggagaaggtgttggcggcgctgcgcgaggacgcggagcgcacagccgccattgaggccgcggtgcgggacgtgctgcgggccaaccccgacgcggcgctggtggacacggaggagggcgacgacgacgacggcctgggcaccgcctccaccgtggcgctggacatggacgacgtgtagggggaggcaggagggctggcaggcagggaggccagtgctgttatggggggggggctgtggtagtacacagctgggcggcagtgggcagcgccaggacgccacctgagcccaattcgccctat

SEQ ID NO: 2905 - protein, 414 aa, Chlamydomonas reinhardtii
MQTAIQMPSGGCLSSGARARSSARATQQILCAPRRDVVAKARRTKTATTTYTQGERPDADTKAKLFNETVDRITRRFGDGSIMRLSDSVTANIETFPSGSLTLDAALGGGYPRGRIIEVYGPEASGKTTLAMHGCGEIQRLGGTVAYIDVEHAFDRTYASAGHHLNNFWYAQPMTGEEALEVMDELCRSNVCDLVVIDSVAALVPRAELEGDIGSVQIGSQARLLSQALRKLSASASKSKTTLFFINQLRNKIGVMFGNPETTSGGNALKYYSSVRIDIRKKETLSESDQAYANRVRAKVVKNKVASPHKEALFEIYYGRGIDFLGGLIDTAERLKVLTRRGAFYYYGDQRLGQGREKVLAALREDAERTAAIEAAVRDVLRANPDAALVDTEEGDDDDGLGTASTVALDMDDV

SEQ ID NO: 2906 - DNA, 1669 bp, Streptococcus suis
  CDS (469)..(1500)
gatcagccgtattttagcggaggaaaagtcgtcggtcagatagggatagcaatcgggctggctatcagaggaagctgactgcattcggcaggagctgcaagctgatttaggtttggctgtgtctgtgcttatcaaaccggaatcaacagaggacaacgtacttgcaaaagtatacctcactttggctacgccttcgggtatttcccaaaaagagatagatttaggtggttattcgtggcaatacttcgccagcttgcttgtctgcaggcctgggattttgtacgaaacactttgtgaaatagcagatatttgctataatagtttgactaagaaaagaggagaaaatcattggctaagaaaccaggaaaaaaattagaagatattacaaagaaatttggcgatgagcgtaaaaaagcgttggatgatgccctaaaatcaattgaaaaagattttggtaagggtgctgttatgcgtcttggtgagcgtgctgagcaaaaagttcaagtcatgagctcaggtagcttatcaatcgacattgcgcttggagcaggtggctatcctaagggccgtatcattgagatttacggtccagagagctcaggtaagacaactgttgctctacacgcagtagctcaagcccagaaagatggtggtattgctgcctttatcgatgcggagcatgccttggatccagcctatgcggcggctcttggtgtcaatattgatgagttactattgtcacagccagactcaggggaacaaggtcttgaaattgcaggcaagctgatcgactctggtgcggttgacttggttgttgttgactcggttgcagcccttgtaccacgtgcagaaattgacggtgatatcggtgatagccacgttggtttgcaggctcgtatgatgagccaggctatgcgcaaactcggtgcatccatcaacaaaactaagacagtagctattttcatcaaccaattacgtgaaaaagtcggtgtcatgtttggtaaccctgaaacaacgcctggtggacgtgcgcttaaattctatgcatctgtccgtatggatgttcgtggaaacacacaaatcaaaggaacaggtgacaagaaagatcaaaacgttggtaaggaaaccaaggtgaagattgtgaagaacaaggtggctccaccatttaaagaagctgttgttgaaatcatgtacggtgaaggaatttctcgcaccggtgaattgattgagattggtagcaacctcggcatcatccaaaaagcaggggcttggtattcatataatggagaaaaaattggccaaggttctgaaaatgctaagaaattcttagcagataatccagcaatctttgatgaaattgaccgcaagatacgtgttcattatggcttgattgaagcagatggagttgaagaagttgcgaccgaagaagctcctgttgttgcggaagaaatccaagatgttatcctaaatcttgatggcggtattgaattagaagattaattcctaacaaaatagatttaatattgaaccattgatgcatatctgttataggtgtgtatgaagttgtttagtataagaacgaaaaagtctggagattccaggcttttttctaataaaaaccgaatttttaccccaaaatttaaagtttttttaaaaaataggtctgcag

SEQ ID NO: 2907 - protein, 343 aa, Streptococcus suis
MRLGERAEQKVQVMSSGSLSIDIALGAGGYPKGRIIEIYGPESSGKTTVALHAVAQAQKDGGIAAFIDAEHALDPAYAAALGVNIDELLLSQPDSGEQGLEIAGKLIDSGAVDLVVVDSVAALVPRAEIDGDIGDSHVGLQARMMSQAMRKLGASINKTKTVAIFINQLREKVGVMFGNPETTPGGRALKFYASVRMDVRGNTQIKGTGDKKDQNVGKETKVKIVKNKVAPPFKEAVVEIMYGEGISRTGELIEIGSNLGIIQKAGAWYSYNGEKIGQGSENAKKFLADNPAIFDEIDRKIRVHYGLIEADGVEEVATEEAPVVAEEIQDVILNLDGGIELED

SEQ ID NO: 2908 - DNA, 1439 bp, Peanut witches
  CDS (218)..(1228)
atttccaagatataatttaaaaatgtatttttttattaatattattttaattttgaatatttttataattattgtttctggtatggattatattttaaaaaattttaaattaatttatacgaattttaattctaaaaattaatttttatagaaaattatatttttgataatattgttaaattttattaaaatgatatatgtagaggtgattgatcaaatgagtaaagaaatatttaaaaaacctcctttaacacaaactatctgtgaaatagagaaaattttcggcaaaggtagtattatgcaaatgaactccgataaagtagaacctatagaatctatttctactggttctttaggattagatatagctttatctattggaggtttacctagaggtagaattgtagaaatttttggacccgaaagcgctggtaaaactactttagctttgcatgtaatagcagaagctcaaaaatctggaggtacggttgcttttatagatgctgaattctttaattttaattatgctaaaactataggagtagactgtaataaaatgttaatatctcaccctgattctggagaagttgctttaaatattgctaatttgttatttgaaaagatgctgttgaatctagtggtagtagattctgtagctgctttagcacctttagctgaattaaatggtgatgtcggtgattcttacgtaggtatacatgctcgaatgatgaatcaggctttaaggaagcaaagccatatcgtttataaatctaatgctattcttatttatattaatcagttaagagaaaaggtaggaattactttcggtaataatgaagttactcccggaggtaaaggattaaaattttttacatctgttagattagatgttcgaaaaacatcagaattaattaaagagaatgatcaagttgtgggagtgaaaactaatgttcgtattgttaaatctaaagtttgttctccttataaaaccgttagttttgatattttatatggcaaaggtatttctaaagttagtgaaattttagatttagcagtaagtttaaatttaattaaaaaaaatggtatgtggtatagttataataatcaacaaattggtcaaggtagagagaaagcgcgagaatttttactaaaacatccagatcttgctcatgaattagaattaaccattcgtaaaaattataatttaagcagtaataataaaaaataaatgtttaattgaaatgcctattaggcgtttttaataattgattatttaattttttatttttcttaataaaaatttaatattttttaattataatttttattttagaaaagatttatttatccttcctagtatataaatatttataattaattaaaaataaaaagattttttaaatatttaatattcggctttagaaaaatatttaattaaa

SEQ ID NO: 2909 - protein, 336 aa, Peanut witches
MSKEIFKKPPLTQTICEIEKIFGKGSIMQMNSDKVEPIESISTGSLGLDIALSIGGLPRGRIVEIFGPESAGKTTLALHVIAEAQKSGGTVAFIDAEFFNFNYAKTIGVDCNKMLISHPDSGEVALNIANLLFEKMLLNLVVVDSVAALAPLAELNGDVGDSYVGIHARMMNQALRKQSHIVYKSNAILIYINQLREKVGITFGNNEVTPGGKGLKFFTSVRLDVRKTSELIKENDQVVGVKTNVRIVKSKVCSPYKTVSFDILYGKGISKVSEILDLAVSLNLIKKNGMWYSYNNQQIGQGREKAREFLLKHPDLAHELELTIRKNYNLSSNNKK

SEQ ID NO: 2910 - DNA, 1377 bp, Myxococcus xanthus
  CDS (201)..(1277)
ttgcgctcctgggcgtggcgcacacgggctgtgggtgggattggcggggctggtggccgccttcctggctgccctccgcgagggctgaccggcaggatgcagcacggatgtcagaggggtggactagggtctacccatcgcgtactaaaagcgcgttcaggtgagccggggtggctcgccaatacaaggagctacgagcaatggccgtgaatcaggagaaggaaaaggcgatcgaactggcgatgtccgcggtggagcgccagttcggcaaggggtccatcatgcggctcggcaacgacgagccaatgatgcgagacgttcaggccatcccgacgggctccatctcgctggacatcgccctgggcgtgggtggcgtgcccaagggccgcatcatcgaaatcttcgggccggagtcgtccggtaagacgacgctgtgtctccacatcgtcgccgaagcgcagaagcgcggcggcatctgcggctacgtggacgcggagcacgcgctggacgtgggctacgcgcgcaagctgggcgtgcgcaccgatgacctgctgctgagccagccggacaccggtgagcaggcgctggaaatcgcggagatgctggtgcgctcgggcgccatcgacgtgctggtggtggactcggtggccgcgctcgtgccgaaggcggagctcgagggtgagatgggcgacgcgcacatgggtgtgcaggcccgcctcatgagccaggcgctccgcaagctgacgggcaccatcgccaagagccagacgtgcgtcatcttcatcaaccagattcgcatgaagattggcgtgatgttcggcaacccggagacgacgacgggcggtaacgcgctgaagttctacgcgtcgcagcgcctggacatccgccgcatcggcgccatcaagaatggcgacaacgtggtgggcagccgcacccgcgtgaaggtggtgaagaacaaggtcgcgccgccgttcaaggaagtcgagttcgacatcatgtacggcacgggcatctcccgtgagggcgacctcatcgacctcgcctccaacgagaacatcgtggagaagagcggcagctggttctccttcaatggtgagcgcatcggccagggccgggagaacgtgaaggagtacctgcgcgagcacccggagatcgcgaaggacatcgaaggccgcgtgctggagaagtacggcatcggcaagtcgggtgcgccgtcgccgcggcgccggacgagtccgcgccggccgaaggtggcagcgagaagcgcggccgtgtgaaggccgtgaagtagtcggtcccggggcttttccccggatggtggcaattcaccatgaaagccagagggccgtccgccgcgaggtgggcggcccttttgct

SEQ ID NO: 2911 - protein, 358 aa, Myxococcus xanthus
MAVNQEKEKAIELAMSAVERQFGKGSIMRLGNDEPMMRDVQAIPTGSISLDIALGVGGVPKGRIIEIFGPESSGKTTLCLHIVAEAQKRGGICGYVDAEHALDVGYARKLGVRTDDLLLSQPDTGEQALEIAEMLVRSGAIDVLVVDSVAALVPKAELEGEMGDAHMGVQARLMSQALRKLTGTIAKSQTCVIFINQIRMKIGVMFGNPETTTGGNALKFYASQRLDIRRIGAIKNGDNVVGSRTRVKVVKNKVAPPFKEVEFDIMYGTGISREGDLIDLASNENIVEKSGSWFSFNGERIGQGRENVKEYLREHPEIAKDIEGRVLEKYGIGKSGAPSPRRRTSPRRPKVAARSAAV

SEQ ID NO: 2912 - DNA, 1404 bp, Acidiphilium facilis
  CDS (187)..(1251)
taatattcaattcacaaaacacttgatactgtatgaggatacagtataatgccgaacacaagaccagttgccgatgacagcctagcggtacgttgacaaaacgcgggttttttatacgcgtctgcatttaagccggcttgttgcaagcgatattacccccgatctctaagaggaagaggaaaaattatggatgaacccggcggcaaaattgaattctccccggccttcatgcagatcgaggggcaatttggcaaaggggccgtgatgcgcgccggggataaacccggcatcaacgaccccgacgtcaagtcgacgggctcgctcggcctcgacggcgccctcggtcaaggggggctcccgcgggggcgggtggttgagatctacgggccggaatcatccggaaaaaccacactgacgctgaaagcgatagcgagtgcacaggctgaaggcgccacgcccgcgtttactgatgcggagcacgcgctggacccaggctttgccagcaagctcggggtgaatgtcaaacgcctcctcatctcgcagcctgataccggggagcaggcgctcgaaatcgccgacatgctgttccgctccggagccgtcgacgtgatcgtgaaggactcggtggccgccctcacgcccaaagccgaaatcgaaggcgagatgggggattcgcaccagggcctccacgcgcgcctcatgagtcaggccttgcggaacaaaacggccaacatctcgcggtggaacaagctggtgatctttaagaagcagatccggatgaaaatgggggtgtatgggagaccggaaacgacgaccggtggtaatgcccttaaattctacgcttcggtgcggcttgatatccgccgcatgggcgcgatgaaaaagagcgcgacgaagtcgtacgattggagcacccgcgtcaaggtggtcaagaataaggtcgcaccacctttccgccaagcggaattagcgatctactacggtgaagggatctaccgtgggtcggaaccggtcgacctgggtgtgaagttggaaaacgtggaaaaaagcggcggctggtacagttaccccggccggcgtattgggcaggggaaggccaacgcgcggcagtacctgagggtgaaaccggagttccccgggattttcgagcaagggatacggggggccatggcagcaccacaccccctcgggtttggggaacgaagagacgtccaacaagagagcggggagccctatgggaataatgggtgaccttaaggatccatttaccacggcccgcatggcatcgccgagtcctgatccgaggcgtaatcgcggataggcctcgagacgacgggcggaaaagcgccagtcgtcggcactgcgcatccagtccggatgccagatggcggatatgggcagtag

SEQ ID NO: 2913 - protein, 354 aa, Acidiphilium facilis
MDEPGGKIEFSPAFMQIEGQFGKGAVMRAGDKPGINDPDVKSTGSLGLDGALGQGGLPRGRVVEIYGPESSGKTTLTLKAIASAQAEGATPAFTDAEHALDPGFASKLGVNVKRLLISQPDTGEQALEIADMLFRSGAVDVIVKDSVAALTPKAEIEGEMGDSHQGLHARLMSQALRNKTANISRWNKLVIFKKQIRMKMGVYGRPETTTGGNALKFYASVRLDIRRMGAMKKSATKSYDWSTRVKVVKNKVAPPFRQAELAIYYGEGIYRGSEPVDLGVKLENVEKSGGWYSYPGRRIGQGKANARQYLRVKPEFPGIFEQGIRGAMAAPHPLGFGERRDVQQESGEPYGNNG

SEQ ID NO: 2914 - DNA, 1059 bp, Actinobacillus actinomycetemcomitans
  CDS (1)..(1059)
atggcaactcaagaagaaaagcaaaaagcactcgacgcggcgttaggtcaaattgaaaaacaatttggtaaaggcgccatcatgaaactcggcgacagccaaaaactggacattgaagcgatttccaccggttctttcggtcttgacctagcactaggcatcggcggtttgccgatggggcgtatcgtggagattttcgggccggaatcttcaggtaaaactaccttaaccctttctgtgattgcggaagcgcaaaaaaccggcaaaacctgtgcctttattgatgcggaacatgctttagacccgatttatgcctccaaactcggcgtggatgtaaaagaacctttagtttcccagccggacaacggcgaacaggcgctggaaatttgtgatgcgttggtgcgttccggtgcggtggatgtaattatcgttgactccgttgccgccttaacgccgaaagcggaaattgaaggcgacatgggcgattcccacatgggattacaagcgcgtttaatgtctcaagcattgcgtaaacttaccagccaaattaaaaacgccaactgcttggtgattttcatcaaccaaattcggatgaaaatcggcgtgatgttcggtaatccggaaaccaccaccggcggtaacgcgttgaaattctatgcctccgtgcgtttggatattcgccgcgtgggttctatcaaagagggtgatgaagttatcggtaatgaaactcgtgtgaaagtggtgaaaaacaaagtggcgccaccgttccgccaagtggatttccaaattctgtacggcgaaggtatttccaaagaaagcgaactgattgagctcggcgtgaaacataaactcatcagcaaagcaggtgcgtggtacgcttaccaaaacgagaaaatcggtcagggcaaaaccaatgctatgaaatggttgaaagacaatcctgaacaagccaaatttatcgaaagcaccttgcgtgatgaattgttggcacatccggaatctgccatcactgcggaagtagaagacgaagcgggtaatggcgaaggcgatttcgaataa

SEQ ID NO: 2915 - protein, 352 aa, Actinobacillus actinomycetemcomitans
MATQEEKQKALDAALGQIEKQFGKGAIMKLGDSQKLDIEAISTGSFGLDLALGIGGLPMGRIVEIFGPESSGKTTLTLSVIAEAQKTGKTCAFIDAEHALDPIYASKLGVDVKEPLVSQPDNGEQALEICDALVRSGAVDVIIVDSVAALTPKAEIEGDMGDSHMGLQARLMSQALRKLTSQIKNANCLVIFINQIRMKIGVMFGNPETTTGGNALKFYASVRLDIRRVGSIKEGDEVIGNETRVKVVKNKVAPPFRQVDFQILYGEGISKESELIELGVKHKLISKAGAWYAYQNEKIGQGKTNAMKWLKDNPEQAKFIESTLRDELLAHPESAITAEVEDEAGNGEGDFE

SEQ ID NO: 2916 - DNA, 1565 bp, Alcaligenes eutrophus
  CDS (194)..(1255)
tgccggtggggcttgccaagcatactgtttttttatacagtacccgacattccgggcgagctaccatgaaaggtgatcgcaccatgccgggttgggcgtcgtggcctggagaatccatcccggaaaagggctttgggttcagggcgtcgcgccgtatgcggcctatttatacaccattgactgaaggacgaccatggacgacaagaaggccggcgccggcgtgagcgctgagaagcagaaggcgcttgccgccgcgctctcccagattgagaagcagtttggcaagggctcgatcatgcgcctgggcgatggcgaaatcgaacaggacatccaggtagtgtccaccggctcgctggggctggacatcgcgctgggcgtgggtggcctgccgcgcggccgcgtggtcgagatctacggtccggaatcgtccggcaagaccacgctgacgttgcaggtggtggccgaaatgcagaagctgggcggcacctgcgcgttcatcgacgccgagcacgccctggatgtccaatatgctggcaagctcggcgtggacgtcggcaatctgctgatctcccagcccgataccggcgagcaggccctggaaatcaccgacgcgctggtgcgctcgggttcgatcgacctgatcgtgatcgactcggtggccgctctggtgccaaaggcagaaatcgagggcgaaatgggcgattcgctgcccggcctgcaggcccgcctgatgagccaggggctgcgcaagctgaccggcacgatcaagcgcacgaactgcctggtgatcttcatcaaccagatccgtatgaagatcggtgtgatgtttggttctcccgaaaccaccaccggcggtaacgcgctgaagttctacgcctcggtgcgcctggacatccgccgtatcggctcgatcaagaagggcgacgaagtcgtcggcaacgagaccaaggtcaaggtggtcaagaacaaggtgtcacctccgttccgcgaggcgttcttcgacatcctctatggccagggcatctcgcgccagggtgaaatcatcgacctgggcgtggacgccaagatcgttgagaaggccggcgcctggtacagctacaacggcgagaagatcggccagggcaaggacaacgcacgcgagtatctgcgcgagaacccggacatcgccgacgagatcgagaacaaggtgcgtctggcgctgggcgtggcgccgctgaacaccgtggcgggcgcgccagcagaggtcgaaggctgagcctgacgtcgctgcttgacgaaagccgtcgcatacttgtgcggcggcttttttgttttcaccccggtttcccgtatcgcgcagcgccgactgccggcttcctcgttatcagccgaatgccccgtccccccctctcactgaaagcccgtgccgtcggctacctttcccgtcgggagcacagccgggccgaactcgcgcgcaagctgcgcctcatgccgagtcgccgagaggtgaggctctgctcgatgtgctcgaacgcgacaactggctgtccaatgagcggttcgtcgatagccttgttcaccgccgg

SEQ ID NO: 2917 - protein, 353 aa, Alcaligenes eutrophus
MDDKKAGAGVSAEKQKALAAALSQIEKQFGKGSIMRLGDGEIEQDIQVVSTGSLGLDIALGVGGLPRGRVVEIYGPESSGKTTLTLQVVAEMQKLGGTCAFIDAEHALDVQYAGKLGVDVGNLLISQPDTGEQALEITDALVRSGSIDLIVIDSVAALVPKAEIEGEMGDSLPGLQARLMSQGLRKLTGTIKRTNCLVIFINQIRMKIGVMFGSPETTTGGNALKFYASVRLDIRRIGSIKKGDEVVGNETKVKVVKNKVSPPFREAFFDILYGQGISRQGEIIDLGVDAKIVEKAGAWYSYNGEKIGQGKDNAREYLRENPDIADEIENKVRLALGVAPLNTVAGAPAEVEG

SEQ ID NO: 2918 - DNA, 1047 bp, Amycolatopsis mediterranei
  CDS (1)..(1047)
atgcctgcagcacccgacaaggacaaggcgctcgagctcgcgctcgcgcagatcgacaagcagtacggcaagggctcggtcatgcgcctcggcgaagagggccgcgcccccatcgccgtgatccccaccggcgcgatcgccctcgacgtcgcgctcggcatcggcggcctgccccgcggccgggtcatcgaggtctacggcccggagtcctccggtaagaccacggtcgccctgcacgcggtggcgaacgcccagcgcaacggtggcatcgcggccttcatcgacgcggagcacgcgctggacccggactacgccaagaagctcggcgtggacaccgacgccctgctcgtctcccagcccgacaccggtgagcaggccctggagatcgcggacatgctggtccgctccggcgcgctcgacatcctggtcatcgactccgtggccgcgctcgtgccccgcgccgagatcgaaggcgagatgggcgactcgcacgtcggtctccaggcccggctgatgagccaggcgctgcgcaagatgaccggtgcgatgaacaactccggcaccaccgcgatcttcatcaaccagctgcgcgagaagatcggcgtcatgttcggctccccggaaaccaccaccggtggcaaggcgctgaagttctacgcgtcggtccggctcgacgtccgccgcatcgagacgctcaaggacggcggcgaggcggtcggcaaccgcacccgcgtcaaggtcgtgaagaacaagatggccccgcccttcaagcaggccgaattcgacatcctgtacggccacggcatctcccgcgagggttcgctcatcgacatgggggtcgaccaggccatcctgcgcaagtccggcgcctggtacacctacgagggcgaccagctcggccagggcaaggagaacgcccggaagttcctgcgcgacaacccggacatcgccaacgagatcgagaagcggatcaaggagaagctcggtatcggtgcgcagctcgacgcggaagccgtcgaggccgttccggcaccggtcgacttctag

SEQ ID NO: 2919 - protein, 348 aa, Amycolatopsis mediterranei
MPAAPDKDKALELALAQIDKQYGKGSVMRLGEEGRAPIAVIPTGAIALDVALGIGGLPRGRVIEVYGPESSGKTTVALHAVANAQRNGGIAAFIDAEHALDPDYAKKLGVDTDALLVSQPDTGEQALEIADMLVRSGALDILVIDSVAALVPRAEIEGEMGDSHVGLQARLMSQALRKMTGAMNNSGTTAIFINQLREKIGVMFGSPETTTGGKALKFYASVRLDVRRIETLKDGGEAVGNRTRVKVVKNKMAPPFKQAEFDILYGHGISREGSLIDMGVDQAILRKSGAWYTYEGDQLGQGKENARKFLRDNPDIANEIEKRIKEKLGIGAQLDAEAVEAVPAPVDF

SEQ ID NO: 2920 - DNA, 1035 bp, Bacteroides thetaiotaomicron
  CDS (1)..(1035)
atggcaaagaaagacgaacttaattttgaaacagataataaaatggcatcaagcgaaaaactgaaagccttacaggctaccatggaaaagatagaaaagaacttcggtaaaggttctatcatgaaaatgggtgatgatagtgttgaacaagtggaagtgattcctaccggctccattgctttaaacgtggcacttggcgtaggaggatatcctaggggaagaatcatcgaaatctatggtccggaatcttccggtaaaacgactctggctattcacgccattgccgaagcacaaaaagccggtggtatcgccgcttttattgatgccgaacatgccttcgaccgtttttatgcagcgaaattaggcgtggatgtagacaatctctggatttctcaaccggacaacggagagcaggccttggaaatagccgaacagttaatccgttcttccgctattgatattattgttattgactccgtagcagcattaactccgaaagcagaaattgaaggcgacatgggtgacaataaggtaggtttgcaggcacgtctgatgtcacaggctttgcgtaaattgaccggtacagtcagcaaaacacgtacaacttgtatctttatcaaccagctccgtgaaaagattggcgtcatgttcggtaatccggaaacaacgacaggtggtaacgcattgaagttctatgcttctgtacgtatagatatccgtggcagccagccaatcaaagacggtgaagaagttcttggtaaactgactaaggtgaaagtggtgaagaacaaagtagcacctcctttccgcaaagcagaatttgatatcatgtttggtgaaggtatttctcactccggagaaatcatcgatttgggcgcagaactgggaatcatcaaaaagagcggttcatggtatagctacaatgacactaaactgggtcaaggacgtgatgcagccaaggtatgtatcaaagataatcccgaacttgctgaagaattagaaggattgatcttcgaagccttgaataaaaaataa

SEQ ID NO: 2921 - protein, 344 aa, Bacteroides thetaiotaomicron
MAKKDELNFETDNKMASSEKLKALQATMEKIEKNFGKGSIMKMGDDSVEQVEVIPTGSIALNVALGVGGYPRGRIIEIYGPESSGKTTLAIHAIAEAQKAGGIAAFIDAEHAFDRFYAAKLGVDVDNLWISQPDNGEQALEIAEQLIRSSAIDIIVIDSVAALTPKAEIEGDMGDNKVGLQARLMSQALRKLTGTVSKTRTTCIFINQLREKIGVMFGNPETTTGGNALKFYASVRIDIRGSQPIKDGEEVLGKLTKVKVVKNKVAPPFRKAEFDIMFGEGISHSGEIIDLGAELGIIKKSGSWYSYNDTKLGQGRDAAKVCIKDNPELAEELEGLIFEALNKK

SEQ ID NO: 2922 - DNA, 1194 bp, Bifidobacterium longum
  CDS (1)..(1194)
atggcacttgagaccaagccggccaaggacccggcagccgaggacaagcacgagctcgatcccaagcgcaaggcggcgctggacaccgcgctggcgcaggtcgagaagagttttggcaaaggttccgcaatgcgactgggcgaccagcccgagcagaacgtcgaggtgattcccaccggttcgttggctctcgatatggcactcggcatcggcggcctacccaagggccgcatcgtggagatctacggccccgaatcatccggtaagaccacgctcgcattgcatgtggtggccaatgcccagaagaagggcggcgtggcggcctacatcgatgccgaacacgcgctcgacccggcctacgcccgcaagctcggcgtggacaccgactcactcatcgtctcccagccggataacggcgagcaggccctcgaaatcgctgacatgctgattcgctccggtgcgcttgacgtcatcgtcatcgactcggtcgccgctttggtgccgaaggccgaaatcgaaggcgaaatgggagacagccatgttggtttgcaggcccgactcatgagtcaggcgctgcgcaagatgaccggcgcgttggctcaggccggcaccaccgccatcttcatcaaccagctgcgtgagaagatcggcgtgttcttcggcaaccctgaaaccaccaccggtggtaaagctctgaagttctacgcctccgtgcgtctcgacatccgccgcatccagaccttgaagaacggcgacgaagcggtgggcaaccgcacgcgcgtcaaggtggtcaagaacaagatggccccgcctttcaagtccgccgaattcgacatgctctacggtgaaggcatttcccgtgagggctcggtgatcgacatggcccagcaggttggcgtggtcaagaagtccggttcgtggttcacctatgagggtgatcagctcggtcagggacgagagaaggtccgtcagttccttaaggacaacccggccatcaccgaggagattgagaacaaggtcaaggccgagttcggtctgatcggttccgccgatcagttcgcggaagatggcgaagccgcagcagcggccgccgtcagcgaggctgctgcggctgacgtggccaaggacagcaaggccgcagcggcgcctgctgccaaaacgacccgtgccaaggccggcacagctaaggcctga

SEQ ID NO: 2923 - protein, 397 aa, Bifidobacterium longum
MALETKPAKDPAAEDKHELDPKRKAALDTALAQVEKSFGKGSAMRLGDQPEQNVEVIPTGSLALDMALGIGGLPKGRIVEIYGPESSGKTTLALHVVANAQKKGGVAAYIDAEHALDPAYARKLGVDTDSLIVSQPDNGEQALEIADMLIRSGALDVIVIDSVAALVPKAEIEGEMGDSHVGLQARLMSQALRKMTGALAQAGTTAIFINQLREKIGVFFGNPETTTGGKALKFYASVRLDIRRIQTLKNGDEAVGNRTRVKVVKNKMAPPFKSAEFDMLYGEGISREGSVIDMAQQVGVVKKSGSWFTYEGDQLGQGREKVRQFLKDNPAITEEIENKVKAEFGLIGSADQFAEDGEAAAAAAVSEAAAADVAKDSKAAAAPAAKTTRAKAGTAKA

SEQ ID NO: 2924 - DNA, 1062 bp, Bordetella pertussis
  CDS (1)..(1062)
atggacgacaaaaccagcaaggccgccgcggccgagaaagccaaggcgctggccgccgcgctgtcgcagatcgaaaagcagttcggcaagggctcgatcatgcgctatggcgacaacgaggtcgaacacgacatccaggtcgtgtccaccggttcgctggggctggacatcgcgctgggcgtcggcggcctgccgcgcggccgcgtgatcgaggtctacggccccgagtcgtccggcaagaccacgctcacgctgcaggtcatcgccgaaatgcagaagctgggcggcacctgcgccttcgtcgacgccgaacacgcgctggacgtgcaatacgcctccaagctgggggtcaacctgaccgacctgctgatctcccagccggacacgggcgagcaggccctcgagatcaccgacgcgctggtgcgctcgggctcggtcgacctgatcgtcatcgactcggtcgcggcgctggtgcccaaggccgaaatcgaaggcgagatgggcgactccctgccgggcctgcaggcccgcctgatgagccaggcgctgcgcaagctgacggccaccatcaagcgcaccaactgcatggtcatcttcatcaaccagatccgcatgaagatcggcgtgatgttcggcaaccccgaaaccaccaccggcggcaacgcgctcaagttctattcctcggtgcgcctggacatccgccgcatcggcgccatcaagaagggcgacgaggtggtcggcaacgaaacccgcgtcaaggtggtcaagaacaaggtggcgccgccgttcaagcaggccgagttcgacatcatgtatggcagcggcatctcgcgcgaaggcgaaatcatcgacctgggcgtgcaagccaatgtggtcgacaagtccggcgcctggtacagctacagcggcaaccgcatcggccagggcaaggacaatgtgcgcgagtacctgaaagagcacaaggaaatggccatcgagatcgaaaacaaggtgcgcgagaaccagggcatagtcagccgcgccgccacctttccggccagcgaagccgaagacggcgaatga

SEQ ID NO: 2925 - protein, 353 aa, Bordetella pertussis
MDDKTSKAAAAEKAKALAAALSQIEKQFGKGSIMRYGDNEVEHDIQVVSTGSLGLDIALGVGGLPRGRVIEVYGPESSGKTTLTLQVIAEMQKLGGTCAFVDAEHALDVQYASKLGVNLTDLLISQPDTGEQALEITDALVRSGSVDLIVIDSVAALVPKAEIEGEMGDSLPGLQARLMSQALRKLTATIKRTNCMVIFINQIRMKIGVMFGNPETTTGGNALKFYSSVRLDIRRIGAIKKGDEVVGNETRVKVVKNKVAPPFKQAEFDIMYGSGISREGEIIDLGVQANVVDKSGAWYSYSGNRIGQGKDNVREYLKEHKEMAIEIENKVRENQGIVSRAATFPASEAEDGE

SEQ ID NO: 2926 - DNA, 1089 bp, Bradyrhizobium japonicum
  CDS (1)..(1089)
atgtccgcaactgccctgcgtatcgtcgaaggatcttccatggacaagagtaaagctctggccgccgcgctctcccagatcgagcgccagttcggcaagggctcggtgatgaagctcggcaagaacgaccggtcgatggatgtcgaggcggtgtcctccggttctctcgggctcgacattgcactggggatcggcggtctgcccaaggggcgcgtcgtggaaatctacgggccggaatcctcgggcaagaccacgctggcgctgcacacggtggcggaagcgcagaagaagggcggcatctgtgccttcatcgacgccgagcacgcgctcgacccggtctatgcacgcaagctcggggtcaatatcgacgagctgctgatttcgcagccggacaccggcgagcaggcgctggaaatctgcgacacgctggtgcgctcgggtgcggtggacgttctggtggtcgattcggtcgcggcgctggtgccgaaggccgaactcgagggcgagatgggcgatgcgctgccgggtctccaggcccgcctgatgagccaggcgctgcgcaagctgacggcctccatcaacaagtcccacaccatggtgatcttcatcaaccagatccgcatgaagatcggtgtgatgtatggctcaccggagaccaccaccggcggcaacgcgctgaagttctacgcctccgtccgcctcgacatccgccgcatcggcgcgatcaaggagcgcgacgaagtggtcggcaacaccacgcgcgtcaaggtggtgaagaacaagctggcgccgcccttcaagcaggtcgagttcgacatcatgtacggcgagggcgtttccaagatgggcgagatcctcgatctcggcgtcaaggccggcatcgtcgaaaagtccggcgcctggttctcctatgacagccagcgcctcggccagggccgcgagaactcgaaagcgttcctgaaggccaaccccgacatcaccgccaagatcgagaccgcgatccgccagaactccggcctgatcgccgagcagattctggccggcacccctgagcgcgacgccgacggcgaggagccggcggacgagtaa

SEQ ID NO: 2927 - protein, 362 aa, Bradyrhizobium japonicum
MSATALRIVEGSSMDKSKALAAALSQIERQFGKGSVMKLGKNDRSMDVEAVSSGSLGLDIALGIGGLPKGRVVEIYGPESSGKTTLALHTVAEAQKKGGICAFIDAEHALDPVYARKLGVNIDELLISQPDTGEQALEICDTLVRSGAVDVLVVDSVAALVPKAELEGEMGDALPGLQARLMSQALRKLTASINKSHTMVIFINQIRMKIGVMYGSPETTTGGNALKFYASVRLDIRRIGAIKERDEVVGNTTRVKVVKNKLAPPFKQVEFDIMYGEGVSKMGEILDLGVKAGIVEKSGAWFSYDSQRLGQGRENSKAFLKANPDITAKIETAIRQNSGLIAEQILAGTPERDADGEEPADE

SEQ ID NO: 2928 - DNA, 2058 bp, Campylobacter fetus
  CDS (401)..(1438)
actttgaaatttggttttaaagtaacgccttttttcttaattaattttggtccatatccctctcgaaaactcactgcagtacgtaaaagagcgtaatcttcatatataaacggatacaaaccaaaacttatagcagtcacgtcataagtcccttttatggcttcgtaatttagcgtttgtatatcggctggggtatttgaaaattgcaaaatattactatcaatccagccgaatttaatagcttcatacataaaaatatcatcggcatctggagagtgagctacgcttacatttttcaaattttttaccttttttgactttttgttagcagtgtattcaaatttagctataatttttaatactttagggtaaaataacttaaatttttaagaggaaaatcatggatgataataagaaaaaaagcctagaccttgctttaaagcagattgataaagcttttggcaaaggcactgttttaaggctaggagacaaggaaatagagccgatagattctatctcctcaggatcgataggacttgatatagctcttggtataggcggcgtaccaaaaggaagaatagtcgaaatttatgggccagaaagctctggtaaaacaactcttactttgcatttaatagcagaatctcaaaaagtcggcggagtttgcgcgtttgtagatgcagagcatgcacttgatgttaaatatgctaaaaatttaggcgttgatacggataacttatatatttctcaaccggacttcggagagcaagctcttgatatagtagaaactctagctagaagcggcgccgttgatcttatagtaatagatagcgtagcagctttaacaccaaaaagcgaaatagaaggcgatatgggagatcagcacgtagggctgcaagcaagactcatgagtcaagcacttagaaaattaaccggagttgtccataaaatgggaactacagttgtatttataaaccaaattcgtatgaaaatcggcgctatgggctatggcactcctgaaactactactggcggaaatgcgcttaaattttacgcttcagttagacttgacgtacgtaaaatagctactttaaaacagagcgatgagccaatcggaaaccgcgtaaaagtaaaagtagtaaaaaacaaagtcgctcctccttttagacaagccgaatttgatatcatgtttggagaaggtatcagcaaagaaggagagataatagattacggcgtaaaacttgatattatcgataaaagcggcgcttggtttagctatgataattcaaaattaggtcaaggcagagaaaactcaaaagcgtttttaaaagaaaataaagcaatagcagatgaaataacagaaaaaatccgtgcaaatatgggtgatagcataatgagcggtgcagtagatgaagaagaaatggaaggagacgagtaatggttatcgtaaaaaagattagtgctatagaagttttagatagtcgtggaaatccaactataaaaaccaaagtagagctatgcgacggaagtataggagaagctatagtaccaagcggcgcgagtactggaaaacgcgaacgtttagaacttagagatggcggagaagcatttggaggcaaaggtgttttaaaagctattaaaaatgtaaattctatgatagctgaagagatatgtggaaaagacgcctataatcaaaaggctatcgacgacgctatgttagcgcttgatggaacagataactactcgcgtatcggcgcaaacgcggttcttggagtatctatggcagtagcaagagctgctgcaaatagcttaaacattccgttatatcgctaccttggaggagcaaatgcctgcacgctacccgtgcctatgtttaatattataaacggtggcgctcacgcaaataatagcgttgattttcaagaatttatgataatgccctttggattttctaaatttagtaacgctctaagagctgcaaccgaagtatatcaaacattaaaaaagatattaaacgatcttggacacagcactgcagtaggtgacgaaggtggattt

SEQ ID NO: 2929 - protein, 345 aa, Campylobacter fetus
MDDNKKKSLDLALKQIDKAFGKGTVLRLGDKEIEPIDSISSGSIGLDIALGIGGVPKGRIVEIYGPESSGKTTLTLHLIAESQKVGGVCAFVDAEHALDVKYAKNLGVDTDNLYISQPDFGEQALDIVETLARSGAVDLIVIDSVAALTPKSEIEGDMGDQHVGLQARLMSQALRKLTGVVHKMGTTVVFINQIRMKIGAMGYGTPETTTGGNALKFYASVRLDVRKIATLKQSDEPIGNRVKVKVVKNKVAPPFRQAEFDIMFGEGISKEGEIIDYGVKLDIIDKSGAWFSYDNSKLGQGRENSKAFLKENKAIADEITEKIRANMGDSIMSGAVDEEEMEGDE

SEQ ID NO: 2930 - DNA, 1458 bp, Chloroflexus aurantiacus
  CDS (116)..(1171)
tgctattatagcacatatgtacggggcaggcaacggcgttgacagcgccctccccatcaagtagagtagcaagaggagagtacgtgtgagcaagaacaatggaggagcgcccgcgatggctatcaccccggagaaagaaaaagcgctcgcggcaacaatggcgcagatcgaccgcaagttcggtaaaggttcgatcatgaagatgggcgaggcgagcagtcgggtggcaattgaagccatcccgaccggttccatcgcgctcgatattgccctcggcattggtggtgtaccgcgagggcgcgttgtcgaaatctttggccctgagagcagcggtaaaaccacactggcccagcatatcattgcagaagcgcagaaaatgggcggagtctgcgccttcatcgacgccgagcatgcctttgacccggtctacgctgcgcggtgtggagtcaacattgatgacttgctcgtttcgcagccggacaccggcgaacaggcgctcgaaatctgtgagatgctggttcgctcgaatgcaattgacgtgatcgttatcgactcggtcgccgctctggtaccgcgtgccgaaatcgagggcgagatgggcgattcgatgcccggtatgcaggcccggctgatgagtcaggcgttgcgcaagttgtcaggtgccatcagcaagagccgtacagtcgtaatcttcatcaatcagttgcgcatgaagatcggcgttatgttaggcacgccggaaaccacgaccggtggtcaggccctgaagttctacacctcggtacggctcgacattcgtcgtgtggaaaccctcaagcaagggcaggaggcaatcggttcgcgggtacgggtgaaggtgatcaagaataaggttgcaccgccttaccgccaggcggagttcgatattctggccaacgaaggtatctcgcgtgagggcaatatcatcgatatcggtactgaattggggattattcgcaagagtggcgcatggttctacctcggcgaggatcggctcggccaggggcgggaaaatgtgcgcgagtttctgaagaataatcctgcccttaccgatgagatcgagcgcctgatcaaagcgcaggcattgacgaatccaacggtgattgcgccgagcgtcgatgttggtgacgatgacgctatttttgaagagtagtacgctcggcgtgcgaacgaaatagcgatcttgggggcaggttttgaaacctgcccttttctgttggtccaatggtagggtggttattggtggcaagattactgtgtattcgattgccatgcgggtatgcaatgggttggcgagtcggcggttgttacgaggcgggttgagcagccggcgggttaagggggcagcgggttaaaaccctgcctcaatacgtggaaggccggcggggatgcctgacggcggggcgggggagatagcgggcgtgctcctggatagccccg

SEQ ID NO: 2931 - protein, 351 aa, Chloroflexus aurantiacus
MAITPEKEKALAATMAQIDRKFGKGSIMKMGEASSRVAIEAIPTGSIALDIALGIGGVPRGRVVEIFGPESSGKTTLAQHIIAEAQKMGGVCAFIDAEHAFDPVYAARCGVNIDDLLVSQPDTGEQALEICEMLVRSNAIDVIVIDSVAALVPRAEIEGEMGDSMPGMQARLMSQALRKLSGAISKSRTVVIFINQLRMKIGVMLGTPETTTGGQALKFYTSVRLDIRRVETLKQGQEAIGSRVRVKVIKNKVAPPYRQAEFDILANEGISREGNIIDIGTELGIIRKSGAWFYLGEDRLGQGRENVREFLKNNPALTDEIERLIKAQALTNPTVIAPSVDVGDDDAIFEE

SEQ ID NO: 2932 - DNA, 1053 bp, Chlamydophila caviae
  CDS (1)..(1053)
atgaatgtacctgatcgtaaaaaagcactagaagcagcaattgcctatatcgaaaaacaatttggcgctggatctatcatgagtctagggaaacactccgctactcatgaaatctcaactataaaaacaggagccttgtctttagatttagctttaggtattgggggtgttccaaaaggacgtattgttgaaatttttggtcctgaatcttcggggaaaactacactagctacccatattgttgccaacgcccaaaagatgggcggtgtcgctgcatatatcgatgcagaacacgctttagatcccggctatgcttctcttataggtgcgaatatcaatgatcttatgatctcccagcccgactgtggtgaagatgctttaagcattgccgaactattagcaagatcaggggctgttgatgttatcgttattgactctgtagctgctttggttcctaaaagcgaactcgaaggggatatcggtgatgtacacgtaggcctacaagcacggatgatgtctcaggcattacgcaaacttacagcaacattagcacgtagccaaacctgcgcgatattcatcaaccaaattcgtgaaaagataggtgttagcttcggtaatcctgaaacaacaaccggtggacgcgcgttaaaattctactcatccatacgcatggatatccgtcgtattggagctatcaaagggaatgaaagttttgatcttggaaaccgcatcaaagtaaaagttgctaaaaacaaattagcacctccattcagaactgcagaattcgatattctctttaatgaggggatttcttcagcaggatgcatcttagacctcgctgtagaacataatatcgtggaaaaaaaaggctcttggttcaactaccaagatcgtaaattaggccaaggaagagaagctgttcgtgaagaacttaagaaaaataagaaattatttgatgagttagaaaaacgtatctatgacatctcttctgcatcaaaagtagtcgctgtagaagagaagaaagaagagctaaaagcgcagcccgtagcttag

SEQ ID NO: 2933 - protein, 350 aa, Chlamydophila caviae
MNVPDRKKALEAAIAYIEKQFGAGSIMSLGKHSATHEISTIKTGALSLDLALGIGGVPKGRIVEIFGPESSGKTTLATHIVANAQKMGGVAAYIDAEHALDPGYASLIGANINDLMISQPDCGEDALSIAELLARSGAVDVIVIDSVAALVPKSELEGDIGDVHVGLQARMMSQALRKLTATLARSQTCAIFINQIREKIGVSFGNPETTTGGRALKFYSSIRMDIRRIGAIKGNESFDLGNRIKVKVAKNKLAPPFRTAEFDILFNEGISSAGCILDLAVEHNIVEKKGSWFNYQDRKLGQGREAVREELKKNKKLFDELEKRIYDISSASKVVAVEEKKEELKAQPVA

SEQ ID NO: 2934 - DNA, 1087 bp, Chromatium vinosum
  CDS (1)..(1044)
atggacgagaaccgaaagaaggcgttggccgccgcgttgacccagatcgaaaagcagttcggcaaaggctcggtcatgcgcatgggcgatgtcggcgccgtgcgcaacatcgaggcgatctcgaccggttcgctcgggctggatctggcgctcggcatcggcggcgtgcccaagggccgtgtcatcgagatctacggccccgagtcctcgggcaagaccacgctgacgctgcatatcatcgccgaatcgcagaaactcggcggcacagccgctttcgtcgatgccgagcacgcgctcgatccggtctatgccgaaaagctcggcgtgaacatgaccgatctgctggtctcccagcccgataccggcgagcaggcgctggagatcaccgacatgctggtgcgttccggtgcggtcgatgtcgtggtcgtcgattcggttgccgcgctcacgcccaaggctgagatcgagggcgagatgggcgactcgcacgtcggcctgcaagcgcgcctcatgtcccaggcgttgcgcaagctcaccggcaacatcaagcgctccaactgctgcgtcatcttcatcaaccagatccggatgaagatcggggtgatgttcggctcgccggagaccacgaccggcggcaatgcgctcaaattctatgcctcggtgcggctcgacatccgtcgtaccggggctatcaagaaaggcgatgaggtcatcggcaacgagaccaaggtcaaggtggtcaagaacaaggtcgcaccgcccttccggcaggccgagttcgacatcctatatggccagggcatctcgcgcgagggcgagatcatcgatctgggcgtggccgagggcttcatcgacaagtccggcgcctggtacagctatgacggcaaccgcatcgggcagggcaaggacaacgttcgcaactttctgtgcgaaaatcccgggatcgcccaggccatcgaagcgcgcatccgcgacaagctgctgcccaagggtggcgtcgaggcgcccgccgaggccgatgtacccgagccgtcggaggattgatccctgaacgatccggtccaagatccggcctcgacccgactga

SEQ ID NO: 2935 - protein, 347 aa, Chromatium vinosum
MDENRKKALAAALTQIEKQFGKGSVMRMGDVGAVRNIEAISTGSLGLDLALGIGGVPKGRVIEIYGPESSGKTTLTLHIIAESQKLGGTAAFVDAEHALDPVYAEKLGVNMTDLLVSQPDTGEQALEITDMLVRSGAVDVVVVDSVAALTPKAEIEGEMGDSHVGLQARLMSQALRKLTGNIKRSNCCVIFINQIRMKIGVMFGSPETTTGGNALKFYASVRLDIRRTGAIKKGDEVIGNETKVKVVKNKVAPPFRQAEFDILYGQGISREGEIIDLGVAEGFIDKSGAWYSYDGNRIGQGKDNVRNFLCENPGIAQAIEARIRDKLLPKGGVEAPAEADVPEPSED

SEQ ID NO: 2936 - DNA, 1346 bp, Clostridium perfringens
  CDS (172)..(1230)
agaaaaaataaaaatgttataaatacttataaataatgttttaaaagtcaaaaaatagtcaattattaagacatgaggttcttttaagaacttcatgttgatgttgactttttttttgtatatattataataatagtagaacttatgttcggttatttaaggaggttacgtatggcaaatatagataaagataaattaaaagctattgagatggctatgggtcaaatagagaagcaatttggaaagggatcagtaatgaaacttggagagcaaggagctcctcaaatggatgctgtttctactggatgcttagatcttgatatagctttaggaattggtggagtaccaaaaggaagaattattgagatatatggaccagagagttctggtaaaacaacagtggctttacatgtagtagcagaggcacaaaaattaggtggagcagcagcgtatatagatgcagagcatgctttagatccagtttatgcaaaaagattaggtgttaatatagatgatttagtagtttcacaaccagatacaggagaacaagctttagaaataacagaagctttagttagatcaggagctatagatgttttagttgtggactcagttgccgctttagttccaagagcagaaattgaaggtgaaatgggagattctcacgttggtcttcaagctagattaatgtcacaagccttaagaaagttaacaggaacaattaacaaatcaaactgcgtagtaatattcataaaccaattaagagaaaaagttggtataatgtttggtaatccagagacaacaccaggtggtagagcgttaaaattctatgcttcagttagaatggatataagaagaatagattcaataaaacaaggtgacggaataactggtaatagaacaagagttaaaatagttaagaataaggttgctcctccatttaagcaagctgaatttgatataatgtacaatgaaggtatatcaaaagaaggtaatatagtagacgttggagtaaaagaaaatatagtacaaaagagtggagcttggttctcatatggagatataagattaggccaaggtagagaaaatgctaaacaatatttaaaagagaatccagcagttgctttagatatagaaaatcaaataagagaaaaatattctcttcctttagctaaggctgttgaatcaacaagtgtagaagaaaatacagaagagtctgttgaaagctaataaaaaagataaggatttccttatcttttttttataattttatcacttcttaataattttaatgtatgaatttaaagttttatgaatatgttaacattaataaaattttaaagctt

SEQ ID NO: 2937 - protein, 352 aa, Clostridium perfringens
MANIDKDKLKAIEMAMGQIEKQFGKGSVMKLGEQGAPQMDAVSTGCLDLDIALGIGGVPKGRIIEIYGPESSGKTTVALHVVAEAQKLGGAAAYIDAEHALDPVYAKRLGVNIDDLVVSQPDTGEQALEITEALVRSGAIDVLVVDSVAALVPRAEIEGEMGDSHVGLQARLMSQALRKLTGTINKSNCVVIFINQLREKVGIMFGNPETTPGGRALKFYASVRMDIRRIDSIKQGDGITGNRTRVKIVKNKVAPPFKQAEFDIMYNEGISKEGNIVDVGVKENIVQKSGAWFSYGDIRLGQGRENAKQYLKENPAVALDIENQIREKYSLPLAKAVESTSVEENTEESVES

SEQ ID NO: 2938 - DNA, 1053 bp, Clostridium tetani
  CDS (1)..(1053)
atggataaagaaaaattaaaagccatagaagcagctatgggaaacatagaaaagcaatttggtaaaggctctgtaatgaaattaggagaaaaaaacatattggatatagaagctatttccacaggatgtcttggaatggacatagctttaggtataggtggagttccaaaaggaagaatagtagaaatatatggacctgaatcatcaggtaagacaactgtggcattacacataatagcagaagctcaaaagaatggtggagttgcagcttttatagatgctgagcatgcattagatccatcttatgcaagaaaattaggagtagatatagacaatttaatagtttctcaaccagatacaggagaacaaggattggaaatagcagaagctcttgttagatccaatgctatagatatagtagttgttgactctgtagcggcattagttcctaaggcagaaattcagggagagatgggagattctcatgttggattacaagcaagattgatgtctcaagcccttagaaaattagcaggttccataaacaaatctaactgtgtagctattttcatcaatcaattaagagaaaaagttggaataatgtttggaagtcctgaaactacaccgggaggaagggcacttaaattttattctagtgtaagattggatgttagaagaatagatacaataaaacaaggagatgagtttttaggaaatagaactagagtaaaagtaactaaaaataaagtagctcctccttttaaaaatgctgagtttgatataatgtataatgaaggtatatcaagaacaggtgatgttttagacttgggtgttaaagaagaaatagtgcaaaaaagtggatcttggttttcctataatgatgtaagattaggtcagggtagagaaaatgcaaaacagtttttaaaggataatccagaactactttatgaaatagaaaatactataagagaaaaatatgatcttccaattgttaaaaataatattaaagcagaagtggaagataaaaaagagaaaaaagcagaagaagtttaa

SEQ ID NO: 2939 - protein, 350 aa, Clostridium tetani
MDKEKLKAIEAAMGNIEKQFGKGSVMKLGEKNILDIEAISTGCLGMDIALGIGGVPKGRIVEIYGPESSGKTTVALHIIAEAQKNGGVAAFIDAEHALDPSYARKLGVDIDNLIVSQPDTGEQGLEIAEALVRSNAIDIVVVDSVAALVPKAEIQGEMGDSHVGLQARLMSQALRKLAGSINKSNCVAIFINQLREKVGIMFGSPETTPGGRALKFYSSVRLDVRRIDTIKQGDEFLGNRTRVKVTKNKVAPPFKNAEFDIMYNEGISRTGDVLDLGVKEEIVQKSGSWFSYNDVRLGQGRENAKQFLKDNPELLYEIENTIREKYDLPIVKNNIKAEVEDKKEKKAEEV

SEQ ID NO: 2940 - DNA, 1161 bp, Corynebacterium efficiens
  CDS (1)..(1161)
atggctacgaaaaagaccaccaaggcggcccccaagggtgatgatcgccagaaggcgctcgacgcggccctcgctctcattgagaaggacttcggtaagggcgctgtcatgcgtctgggtgatgaaaaccgtccaccgatccaggtgatctcctccggcaacaccgcacttgatatcgccctgggcatcggaggtttcccccgtggccgcatcgtcgaggtctatggtccggaatcctccggtaagaccaccgtggcgctgcacgccatcgcgcaggcgcagaaagccggcggtatcgccgcgttcatcgatgctgagcatgcattggatccggattacgcccgcaaactcggtgtggacaccgatgcgctgctggtatcccagccggataccggtgagcaggctcttgagattgccgatatgcttgtgcgctccggtgccatcgatatcctcgtcatcgactctgtggcggccctgaccccgaaggccgagatcgagggcgagatgggtgacagccacgtcggcctgcaggcgcgcctgatgtcccaggccctgcgtaagatgaccggcgcgttgtacaactccggtaccaccgcgatcttcatcaaccagctgcgtgagaagatcggcgtgatgttcggttccccggagaccaccacgggtggtaaggcactgaagttctacgcctccgtccgcattgatgtccgtcgcattcagaccctcaaggacggtcaggatgccatcggtaaccgcacccgcgccaagatcgtcaagaacaaggtgtcaccaccgttcaagatcgccgagttcgacatcatctacggggagggcatctcccgtgaatcctcgatcatcgacctggcggttgataacggcattgtgaagaagtccggatcgtggtttacctatgagggtgaccagctgggtcagggtaaggagaaggcacgcctgttcctcaaggagaccccggagctcgccgacgaaatcgaggagaagatcttccgcaaactcggtgtcgggaagttcgcccagacggccgatgaactgaccgatgacccggttgagctcattccgaatgttgatttcgacgacgaggatgatgacttcgacgcctccaccgccccggcagggaccttcaccgaggtcaccaccgagaactag

SEQ ID NO: 2941 - protein, 386 aa, Corynebacterium efficiens
MATKKTTKAAPKGDDRQKALDAALALIEKDFGKGAVMRLGDENRPPIQVISSGNTALDIALGIGGFPRGRIVEVYGPESSGKTTVALHAIAQAQKAGGIAAFIDAEHALDPDYARKLGVDTDALLVSQPDTGEQALEIADMLVRSGAIDILVIDSVAALTPKAEIEGEMGDSHVGLQARLMSQALRKMTGALYNSGTTAIFINQLREKIGVMFGSPETTTGGKALKFYASVRIDVRRIQTLKDGQDAIGNRTRAKIVKNKVSPPFKIAEFDIIYGEGISRESSIIDLAVDNGIVKKSGSWFTYEGDQLGQGKEKARLFLKETPELADEIEEKIFRKLGVGKFAQTADELTDDPVELIPNVDFDDEDDDFDASTAPAGTFTEVTTEN

SEQ ID NO: 2942 - DNA, 1402 bp, Corynebacterium glutamicum
  CDS (133)..(1263)
tccaaatccttgaacttcaagtctaagtaagtaggggtcactgctgcagtgctgttttagtcagtgctgaagtgatgcaaccgtaggaattttcgtccacatcaacgtcaataaaactaagaggaattaaaaatggctcccaagaagacagcaacaaaggcaactgccgccaaggggaatgatcgtcagaaggcacttgatgccgcactagccctgattgagaaggatttcggtaaaggcgctgtcatgcgtctgggtgatgagaatcgtccgccaatccagaccatctcatctggtaacaccgcgattgatattgccttgggtatcggtggattcccacgtggtcgaatcgttgaggtgtatggcccagaatcatcaggtaaaaccaccgttgcactgcacgcaattgcgcaggcacaaaaggccggcggcatcgctgcattcattgacgccgagcacgcgttggatccagattatgctcgcaagcttggtgtagatactgatgcgcttctggtttcgcagccagacactggtgagcaagcactagaaatcgccgacatgctggttcgttccggcgcaatcgacatcatcgtgattgactcggtggctgcgctgacaccaaaggctgaaattgaaggcgaaatgggcgatagccacgttggtcttcaggcccgcctcatgagccaggcgcttcgtaagatgacaggtgcgctgtacaactcgggtaccaccgcgatcttcattaaccagctgcgtgaaaagatcggtgtgatgttcggttccccagaaaccaccaccggtggtaaggccctgaagttctacgcatctgttcgttgtgacattcgacgaatccagactctgaaggacggacaggatgccattggtaaccgcacccgcttgaaggtcgttaagaacaaggtctccccaccgttcaagatcgctgaattcgacatcatgtacggcgaaggcatctcccgtgaatcctccgtcattgacttggcagtggacaacggcattgtgaagaagtcaggttcctggttcacctacgagggcgaacagcttggtcaaggtaaggaaaaggtgcgtctttccctcaaggagaaccctgaactcaccgatgagctggaagataagatcttcaagaagctgggagtaggcaagtacgctgcagcctcagatgaactcaccgacgatccagtagagctcgtgcctaacgttgacttcgatgatgaagccgacaccgaagcagacgctgaagactaagcaccagttttaacaaagcagggacaatccacacacttaaaccatgatgtggcttgttcctgctttttcgtcaacgaagggcaacaacgcgatggatatcaagccgaaaagattgaaaagctcagaaaagcactcgaca

SEQ ID NO: 2943 - protein, 376 aa, Corynebacterium glutamicum
MAPKKTATKATAAKGNDRQKALDAALALIEKDFGKGAVMRLGDENRPPIQTISSGNTAIDIALGIGGFPRGRIVEVYGPESSGKTTVALHAIAQAQKAGGIAAFIDAEHALDPDYARKLGVDTDALLVSQPDTGEQALEIADMLVRSGAIDIIVIDSVAALTPKAEIEGEMGDSHVGLQARLMSQALRKMTGALYNSGTTAIFINQLREKIGVMFGSPETTTGGKALKFYASVRCDIRRIQTLKDGQDAIGNRTRLKVVKNKVSPPFKIAEFDIMYGEGISRESSVIDLAVDNGIVKKSGSWFTYEGEQLGQGKEKVRLSLKENPELTDELEDKIFKKLGVGKYAAASDELTDDPVELVPNVDFDDEADTEADAED

SEQ ID NO: 2944 - DNA, 1409 bp, Corynebacterium pseudotuberculosis
  CDS (223)..(1332)
agatcagtttgcctatcgaacatctgtttgtgtattctcggtggggattaaagtgatgttgagaatggtcgttaggattcatgcttagttgaatcgagctcaccaattgggggtggaattccccgactataaaacgattagggatccaaagtgccctgattgttcgtcaaatggatgggtcagattaatgtgagtgttcctcaataagaaaagaaggatgaaatggcagctaagaaaaattcgaagtctcagccggcaacaggggacaatcggcaaaaggcgctcgacgcagccttagctatgatcgagaaagactttggcaaaggcgcagtaatgcgccttggtgatgataaccgccctccgattagtgctatttcttccgggaacactgcaatcgatgttgctcttggtattggaggctttcccaaggggcgcattgtagaggtgtatggacctgagtcttcaggtaaaacaaccgtggcgctgcatgctatagctcaagcgcagcgtgctggaggaattgctgcttttatcgatgcggaacacgcattagatccggattatgcacgtaaacttggcgtagacacagatgcacttttggtgtctcaaccggatacaggtgagcaagctctggagattgcagatatgcttgttcgctctggagctatagatattattgtcatcgactctgtggccgcacttacccctaaagcagaaatcgaaggggaaatgggggatagccacgttggtttgcaagcgcgtttgatgagtcaggcgctgcgtaagatgaccggtgctctttataactcgggaaccaccgctatctttattaatcagctgcgcgaaaagattggcgtgatgtttggctcgcctgagacgactacgggtggcaaagcgcttaagttctatgcttcagttcgttgtgatgttcggcgtatccaaacgctaaaggacgggcaggatgccatcggtaacaggacgcggttaaaggtagtaaagaataaggtctcgcctccatttaaaatcgcggaatttgacatcatgtatggggaaggtatctctagagaatcctccattatcgatttgggtgtagataatgggatcatcaaaaaatcaggctcgtggtttacctatgatggtgatcagcttggtcagggcaaagaaaaagttcgtctgtatttaaagcagactcctgagcttgcggatgaaattgaagagaagatcttccgggcattgcagatcggaaagtacgctaaccagaacgacgcacttactgatgatccagtagacatggttcctaatatcgattttgatgatgaggacaatggataacgttgatccagctctgagcaaagaagacaaactcaagcgcctctcgcaggcgcttgagcgctatcatgaggaaggca

SEQ ID NO: 2945 - protein, 369 aa, Corynebacterium pseudotuberculosis
MAAKKNSKSQPATGDNRQKALDAALAMIEKDFGKGAVMRLGDDNRPPISAISSGNTAIDVALGIGGFPKGRIVEVYGPESSGKTTVALHAIAQAQRAGGIAAFIDAEHALDPDYARKLGVDTDALLVSQPDTGEQALEIADMLVRSGAIDIIVIDSVAALTPKAEIEGEMGDSHVGLQARLMSQALRKMTGALYNSGTTAIFINQLREKIGVMFGSPETTTGGKALKFYASVRCDVRRIQTLKDGQDAIGNRTRLKVVKNKVSPPFKIAEFDIMYGEGISRESSIIDLGVDNGIIKKSGSWFTYDGDQLGQGKEKVRLYLKQTPELADEIEEKIFRALQIGKYANQNDALTDDPVDMVPNIDFDDEDNG

SEQ ID NO: 2946 - DNA, 1032 bp, Coxiella burnetii
  CDS (1)..(1032)
atggataatcgtagtaatgcgctgaatgctgctttgtcgcaaattgaacgtcagttcggtaaaggttcggtcatgcgtttgggtgatcccggactcataccggacatcgatgtcatttcaacaggctccttgggtcttgatatcgctttgggtgtgggtggattaccccgcggtcggatcattgaaatttacgggccggaagcttccggaaaaaccacgctagccttacaaacgatcgcttcttgtcagcgtatgggcggtacggctgcttttgtggatgcggaacatgcgttggatgccatttatgcgggcaaattaggcgttaaagtagaggacttgttggtatcccagccggatacaggggaacaagctttagaaattacagacatgttggttcgctcgggcgctgttgatctgatcgtgatcgactccgttgccgccctgacgccaaaagccgaaattgaaggtgatatgggcgattctcatatgggtttgcaagcgcgtttaatgtcacaagcgctgcgcaagctcacggcaaacattaagaaatccaataccttagtgatatttattaatcaaatacgtatgaaaatcggcgttatgtttggtaatccggaaacgaccaccggagggaacgcgcttaagttttattcgtcagtacgcttggatattcgccgcatcggagcgatcaaaaagggcgaagagattttaggcagtgaaactcgagtaaaggtagttaaaaacaaggtggcgccgcctttccgtcaagtcgagtttgatattctttacggtcttggtatttcgcgtgaaagtgagttaattgacctcggtgttaaaaatgaactggtcgaaaaagcaggcgcttggtacagttacaatggcgagcgtatcggccaagggaaagaaaacgttcgacaatttttccttgaaaatccaaaaattgcaggggaaattgaaacacgtttgcgtgaaaaactgttgccgcatcggcaaggcgagaaaatcgctgaagaagtcaatgcagcagaatga

SEQ ID NO: 2947 - protein, 343 aa, Coxiella burnetii
MDNRSNALNAALSQIERQFGKGSVMRLGDPGLIPDIDVISTGSLGLDIALGVGGLPRGRIIEIYGPEASGKTTLALQTIASCQRMGGTAAFVDAEHALDAIYAGKLGVKVEDLLVSQPDTGEQALEITDMLVRSGAVDLIVIDSVAALTPKAEIEGDMGDSHMGLQARLMSQALRKLTANIKKSNTLVIFINQIRMKIGVMFGNPETTTGGNALKFYSSVRLDIRRIGAIKKGEEILGSETRVKVVKNKVAPPFRQVEFDILYGLGISRESELIDLGVKNELVEKAGAWYSYNGERIGQGKENVRQFFLENPKIAGEIETRLREKLLPHRQGEKIAEEVNAAE

SEQ ID NO: 2948 - DNA, 1047 bp, Enterococcus faecalis
  CDS (1)..(1047)
atggcagatgatcgtaaagtggctttagatgccgcactgaaaaaaattgaaaagaactttgggaaaggttctattatgaaattaggcgaaaaagctgatcaaaaaatttcaactatccctagtggttctttagcgttagatgttgcattgggcgtaggtgggtatccacgtggccgaattattgaagtatatggtcctgagagttcaggtaaaacaactgtttctttacacgcaattgcagaagtgcaacgaaatggtggaacagccgcttttatcgatgctgagcatgcattggatcctcaatatgcggagaaactaggcgttaacatcgatgaattacttttatctcaaccagatacgggcgagcaaggcttagagattgccgatgccttagtttcaagtggtgcgattgacatcgttgtcatcgactcggttgctgcgttagttcctcgtgcagagattgatggtgagatgggagcgagccatgtcggcttacaagctcgactaatgtctcaagcactacgtaaattatcaggctcaattaataagacaaaaacaattgctattttcattaaccaaattcgtgaaaaagttggcgtgatgttcggaaatcctgaaacaactcctggtggacgtgcattgaaattctacgcaacggttcgtctagaagtccgtcgtgcagaacagttaaaacaaggaacagacatcgtcggtaaccgcacaaaaattaaagtcgttaaaaacaaagtggcgccaccatttaaagtggcagaagttgatatcatgtatggccaaggtatttcccaagaaggcgaattactagatatggctgtggaaaaagaccttatcagtaaaagtggtgcttggtatggctacaaagaagaacgaattggccaaggccgtgaaaatgccaaacaatacatggcggatcatcctgaaatgatggcagaagtgtctaaattggtccgtgatgcatacggcatcggtgacggttcaaccattacagaagaagcagaaggtcaagaagaattacccttagatgaatga

SEQ ID NO: 2949 - protein, 348 aa, Enterococcus faecalis
MADDRKVALDAALKKIEKNFGKGSIMKLGEKADQKISTIPSGSLALDVALGVGGYPRGRIIEVYGPESSGKTTVSLHAIAEVQRNGGTAAFIDAEHALDPQYAEKLGVNIDELLLSQPDTGEQGLEIADALVSSGAIDIVVIDSVAALVPRAEIDGEMGASHVGLQARLMSQALRKLSGSINKTKTIAIFINQIREKVGVMFGNPETTPGGRALKFYATVRLEVRRAEQLKQGTDIVGNRTKIKVVKNKVAPPFKVAEVDIMYGQGISQEGELLDMAVEKDLISKSGAWYGYKEERIGQGRENAKQYMADHPEMMAEVSKLVRDAYGIGDGSTITEEAEGQEELPLDE

SEQ ID NO: 2950 - DNA, 1072 bp, Erwinia carotovora
  CDS (1)..(1029)
atggctattgatgaaaacaagcaaaaagcattggccgcagcacttggtcaaattgaaaagcaatttggtaaagggtctatcatgcgtctgggcgaagatcgttccatgaacgttgaaaccatctctacgggttctttatcattagacgttgctttaggtgctggtggtttaccacgcgggcgtattgttgaaatctatggcccagaatcttatggtaaaacaacattaacactacaagttatcgctgctgctcaacgtgaaggcaaaatttgtgcattcattgatgctgagcacgctttagaccctatctatgctcaaaaactaggcgtagatattgataacctgctctgttctcagcctgatactggtgaacaagccctagaaatttgtgatgcattatctcgttctggtgcagttgatgttatcgttgttgactccgttgcagctttaacaccaaaagcagaaattgaaggtgagattggtgattcacacgttggtttagctgctcgtatgatgagtcaagctatgcgtaagttagcgggtaacttgaaaaactccaacactctgcttattttcatcaaccaaattcgaatgaaaatcggtgttatgtttggtaatccagaaaccacaacaggtggtaatgcacttaaattctacgcatctgttcgtttagatattcgtcgtatcggctctgttaaaaacggtgatgaagttgttggtagtgaaacacgcgttaaagtggtgaaaaacaaaattgcagcaccatttaaacaagctgaattccaaattatgtatggtgaaggtatcaatacctttggcgaattgattgatttaggtgttaaacacaaattggtagagaaagctggtgcatggtacagctacaatggtgagaaaattggtcaaggtaaagccaatgcaacaacttatttaaaagaacaccctgaaatgtacaatgagttaaacactaaacttcgtgaaatgttattaaatcacgcaggtgaatttactagcgcacgtgatttttgctaatgatagtgatgacgccgcagatattgaagaaacagaaaaataa

SEQ ID NO: 2951 - protein, 342 aa, Erwinia carotovora
MAIDENKQKALAAALGQIEKQFGKGSIMRLGEDRSMNVETISTGSLSLDVALGAGGLPRGRIVEIYGPESYGKTTLTLQVIAAAQREGKICAFIDAEHALDPIYAQKLGVDIDNLLCSQPDTGEQALEICDALSRSGAVDVIVVDSVAALTPKAEIEGEIGDSHVGLAARMMSQAMRKLAGNLKNSNTLLIFINQIRMKIGVMFGNPETTTGGNALKFYASVRLDIRRIGSVKNGDEVVGSETRVKVVKNKIAAPFKQAEFQIMYGEGINTFGELIDLGVKHKLVEKAGAWYSYNGEKIGQGKANATTYLKEHPEMYNELNTKLREMLLNHAGEFTSARDFC

SEQ ID NO: 2952 - DNA, 1137 bp, Fusobacterium nucleatum
  CDS (1)..(1137)
atggcagcaaagaaagataaaagtgtaccagattcaaaaataacagataaagaaggaaaagaaaaagcagtcaaagacgctatggcagcgattacaaaaggttttgggtctggacttattatgaaattgggagaaaaaagttctatgaatgtagaatctatcccaacaggaagtataaatttggatatagctttgggaattggtggagtacctaaaggaagaattattgaaatatatggagcagaaagttcaggtaagacaactcttgcattacatgttatagctgaagcacaaaaacaaggtggaacagttgcatttattgatgctgaacatgcacttgatccagtttatgcaaaagcattaggagttgacatagacgaacttttaatttcccaaccagattatggggaacaagcattagaaattgcagatactcttgttagatcaggggctattgatttaatagtaattgactcagttgcagcacttgttccaaaagcagaaatagatggagaaatgtctgatcaacaaatgggattacaagctagacttatgtcaaaaggtttaagaaaattaacaggaaatcttaacaaatataagactacaatgatttttattaaccaaatcagagaaaaaattggtgtaacttatggccctacaactacaactactggtggaaaggcacttaaattctattcatcagttagaatggaagttaaaaagatgggtacagtaaaacaaggtgatgatccaataggaagtgaagttatagtaaaagtaactaagaataaggttgcacctccatttaaagaagcagcatttgaaatactatatggaaaagggatttcaaaggttggagagattatagatgcagctgttgcaaaagatgtaatagttaaagctggttcttggttcagttttagagaccaaagtataggacaaggaaaagaaaaagtaagagcagaattagaaataaatcctgaattattagcacaagttgaaaaagatttaaaggaagccattgcaaaaggtcctgttgataagaaaaagaaaaaatctaaaaaagaagcttcttctgatgacactgatgatgaaaatcttgaaatagatgatgcaattgatgaaaataacgattaa

SEQ ID NO: 2953 - protein, 378 aa, Fusobacterium nucleatum
MAAKKDKSVPDSKITDKEGKEKAVKDAMAAITKGFGSGLIMKLGEKSSMNVESIPTGSINLDIALGIGGVPKGRIIEIYGAESSGKTTLALHVIAEAQKQGGTVAFIDAEHALDPVYAKALGVDIDELLISQPDYGEQALEIADTLVRSGAIDLIVIDSVAALVPKAEIDGEMSDQQMGLQARLMSKGLRKLTGNLNKYKTTMIFINQIREKIGVTYGPTTTTTGGKALKFYSSVRMEVKKMGTVKQGDDPIGSEVIVKVTKNKVAPPFKEAAFEILYGKGISKVGEIIDAAVAKDVIVKAGSWFSFRDQSIGQGKEKVRAELEINPELLAQVEKDLKEAIAKGPVDKKKKKSKKEASSDDTDDENLEIDDAIDENND

SEQ ID NO: 2954 - DNA, 1613 bp, Herbaspirillum seropedicae
  CDS (199)..(1254)
tcgggcgacgaacaaaacgcttgcacgaagcactgtttttttatacagtatcgctctatcggggcgttgaaccgatgcgcgcggcgaggccgcagcgacattgcgttagatattgcgctgtattgccggtccaccggccgccccagcatcacattccccgggtaccccttcttcacgacattttgccgagagagacttatggacgacaaaaaagctgcgaacaactctgagaagagcaaggcgctggccgccgcgttggcacagattgaaaagcagtttggcaagggctcggtgatgcgcatggaagatggcgtcatcgccgaggaaatccaggcggtctccactggctcactgggcctggacatcgccctgggcatcggcggcctcccgcgtggccgcgtcatcgagatctacggcccggaatcctcgggcaagaccaccctgaccctgcaatcgattgccgagatgcagaaactgggcggcacctgcgccttcatcgatgccgagcacgcactggacgtcacctatgcgcaaaagctgggtgtgaacctgaacgacctgctgatctcccagcccgacaccggcgaacaggccctggaaatctgcgacgccctggtacgttccggcgccgtggacctgatcgtggtcgactccgtggccgcactgacccccaaggctgaaatcgaaggcgacatgggcgactccctgcctggcctgcaagcccgcctgatgtcgcaggcgctgcgcaagctgaccggcagcatcaaccgtaccaataccacggtcatcttcatcaaccagatccgcatgaagatcggcgtcatgttcggcaaccccgaaaccaccaccggtggtaatgccctgaagttctacgcctccgtgcgcttggacatccgccgcaccggctcgatcaagtccggcgacgaagtcatcggcagcgagaccaaggtcaaggtcgtcaagaacaaggtcgctccgccgttccgcgaagcccactttgacatcctgtatggcgaaggcacctcgcgcgaaggcgagatcctggacctcggttccgagcacaaggtggtcgagaagtccggcgcctggtacagctacaacggcgagcgcatcggccagggcaaggacaatgcccgcaactacctgaaggaacatccggaactggcgcgcgagatcgaaaacaaggtccgcgtggccctgggtgtgccggaactggccggtggcgaagccgaagccgaagcgaaagcctcctgatcttccgctccctcattcatgcgcctgcgtggcggctgggtttgcctgagccgttgccgtcagggaggcgtttgattgccctgcgcctgccatgtgctgctgttctggcgggcgatggggtgctgtcgtagtcgccatatcttgtttgttccgcgttgcgggcaggcagggtatgggtaccgaactgcgcttgttttgccgcattactgcatcattgcatcaccgcttcattgcatcatcgtctcactgcatcaccctttcattgcatccttgcctcaccgttgcgatgccctgaatggtttttactgcatcagcttcccgtgtattcatctgctccttcgtccgtgtaatcgaacgtc

SEQ ID NO: 2955 - protein, 351 aa, Herbaspirillum seropedicae
MDDKKAANNSEKSKALAAALAQIEKQFGKGSVMRMEDGVIAEEIQAVSTGSLGLDIALGIGGLPRGRVIEIYGPESSGKTTLTLQSIAEMQKLGGTCAFIDAEHALDVTYAQKLGVNLNDLLISQPDTGEQALEICDALVRSGAVDLIVVDSVAALTPKAEIEGDMGDSLPGLQARLMSQALRKLTGSINRTNTTVIFINQIRMKIGVMFGNPETTTGGNALKFYASVRLDIRRTGSIKSGDEVIGSETKVKVVKNKVAPPFREAHFDILYGEGTSREGEILDLGSEHKVVEKSGAWYSYNGERIGQGKDNARNYLKEHPELAREIENKVRVALGVPELAGGEAEAEAKAS

SEQ ID NO: 2956 - DNA, 1143 bp, Lactobacillus plantarum
  CDS (1)..(1143)
atggctgatgcacggaaagcagcactagataccgccctgaaaaagatcgaaaagaatttcggtaaaggggcgattatgcggatgggtgacgctgcccagacgactatttcaacgatttcaagtggatcgttggccttagatgacgcgttgggtgtcggcggctacccacgtggtcggatcgtggaaatctacggtcctgaaagttcaggtaaaacgaccgtggcactacatgcggttgctgaagttcaaaagcagggtggtacggcggcctatatcgatgctgaaaacgcactagaccccgtttatgcggaacacctaggggtcaacattgatgacctgttactttcgcaaccagatactggtgaacaagggcttgaaattgcagatgccttagtttccagtggtgcggtcgatattttagttgttgactcggtggcggccttagtgccacgtgccgaaattgaaggtgaaatgggtgacgcacacgttgggttacaagcgcggctgatgtcacaagcgctccggaagttatcagggacattgaacaaaaccaagacaatcgcgttatttatcaatcaaattcgtgaaaaagttggtgtgatgtttggtaatcctgaaacgactcctggtggtcgggccttgaaattttacgccacgattcgtttggaagtacggcgggcagaacagatcaaggaaggaaccaatattattggtaaccgtgtccggatcaaagtcgttaagaacaaggttgcaccgccatttaagcgtgccgaagtggatatcatgtatggtcaaggtatctcacaaactggtgaaattgttgatatggctgctgaaaaggatattgttaagaagagtggttcttggtattcatatggtgacgatcgcattggtcaaggccgtgaaaatgccaagaagtatttggacgagcatcctgatgtcatgacggagattcgccaaaaggttcgtgatgcatatggtatggatgcaactggtgaagaaacgtctgaaactgatgatcaggccaaagaagctaaggataagggaactgctaagaatggcagtaagggtcaaagtaagtccactaaagcgacaccagcggaaactgctctcgatctcggcgaccaaccaaccgaaaaatag

SEQ ID NO: 2957 - protein, 380 aa, Lactobacillus plantarum
MADARKAALDTALKKIEKNFGKGAIMRMGDAAQTTISTISSGSLALDDALGVGGYPRGRIVEIYGPESSGKTTVALHAVAEVQKQGGTAAYIDAENALDPVYAEHLGVNIDDLLLSQPDTGEQGLEIADALVSSGAVDILVVDSVAALVPRAEIEGEMGDAHVGLQARLMSQALRKLSGTLNKTKTIALFINQIREKVGVMFGNPETTPGGRALKFYATIRLEVRRAEQIKEGTNIIGNRVRIKVVKNKVAPPFKRAEVDIMYGQGISQTGEIVDMAAEKDIVKKSGSWYSYGDDRIGQGRENAKKYLDEHPDVMTEIRQKVRDAYGMDATGEETSETDDQAKEAKDKGTAKNGSKGQSKSTKATPAETALDLGDQPTEK

SEQ ID NO: 2958 - DNA, 1101 bp, Leptospira interrogans
  CDS (1)..(1101)
atgggagaaagtatcatgaagaaagcaaaagaagatgctccgagcgtagatgattctaaaaagttagcgatcgagcaagcaatgagccaaattgaaaaacaatttggaaagggttcgattatgaaattaggatcggattctgccaaacaaaccgttcaagtaattccttccggttctttggatttagacattgcactgggtataggtggttatccgatcggtagaattgtagaaatttacggacctgagtcttctggaaaaactactctcacactttctgcaattgcagaggctcagaaaagaggtggtgtggctgcgtttatagatgcagaacacgctttggatccatcttatgccaaaaaacttggggtcaatatagacgaacttttagtttctcaaccggataatggagaagaagcattagaaatctgtgaatctttagttcgaagtaatgcaattgatttaatcgtaattgattctgtggcggctttggttcccaaggctgaaatagaaggagatatgggagattcacacatgggtttacaagcaagactcatgtcccaggcgcttagaaaactaactggtaccattgcaaaatccaaaaccgtagtaatctttatcaatcaaattcgtatgaaaatcggtgttatgttcggttctcctgaaactacaactggcggaaatgctttgaaattctactgttcagttcgtttggatatccgtaaaatagaaacgatcaaagaaaaagaagaatctgtaggaaacagagtacgggtcaaagtagtcaaaaataagtgtgctcctccgtttaaacaggctgaatttgacataatctttaacgctgggattagcagagaaggttctctggttgacctaggtgtaaagcatgatattattcataaggccggagcttggtattcttacaatacggaaaaaattggccaaggtaaggaggccgctaaggaatacttgaaaaacaaccctgaaattgccttaaccatcgaaaatatggtcagagatctaaattctcttcctttgttagttcaggaaaataataaaaaatctcgtaaagaggaaaaattagaacaggccgcaggctaa

SEQ ID NO: 2959 - protein, 366 aa, Leptospira interrogans
MGESIMKKAKEDAPSVDDSKKLAIEQAMSQIEKQFGKGSIMKLGSDSAKQTVQVIPSGSLDLDIALGIGGYPIGRIVEIYGPESSGKTTLTLSAIAEAQKRGGVAAFIDAEHALDPSYAKKLGVNIDELLVSQPDNGEEALEICESLVRSNAIDLIVIDSVAALVPKAEIEGDMGDSHMGLQARLMSQALRKLTGTIAKSKTVVIFINQIRMKIGVMFGSPETTTGGNALKFYCSVRLDIRKIETIKEKEESVGNRVRVKVVKNKCAPPFKQAEFDIIFNAGISREGSLVDLGVKHDIIHKAGAWYSYNTEKIGQGKEAAKEYLKNNPEIALTIENMVRDLNSLPLLVQENNKKSRKEEKLEQAAG

SEQ ID NO: 2960 - DNA, 1126 bp, Mycoplasma mycoides
  CDS (79)..(1116)
gttataaatattttaaaaaaaatgatccttttttaaaaaacttttcctaatactaatatgaaaggataaaaaggatctatgagtacagaattacaaaacacaatagaaaataatgatataagagaatctcaaatgtgaaattcaaaagagctaaaagaagctattaaagaaattgaaaaaatgtttggtaaaggttctattatggttcttggccaaagtgataatttaaatattgaaacattttcatcaggatcacttttattagataatgcattaggaattggtggttatcctaaaggaagaattattgaaatttatggacctgaatcatctggaaaaaccactttatctttacatgctatttgtgaagttcaaaaactaggtggaattgctgcttttattgatgcagaacattctttagaacctaaatattgtcaaactttaggaattgatacaaataaattactagttagtcaaccagataatggagaacaagctttagatattttagaaatgttaattaattcaaatagtattgatttaattgttgttgattcagttgctgctttagttccaaaaactgaattagatggtgaaatgagtgatcaatcaattggactacaagcaagaatgatgtctaaagctttgagaaagttaaattggttaattgcaaaatcaaatactacagtaatttttattaaccaattaagagaaaaaattggagttatttttggaaatcctgaaactacaacaggtggtaaagctttaaagtttttttcatcaattagattagaagttagaaaagcagaaaatattttaaataattacgaaattattggaaataaaatcaaaatcaaagttgttaaaaataaaacagcaatcccttttaaaactacaacaatttcacttttatataataaaggaattgataaacttggtgaattagtagatttattagttagttatgaaattattgaaaaatcaggagtttgatattcttatcaaaatgaaaaaattggccaaggaagaactagtgttattcaatgactaaatgctgatgaaaatagaataaatgaactaactgaacaagttaaaaaactaattaaacaagattaaaaaataaaat

SEQ ID NO: 2961 - protein, 345 aa, Mycoplasma mycoides
MSTELQNTIENNDIRESQMWNSKELKEAIKEIEKMFGKGSIMVLGQSDNLNIETFSSGSLLLDNALGIGGYPKGRIIEIYGPESSGKTTLSLHAICEVQKLGGIAAFIDAEHSLEPKYCQTLGIDTNKLLVSQPDNGEQALDILEMLINSNSIDLIVVDSVAALVPKTELDGEMSDQSIGLQARMMSKALRKLNWLIAKSNTTVIFINQLREKIGVIFGNPETTTGGKALKFFSSIRLEVRKAENILNNYEIIGNKIKIKVVKNKTAIPFKTTTISLLYNKGIDKLGELVDLLVSYEIIEKSGVWYSYQNEKIGQGRTSVIQWLNADENRINELTEQVKKLIKQD

SEQ ID NO: 2962 - DNA, 1050 bp, Mycobacterium smegmatis
  CDS (1)..(1050)
atggcgcagcaggccccagatcgcgaaaaggccctcgaactggcgatggcccagatcgacaagaatttcggcaaaggctcggtgatgcgcctcggcgaagaggtgcgccagccgatctcggtgatccccaccggctccatctcgctggatgtggcgctcggcatcggcggcctgccgcggggccgcgtcatcgagatctacggcccggagtcctcgggtaagaccaccgtggccctgcatgccgtcgccaacgcgcaggccgcgggcggtatcgcggcgttcatcgacgccgagcacgcgctggatcccgagtacgccaagaagctgggtgtggacaccgactcgctgctggtgtcgcagcccgacaccggtgagcaggcgctggagatcgccgacatgctggtgcggtccggcgcgctggacatcatcgtcatcgactcggtcgccgccctggtgccgcgcgccgagatcgagggcgagatgggtgacagccacgtcggcctgcaggcccgcctgatgagccaggcgctgcgcaagatgaccggcgcgttgaacaactcgggcaccaccgcgatcttcatcaaccagctccgcgagaagatcggtgtgatgttcggctcgcccgagaccaccacgggcggtaaggcactgaagttctacgcctcggtccgcctcgacgtgcgccgtatcgagacgctcaaggacggcaccgacgcggtcggtaaccgcacccgcgtcaaggtcgtcaagaacaaggtctccccgccgttcaagcaggccgagttcgacatcctctacggccagggcatcagccgcgagggttcgctcatcgacatgggcgtcgagcacggcttcatccgcaagtccgggtcctggttcacctacgagggtgagcagctgggccagggcaaggagaacgcccgcaagttcctgctggagaacaccgacgtcgccaacgagatcgagaagaagatcaaagagaagctcggtatcggcgccgtcgtgaccgctgaagccgatgacgtcctcccggccccggttgacttctga

SEQ ID NO: 2963 - protein, 349 aa, Mycobacterium smegmatis
MAQQAPDREKALELAMAQIDKNFGKGSVMRLGEEVRQPISVIPTGSISLDVALGIGGLPRGRVIEIYGPESSGKTTVALHAVANAQAAGGIAAFIDAEHALDPEYAKKLGVDTDSLLVSQPDTGEQALEIADMLVRSGALDIIVIDSVAALVPRAEIEGEMGDSHVGLQARLMSQALRKMTGALNNSGTTAIFINQLREKIGVMFGSPETTTGGKALKFYASVRLDVRRIETLKDGTDAVGNRTRVKVVKNKVSPPFKQAEFDILYGQGISREGSLIDMGVEHGFIRKSGSWFTYEGEQLGQGKENARKFLLENTDVANEIEKKIKEKLGIGAVVTAEADDVLPAPVDF

SEQ ID NO: 2964 - DNA, 1044 bp, Oceanobacillus iheyensis
  CDS (1)..(1044)
atgagtgatagaaaacaagcattagatatggctttaagacaaatagagaagcaatttggtaaaggttccattatgaaaatgggggagaatgaaatcccgaaaatcgctactatcccaagtggatcattagcattagatgttgccttaggtataggcgggtatcctcgtggtcgtgtagttgaaatatatggtccagagtcctcaggtaaaacaaccgtagcacttcacgcaattgcggaagcacaaaagcaaggaggacaagctgcgtttatcgatgcagagcatgcgcttgacccagtatatgcgaaagctttaggtgtaaatattgatgaattactgttatctcaaccagatacaggtgaacaagcattagaaattgcagaggcccttgttcgaagcggtgctgtagatattatcgtagttgactctgtagctgcgcttgtgccaaaagctgaaattgaaggtgaaatgggagattctcatgttgggctacaagcacgtttaatgtcacaagcattacgtaaattatctggtgcaataaataagtcgaaaacaacggcaatatttattaaccaaatccgtgaaaaagtcggagttatgttcggaaatccagagacaactcctggtggacgagcattaaaattctattcctctgtacgtttagaagtaagaagagcggaaacattaaagctaggtaatgatgcagtcggaaataaagcgcgaattaaagttgtaaaaaataaagttgctccaccgtttaaacaagctgaagtagatattatgtatggaaaaggtatttctaaagaaggtgaagtattagatattggttccgatctagatattgttatgaaaagtggtgcatggtattcctataacaatgatcgtctaggacagggcagagaaaatgcgaaacaatatctaaaagaacatgaagaagtattaacagaaatccatcagtctattcgtcagcattatgaattagacaaggtggatgaagataagacggaagaagaagcttctcaagagagtcttgatttaaaatag

SEQ ID NO: 2965 - protein, 347 aa, Oceanobacillus iheyensis
MSDRKQALDMALRQIEKQFGKGSIMKMGENEIPKIATIPSGSLALDVALGIGGYPRGRVVEIYGPESSGKTTVALHAIAEAQKQGGQAAFIDAEHALDPVYAKALGVNIDELLLSQPDTGEQALEIAEALVRSGAVDIIVVDSVAALVPKAEIEGEMGDSHVGLQARLMSQALRKLSGAINKSKTTAIFINQIREKVGVMFGNPETTPGGRALKFYSSVRLEVRRAETLKLGNDAVGNKARIKVVKNKVAPPFKQAEVDIMYGKGISKEGEVLDIGSDLDIVMKSGAWYSYNNDRLGQGRENAKQYLKEHEEVLTEIHQSIRQHYELDKVDEDKTEEEASQESLDLK

SEQ ID NO: 2966 - DNA, 1071 bp, Paracoccus denitrificans
  CDS (1)..(1071)
atggcaggggcaacacttttcgacatgaacgacaagcgatccgcagacaagcagaaggcgctagacagcgcattggcccagatcgaacggcagttcggcaaaggctcgatcatgaagctgggcgccgacaatccggtggccgagatcgaggccacctcgaccggctcgctggggctcgacatcgcgctggggatcggcggtctgcccaagggccggatcatcgagatattcgggccggaaagctcgggcaagaccacgctgacgctgcatgtcgtggcggaagagcagaagaaaggcggcgtttgcgcctttgtcgatgccgaacatgcgctggacccgcaatatgccaagaagctgggcgtcaatctggacgagttgctgatcagccagcccgatacgggcgagcaggcgcttgagattgtcgatacgctggtggcttccggtgcggtcagcctggtggtggtcgattcggtcgcggcgctgacccccaagtccgagatcgaaggtgacatgggcgacatgcagatgggcagccaggcccggctgatgagccaggcgatgcgcaagctgaccgccagcatcggccggtcgaactgtatggtgatcttcatcaaccagatccgcatgaagatcggcgtgatgttcggaagcccagagacgacgaccggcggcaatgccctgaagttttatgcctcggtgcgcctggatatccgccgcgccggctcgatcaaggaccgtgacgaggtgaccggcaacgccactcgcgtcaaggtggtcaagaacaaggtcgcgccacctttccgtcaggtcgagttcgacatcatgtatggcgagggcatctcgaaggtcggcgaactgatcgacttgggcatcaaggccggcgtggtcgaaaaatcggggtcgtggtactcctatggcgacgagcgcatcggccagggccgtgagaatgccaagcaattcctgcgcgatcatcccgatatggcccatgcgatcgaggacaagatccgcgccagccacggcctggatttcggcgtcgcggacgatggcgatgaggtgatggccgaggattga

SEQ ID NO: 2967 - protein, 356 aa, Paracoccus denitrificans
MAGATLFDMNDKRSADKQKALDSALAQIERQFGKGSIMKLGADNPVAEIEATSTGSLGLDIALGIGGLPKGRIIEIFGPESSGKTTLTLHVVAEEQKKGGVCAFVDAEHALDPQYAKKLGVNLDELLISQPDTGEQALEIVDTLVASGAVSLVVVDSVAALTPKSEIEGDMGDMQMGSQARLMSQAMRKLTASIGRSNCMVIFINQIRMKIGVMFGSPETTTGGNALKFYASVRLDIRRAGSIKDRDEVTGNATRVKVVKNKVAPPFRQVEFDIMYGEGISKVGELIDLGIKAGVVEKSGSWYSYGDERIGQGRENAKQFLRDHPDMAHAIEDKIRASHGLDFGVADDGDEVMAED

SEQ ID NO: 2968 - DNA, 1320 bp, Pasteurella haemolytica
  CDS (157)..(1263)
caagggcattgccttgctcgcaaatttatttttgtgatcttgatcgaaaatcctaaaaaaatgcttgcaactggataagtaaatactataataatatacagttattttgcagcaacaagcggttgcttttagataaaagtttacaaaggatagaatatggcagagaaaaaaagtcaaaagaacactccggttaaacagattgatccggaacaaaaagaaaaagcgttggcagccgcattagctcaaattgaaaagcaatttggcaaaggctcaattatgaagttaggcgatactcaagcccttgatattgaagcagtttcaaccggttctcttggtttagactcagcattaggcattggtggtttaccaatgggtcgtattgtggaaatttatggaccggagtcttcaggtaaaactacattaactttatctgtggtggctcaagcccaaaaaaatggtaaaacttgtgcctttattgatgccgaacacgcacttgatcctatttacgcccgtaagttaggggtagatacagatggattattaatttcacaaccggataatggcgaacaagcattagaaatttgtgatgcgttagttcgttccggtgcggttgatgtaattattgtggactctgttgcggcacttacaccaaaagcagagattgaaggcgatatgggtgattcccatatgggcttacaagctcgtttaatgtcacaagcattgcgtaaattaaccgcaaatatcaaagcgaccaactgcttggtgattttcattaaccaaattcgtatgaaaattggagtaatgttcggtaaccctgaaaccacaactggtggtaatgcccttaaattctatgcttcagtacgtttagatattcgtcgttcaggcgtagtaaaagacggtgatgaggttatcggtagcgaaacaaaagtgaaaattgtgaaaaacaaggttgctccaccgttccgtgaagtccaatttgatattatgtacggtgagggcattgcccgtatgaatgaattactcattttagcggaatctcacggcttcattaataaagcaggggcttggttctcttatgaaggggagaaaatcggtcagggtaaaaataatgccatcaaatggttaaaagaacaccctgaagtggcgagtaaaattgagcaagatattcgaaatctactcatttcaaacccaacttttacggctactccagattctgaaaatgcagacaatgcagatgatgaatttagtgaagaagaactctaattaaatttatgcggttttcgctcaacgtgaaaatcgcatttttatttataaccgata

SEQ ID NO: 2969 - protein, 368 aa, Pasteurella haemolytica
MAEKKSQKNTPVKQIDPEQKEKALAAALAQIEKQFGKGSIMKLGDTQALDIEAVSTGSLGLDSALGIGGLPMGRIVEIYGPESSGKTTLTLSVVAQAQKNGKTCAFIDAEHALDPIYARKLGVDTDGLLISQPDNGEQALEICDALVRSGAVDVIIVDSVAALTPKAEIEGDMGDSHMGLQARLMSQALRKLTANIKATNCLVIFINQIRMKIGVMFGNPETTTGGNALKFYASVRLDIRRSGVVKDGDEVIGSETKVKIVKNKVAPPFREVQFDIMYGEGIARMNELLILAESHGFINKAGAWFSYEGEKIGQGKNNAIKWLKEHPEVASKIEQDIRNLLISNPTFTATPDSENADNADDEFSEEEL

SEQ ID NO: 2970 - DNA, 1500 bp, Pasteurella multocida
  CDS (175)..(1239)
gatatcaaggatataaaaaacaaaaattgcactttcaaactgacaacttgacggatagcgcaattttattttgcgagaaatcccacaaatttgataaaaagcacttgatactgtttattcatacagttaatatacacgacaaattctgatgatgattttattgaggattcaaacatggcaacaaaagaagaaaaaaataaagcactggcagcagcacttgggcagattgaaaaacaatttgggaaaggctctattatgaaattgggcgatacccaagccttggatgttgaagccgtgtcaacaggctccttaagcctcgacgtcgcacttggcattggcgggttaccaatgggtcgtattgttgaaattttcggacctgaatcttccggtaaaaccaccttaaccctttctgtcattgcgcaagcacaaaaagaaggcaaaacctgtgcctttattgacgcagaacacgcattagatccaatttatgctgccaaactgggcgtcaatgtgaatgaactgttagtttcccaacctgataacggtgaacaagcactcgaaatttgcgatgcgttagtgcgttcaggtgcagtagatgtgatcattgtggactcagtcgcagcattaaccccgaaagcggaaattgaaggagaaatgggtgactcacacatgggcttacaagcacgtttgatgtcacaagcgttacgtaaactcactggacaaatcaaaaactcaaattgcttagtggtctttattaaccaaatccgtatgaaaattggtgttatgttcggtaacccagaaaccacaacagggggtaatgcactgaaattctatgcctctgtacgtttagatattcgccgtacgggtgcgattaaagagggtgaagaagtgatcggtaacgaaacccgtgtcaaagtggtgaaaaacaaagtggcggcaccattccgtcaagtagatttccaaattctttacggtcaaggtatttctaaaacaggcgagctcatcgagttaggcgtaaaacacaaattagtggataaagcaggtgcatggtacgcttacaatggtgaaaaaatcggtcaaggtaaagctaacgcgatgaaatggttagaagagcatcctgaagaagcattggctttagaaacgaaattacgcaatgagttgctcgcgaatccagaaaaagtactcgcggcagacattgcggaaaaaaatgaaagctctacgggcttagaagcggattattaatctgtttttagcggtttaatcgaaaaaagtgcggtgagttttaacaaaatttcaccgcactttttgctgagtatatctaaacattgtaaagaagcaggtaaccatcgtatgtcttctcccgcgttaaattatgtcgttggcttattagcacgccgtgaatacagtgagtttgaactcgctgtaaaatgcaagaaaaaggcttttctgaacaagaaattgatgacacacttgccttttgccaacaaaaaaactggcaaaatg

SEQ ID NO: 2971 - protein, 354 aa, Pasteurella multocida
MATKEEKNKALAAALGQIEKQFGKGSIMKLGDTQALDVEAVSTGSLSLDVALGIGGLPMGRIVEIFGPESSGKTTLTLSVIAQAQKEGKTCAFIDAEHALDPIYAAKLGVNVNELLVSQPDNGEQALEICDALVRSGAVDVIIVDSVAALTPKAEIEGEMGDSHMGLQARLMSQALRKLTGQIKNSNCLVVFINQIRMKIGVMFGNPETTTGGNALKFYASVRLDIRRTGAIKEGEEVIGNETRVKVVKNKVAAPFRQVDFQILYGQGISKTGELIELGVKHKLVDKAGAWYAYNGEKIGQGKANAMKWLEEHPEEALALETKLRNELLANPEKVLAADIAEKNESSTGLEADY

SEQ ID NO: 2972 - DNA, 1023 bp, Porphyromonas gingivalis
  CDS (1)..(1023)
atggcagaagaaaagatacccacggtgcaggatgagaagaaactgcaagccctgcgaatggccacggagaagatagagaagactttcggaaaaggtgctatcatgaatatgggagccaatacggtggaagatgtaagcgttatcccctccggctccatcggtttggatttggctctcggtgtaggcggttaccctcgcggacgtattatcgagatatacggaccggaatcttccggtaagaccactctggctatccatgccattgccgaagcgcagaaagcaggtggcttggcggccatcatcgatgcggaacatgctttcgaccgcacctatgccgaaaagttgggcgtcaatgtggataatctctggatagcacagccggacaacggtgaacaggctttggaaatcgccgagcaactgattcgctcttctgctgtcgacattatagtcattgactctgtcgcagccctcacgcccaaagcggaaatagagggtgaaatgggggacaacaaggttggtttgcatgcccgtctgatgtcgcaagcactgcgtaagatgaccggagccatcagcaaatccaatacaacctgtatcttcatcaaccagctacgagagaagatcggtgttttgttcggcaatccggagaccaccacaggggggaatgcactgaaattctatgcatccatccgcatcgacattcgcaagagcacaccgatcaaggatggcgaagagatcatgggacacctgaccaaggtgaaagtgttgaaaaacaaggtggctcctccattccgcaaagcagagttcgacatcgtattcggagaaggtatttcgcgttccggcgagattatcgatttgggtgtagagctggatattatcaagaagagcggatcgtggttcagctatggcgatacgaagctgggacagggacgtgaggctgccaaggaaatgattcgggacaatgaggaattggccgaagaactgactgaaaaaatacgcgaagccattcgcaacaaacattcataa

SEQ ID NO: 2973 - protein, 340 aa, Porphyromonas gingivalis
MAEEKIPTVQDEKKLQALRMATEKIEKTFGKGAIMNMGANTVEDVSVIPSGSIGLDLALGVGGYPRGRIIEIYGPESSGKTTLAIHAIAEAQKAGGLAAIIDAEHAFDRTYAEKLGVNVDNLWIAQPDNGEQALEIAEQLIRSSAVDIIVIDSVAALTPKAEIEGEMGDNKVGLHARLMSQALRKMTGAISKSNTTCIFINQLREKIGVLFGNPETTTGGNALKFYASIRIDIRKSTPIKDGEEIMGHLTKVKVLKNKVAPPFRKAEFDIVFGEGISRSGEIIDLGVELDIIKKSGSWFSYGDTKLGQGREAAKEMIRDNEELAEELTEKIREAIRNKHS

SEQ ID NO: 2974 - DNA, 1824 bp, Prevotella ruminicola
  CDS (501)..(1523)
tggtgattcagaacatcggcttgagcctgttattggatcgaggttagaatacggaggcaccattggccgatggtacttggtactgccaaggtaagaatttgtactctgcagttcctgaaggctgtgctgcctaacccacaggatcttggcgagatactacgagggacaaacctctatcggctgccgcatccgtggtattggcaacgatggcaaggagcacacctattatgtatacaacaactgcagccaccgtgccgcctacgaggagaccggtatgcagggtgttagctataccacaggtgtaccagcgatgattggtgccatgatgttctgcaagggtctttggaacaccccaggcgttcacaacgtagaggagttcgatcccgatccattcatggagcagctcaacaagcagggtctgccttggcatgagatccacgatggcgacttggaattataatcaattataaataataactcatcaaatagtataactaactatggcaaaagaaaaagatgaggccttgtcgcctcagcaggagaagttgaaagcgcttcaggccgccatgtcgaagattgagaaagactatggtaagggctcgattatgcgcatgggagacgagcagatagataatgtagaagttatcccaacaggttcgataggtttgaatgcagccttaggtgtaggtggctaccccaaaggtcgtatcatcgagatatatggtcccgagtcgtcaggtaaaaccacactggccatccacgctattgccgagtgccagaagaatggtggtattgccgctttcatcgatgccgagcatgctttcgaccgtttctatgcagcccacctgggtgttgatgtagagaacctctatatctcacagcccgataatggtgagcaggctctggagattgccgaccagttgattcgttcgagtgctatcgatatcatcgtcatcgactctgtagccgctctgactcctaagaaggagattgagggcgatatgggtgattctgcagttggtctgcaggcccgtctgatgagccaggcactccgcaagctcacctcaaccatctcgaagactaacactacctgtatcttcatcaaccagttgcgtgagaagattggtgtaatgttcggtaaccccgaaactaccacaggtggtaacgccctgaagttctacgcttcagtacgtctggatatccgcaaggttactgccattaaggatggcgacaacatcattggtaaccaggtacgcgtaaaggtgattaagaataaggtagctcccccattccgcaaggccgaattcgagattacctttggcgagggcatctcaaagattggcgagattgtagatctgggtgttgagtacgagattatcaagaagagtggttcatggttcagctatggcgactcgaagttggctcagggccgtgatgcagtaaaagcgctgctcaaggataatccagagctttgcgaggaactcgaagcaaagattatggaagctatcgctgacaagaaataataaaaacaattatcccagccgcttggctgggataattgtttattcggctgttggatcggctttaccacccatccaaccctttactggctgaggcttcttctttttcttaccagtgccttcgttcatatcctttacgctggttttcttaaccacacccgttccgtcgaactctatacagcagtttatcgttcgagcggttaaacacccagaagtactgtccacctgtccgggctcgacttatcgggccacctgcatctgaactcgtcctcgctcataccgacacctacgtgtccggcacgat

SEQ ID NO: 2975 - protein, 340 aa, Prevotella ruminicola
MAKEKDEALSPQQEKLKALQAAMSKIEKDYGKGSIMRMGDEQIDNVEVIPTGSIGLNAALGVGGYPKGRIIEIYGPESSGKTTLAIHAIAECQKNGGIAAFIDAEHAFDRFYAAHLGVDVENLYISQPDNGEQALEIADQLIRSSAIDIIVIDSVAALTPKKEIEGDMGDSAVGLQARLMSQALRKLTSTISKTNTTCIFINQLREKIGVMFGNPETTTGGNALKFYASVRLDIRKVTAIKDGDNIIGNQVRVKVIKNKVAPPFRKAEFEITFGEGISKIGEIVDLGVEYEIIKKSGSWFSYGDSKLAQGRDAVKALLKDNPELCEELEAKIMEAIADKK

SEQ ID NO: 2976 - DNA, 978 bp, Proteus vulgaris
  CDS (1)..(978)
atggctattgatgagaacaaacaaaaggcacttgcggcagcactgggtcaaatcgaaaagcaatttggtaaaggttctatcatgcggttgggcgaggatcgctcgatggatgttgaaaccatttctacgggctctttgtcccttgatattgctctgggggccggcggtttacctatggggcgcatcgttgagatttatggcccagaatcttctggtaaaaccacgctgaccttacaggtgattgccgctgctcaacgcgaaggaaaaacctgtgcgttcatcgatgctgaacatgcgttggacccgatttatgcgaaaaaacttggcgtagatattgataacctgctgtgttctcagccggataccggtgagcaagcactggagatctgtgatgcactcacgcgctctggcgctgttgacgttatcattgtcgactctgttgcagccttgacaccaaaagctgaaattgaaggcgaaatcggtgactctcacatgggccttgcggcacgtatgatgagccaggctatgcgtaaactggcaggtaacctgaaacaagccaatacgctgctaatcttcattaaccagatccgtatgaaaattggtgtgatgtttggtaaccctgaaaccactaccggtggtaacgcactgaaattttatgcctctgttcgtctggatattcgtcgtactggcgctatcaaggacggtgaagaagttgtcggtagcgaaactcgcgttaaagtcgtgaagaataaagtggcagcaccgttcaaacaggctgaattccaaattttgtatggtgaaggtatcaatatccatggtgagttagttgatctgggtgtgaaacacaaactgatcgaaaaagcgggtgcatggtatagctataacggcgacaaaatcggccagggtaaagcaaacgcctgcaatttcctgaaagagaattcgctggtgaaggaaacgaagaattttaatggctgctga

SEQ ID NO: 2977 - protein, 325 aa, Proteus vulgaris
MAIDENKQKALAAALGQIEKQFGKGSIMRLGEDRSMDVETISTGSLSLDIALGAGGLPMGRIVEIYGPESSGKTTLTLQVIAAAQREGKTCAFIDAEHALDPIYAKKLGVDIDNLLCSQPDTGEQALEICDALTRSGAVDVIIVDSVAALTPKAEIEGEIGDSHMGLAARMMSQAMRKLAGNLKQANTLLIFINQIRMKIGVMFGNPETTTGGNALKFYASVRLDIRRTGAIKDGEEVVGSETRVKVVKNKVAAPFKQAEFQILYGEGINIHGELVDLGVKHKLIEKAGAWYSYNGDKIGQGKANACNFLKENSLVKETKNFNGC

SEQ ID NO: 2978 - DNA, 1047 bp, Pseudomonas oleovorans
  CDS (1)..(1047)
atggatcaggcaaaaagcaaagcgttagaagcggctctttctcaaattgagaagcagtttggtaagggttccatcatgcggctgggctccgaccgcactatggatatagatgttatatcgactggctcactcggcttggacatcgccttgggggtgggtgggttgccgcgcggccgtatcgttgaaatctatgggccggagtcttctggtaaaaccacgcttacgctgtcggtgattgctgaagcgcagcgtcaaggtttgacttgtgcatttgtcgatgctgagcacgcgcttgatccgatctacgcagccaagctcggcgttaatattgacgaactcctgtgctcacagcctgacactggtgagcaggcacttgaaatcgtagacatcttgacgcgttctggggcagtcaatcttattgtcgttgactctgttgctgctcttgttccgaaggctgagattgaaggcgaaatcggggattcccatgtaggtcttgccgcccgaatgatgtcgcaggcgatgaggaagatcactggtaacctgaagaactccaatactatgtgtatcttcattaaccagattcgtatgaagatcggtgtaatgtttggcaacccggaaaccaccaccggcggtaacgccctgaagttctacgcctcggtgcgcctggacatccgtcgtaccggcgcggtcaaggaaggcgaggaagtggtgggcagcgaaacccgtgtgaaagtggtcaagaacaaagttgctgctccattcaggcaagcagagttccagatcgtttacggtcagggtattagcaaggcgggtgagatcgttgacctcgctgttgctaacaactttgttgaaaagtcaggcgcttggtactccttcgaaggtaacaagatcggccaaggtaaggccaataccatgaaatggctgttggaaaacaaacctactatggacaagctggaaggtatgattcgcgaaaagttgatgtctaagcctcaggctgaaacctctgcacgtctcgcaacccaagaagaactggctgacgactattga

SEQ ID NO: 2979 - protein, 348 aa, Pseudomonas oleovorans
MDQAKSKALEAALSQIEKQFGKGSIMRLGSDRTMDIDVISTGSLGLDIALGVGGLPRGRIVEIYGPESSGKTTLTLSVIAEAQRQGLTCAFVDAEHALDPIYAAKLGVNIDELLCSQPDTGEQALEIVDILTRSGAVNLIVVDSVAALVPKAEIEGEIGDSHVGLAARMMSQAMRKITGNLKNSNTMCIFINQIRMKIGVMFGNPETTTGGNALKFYASVRLDIRRTGAVKEGEEVVGSETRVKVVKNKVAAPFRQAEFQIVYGQGISKAGEIVDLAVANNFVEKSGAWYSFEGNKIGQGKANTMKWLLENKPTMDKLEGMIREKLMSKPQAETSARLATQEELADDY

SEQ ID NO: 2980 - DNA, 1068 bp, Pseudomonas putida
  CDS (1)..(1068)
atggacgacaacaagaagcgcgccttggctgcggccctgggtcagatcgaacgccaattcggtaaaggcgcggtcatgcgcatgggtgaccatgagcgtcaaggcattccggccatctccaccggctcgctggggctggatatcgccctgggcatcggcggtctgccaaaaggccgtatcgtcgagatctacggcccggaatcgtcgggtaagaccacgctgaccctgtctgtcatcgctgaagcgcaaaagaacggtgctacctgcgccttcgtcgacgccgaacatgcccttgaccctgagtacgccggcaagctgggcgtcaacgtcgatgacctgctggtttcgcagccggacaccggtgagcaggcccttgaaatcaccgacatgctggtgcgttccaacgcggtcgacgtgatcattgtcgactccgttgccgcgctggtaccgaaggccgagatcgaaggcgagatgggtgacatgcatgtgggcctgcaggcccgcctgatgtcccaggcactgcgtaagatcaccggtaacatcaagaacgcgaactgcctggtcatcttcatcaaccagatccgtatgaagatcggtgtgatgttcggcagcccggaaaccactaccggtggtaacgccctgaagttctatgcttcggtccgtctggacatccgccgtaccggcgcggtcaaggaaggcgacgaagtggtcggcagcgaaacccgcgtcaagatcgtcaagaacaaggtctcgcctccgttccgtcaggctgagttccagattctttacgggaaaggtatctaccgtaacggcgagatcattgatctgggggtatctcagggcctggtcgaaaagtccggcgcctggtacgcctaccaaggcaacaagatcggtcaaggcaaagccaacgctgccaagtacctggctgagaacccggctattggtgccgagatcgagaagcagattcgtgagaagttgctgaaagcgggtgctgctgctgaagccggcaaagctgctgctgctgaagctgatgccgatgacatggccgacgctgacgccggttattga

SEQ ID NO: 2981 - protein, 355 aa, Pseudomonas putida
MDDNKKRALAAALGQIERQFGKGAVMRMGDHERQGIPAISTGSLGLDIALGIGGLPKGRIVEIYGPESSGKTTLTLSVIAEAQKNGATCAFVDAEHALDPEYAGKLGVNVDDLLVSQPDTGEQALEITDMLVRSNAVDVIIVDSVAALVPKAEIEGEMGDMHVGLQARLMSQALRKITGNIKNANCLVIFINQIRMKIGVMFGSPETTTGGNALKFYASVRLDIRRTGAVKEGDEVVGSETRVKIVKNKVSPPFRQAEFQILYGKGIYRNGEIIDLGVSQGLVEKSGAWYAYQGNKIGQGKANAAKYLAENPAIGAEIEKQIREKLLKAGAAAEAGKAAAAEADADDMADADAGY

SEQ ID NO: 2982 - DNA, 1110 bp, Pseudomonas syringae
  CDS (46)..(1110)
gtggccatcaaggccctaattgaatttgattacgtgaggacttcaatggacgacaacaagaagaaagccttggctgcggccctgggtcagatcgagcgtcagttcggtaaaggtgccgtgatgcgcatgggcgaccatgatcgccaggcaattcctgccatctctaccggttcgcttggtctggatatcgcactcggtatcggcggtctgccaaaaggccggatcgtggaaatctacggtcctgaatcttccggtaaaaccacgctgaccctgtcggtcatcgcgcaagcccagaaaatgggcgctacctgtgcgttcgtcgacgccgagcacgcacttgatcctgaatatgccggcaagctgggcgtcaatgtagacgacctgctggtctcgcagccggacaccggtgagcaggcactggaaatcaccgacatgctggtgcgctccaatgccatcgacgtcatcgttgtcgactccgttgcggccctggtgcccaaggcagagatcgaaggcgaaatgggtgacatgcacgtgggtctgcaggcccgcctgatgtcgcaggcgctgcgcaagatcaccggtaacatcaagaacgccaactgcctggttatcttcatcaaccagatccgcatgaagatcggtgtcatgttcggcagcccggaaaccaccaccggtggtaacgcgctgaagttctacgcttcggtacgtctggatatccgtcgcaccggtgcggtgaaggaaggcgacgaagtggtcggtagcgaaacccgcgtcaaggtcgtgaagaacaaagtggcgccgccgttccgtcaggccgagttccagattctctacggcaagggtatctacctcaacggcgaaatcgtcgacctggccgttctgcacggttttgtcgagaagtcgggtgcctggtacagctatcagggcagcaagatcggtcagggtaaagccaactcggccaagttcctggcagataacccggaaatctgcaaagcgctcgagaagcagattcgcgataagctgctcacgcctggcgtcgacaccaaggctgtcggttcccgtgaagctgttgttgccgatgacgtggccgaagcagacgctgatagctga

SEQ ID NO: 2983 - protein, 354 aa, Pseudomonas syringae
MDDNKKKALAAALGQIERQFGKGAVMRMGDHDRQAIPAISTGSLGLDIALGIGGLPKGRIVEIYGPESSGKTTLTLSVIAQAQKMGATCAFVDAEHALDPEYAGKLGVNVDDLLVSQPDTGEQALEITDMLVRSNAIDVIVVDSVAALVPKAEIEGEMGDMHVGLQARLMSQALRKITGNIKNANCLVIFINQIRMKIGVMFGSPETTTGGNALKFYASVRLDIRRTGAVKEGDEVVGSETRVKVVKNKVAPPFRQAEFQILYGKGIYLNGEIVDLAVLHGFVEKSGAWYSYQGSKIGQGKANSAKFLADNPEICKALEKQIRDKLLTPGVDTKAVGSREAVVADDVAEADADS

SEQ ID NO: 2984 - DNA, 1980 bp, Pseudomonas tolaasii
  CDS (414)..(1472)
agaaaacccggcagttgggtgtgcctgaagagctgttcgccaaagtcggcgcagtcagccaggaagtggtggaagcaatggtgcgcggcgcgcaggaaaaaagcctcgcgcgctttgccgtggcggtcagcggtgtggccgggccggacggtggttcgcccgacaaaccggtgggcaccgtatggttggcatttggcgtgggcgagaacgtgacggccgagcgggcgcacttcaccggcaaccgcgacgaggtccgccgacaaacggtaaaggccgcgctggagggtttgttgcgacgagctgcagcagaaatcgaaaatcaggggtaggcgatcccggatctttgtggaacaatactgtctacttatacaggtgttggccgaccaggccttattgattacgtgaggactttaatggacgacaacaagaagaaagccttggctgcggccctgggtcagatcgaacgtcaattcggcaagggtgccgtaatgcgtatgggcgatcacgaccgtcaggcgatcccggctatttccacgggctctctgggtctggacatcgcgctcggcattggcggcctgccaaaaggccgtatcgttgaaatctatggtcctgaatcttccggtaaaacgaccctgaccctgtcggtgattgcccaggcacaaaaaatgggcgccacttgcgcgttcgtcgatgccgagcacgccctggacccagagtacgccggcaagctgggcgtcaacgttgacgacctgctggtttcccagccggacaccggtgagcaagccctggaaatcaccgacatgctggtgcgctccaacgccatcgacgtgatcgtggtcgactccgtggcagccctggtaccgaaggctgaaatcgaaggcgaaatgggtgacatgcacgttggcctgcaagcccgtctgatgtcccaggcgctgcgtaaaatcaccggtaacatcaagaatgccaactgcctggtgatcttcatcaaccagatccgcatgaagatcggcgtgatgttcggcagcccggaaaccaccacgggtggtaacgcgttgaagttctacgcttcggtccgtctggatatccgccgtactggcgcggtgaaggaaggtgacgaggtggtgggcagcgaaacccgcgttaaagtcgtgaagaacaaggtggccccgccattccgtcaggccgaattccagattctctacggcaagggtatctacctgaacggtgagatgatcgacctgggcgtgctgcacggttttgtcgagaaatccggtgcctggtatgcctacaacggcagcaagatcggtcagggcaaggccaactcggccaagttcctggcggacaacccggacatcgcagccacgcttgagaagcagattcgcgacaagctgctgactgcagcgccagacgtgaaagcggccgccaaccgtgagccggttgacgagatggaagaagtcgacactgacatctgaagcaaacgatgaccgttgtactggatacactcgtcgctgttcggcgcaccgcaatggacctgctcgctcgccgcgagcatggtcgagtcgagctgacgcgtaaactgcgtcagcgcggcgcggagcccgaaatgatcgaaacagccctcgaccgtttaacggaagaggggctgttgtcggaagcccgttacctcgaaagctttgtctcctaccgaccccgctccggttacggcccagcgcgaattcgcgaagagctgagccagcgcggcctgcaacgcgcggatatcgaccttgctttgcgtgagtgtggcatcagttggcaatcgcagcttgaagacacctggcgccgcaagttctctggccacctcccgatagatgccaaggagcgagcgaagcaagggcgctttttgagttatcgcgggttttcgatggacatgatcagccggctcttgagtggtcgcgatctggacgattaaaaacagaggcgggccttttgtggcgagggagc

SEQ ID NO: 2985 - protein, 352 aa, Pseudomonas tolaasii
MDDNKKKALAAALGQIERQFGKGAVMRMGDHDRQAIPAISTGSLGLDIALGIGGLPKGRIVEIYGPESSGKTTLTLSVIAQAQKMGATCAFVDAEHALDPEYAGKLGVNVDDLLVSQPDTGEQALEITDMLVRSNAIDVIVVDSVAALVPKAEIEGEMGDMHVGLQARLMSQALRKITGNIKNANCLVIFINQIRMKIGVMFGSPETTTGGNALKFYASVRLDIRRTGAVKEGDEVVGSETRVKVVKNKVAPPFRQAEFQILYGKGIYLNGEMIDLGVLHGFVEKSGAWYAYNGSKIGQGKANSAKFLADNPDIAATLEKQIRDKLLTAAPDVKAAANREPVDEMEEVDTDI

SEQ ID NO: 2986 - DNA, 1501 bp, Rhizobium etli
  CDS (242)..(1327)
caagaatcttcttcttcattcaaccgccttccgatgccgaagcgcgaatcgagacgggccttctgcggccaaggccggcgcatctggcctaagccgttgcttgcatcgataaaacaaatatagaacacgggctgttttacctttttctttcaatcgtttgatcgcctattgcgagagtggaacaaatagggtacaaactcgacattgcttgggcggcttcaataacctaaaggtggatcagatgtctcagaattcattgcggctggtagaggacaaatcggtggacaaaagcaaggcgcttgaagcggcactctcacagattgagcggtcgttcggcaagggctcgatcatgaaactcggttccaacgagaacgtcatcgaaatcgagacgatttcgacgggttcgctggggctcgatatcgcgcttggcgtcggcggcctgccgaagggccgcatcatcgaaatctacgggccggaaagctcaggcaagacgacgctggcgctgcagaccatcgcggaatcgcagaagaagggcggcatctgcgcctttgtcgacgccgaacatgcgctcgatccggtctatgcccgcaagcttggcgtcgatctccagaaccttctgatctcgcagcccgataccggcgagcaggcgcttgagattaccgatacgctggtgcgctccggcgccgtcgacgttctggtcgtcgactcggtcgccgcactgacgccgcgtgccgaaatcgaaggtgaaatgggcgacagccttcccggcttgcaggcacgtctgatgagccaggcgctgcgcaagctgaccgcctcgatctccaagtcgaatacgatggtgatcttcatcaaccagatccgcatgaagatcggcgtcatgttcggttcgcctgagacaacgacgggcggcaatgcgctgaaattctatgcctccgtgcgcctcgacatccgtcgcatcggctcggtcaaggagcgcgaagaggtgatcggcaaccaaacccgcgtcaaggtcgtcaagaacaagatggcgcctcccttcaagcaggtcgaattcgacatcatgtatggcgaaggcgtatcgaagaccggcgaactcgtcgatctcggcgtcaaggccggcatcgtcgaaaagtcgggcgcctggttttcctataacagccagcgtctcggccagggcggcgaaaacgccaagaccttcctgcgcgacaatcccgatctcgcccgtgagatcgagctggcgttgcgcgaaaatgccggtctcatcgcagaccgcttcctgcagaacggcgggccggatgcagacgacggcgatggcgcggacatgtaaattccgcgtttgaatgcatcgaccattccagagcattcctgatgagaatgcggccggtttcgtttgtcggctggacagtggcggaggcgaacgttaaaagccgatggatttgtattatctgtccggcagcattgaagggcatagaatgagtggtgtgaacgatatccggtcgac

SEQ ID NO: 2987 - protein, 361 aa, Rhizobium etli
MSQNSLRLVEDKSVDKSKALEAALSQIERSFGKGSIMKLGSNENVIEIETISTGSLGLDIALGVGGLPKGRIIEIYGPESSGKTTLALQTIAESQKKGGICAFVDAEHALDPVYARKLGVDLQNLLISQPDTGEQALEITDTLVRSGAVDVLVVDSVAALTPRAEIEGEMGDSLPGLQARLMSQALRKLTASISKSNTMVIFINQIRMKIGVMFGSPETTTGGNALKFYASVRLDIRRIGSVKEREEVIGNQTRVKVVKNKMAPPFKQVEFDIMYGEGVSKTGELVDLGVKAGIVEKSGAWFSYNSQRLGQGGENAKTFLRDNPDLAREIELALRENAGLIADRFLQNGGPDADDGDGADM

SEQ ID NO: 2988 - DNA, 1098 bp, Rhizobium loti
  CDS (1)..(1098)
atggctcagaattctttgcggcttgtagaggataaggcagtggacaaatcaaaggctctggatgcggcgctgtcgcaaatcgagcgggctttcggcaagggctcgatcatgcggctcggcgcgaacgagcaggtcgtcgagatcgaaaccgtgccgaccggctcgctcggcctcgacatcgcgctcggcgtcggtggcctgccgcgcggccgcatcatcgagatctacggaccggaaagctcgggcaagacgacgctggccctccacacggtggccgaagcccagaagaagggcggcatctgcgccttcgtcgacgccgaacacgcgctcgatccggtctatgcccgcaagctcggcgtcgaccttgaaaacctgctgatctcgcagcccgataccggcgagcaggcgctggagatctgcgacacgctggtgcgttccggcgccatcgacgtgctggtggtcgattcggtcgcggcactgacgccgcgcgccgaaatcgagggcgagatgggcgattcgctgcccggcctgcaggctcgactgatgagccaggcgctgcgcaagctgaccgcctcgatctcgcgctccaacaccatggtcatcttcatcaaccagatccgcatgaagatcggcgtcatgttcggttcgcccgagaccacgaccggcggcaatgcgctgaaattctatgcgtcggtgcgcctcgatatccgccgcatcggctcggtcaaggaccgcgacgaggtcgttggcaaccagacccgcgtcaaggtggtcaagaacaagctggcgccgcccttcaaggtggtcgagttcgacatcatgtatggcgagggcgtgtccaagaccggcgaactggtcgacctcggcgtcaaggccggcgtggttgagaaatcgggcgcctggttctcctacaattcgcaacgtctcggccaggggcgcgaaaatgcaaagctgttcctgcgcgacaatcccgataccgcacgcgagatcgaactggcgctcaggcagaatgccgggctgatcgccgaaaaattcctcgagaatggcggctctgaaggcggcgacgacggttttgaggacgaagccggcgcaatgtag

SEQ ID NO: 2989 - protein, 365 aa, Rhizobium loti
MAQNSLRLVEDKAVDKSKALDAALSQIERAFGKGSIMRLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSGAIDVLVVDSVAALTPRAEIEGEMGDSLPGLQARLMSQALRKLTASISRSNTMVIFINQIRMKIGVMFGSPETTTGGNALKFYASVRLDIRRIGSVKDRDEVVGNQTRVKVVKNKLAPPFKVVEFDIMYGEGVSKTGELVDLGVKAGVVEKSGAWFSYNSQRLGQGRENAKLFLRDNPDTAREIELALRQNAGLIAEKFLENGGSEGGDDGFEDEAGAM

SEQ ID NO: 2990 - DNA, 1092 bp, Rhodopseudomonas palustris
  CDS (1)..(1092)
atggctgcccccaccgcattgcgtatcgtcgaaggttcctcaatggacaaatccaaggcgctctccgccgcgctgtctcagatcgagcgtcagttcggcaagggctcggtgatgaggctcggcaagaacgaccgctcgatggacatcgagacgatctcctccggctcgctcgggctcgacatcgcgctcggcgtcggcggtctgccgaaggggcggatcgttgagatctacgggccggaatcctccggcaagaccacgctggcgctgcactgcgtcgcggaagcccagaagaagggcggcatttgtgccttcgtcgacgccgaacacgcgctcgatccggtctatgcccgcaagctcggcgtcaatgtcgacgacctgctgatctcgcagcccgatcacggcgagcaggcgcttgagatcgccgacacgctggtgcgctccggcgcgatcgacgtgctgatcgtcgactcggtggcggcgctggtgccgcgcgccgaactcgaaggcgaaatgggtgacgcgctgcccggcctgcaggcgcggttgatgagccaggcgctgcgcaagctcaccgcctcgatcaacaagtccaataccatggtgatcttcatcaaccagatccggatgaagatcggcgtgatgtacggctcgccggaaaccaccaccggcggcaacgcgctgaaattctacgcctcggtccggctcgacatccgccgcatcggccagatcaaggaacgcgacgaggtggtcggcaaccagacccgcgtcaaggtggtgaagaacaagctggcgccgccgttcaagcaggtcgaattcgacatcatgtacggcgaaggcgtctccaagatgggcgagatcctcgatctcggcgtcaaggccggcatcgtcgaaaagtcgggcgcctggttctcgcatgacagccagcggctcggccagggacgcgagaacgccaaggcgttcctcaaggccaaccccgacatgaccgccaagatcgaggcggcgatccgccagaattccggactgatcgccgaacagattctcgcaggctcgcccgagagcgatgccgacggcgaggagccgatggaagagtaa

SEQ ID NO: 2991 - protein, 363 aa, Rhodopseudomonas palustris
MAAPTALRIVEGSSMDKSKALSAALSQIERQFGKGSVMRLGKNDRSMDIETISSGSLGLDIALGVGGLPKGRIVEIYGPESSGKTTLALHCVAEAQKKGGICAFVDAEHALDPVYARKLGVNVDDLLISQPDHGEQALEIADTLVRSGAIDVLIVDSVAALVPRAELEGEMGDALPGLQARLMSQALRKLTASINKSNTMVIFINQIRMKIGVMYGSPETTTGGNALKFYASVRLDIRRIGQIKERDEVVGNQTRVKVVKNKLAPPFKQVEFDIMYGEGVSKMGEILDLGVKAGIVEKSGAWFSHDSQRLGQGRENAKAFLKANPDMTAKIEAAIRQNSGLIAEQILAGSPESDADGEEPMEE

SEQ ID NO: 2992 - DNA, 1047 bp, Rhodopseudomonas viridis
  CDS (1)..(1047)
atggacaaaaccaaggcgctcgacgccgcgctcactcagatcgagcgggcattcggcaagggctcgatcatgcggctcggcaaatccggcgcggcgctggaggtcgagacgatttcgaccggctcgctcgggctcgacatcgcgctcggcatcggcgggctgccgcgcggccgagtggtcgagattttcggcccggaatcgtcgggcaagaccacgctggcgctgcacaccgtcgccgaggcgcagaagaagggcggggtttgtgccttcatcgacgccgagcacgccctcgacccgctctatgcccgcaagcttggggtcaatctcgacgacctgttgatctcgcagccggatgctggtgagcaggcgctggagatcgccgacacgctggttcgctcgggcgccatcgacgtgctggtggtcgactcggtcgccgccctggtgccgcgcgccgagctggaaggcgaaatgggcgacagtcagccgggcatgcaggcgcggttgatgagccaggcgcttcgcaagctcactgcctcgatctcgcgctccaactgcatggtgatcttcatcaaccagatccgcatgaagatcggcgtgatgtacggctcgccggagaccaccaccgggggtaacgccctgaaattctacgcctcggtccgcctcgacatccgccgcatcggtgcaatcaaggaacgcgacgaggttgtgggcaaccagacccgggtgaaagtggtcaagaacaagctcgccccgccgttcaagcaggtcgagttcgacatcatgtacggcgagggcatctccaaggccggtgagttgatcgacctcggtgtcaaagccggcgtggttgataagtcgggctcatggttctcccacgatagccagcgcatcggtcagggccgcgagaacgtcaagggcttcctcaagggccaccccgacgtcgccggccgcatcgaggcggcgattcgccagaatgccggcttgatcgccgagcggattctcggttcctcggaggacagcgaggacggcgaggacgctgccgaggcgtga

SEQ ID NO: 2993 - protein, 348 aa, Rhodopseudomonas viridis
MDKTKALDAALTQIERAFGKGSIMRLGKSGAALEVETISTGSLGLDIALGIGGLPRGRVVEIFGPESSGKTTLALHTVAEAQKKGGVCAFIDAEHALDPLYARKLGVNLDDLLISQPDAGEQALEIADTLVRSGAIDVLVVDSVAALVPRAELEGEMGDSQPGMQARLMSQALRKLTASISRSNCMVIFINQIRMKIGVMYGSPETTTGGNALKFYASVRLDIRRIGAIKERDEVVGNQTRVKVVKNKLAPPFKQVEFDIMYGEGISKAGELIDLGVKAGVVDKSGSWFSHDSQRIGQGRENVKGFLKGHPDVAGRIEAAIRQNAGLIAERILGSSEDSEDGEDAAEA

SEQ ID NO: 2994 - DNA, 1074 bp, Shewanella oneidensis
  CDS (1)..(1074)
atgaaggtcgatccaaacaaagagaaagcacttgctgcggtattgagccaaattgagaagcaatttggtaaaggctccatcatgaagctgggcgaagaccgctctatggatgttgagaccatttctacaggttctctttcccttgacgtcgctcttggggcaggtggtttgcctatgggccgtatcgttgagatctatggtccagagtcatcaggtaaaacaactctgacattagaagtgattgccgccgctcagcgcgaaggtaaaacctgtgcctttatcgatgcagaacacgctcttgatcctatctacgcgaaaaaattaggcgttgatattgataacttattgtgttcacagcccgataccggtgagcaagcccttgagatttgtgatgcattaacccgttctggtgcggttgatgtgattatcgttgactcggtagcggcattaacaccaaaggcggagattgaaggtgaaattggtgactcacacatgggcttagcggctcgtatgatgagccaagcaatgcgtaagttagcgggtaacctcaagcaatcgaacactctgttaatcttcatcaaccaaattcgtatgaagattggggtgatgtttggtaacccagaaaccacaacgggtggtaatgctctgaaattctatgcctctgttcgtttggatatccgccgtacaggcgctatcaaagaaggtgatgaggtggttggtaacgagacacgcgtaaaagtcgttaaaaacaaagttgcagcgccatttaaacaagcagagttccaaattctatacggtcaaggtatcaaccgtactggcgagttagttgatttaggtgtagcccataaactgattgagaaagcaggcgcttggtatagctacaagggcgataaaattggtcaaggccgtgcaaatgcgggtaaatatttgactgaaaacccagctatagccgctgaaatcgataagacattgcgtgagctattgttgagtaacccgagtgccctggcatcatcggcatccgatgatgacaatgtcgaggggaatattgatttagaaacaggcgaagtgttctga

SEQ ID NO: 2995 - protein, 357 aa, Shewanella oneidensis
MKVDPNKEKALAAVLSQIEKQFGKGSIMKLGEDRSMDVETISTGSLSLDVALGAGGLPMGRIVEIYGPESSGKTTLTLEVIAAAQREGKTCAFIDAEHALDPIYAKKLGVDIDNLLCSQPDTGEQALEICDALTRSGAVDVIIVDSVAALTPKAEIEGEIGDSHMGLAARMMSQAMRKLAGNLKQSNTLLIFINQIRMKIGVMFGNPETTTGGNALKFYASVRLDIRRTGAIKEGDEVVGNETRVKVVKNKVAAPFKQAEFQILYGQGINRTGELVDLGVAHKLIEKAGAWYSYKGDKIGQGRANAGKYLTENPAIAAEIDKTLRELLLSNPSALASSASDDDNVEGNIDLETGEVF

SEQ ID NO: 2996 - DNA, 1235 bp, Spirulina platensis
  CDS (54)..(1151)
tatttttgatccgcaattttaccaatttttactctgagcaggattcaaagctaatggccagcaaaaccgagaattccgaaaagcagaaagccctaaattcagtccttaaccaaatcgaaaagagttttggtaaggggtctattgtccgcctaggagactccgcccgtatgaaggtggaaactatctccagtggcgcattaaccttggatttggcccttggtggtggtttgccgaggggaagggtgattgaaatttatggcccagaaagttccggtaaaactactttggctctccatgcgatcgccgaaatccaaaaaactggcggaatagcagcttttgtggacgctgaacacgccctcgaccctacctatgcagccgccctgggagtagatattgaaaacctcctagtttcccaacctgacaccggggaaatggctttagaaatagtagatcaattggtgcgatcggtagcggttgatattgtagtggtagactcggtagctgctttagttccccgtgctgaaattgaaggggatatgggggattctcacatgggactacaagcccggttaatgagtcaagccctacggaaaattaccggaaatatcggtaaatctggctgtacagttattttcctgaatcagttacgccaaaaaattggtattgtctacggcaacccagaaactaccaccggggggaatgcccttaaattctacgcctcggtccgtcttgatatccgccgcacccaaaccctgaaaaaaggctcggacgagtatggcattcgcgctaaagttaaggtggctaaaaataaggtcgcgccacccttccgaatcgctgaatttgatattattttcggccagggaatctcaactatcggttgtttgattgacctcgcagaagaaaccggagtgattaaacgtaagggcgcttggtatagctacaacaacgagaatatcggtcaaggacgcgatcgcaccatcacctatatgcaggaaaacccagcatttaccgaagaaattgataaacgagtccgtgccgctttagcagggggtgcagttgtatcagccacctctgttgttaaacttgatgataatcctgacacagatgatcatgatgtcgaagacattgacgagaatactgatgaggaataaatcattaatttagttaaatcaagtcccctttaaccagtggaaaaaggcaattaattgcctcccctgaagtccggcactccccac

SEQ ID NO: 2997 - protein, 365 aa, Spirulina platensis
MASKTENSEKQKALNSVLNQIEKSFGKGSIVRLGDSARMKVETISSGALTLDLALGGGLPRGRVIEIYGPESSGKTTLALHAIAEIQKTGGIAAFVDAEHALDPTYAAALGVDIENLLVSQPDTGEMALEIVDQLVRSVAVDIVVVDSVAALVPRAEIEGDMGDSHMGLQARLMSQALRKITGNIGKSGCTVIFLNQLRQKIGIVYGNPETTTGGNALKFYASVRLDIRRTQTLKKGSDEYGIRAKVKVAKNKVAPPFRIAEFDIIFGQGISTIGCLIDLAEETGVIKRKGAWYSYNNENIGQGRDRTITYMQENPAFTEEIDKRVRAALAGGAVVSATSVVKLDDNPDTDDHDVEDIDENTDEE

SEQ ID NO: 2998 - DNA, 1074 bp, Staphylococcus epidermidis
  CDS (25)..(1074)
ctttctgtagtaggaggtctcgttatggataatgaacgtcaaaaagctttagatacagtaattaaaaacatggaaaaatcttttggtaaaggtgccgttatgaagttaggcgataataaaggtcgcagagtatcaagcacttcaagtggttctgtcacagttgataatgcattaggggttggaggttatcctaaaggaagaattatcgaaatatatggacctgaaagttcaggtaagacgacagtagctttacatgctatcgctgaagtacaaaaaaacggtggtgtagcagcatttatcgatgccgaacatgctctcgatccagtatatgcacaagcattaggtgtagatattgataatttatatttatctcaacctgatcatggtgaacaaggtcttgaaatcgccgaagcttttgttcgtagtggtgctgtggacattgttgttgtcgattcagtagcagcattaacacctaaagctgaaattgaaggtgaaatgggagatactcatgttggtttacaagcaagattaatgtctcaagcattaagaaagttatcaggggctatttctaaatctaatactacagctatatttattaaccaaattcgtgaaaaggtcggtgtgatgttcgggaatcctgaaacaacgcccggtggtagagccctaaaattctatagttctgtacgtttagaggtaagaagagcagagcagttaaaacaaggtcaagatattgtaggtaacagaaccaaaataaaagttgtaaaaaataaagttgcacctccatttagagttgcagaagtagatattatgtatggtcaaggtatctctaaggaaggagagctcattgatttaggtgtagagaatgatatcgttgataaatcaggtgcttggtattcttataatggagatagaatgggccaaggtaaagaaaacgtcaaaaattatcttaaggaaaatccacaaatcaaagaagaaattgaccgtaagttacgtgaaaagttaggtattttcgatggtgatgtggatgaaaatgagaatgaagacgattcaccaaaaactttatttgatgaatag

SEQ ID NO: 2999 - protein, 349 aa, Staphylococcus epidermidis
MDNERQKALDTVIKNMEKSFGKGAVMKLGDNKGRRVSSTSSGSVTVDNALGVGGYPKGRIIEIYGPESSGKTTVALHAIAEVQKNGGVAAFIDAEHALDPVYAQALGVDIDNLYLSQPDHGEQGLEIAEAFVRSGAVDIVVVDSVAALTPKAEIEGEMGDTHVGLQARLMSQALRKLSGAISKSNTTAIFINQIREKVGVMFGNPETTPGGRALKFYSSVRLEVRRAEQLKQGQDIVGNRTKIKVVKNKVAPPFRVAEVDIMYGQGISKEGELIDLGVENDIVDKSGAWYSYNGDRMGQGKENVKNYLKENPQIKEEIDRKLREKLGIFDGDVDENENEDDSPKTLFDE

SEQ ID NO: 3000 - DNA, 1140 bp, Streptococcus agalactiae
  CDS (1)..(1140)
atggctaaaaaaacgaaaaaagcagaagaaattactaagaaattcggtgatgaacgtcgaaaagccttagatgatgctttgaaaaatattgaaaaagattttggtaagggcgcagtgatgcgcttaggtgagcgagctgaacaaaaggttcaagtaatgagttcaggttctcttgctttagatatcgctttaggagcaggtggatatcctaaaggacgtatcgtcgaaatttatggaccagagtcatctggtaaaacaacggttgcccttcatgccgtagctcaagcccaaaaggaaggtgggattgctgcctttattgatgctgagcacgctcttgacccagcctatgctgcggctcttggagttaatattgatgagttacttttgtctcaacctgactcaggtgagcaaggtcttgaaattgcaggtaaattgattgattcaggcgcagttgatttagttgttgtcgattcagttgcagcccttgttcctcgtgctgagattgatggtgatattggtgacagccacgttggtttgcaagctcgtatgatgagtcaagcaatgcgtaaattgtcagcatccattaacaagacaaagacaatcgcaatttttatcaaccagttaagggaaaaagtaggcgttatgtttggtaaccctgaaacaacacctggtggtcgtgctttgaaattttattcatcggttcgtctagatgttcgtggtaatactcaaatcaagggaactggtgagcataaagatcataatgttggtaaagagacaaaaatcaaagttgttaaaaataaagttgctccaccattccgtgaagcttttgtcgaaattatgtatggtgaaggtatttctcgcacgggtgagttaattaaaattgctagtgatttggatattatccaaaaagcaggtgcatggtactcatataatggtgagaaaattggacaaggttctgaaaatgccaaaaaatatttagcagataatccagcaatttttgatgaaattgaccataaagtgcgcgtgcactttggaatgactgaagatgattcgccagttcagtctgagctcgttgaagaaaaaaatgaagctgatgatcttgttttagatttggacaatgctattgaaattgaggaataa

SEQ ID NO: 3001 - protein, 379 aa, Streptococcus agalactiae
MAKKTKKAEEITKKFGDERRKALDDALKNIEKDFGKGAVMRLGERAEQKVQVMSSGSLALDIALGAGGYPKGRIVEIYGPESSGKTTVALHAVAQAQKEGGIAAFIDAEHALDPAYAAALGVNIDELLLSQPDSGEQGLEIAGKLIDSGAVDLVVVDSVAALVPRAEIDGDIGDSHVGLQARMMSQAMRKLSASINKTKTIAIFINQLREKVGVMFGNPETTPGGRALKFYSSVRLDVRGNTQIKGTGEHKDHNVGKETKIKVVKNKVAPPFREAFVEIMYGEGISRTGELIKIASDLDIIQKAGAWYSYNGEKIGQGSENAKKYLADNPAIFDEIDHKVRVHFGMTEDDSPVQSELVEEKNEADDLVLDLDNAIEIEE

SEQ ID NO: 3002 - DNA, 1119 bp, Streptomyces ambofaciens
  CDS (1)..(1119)
atggcaggaaccgaccgcgagaaggctcttgacgccgcactcgcacagattgaacggcagttcggcaagggcgcggtcatgcgcatgggcgaccggtcgaaggagcccatcgaggtcatcccgaccgggtcgaccgcgctcgacgtggccctcggcgtcggcggcctgccgcgcggccgcgtcatcgaggtctacggtccggagtcctccggtaagacgaccctgaccctgcacgccgtggcgaacgcgcagaaggccggcggccaggtggcgttcgtggacgcggagcacgccctcgaccccgagtacgcccagaagctcggcgtcgacatcgacaacctgatcctgtcccagccggacaacggtgagcaggccctggagatcgtggacatgctggtccgctccggcgccctcgacctcatcgtcatcgactccgtcgccgcgctcgtcccgcgcgcggagatcgagggcgagatgggtgacagccacgtcggtctccaggcccggctgatgagccaggcgctccggaagatcaccagcgcgctcaaccagtccaagaccaccgcgatcttcatcaaccagctccgcgagaagatcggcgtcatgttcggctccccggagaccacgaccggtggccgggcgctcaagttctacgcctcggtgcgactcgacatccgacgcatcgagacgctcaaggacggcaccgacgcggtcggcaaccgcacgcgcgtcaaggtcgtcaagaacaaggtcgcgccgcccttcaagcaggccgagttcgacatcctctacggccagggcatcagccgcgagggcggcctgatcgacatgggcgtggagcacggcttcgtccgcaaggccggcgcctggtacacgtacgagggcgaccagctcggccagggcaaggagaacgcgcgcaacttcctgaaggacaaccccgacctcgccaacgagatcgagaagaagatcaaggagaagctgggcgtcggagtccgtcccgaggagccgacggccaccgagtccggaccggacgccgcgacggccgaatccgcaccggcggtgcccgcgcccgcgaccgccaaggtcaccaaggccaaggccgcggcagccaagagctga

SEQ ID NO: 3003 - protein, 372 aa, Streptomyces ambofaciens
MAGTDREKALDAALAQIERQFGKGAVMRMGDRSKEPIEVIPTGSTALDVALGVGGLPRGRVIEVYGPESSGKTTLTLHAVANAQKAGGQVAFVDAEHALDPEYAQKLGVDIDNLILSQPDNGEQALEIVDMLVRSGALDLIVIDSVAALVPRAEIEGEMGDSHVGLQARLMSQALRKITSALNQSKTTAIFINQLREKIGVMFGSPETTTGGRALKFYASVRLDIRRIETLKDGTDAVGNRTRVKVVKNKVAPPFKQAEFDILYGQGISREGGLIDMGVEHGFVRKAGAWYTYEGDQLGQGKENARNFLKDNPDLANEIEKKIKEKLGVGVRPEEPTATESGPDAATAESAPAVPAPATAKVTKAKAAAAKS

SEQ ID NO: 3004 - DNA, 1134 bp, Streptomyces avermitilis
  CDS (1)..(1134)
atggcaggaaccgaccgcgagaaggcgctcgacgccgcgctcgcacagattgaacggcaattcggcaagggcgcggtgatgcgcctgggcgagcggccgaatgagcccatcgaggtcatccccaccgggtcgaccgcgctcgacgtcgccctcggcgtcggcggcctgccgcgcggccgagtggtggaggtgtacggcccggagtcctccggtaagacgaccctgacgctgcacgcggtggcgaacgcgcagaaggccggcggccaggtggccttcgtggacgccgagcacgccctcgaccccgagtacgcgaagaagctcggcgtcgacatcgacaacctgatcctgtcgcagccggacaacggtgagcaggctctggagatcgtggacatgctggtccgctccggcgcgctcgacctgatcgtcatcgactccgtcgccgccctggtgccgcgcgcggagatcgagggcgagatgggcgactcgcacgtgggtctgcaggcccgcctgatgagccaggccttgcggaagatcaccagcgcgctcaaccagtcgaagaccaccgcgatcttcatcaaccagctccgcgagaagatcggcgtgatgttcggctctccggagaccacgacgggtggccgggcgctgaagttctacgcctcggtgcggctcgacatccgtcgcatcgagacgctgaaggacggcaccgacgcggtcggcaaccgcacccgcgtcaaggtcgtcaagaacaaggtcgcgccgcccttcaagcaggccgagttcgacatcctctacgggcagggcatcagccgcgaaggcggcctgatcgacatgggcgtggagaacggcttcgtccgcaaggctggcgcctggtacacgtacgagggcgaccagctcggccagggcaaggagaacgcgcgcaacttcctgaaggacaaccccgacctcgccaacgagatcgagaagaagatcaaggagaagctgggcgtcggcgtacggccggaggagcccacggcggagccgggcgcggacgcggcggtcacgtcggccgcggctgccacggacgacaccgcgaagacggtgtccgctcccgcggccaagaccaccaagtccaaggccgcggcggccaagagctag

SEQ ID NO: 3005 - protein, 377 aa, Streptomyces avermitilis
MAGTDREKALDAALAQIERQFGKGAVMRLGERPNEPIEVIPTGSTALDVALGVGGLPRGRVVEVYGPESSGKTTLTLHAVANAQKAGGQVAFVDAEHALDPEYAKKLGVDIDNLILSQPDNGEQALEIVDMLVRSGALDLIVIDSVAALVPRAEIEGEMGDSHVGLQARLMSQALRKITSALNQSKTTAIFINQLREKIGVMFGSPETTTGGRALKFYASVRLDIRRIETLKDGTDAVGNRTRVKVVKNKVAPPFKQAEFDILYGQGISREGGLIDMGVENGFVRKAGAWYTYEGDQLGQGKENARNFLKDNPDLANEIEKKIKEKLGVGVRPEEPTAEPGADAAVTSAAAATDDTAKTVSAPAAKTTKSKAAAAKS

SEQ ID NO: 3006 - DNA, 1152 bp, Streptococcus mutans
  CDS (1)..(1152)
atggccaaaagaataaaaaagacagaagaaataacgaaaaaatttggtgatgagcgtaagaaagctcttgatgatgctttgaaaaacatcgaaaaagattttggtaaaggtgcagttatgcgtctgggtgaacgcgctgaacaaaaggttcaggtgatgagttcaggaagtctggctcttgatattgctcttggggcaggcggttatccaaaagggcgtatcgttgagatttacgggccagaatcttctggtaagacaactgtcgctcttcatgctgttgctcaggcgcaaaaagatggcggtattgccgctttcattgatgcagaacatgcccttgatccagcctatgctgctgctcttggtgttaatattgatgagcttttgctttcacaaccagattcaggagaacagggtcttgaaattgcagggaaattgattgattctggcgctgttgatttagttgttgttgactcagtggcagctttagtaccacgtgcggagattgacggagatattggtgatagtcatgttggcttacaagcacgcatgatgagtcaagcgatgcgtaaattatcagcttcaataaataaaacaaaaaccattgccatttttattaatcaattgcgggaaaaagttggtattatgtttggtaatccagaaacaacccctggcgggcgtgccttgaagttttattcttctgtgcgtcttgatgtccgtggcaatactcaaattaaaggaaccggggaacaaaaagacagcaatattggtaaagagaccaaaattaaagttgttaaaaataaagttgctccaccatttaaggaagcttttgtagaaattatatatggtgaaggcatttctcgtacaggtgaattagttaagattgccagtgatttgggaattatccaaaaagctggagcttggtactcttataatggtgaaaaaattgggcaaggttctgaaaatgctaaaaaattcctagctgataatccagaaatttttgatgacatcgatcataaagtgcgtgttcaatatggtttaattgaggaagataatactgaagaaaaacagtcttctaaagaaaaagaaactgatgagaaagctgacaaaaaccttgttttagagctggatgatacaattgagcttgaagattga

SEQ ID NO: 3007 - protein, 383 aa, Streptococcus mutans
MAKRIKKTEEITKKFGDERKKALDDALKNIEKDFGKGAVMRLGERAEQKVQVMSSGSLALDIALGAGGYPKGRIVEIYGPESSGKTTVALHAVAQAQKDGGIAAFIDAEHALDPAYAAALGVNIDELLLSQPDSGEQGLEIAGKLIDSGAVDLVVVDSVAALVPRAEIDGDIGDSHVGLQARMMSQAMRKLSASINKTKTIAIFINQLREKVGIMFGNPETTPGGRALKFYSSVRLDVRGNTQIKGTGEQKDSNIGKETKIKVVKNKVAPPFKEAFVEIIYGEGISRTGELVKIASDLGIIQKAGAWYSYNGEKIGQGSENAKKFLADNPEIFDDIDHKVRVQYGLIEEDNTEEKQSSKEKETDEKADKNLVLELDDTIELED

SEQ ID NO: 3008 - DNA, 1137 bp, Streptococcus pyogenes
  CDS (1)..(1137)
atggcaaaaaaattaaaaaagaatgaagaaatcactaagaagtttggtgacgaacgtcgcaaagctcttgatgatgctttgaaaaatattgaaaaagatttcggtaagggcgcagtgatgcgattaggagaacgtgcagagcaaaaagttcaggttatgagttcaggaagtctagctcttgatattgcgcttggagctggtggttatcctaaaggacgtatcatcgaaatctatggtccagagtcttccggtaaaacgactgtggctttacatgctgtagcacaagctcaaaaagaaggtggaatcgcagcctttatcgatgccgagcatgcgcttgatccagcttatgctgctgcgcttggggttaatattgatgaactcctcttgtctcaaccagattctggagaacaaggacttgaaattgcaggtaaattgattgattctggtgcggttgatctggttgttgtcgattcagtagcagctttagtgccacgtgctgaaattgatggtgatattggcgatagccatgtcggattgcaagcacgtatgatgagtcaggccatgcgtaaattatcagcttctattaataaaacaaaaactatcgctatctttattaaccaattgcgtgaaaaagttggtgtgatgtttggaaatcctgaaacaacaccaggtggtcgagctttgaaattctatgcttctgttcggttggatgtgcgtggaacaactcaaattaaaggaactggtgaccaaaaagatagcagtattggtaaggagaccaaaatcaaggttgttaaaaacaaggtcgctccgccatttaaggtagcagaagttgaaatcatgtatggggaaggtatttctcgtacaggggagcttgtgaaaattgcttctgatttggacattatccaaaaagcaggtgcttggttctcttataatggtgagaagattggccaaggttctgaaaatgctaagcgttatttggccgatcatccacaattgtttgatgaaatcgaccgtaaagtacgtgttaaatttggtttgcttgaagaaagcgaagaagaatctgctatggcagtagcatcagaagaaaccgatgatcttgctttagatttagataatggtattgaaattgaagattaa

SEQ ID NO: 3009 - protein, 378 aa, Streptococcus pyogenes
MAKKLKKNEEITKKFGDERRKALDDALKNIEKDFGKGAVMRLGERAEQKVQVMSSGSLALDIALGAGGYPKGRIIEIYGPESSGKTTVALHAVAQAQKEGGIAAFIDAEHALDPAYAAALGVNIDELLLSQPDSGEQGLEIAGKLIDSGAVDLVVVDSVAALVPRAEIDGDIGDSHVGLQARMMSQAMRKLSASINKTKTIAIFINQLREKVGVMFGNPETTPGGRALKFYASVRLDVRGTTQIKGTGDQKDSSIGKETKIKVVKNKVAPPFKVAEVEIMYGEGISRTGELVKIASDLDIIQKAGAWFSYNGEKIGQGSENAKRYLADHPQLFDEIDRKVRVKFGLLEESEEESAMAVASEETDDLALDLDNGIEIED

SEQ ID NO: 3010 - DNA, 1356 bp, Streptococcus parasanguis
  CDS (118)..(1263)
aagcttgtgccaaatggaagaataattctaaaaatggatagaaaatgtgccttcaaaggacggaaaccgttggtgagtggagtgcatttcctgtatagcaaaaaataggagaaaagaatggcgaaaaaacagaaaaaattagatgatatcactaagaaatttggagatgagcgtgaaaaagcgctcaacgatgccctgaagttgatcgaaaaagactttggtaaaggatccatcatgcgtttgggtgaacgtgcagagcaaaaagtacaagtcatgagctctggttccttggcgcttgatattgccttgggtgctggtggttatccgaaaggtcggatcatcgaaatctatggtccagaatcatctggtaaaacaaccgttgccctccatgcagtagcccaagcacagaaagaaggaggcattgcagcctttatcgatgcggagcatgccttggatccatcttatgcagcggctcttggagtcaatatcgacgaacttctcttgtctcaaccagactcaggggagcaaggacttgaaattgctggtaaattgatcgactcaggtgcggttgatttggtggttgtcgattctgttgctgccttggtaccacgtgcggaaatcgatggagatatcggagatagccacgttggtttgcaagcgcggatgatgagccaagcgatgcgcaaactcggagcttccatcaacaagaccaagaccattgccatctttattaaccaattgcgtgaaaaagttggggttatgtttgggaatcctgaaaccacacctggtggtcgtgcccttaaattctatgcttcggttcgtttagatgtccgtggaaatactcaaatcaaggggactggggaccaaaaagataccaacgttggtaaggaaactaagatcaaggttgtaaagaacaaggtagctccaccgtttaaagaagccatggttgaaatcatgtacggggaaggaatttcacgtacgggtgaattggttaaaattgcaacagatttggatatcattcaaaaagcgggtgcgtggtactcatataatggcgaaaaaattggtcaaggatctgaaaatgctaagaaattcttggctgaccacccagaaatttttgacgaaatcgaccacaaggttcgggtacattttggtttgatcgaaaaagacgaagcggtgaaaagccttgataaaactgaagaggcagctcctgtcgtagaagaagtaactctggatttagatgacgcgattgaaattgaagattaatttttttcaaaataggtcgctagactgatggtttttgtgttataatttaatacgatagtattatcgtgtagcgaaaggagtgcatgcatgatt

SEQ ID NO: 3011 - protein, 381 aa, Streptococcus parasanguis
MAKKQKKLDDITKKFGDEREKALNDALKLIEKDFGKGSIMRLGERAEQKVQVMSSGSLALDIALGAGGYPKGRIIEIYGPESSGKTTVALHAVAQAQKEGGIAAFIDAEHALDPSYAAALGVNIDELLLSQPDSGEQGLEIAGKLIDSGAVDLVVVDSVAALVPRAEIDGDIGDSHVGLQARMMSQAMRKLGASINKTKTIAIFINQLREKVGVMFGNPETTPGGRALKFYASVRLDVRGNTQIKGTGDQKDTNVGKETKIKVVKNKVAPPFKEAMVEIMYGEGISRTGELVKIATDLDIIQKAGAWYSYNGEKIGQGSENAKKFLADHPEIFDEIDHKVRVHFGLIEKDEAVKSLDKTEEAAPVVEEVTLDLDDAIEIED

SEQ ID NO: 3012 - DNA, 1416 bp, Streptomyces rimosus
  CDS (229)..(1359)
gggcagcagtgtgagcgaggccggcatcgtcaccaggaccggcgggtcgtgcgtggtgcgcttgacaccaaaatcgaacgtctattcttatgagacgtccgacccgtgtttctgcccgagttcccgggagttatccacaggccggagtcgggtccgggcgcattgtcagtggcaggcgttagcgtcatggacgtgaagcgatcgactcaagcaaaccgggtggaagccatggcaggcactgaccgcgagaaggcgctggacgccgcgctcgcacagattgaacggcaattcggcaagggtgccgtgatgaggatgggagagcgctcgaaggagcccatcgaggtcatccccaccgcgtcgaccgcactggacgtcgcgctcggcgtcggcggtatcccccgcggccgcgtggtggagatctacggcccggagtcctccggcaagacgaccctgaccctgcacgcggtggcgaacgcgcagaaggccggcggctccgtcgccttcatcgacgccgagcacgcgctcgaccccgagtacgccaagaagctgggcgtggacacggacgcgctgatcctgtcccagccggacaacggcgagcaggccctggagatcgtggacatgctggtccgctccggcgcgctcgacctcatcgtgatcgactcggtcgccgcgctggtgccccgggcggagatcgagggtgagatgggcgactcccacgtgggtctccaggcccgtctgatgagccaggcgctgcggaagatcaccagcgcgctcaaccagtccaagaccaccgcgatcttcatcaaccagctccgcgagaagatcggcgtgatgttcggctcgccggagaccacgaccggtggccgcgccctgaagttctacgcctcggtgcgcatcgacatccgccgtatcgagaccctcaaggacggcaccgaagcggtcggcaaccgcacccgctgcaaggtcgtcaagaacaaggtcgccccgcccttcaagcaggccgagttcgacatcctgtacggccagggcatcagccgtgagggcggcctgatcgacatgggcgtcgagcacggcttcatccgcaagtcgggcgcctggtacacctacgagggcgaccagctcggccagggcaaggagaacgcccgcaacttcctcaaggacaaccccgacctcgccaacgaggtggagaagaagatcaaggagaagctgggcgtcggcgtgaagccggaagacctgacggcggagcccggcgcggacgcggcgggtgcggcggccgacgcggaggccccggccaagtccgtaccggcaccggccgccaagagtgccaagggctccaaggccgcagcggccaagagctagtccatcgtgacgcggcgaacggaatggcccgaggaccgcggctacggccatggtgac

SEQ ID NO: 3013 - protein, 376 aa, Streptomyces rimosus
MAGTDREKALDAALAQIERQFGKGAVMRMGERSKEPIEVIPTASTALDVALGVGGIPRGRVVEIYGPESSGKTTLTLHAVANAQKAGGSVAFIDAEHALDPEYAKKLGVDTDALILSQPDNGEQALEIVDMLVRSGALDLIVIDSVAALVPRAEIEGEMGDSHVGLQARLMSQALRKITSALNQSKTTAIFINQLREKIGVMFGSPETTTGGRALKFYASVRIDIRRIETLKDGTEAVGNRTRCKVVKNKVAPPFKQAEFDILYGQGISREGGLIDMGVEHGFIRKSGAWYTYEGDQLGQGKENARNFLKDNPDLANEVEKKIKEKLGVGVKPEDLTAEPGADAAGAAADAEAPAKSVPAPAAKSAKGSKAAAAKS

SEQ ID NO: 3014 - DNA, 1916 bp, Streptococcus thermophilus
  CDS (555)..(1694)
tctagacggaaaaagcttgcctgatctcatctatggatatggagaatcaaatagttagttatgaagtgttctatttgcttaagaaatatggcaaaactattactgcagctgaaagtttaacagctggcttatttcaagctagtgttcgtgattttcctggagcttcacaagtattcaagggtggttttgtcacctatagactggaagaaaaagctaaaatgttgggtattccttatctaaattagaagacgatggtgttgttagtcattttacagcagaaaaaatggctgaggtttccgagttaagacagatagtgattacgatgcgctactgagtagcagaccagagtctttggaggctcagcaggtacagtctttattggtattgccgatagaaccaagtcgatcaattaaggttgttataggtggaagaagtcgatctgatgttagatatatcagtacactctatgcctttaacctagttcgccaagctttattacaagaggacaactcaatttaagtttgtcatttaacacagaaagaagaggaaattaaatggctaagaaaacaaagaaaacagaagaaatcacaaagaagtttggtgatgagcgttggaaagcactcgacgatgcattaaaaaacattggaaaagattttggtaagggtgcagttatgcgtcttggtgagcgtgcagaggaaaaagttcaggttatgagctcaggctcactagctttggatattgctcttggtgcgggtggttacccaaagggtcgtattattgaaatttacggaccagaatcatcaggtaaaacaactgttgcccttcatgcagttgctcagactcaaaaagaaggtggcatcgcagcttttatcgatgccgagcatgctcttgaccctgcgtatgcagcagctctaggtgttaatatcgatgagcttcttttgtcgcagcctgattctggtgagcaaggtctcgaaattgcatgtaagctgattgactctggtgcagtggatttagttgttgttgactcagttgcggccttggtaccacgtgcagaaattgatggagatattggtgacagtcatgtaggacttcaagcgcgtatgatgagtcaagccatgcgtaaactttctgcatctattaataaaacaaaaacgattgctatctttattaaccagttgcgtgaaaaagttggtatcatgtttggtaacccagagactaccccaggtggacgtgctttaaaattctatgcatacgtagctcttgatgtacgtggtaatacacaaattaagggaactggtgacaaaaaggaccaaaatgttggtaaggaaaccaagattaaggttgttaaaaacaaagttgctccaccatttaaagaagcttttgttgaaattatgtatggcgaaggaatttcacaaaccggtgaacttgtaaaaattgcaagtgatataggcattattcagaaagccggagcttggttctcatataatggggagaaaattggtcaaggatctgaaaatgctaaaaagtatttagcagatcaccctgagatttttgcagaaatcgatcataaagtacgcgtacactacggtctgattgagctagatgaggacgatgttgttgaagatacacaagttgaagacacgtctgatgaactcattctagatcttgattcaaccattgaaatcgaagaataagtgtcaaagagcccaaaaggttcttttctttttgatttgaattaagaagaaaatatgagcaatataagttaaaaaagcgaatacaccccagattcaaaataggtcgctagactttaataaatcaaagaaggtgataagataatagatcatgtgacagaaagagagaattaacatgattaagtttatacaatttcaagttgtacaagttgtaaaaagcaaaaa

SEQ ID NO: 3015 - protein, 379 aa, Streptococcus thermophilus
MAKKTKKTEEITKKFGDERWKALDDALKNIGKDFGKGAVMRLGERAEEKVQVMSSGSLALDIALGAGGYPKGRIIEIYGPESSGKTTVALHAVAQTQKEGGIAAFIDAEHALDPAYAAALGVNIDELLLSQPDSGEQGLEIACKLIDSGAVDLVVVDSVAALVPRAEIDGDIGDSHVGLQARMMSQAMRKLSASINKTKTIAIFINQLREKVGIMFGNPETTPGGRALKFYAYVALDVRGNTQIKGTGDKKDQNVGKETKIKVVKNKVAPPFKEAFVEIMYGEGISQTGELVKIASDIGIIQKAGAWFSYNGEKIGQGSENAKKYLADHPEIFAEIDHKVRVHYGLIELDEDDVVEDTQVEDTSDELILDLDSTIEIEE

SEQ ID NO: 3016 - DNA, 1271 bp, Streptomyces violaceus
  CDS (75)..(1208)
cgggcccattgtcagtggcaggggttagcgtctttcacatgaagcgatcgactcaagcaaaccgggtggaacccatggcaggaaccgaccgcgagaaggcgctcgacgccgcgctcgcacagattgaacgccaattcggcaagggcgccgtgatgcgcatgggcgaccgcacccaggagccgatcgaggtgatctccaccggatcgaccgccctcgacatcgccctcggcgtcggtggcctgccgcgcggccgtgtcgtggagatctacggaccggagtcctccggtaagacgaccctgacgctgcacgccgtggccaacgcacagaaggccggcggccaggtggcgttcgtggacgccgagcacgccctcgaccccgagtacgccaagaagctcggcgtcgacatcgacaacctcatcctgtcccagccggacaacggcgagcaggccctcgagatcgtcgacatgctggtccgctccggcgccctcgacctcatcgtcatcgactccgtcgccgcgctcgtcccgcgcgcggagatcgagggcgagatgggtgactcccacgtcggtctccaggcccgactgatgagccaggcgctccggaagatcaccagcgcgctcaaccagtccaagaccaccgcgatcttcatcaaccagctccgcgagaagatcggcgtgatgttcggctcgccggagaccacgaccggtggccgcgccctcaagttctacgcctcggtgcgcctcgacatccgtcgcatcgagaccctcaaggacggcaccgacgcggtcggcaaccgcacccgcgtcaaggtcgtcaagaacaaggtcgcgcccccgttcaagcaggccgagttcgacatcctctacggccagggcatcagccgcgagggcggtctgatcgacatgggcgtggagcacggcttcgtgcgcaaggccggtgcctggtacacgtacgagggcgaccagctcggccagggcaaggagaacgcccgcaacttcctcaaggacaaccccgacctcgccgacgagatcgagcggaagatcaaggagaagctgggcgtcggcgtccggcccgacgcggccaaggccgaggcggcgacggacgcggcggccgcggacaccgccggcacggacgacgcggccaagagcgtcccggcacccgcgagcaagaccgcgaaggcgaccaaggccaccgcggtcaagagctgacccggtgaccggtcgcaccgaatggccggtgacagctcgactcgtcgaggccggaagagctgt

SEQ ID NO: 3017 - protein, 377 aa, Streptomyces violaceus
MAGTDREKALDAALAQIERQFGKGAVMRMGDRTQEPIEVISTGSTALDIALGVGGLPRGRVVEIYGPESSGKTTLTLHAVANAQKAGGQVAFVDAEHALDPEYAKKLGVDIDNLILSQPDNGEQALEIVDMLVRSGALDLIVIDSVAALVPRAEIEGEMGDSHVGLQARLMSQALRKITSALNQSKTTAIFINQLREKIGVMFGSPETTTGGRALKFYASVRLDIRRIETLKDGTDAVGNRTRVKVVKNKVAPPFKQAEFDILYGQGISREGGLIDMGVEHGFVRKAGAWYTYEGDQLGQGKENARNFLKDNPDLADEIERKIKEKLGVGVRPDAAKAEAATDAAAADTAGTDDAAKSVPAPASKTAKATKATAVKS

SEQ ID NO: 3018 - DNA, 1068 bp, Synechococcus elongatus
  CDS (1)..(1068)
atgagtgacaccaccctttccctcctttcccccgaaaagcgcaaagcccttgagtttgccatctcccaaattgaacgcagctttggtaagggcagcattatgcgccttggagatgccaccagcatgaaggtggagacgatttccagtggcgccctcacccttgaccttgctttgggcggtggactaccgaaggggcggatcattgaaatttatgggcctgaaagttcagggaaaaccaccttagccctccatgccatcgctgaagtgcaaaaggcagggggtgtggcggcttttgtggatgctgaacatgcccttgatcccacctatgccgctgccctacgggtagatattcaaaacttactggttgcccagccagacactggggaagcggctctagaaattgttgatcaactggtgcgctcaaccgctgtggatattatagtggtggactccgtggccgccttagtaccccgtgccgaaattgagggtgacatgggagagagccatgtggggctgcaagcccgcctcatgagccaagccctgcgcaaaattaacggcaatatcagtaaaacaggttgtacggtgattttcctgaaccaattgcggcaaaaaattggcctcacctacggtaacccggaaacaacgacggggggagtagccctcaagttctatgcctcggtgcgcctagatattcgacgggtgcaaaccctgaagaagggaacagaggaatttggtattcgcgccaaagtcaaggtggccaaaaataaagtggcgcctccctttcgcattgcggagtttgacattatttttggtaagggtattgccaatctcggctgtatcctcgacatggctgaggaagttggtgtgattacccgcaagggggcttggtattcctacaacggcgaaaatcttgcccaaggccgcgacaacacaattaactacatggaggagaaccccagctttgcccaagagattgaacagcaggtgcggcaaaggtttgaccagcgggtagccctctccgccaatacagcggcttatactgaggaggaaattggcgaaggggaatag

SEQ ID NO: 3019 - protein, 355 aa, Synechococcus elongatus
MSDTTLSLLSPEKRKALEFAISQIERSFGKGSIMRLGDATSMKVETISSGALTLDLALGGGLPKGRIIEIYGPESSGKTTLALHAIAEVQKAGGVAAFVDAEHALDPTYAAALRVDIQNLLVAQPDTGEAALEIVDQLVRSTAVDIIVVDSVAALVPRAEIEGDMGESHVGLQARLMSQALRKINGNISKTGCTVIFLNQLRQKIGLTYGNPETTTGGVALKFYASVRLDIRRVQTLKKGTEEFGIRAKVKVAKNKVAPPFRIAEFDIIFGKGIANLGCILDMAEEVGVITRKGAWYSYNGENLAQGRDNTINYMEENPSFAQEIEQQVRQRFDQRVALSANTAAYTEEEIGEGE

SEQ ID NO: 3020 - DNA, 1023 bp, Thermus thermophilus
  CDS (1)..(1023)
atggacgagagcaagcgcaaggccctggagaacgccctgaaggcgattgagaaggagttcggcaagggggcggtgatgcggctgggcgagatgcccaagcagcaggtggacgtgatccccaccggctccctcgccctagacctcgccctggggatcggcggcatcccccgggggcggatcgtggagatctatggccccgagtccgggggcaagaccaccctcgccctcaccatcatcgcccaggcccagaggcggggcggggtggccgccttcgtggacgcggagcacgccctggaccccctgtacgcccagcgcctcggcgtccaggtggaggacctcctggtctcccagcccgacacgggcgagcaggccctggagatcgtggagctcctcgcccgctcgggggcggtggacgtgatcgtggtggactcggtggccgccttggtcccccgggcggagattgagggggagatgggggaccagcacgtgggcctccaggcccggctcatgagccaggcccttcgcaagctcaccgcggtgctcgccaagagcaacaccgccgccatcttcatcaaccaggtgcgggagaaggtgggggtcacgtacggcaaccccgagaccaccccgggggggagggcgctgaagttctacgccagcgtgcgcctggacgtgcgcaaaagcggccagcccatcaaggtggggaacgaggccgtgggcgtcaaggtgcgggtcaaggtggtgaagaacaagctcgccccccccttccgcgaggcggagctggagatctacttcggccgggggctggacccggtggccgacctggtgaacgtggccgtggccgcgggggtcattgagaaggccgggtcctggttctcctacggggagctccgcctgggccaggggaaggagaaggcggccgaggccctgcgggagcggcccgagcttttggaggagatccgcaccaaggtcttggagcgggccggggaggtggtcctggccgcgggcgaggacgagggggagtag

SEQ ID NO: 3021 - protein, 340 aa, Thermus thermophilus
MDESKRKALENALKAIEKEFGKGAVMRLGEMPKQQVDVIPTGSLALDLALGIGGIPRGRIVEIYGPESGGKTTLALTIIAQAQRRGGVAAFVDAEHALDPLYAQRLGVQVEDLLVSQPDTGEQALEIVELLARSGAVDVIVVDSVAALVPRAEIEGEMGDQHVGLQARLMSQALRKLTAVLAKSNTAAIFINQVREKVGVTYGNPETTPGGRALKFYASVRLDVRKSGQPIKVGNEAVGVKVRVKVVKNKLAPPFREAELEIYFGRGLDPVADLVNVAVAAGVIEKAGSWFSYGELRLGQGKEKAAEALRERPELLEEIRTKVLERAGEVVLAAGEDEGE

SEQ ID NO: 3022 - DNA, 1405 bp, Thiobacillus ferrooxidans
  CDS (196)..(1236)
ttggcgattgctgggttgttgcggtaaccatcgccggtaaccatcgccgtttgccccgcccgcccgctcaggtagaatgccggaaaaggttgttcgctaagccgcggtgtcggttcagcgggtcctgccgcgcgccactacaacatggtgttttgcaaggatggttacccctcgattctggagaaggaaaatattatggatgaacagcgcagcaagggcctttcggcggccctgtcacagattgacaaacagtttggtaaaggcgccgtcatgcgtctcggtgatcataacgccatcaaggacatcgaggtctactccaccggctcgctgggtctggatctggcgctgggtgttggcggactgccccggggccgggtggtagagatctacgggccggaatcttccggtaaaacgactctcaccctgcatgccatagccagttgtcaggctgcaggcggcaccgccgcctttatcgatgccgagcacgcgctcgacccaggctatgcccacaagctcggcgtcgatctggaaaacctcctgatctcccagcctgataccggcgagcaggccctggaaatcgccgacatgctggtgcgctccggtgccgtggacctcatcgtcatcgactccgtggccgctctgacccccaaagcggaaatcgaaggcgagatgggcgattcccacgtcggtctgcaggcgcgtctgatgagtcaggctttgcgcaacttaaccgccaatatctcccggagcaacaccctggtcatttttatcaaccagattcgcatgaaaatcggggtgatgtatggcagtccggaaaccaccaccggtggtaatgcccttaaattctacgcttccgtgcgccttgatatccgccgcatcggcgcgatcaaaaagagcgacgaagtggtaggtaacgatacccgcgtcaaggtggtcaagaataaggtcgcaccacctttccgcgaagccgaatttgccatctattacggtgaaggcatctcccgactgtccgaactggtggacctcggtgtgaagttcgacatcgtcgaaaaaagcggcgcctggtacagttaccagggccaccgtattggtcagggcaaggacaatgcccgccagtacctcaaggtgcatccggaactggcggccaatatcgagcagcggatacgggcagcggcagcaggacaccccctggcctttgccgaagaggtggagagcccgcagcggtcggctagttgacgacagaacgcagcgatcccaccgcctggcacctacggttctggcgcgccgggagtatgggcgccgggagttgggtgacaaactgctccgtgcgggatgtgacgcaggggacgtgcctgcgctggatgcgctcgccgccgccggttatcaggatcacgcgcctggtcat

SEQ ID NO: 3023 - protein, 346 aa, Thiobacillus ferrooxidans
MDEQRSKGLSAALSQIDKQFGKGAVMRLGDHNAIKDIEVYSTGSLGLDLALGVGGLPRGRVVEIYGPESSGKTTLTLHAIASCQAAGGTAAFIDAEHALDPGYAHKLGVDLENLLISQPDTGEQALEIADMLVRSGAVDLIVIDSVAALTPKAEIEGEMGDSHVGLQARLMSQALRNLTANISRSNTLVIFINQIRMKIGVMYGSPETTTGGNALKFYASVRLDIRRIGAIKKSDEVVGNDTRVKVVKNKVAPPFREAEFAIYYGEGISRLSELVDLGVKFDIVEKSGAWYSYQGHRIGQGKDNARQYLKVHPELAANIEQRIRAAAAGHPLAFAEEVESPQRSAS

SEQ ID NO: 3024 - DNA, 1314 bp, Tropheryma whipplei
  CDS (1)..(1314)
atgtcatctaacgatcagataaatcgcacgcgcgcgctagagcttgctttagcaaatatagatcgccaatatggcaaaggcgctgttatgcgcatgaacgatgcccagaaagcgtatatagacgttataccaactggttccattgcacttgattatgcacttggggttggaggtctgcctcgcggccggattgttgagatatacggtcctgaatcaagcggtaaaaccactttgactctacacgcaatagcaagtgtccagcgcgctggtggcattgctgcgttcatagatgccgagcatgcacttgatccggagtatgcaaaaaaacttggggttgatattgatgcgcttcttgtcagccaacctgatagcggcgagcaggcattggagatatcggatatgttaattcgctcaacagcaattgacctgattgtcatagattccgttgctgcgcttgtcccgcgagctgaacttgagggtgatatgggggatatgcatgttggcctccaggcacggctcatgtctcaggctctgagaaagataacatccgggctgaatcagaccggaacgaccgctatatttatcaatcaacttcgtgaaaaggttggtgttttttttggcagtccagaaacaactcccggcggccgtgctctaaagttttatgcttcagttaggcttgatattcgtcgagtcgaaaccatcaagcagggcacagaggctgttggaaaccgtacgcgcgttaaggtggtgaaaaacaaagttgcaccgcccttcaaacaggccgagttcgacgttctgtacggggttggtatttcccgagaaagcggcttgatcgattttgcagttgataggggaatcattaaaaaatcaggatcgtggtacgtctatggcgatgatcagttggggcagggtaaggagaatgctcgtcggtttctcttagagaataagagcgtcgcggatgagatcgagaataaaataatcagccttttaggtttcaggtcgaacgagttcggtgatttgccagatcatgatgccgctgtgcgcactagtcctgacacaaattcccgtaaagtgagtggaactggcgccgtacacacaacatccggtagcccgtccgccggcaaaggtactgcctccggtgctgtaaacaattcacgcgactctactggtggcgatacaccggctggccagggccctttaaacttatctgtaaatcgtgacgtatcgactgatactgtttcgtctaagataagtgatgctacacataatcaaaagcccgcgggtaatggaaaaagtgttaagagaaagggttag

SEQ ID NO: 3025 - protein, 437 aa, Tropheryma whipplei
MSSNDQINRTRALELALANIDRQYGKGAVMRMNDAQKAYIDVIPTGSIALDYALGVGGLPRGRIVEIYGPESSGKTTLTLHAIASVQRAGGIAAFIDAEHALDPEYAKKLGVDIDALLVSQPDSGEQALEISDMLIRSTAIDLIVIDSVAALVPRAELEGDMGDMHVGLQARLMSQALRKITSGLNQTGTTAIFINQLREKVGVFFGSPETTPGGRALKFYASVRLDIRRVETIKQGTEAVGNRTRVKVVKNKVAPPFKQAEFDVLYGVGISRESGLIDFAVDRGIIKKSGSWYVYGDDQLGQGKENARRFLLENKSVADEIENKIISLLGFRSNEFGDLPDHDAAVRTSPDTNSRKVSGTGAVHTTSGSPSAGKGTASGAVNNSRDSTGGDTPAGQGPLNLSVNRDVSTDTVSSKISDATHNQKPAGNGKSVKRKG

SEQ ID NO: 3026 - DNA, 1411 bp, Vibrio cholerae
  CDS (183)..(1247)
aagcttgattgagcatctcgcagcagatcaggttcaaaacgttaactgagccaaacttttttctatacaggggtggacactgtacaaatcaacagtataatgaaccccaacatgacaaatcagcgtcgacccgatttcgacacaattacctatcacctgagagtgactatccggagagagtaatggacgagaataaacagaaggcacttgcggccgccctcggtcaaattgaaaagcaatttggtaaaggctccatcatgcgcttaggcgacaaccgcgcgatggatgtagaaaccatttcgaccggttctctgtctctggatatcgcgttgggtgctggtggtctaccaatgggacgtatcgttgagatcttcggccctgaatcttcgggtaaaacgacactgactctggaactgattgctgctgcacaacgtgaaggtaaaacctgtgcgtttatcgatgccgagcacgcactggatccggtttatgccaaaaaattgggcgtgaatatcgatgagctactggtttctcagccagataccggcgagcaagcactggaaatttgtgatgcactggctcgctctggtgctgtggatgtcatcgttgttgactcagtagcggctttgacaccaaaagcggaaattgaaggcgaaatgggcgatagccacatgggtctgcaagcgcgtatgttgtcgcaagcaatgcgtaaactgacgggtaacctcaagcaatccaactgtatgtgtatcttcatcaaccaaattcgtatgaagattggtgtgatgtttggtaacccagaaactaccactggcggtaacgcactgaaattctacgcttctgttcgtttggatattcgccgtactggcgcaatcaaagaaggcgaagaagtggtgggtaacgaaacccgtatcaaggttgtgaagaacaagattgctgcgccgtttaaagaagcgaacactcagatcatgtatggccaaggtttcaatcgtgaaggtgaattgatcgatcttggtgtgaaacacaaaatggttgagaagtcaggcgcttggtacagctataacggcgataaaatcggccaaggtaaagcgaatgcctgcaagtatctgaaagaaaacccagaaattgcgaaaactctagataaaaaactgcgtgaaatgctgttaaacccagaaaacatgcagctgatcgctgaaacatcttctgcggcggatgacgtcgaatttggcgcggtgccagaagagttttaatcggcaggctgaatgcaaagaggttcagcctctcaatctcgatgttgatgaagccctgcaatgcagggcttctttttggctgccaattgagtgagtgactcaaaactcaccgttagcctaatagggagttccatgagtttcgacttagccacttgccgacaaag

SEQ ID NO: 3027 - protein, 354 aa, Vibrio cholerae
MDENKQKALAAALGQIEKQFGKGSIMRLGDNRAMDVETISTGSLSLDIALGAGGLPMGRIVEIFGPESSGKTTLTLELIAAAQREGKTCAFIDAEHALDPVYAKKLGVNIDELLVSQPDTGEQALEICDALARSGAVDVIVVDSVAALTPKAEIEGEMGDSHMGLQARMLSQAMRKLTGNLKQSNCMCIFINQIRMKIGVMFGNPETTTGGNALKFYASVRLDIRRTGAIKEGEEVVGNETRIKVVKNKIAAPFKEANTQIMYGQGFNREGELIDLGVKHKMVEKSGAWYSYNGDKIGQGKANACKYLKENPEIAKTLDKKLREMLLNPENMQLIAETSSAADDVEFGAVPEEF

SEQ ID NO: 3028 - DNA, 1044 bp, Vibrio parahaemolyticus
  CDS (1)..(1044)
atggacgagaacaaacagaaagcgctcgccgctgcgctaggtcaaattgaaaagcaattcggtaaaggctctatcatgcgccttggtgataaccgcgcaatggatgtagaaaccatttcaacgggttcgctttctcttgatatcgctttgggtgctggtggtctaccaatgggtcgtatcgtagaaatctacggtccagaatcttcaggtaaaacaacgctaactctcgagcttatcgctgctgcacaacgtgaaggtaaaacttgtgcgtttatcgatgctgagcacgcgttggatcctgtgtacgctaaaaagcttggtgttgatatcgatgcgctattggtatctcagccagacactggtgagcaagctctagagatttgtgatgcattagctcgctctggcgccatcgacgtaatggttgttgactctgttgctgctctaacacctaaagctgagatcgaaggcgaaatgggcgacagccacatgggtctccaagctcgtatgctttctcaagcaatgcgtaagcttacaggtaacctgaaacagtctaactgtatgtgtatcttcatcaaccaaatccgtatgaagattggtgtgatgttcggtaaccctgaaacgactactggcggtaacgcgcttaagttttacgcttctgttcgtttagatatccgtcgtactggcgcaatcaaagaaggcgatgaagttgtaggtaacgaaacgcgtatcaaagtggttaagaacaagattgcagcaccatttaaagaagcaaacacgcaaatcatgtatggccaaggctttaaccgtgaaggtgagttgattgacttaggcgtgaagcacaagctagtagaaaaagcgggtgcttggtacagctacaatggcgataagattggtcaaggtaaagcaaacgcttgtaactacctgcgtgagcatccagaaatcgcgaaaacaatcgataccaaactgcgtgaaatgctactttctccagctcaaccagaagcacctgctgccggtgagaagcctgagcaagaagaagagttttaa

SEQ ID NO: 3029 - protein, 347 aa, Vibrio parahaemolyticus
MDENKQKALAAALGQIEKQFGKGSIMRLGDNRAMDVETISTGSLSLDIALGAGGLPMGRIVEIYGPESSGKTTLTLELIAAAQREGKTCAFIDAEHALDPVYAKKLGVDIDALLVSQPDTGEQALEICDALARSGAIDVMVVDSVAALTPKAEIEGEMGDSHMGLQARMLSQAMRKLTGNLKQSNCMCIFINQIRMKIGVMFGNPETTTGGNALKFYASVRLDIRRTGAIKEGDEVVGNETRIKVVKNKIAAPFKEANTQIMYGQGFNREGELIDLGVKHKLVEKAGAWYSYNGDKIGQGKANACNYLREHPEIAKTIDTKLREMLLSPAQPEAPAAGEKPEQEEEF

SEQ ID NO: 3030 - DNA, 996 bp, Wigglesworthia glossinidia brevipalpis
  CDS (1)..(996)
atgataattgaaaacaataaaaaaaaagctttagaaaaagctttagataaaattgaaaaacaattcggaaaaggatctataatgactcttggagaaaatagatctatggatatagaaactatttctacagggtctttgtctttagatattgctttaggcacaggaggtcttccaatgggaagaattgttgaaatttacggtcctgaatcttctggaaaaacaacattaacattagaagttatttatgaagcacaaaaaaagggtaaaatatgtgcatttatagatgctgaacatgctttagatccaatatatgctaaaaatctaggagtagatattaataatttattatgctctcaacctgataatggagagcaagctttagaaatttgtgattcattaactagatcaggagcagtagatcttattatagtagattctgtggcagcgttgactccaaaagctgaaatagatggagaaataggcgatttacatttaggattagcggctagaatgatgagccaggcaatgaggaagctggcaggaaatcttaaaaatgccaatactcttttgatttttatcaaccaaattcgagttaaaataggaactatatttggtagccctgaagttactactggagggaacgctttaaaattttatgcttcagtaagattggatattagaaaaattggaactattaaagatggagatattattataggaaacgaaactagagtaaaagtagtaaaaaataaaatatctgctccttttaggcaagcagaatttcaaattttatatggaaatggaataaacactgaaggagaattaatcactttaggagttaatcataatataattgaaaaatcaggttcatggtatagttataataaaaataaaataggacaaggaaaaaataatgcatgcaattttttaaaaaacaatccaaatatttctaaagaaatttctagaaaaatcagagaaattaatttgattaaataa

SEQ ID NO: 3031 - protein, 331 aa, Wigglesworthia glossinidia brevipalpis
MIIENNKKKALEKALDKIEKQFGKGSIMTLGENRSMDIETISTGSLSLDIALGTGGLPMGRIVEIYGPESSGKTTLTLEVIYEAQKKGKICAFIDAEHALDPIYAKNLGVDINNLLCSQPDNGEQALEICDSLTRSGAVDLIIVDSVAALTPKAEIDGEIGDLHLGLAARMMSQAMRKLAGNLKNANTLLIFINQIRVKIGTIFGSPEVTTGGNALKFYASVRLDIRKIGTIKDGDIIIGNETRVKVVKNKISAPFRQAEFQILYGNGINTEGELITLGVNHNIIEKSGSWYSYNKNKIGQGKNNACNFLKNNPNISKEISRKIREINLIK

SEQ ID NO: 3032 - DNA, 1035 bp, Xanthomonas axonopodis
  CDS (1)..(1035)
atggacgagaacaagaagcgcgccctttccgccgcactgagccagatcgaaaagcaattcggcaagggctcggtcatgcgcatgggcgaccgcgtcattgaggcggtcgaagtcatcccgaccggctcgctgatgctggatatcgccctggggatcggcggcctgccgaagggtcgcgtggtcgaaatctacggcccggaatcctccggcaagaccaccttgaccctgcaagccatcgccgagtgccagaagaacggcggcaccgctgccttcatcgatgccgagcacgcactggacccgatttatgcggccaagctgggcgtcaatgtcgacgacctgctgctgtcgcagccggataccggtgagcaggcactggaaattgccgacatgctggtgcgttcgggttcggttgatatcgtggtggtcgactcggtcgctgcactgacgccgaaggcggaaatcgaaggcgagatgggcgaccagctgccaggtttgcaggctcgcttgatgagccaggcgctgcgcaagctcaccggcaatatcaagcgctccaacacgctggtggtcttcatcaatcagctgcgcatgaagatcggcgtcatgatgccgggccagagcccggaagtgaccaccggcggcaacgcgctgaagttctacgcctcggtgcgtctggatatccgccgtatcggtgcgatcaagaagggcgacgagatcatcggcaaccagaccaagatcaaggtggtcaagaacaagctggcgcctccgttcaagcaggtcgtgaccgaaatcctgtatggcgaaggcatcagtcgcgagggcgaattgatcgacatgggcgtggaagccaagctggtcgacaaggccggcgcctggtacagctatggcgatgagcgcatcgggcagggcaaggacaacgcgcgaacctacctgcgcgacaactcgcaggttgcgacccggctggaagcggagctgcgtgagaagttccaacctgccgaagcaccgcgtgaagccggcgacgacgaagacaaggagtaa

SEQ ID NO: 3033 - protein, 344 aa, Xanthomonas axonopodis
MDENKKRALSAALSQIEKQFGKGSVMRMGDRVIEAVEVIPTGSLMLDIALGIGGLPKGRVVEIYGPESSGKTTLTLQAIAECQKNGGTAAFIDAEHALDPIYAAKLGVNVDDLLLSQPDTGEQALEIADMLVRSGSVDIVVVDSVAALTPKAEIEGEMGDQLPGLQARLMSQALRKLTGNIKRSNTLVVFINQLRMKIGVMMPGQSPEVTTGGNALKFYASVRLDIRRIGAIKKGDEIIGNQTKIKVVKNKLAPPFKQVVTEILYGEGISREGELIDMGVEAKLVDKAGAWYSYGDERIGQGKDNARTYLRDNSQVATRLEAELREKFQPAEAPREAGDDEDKE

SEQ ID NO: 3034 - DNA, 1594 bp, Xenorhabdus nematophilus
  CDS (142)..(1218)
tttaaaaattttgttggaagaaatcataaaaaattagcttgatgctgtatgattatacagtataatcatgcagcagctttggtatcagaaacagtttatcagcagtgaggcagccccttcattgcttgcgaaggagtaaacatggctaacgatgaaaacaaacaaaaagcactcgcagcagcgcttggacagattgagaaacaatttggtaaaggttccatcatgcgtttgggtgaaaaccgctcaatggatgttgaaactatctctactggttccctgtcattggatatcgcactaggcgcaggtggtttgccaatgggccgtattgttgagatatatgggcctgaatcttccggtaaaacaacgttaacattgcaagtgatcgctgctgcccagcgtgaaggcagaacgtgtgcttttattgatgccgaacatgcccttgatccagtttatgctaaaaaactgggcgtagatattgataacctgttgtgttcgcagcctgataccggtgaacaggcgttggaaatctgtgatgctttatcccgttccggcgcagtggatgtcattattgttgactccgttgcggcattgacaccaaaagcggaaattgaaggtgaaatcggtgattctcatatggggctggcagcgcgtatgatgagtcaggccatgcgtaagctggcaggtaacttgaaaaattcaaataccctgttgatcttcatcaaccagatccgtatgaaaattggtgtgatgtttggtaaccctgaaacaccgccgggtggtaatgcgctgaaattctatgcgtctgtccgtttggatatccgccgtacgggttccgtgaaaaatggtgatgaagttgttggtagcgaaacgcgtgtgaaagtcgttaaaaacaaagttgcagcaccattcaaacaggctgaattccaaattctttatggggaaggtattaatactctgggagagttgatcgatctgagtgttaaacacaaaatggtagaaaaagcaggtgcatggtatagctacaatggtgacaaaatcgggcagggtaaagccaacgccacgatttacctgaaagagcatccagaaactgctgctgagttgaataagaaactgcgtgatttgttgttgcacaatactggggatttcagtagcgcagcttcagattatgtgacagattacgaagacaacactgaagaagtgaataacgaagagttctaattgcttttcaatcactatctcgttttgaaaaccacatctatatcgggtgtggttttttgcttttaatgagggaataaacattcttgaaataagtatatcgaaacaggcttaatgaacagactttcagaaaatgcccagacgaattacaatgctgaaaagcgaatggatttatatgggattttacttcttacggaagacattctatcttaaccctattttaatttattcgtgagttgaaatgatgatgcgatatatcatcttaaacattcacaaatcttttttttcagcttgatttcgggacaattatgagcaaaagcaccgctgagatccgtcaagcgtttcttgacttttttcatactaaagggcaccaggtcgt

SEQ ID NO: 3035 - protein, 358 aa, Xenorhabdus nematophilus
MANDENKQKALAAALGQIEKQFGKGSIMRLGENRSMDVETISTGSLSLDIALGAGGLPMGRIVEIYGPESSGKTTLTLQVIAAAQREGRTCAFIDAEHALDPVYAKKLGVDIDNLLCSQPDTGEQALEICDALSRSGAVDVIIVDSVAALTPKAEIEGEIGDSHMGLAARMMSQAMRKLAGNLKNSNTLLIFINQIRMKIGVMFGNPETPPGGNALKFYASVRLDIRRTGSVKNGDEVVGSETRVKVVKNKVAAPFKQAEFQILYGEGINTLGELIDLSVKHKMVEKAGAWYSYNGDKIGQGKANATIYLKEHPETAAELNKKLRDLLLHNTGDFSSAASDYVTDYEDNTEEVNNEEF

SEQ ID NO: 3036 - DNA, 1044 bp, Xylella fastidiosa
  CDS (1)..(1044)
atggatgagaacaagaaacgcgccctttctgtcgctttaagccagattgaaaaacagttcggcaaggggtccgtgatgcggatgggcgatcgcgtgatcgaagccgtagaggcgatcccgacaggttcgctcatgttggatctggccctggggataggtggtttgccaaagggacgtgtcgtggaaatctatgggccggaatcttctgggaagaccacattgactttgcaggcgatcgctcaatgccagaagaggggaggtacagcagcgttcattgatgctgagcatgccttggatccgatttatgcgggcaagttaggcgtcaatgttgatgatttgttgttgtctcagccagatactggggagcaggctctggaaatcgctgacatgctggtgcgctcggggtcgatcgatatcatggttattgattcggttgcggcactcacgccaagggcggagattgagggtgagatgggagatcagttgcccggtcttcaggcgcgattgatgagccaggcgctgcgtaaattgaccggcaatatcaagcgctctaatacgctggtgatttttatcaaccagttgcgtatgaaaattgggatcatgatgccgggtcaaagccctgaaactacgacagggggtaatgcgctgaagttctatgcttctgtgcgtttggatattcgccgtattggcgcgatcaagaaaggtgacgaaattatcgggaatcaaaccaaaatcaaggttgttaaaaacaagttggcgcctcccttcaaacaagtcgtgactgagattctctatggtgaaggcatcagtcgtgaaggggaattgattgaaatgggcgtggaggccaagttggttgagaaagccggcgcttggtatagctatggtggtgagcggatcgggcaaggaaaagataatgcgcgtggctatctacgcgaaaacccgcattttgcggccaagcttgaggctgatttgcgtgagaaatttgagccgaccgagctttctcgagaagagggcgatgaagatacgctcgaagatgcaatgtaa

SEQ ID NO: 3037 - protein, 347 aa, Xylella fastidiosa
MDENKKRALSVALSQIEKQFGKGSVMRMGDRVIEAVEAIPTGSLMLDLALGIGGLPKGRVVEIYGPESSGKTTLTLQAIAQCQKRGGTAAFIDAEHALDPIYAGKLGVNVDDLLLSQPDTGEQALEIADMLVRSGSIDIMVIDSVAALTPRAEIEGEMGDQLPGLQARLMSQALRKLTGNIKRSNTLVIFINQLRMKIGIMMPGQSPETTTGGNALKFYASVRLDIRRIGAIKKGDEIIGNQTKIKVVKNKLAPPFKQVVTEILYGEGISREGELIEMGVEAKLVEKAGAWYSYGGERIGQGKDNARGYLRENPHFAAKLEADLREKFEPTELSREEGDEDTLEDAM

SEQ ID NO: 3038 - DNA, 1020 bp, Zymomonas mobilis
  CDS (1)..(1020)
atggacaagcaaaaagcccttgaagcggctttagctcagattgaccgcgcttttggtaaaggttcggttatgcgcttggggtctcgtgaaaaaatcgagattgatacaatttccagcggatcacttggccttgatattgcgctgggcattggcggcttgccccgtggccgtatcgtcgaaatctatggtcctgaaagctcgggtaaaacaactttagccctccatgctatcgccgaagcacaaaaagcaggtggaacagcggcctttgtcgatgctgaacatgcgcttgatccggtctatgccaaaaaactgggtgttaatacggatgatctaatcgtctctcagcctgatacgggtgagcaggctctggaaattacagataccctgatccgttctaacgctgttgatatattggttgtcgattctgttgcggccttaacgcctcgtgctgaaatcgaaggcgaaatgggcgatagtcacgttggtttgcaagcccgtttgatgagtcaggcgcttcgcaaaattaccggctcaatcaaccgctctcaaactttggttatttttattaaccaagtccggatgaaaatcggggttatgtatggcaaccctgaaacaacaacgggcggtaatgctttgaaattctatgccagcgttcggcttgatatccgtcgtgtaggacaaattaaagatcgcgatgaaatcgttggtaatgctacccgtgtcaaagtggtaaaaaacaagctgctccggcctttcaagcaggttgaattcgatatcatgtatggagaaggtgtctccaagatgggcgaaattctcgatctgggcgtaaaagccggtattatcgacaagtcaggctcatggttcagtcatgattccgttcgcatcggtcagggacgtgaaaatgccaaaacgttcttgcgtgaacatcctgaaatgactgaaaaaattgaaaaaatgattcgtcataatacggctgaaattgccgacgaaatgctggatccatctatccctgaagattag

SEQ ID NO: 3039 - protein, 339 aa, Zymomonas mobilis
MDKQKALEAALAQIDRAFGKGSVMRLGSREKIEIDTISSGSLGLDIALGIGGLPRGRIVEIYGPESSGKTTLALHAIAEAQKAGGTAAFVDAEHALDPVYAKKLGVNTDDLIVSQPDTGEQALEITDTLIRSNAVDILVVDSVAALTPRAEIEGEMGDSHVGLQARLMSQALRKITGSINRSQTLVIFINQVRMKIGVMYGNPETTTGGNALKFYASVRLDIRRVGQIKDRDEIVGNATRVKVVKNKLLRPFKQVEFDIMYGEGVSKMGEILDLGVKAGIIDKSGSWFSHDSVRIGQGRENAKTFLREHPEMTEKIEKMIRHNTAEIADEMLDPSIPED

SEQ ID NO: 3040 - DNA, 1660 bp, primary endosymbiont of Sitophilus oryzae
  CDS (11)..(1078)
aggagtaaaaatggctattgatgagaataaacaaaaggcgttagcggcagcactgggtcaaattgaaaagcaattcggcaagtgttcgatcatgcgcctgggtgaagatcgctccatggatgttgaaacgatctccacaggttctctgtctctggatattgcgttgggcgccggtgggctgcccatgggccgtatcgttgaaatctacggcccggaatcatcgggtaaaaccactctgaccctgcaggttatcgccgcggcgcagcgcgaaggcaaaacctgcgcctttatcgatgccgagcatgccctggaccctatctacgccaaaaagctgggcgtcgatatcgataatctgttgtgctcccagccggacaccggcgaacaggcgctggaaatctgcgatgctctgacccgctccggcgctgtagacgtcatcatcgtcgactccgtggcggcactgacgccgaaagcggaaatcgagggtgagatcggcgattcccatatgaggctggccgcccgtatgatgagccaggcgatgcgcaaactggcgggtaatttgaaaaacgccaatacgctgctgattttcattaaccagatccgcatgaagatcggcgtcatgttcggtaacccggagaccacgaccggtggtaatgcgcttaagttttacgcatcggttcgtctggatattcgccgtatcggctcggtgaaagaaggcgatgtggtggtgggcagtgaaacccgcgtcaaagtcgtgaagaacaaagtcgccgcgccgtttaaacaggccgaattccagatcatgtacggcgaaggcatcaacattcgcggtgagctggtcgatctgggcgtcaagcacaagctgatagagaaagcgggcgcctggtacagctataacggcgagaagatcggtcagggcaaggccaatgcctgcacctttctgaaggaccatcccgaactggcggcggagctggacaaaaagctgcgcgacatgctgctgcatagcgccgatggcaacagcctggtcagcgacgtggaaagcgaggacgaaagcgccagcgagagcaatgaagagttttaatcgacgggcggtgaagacgacggcgcaacccgcgaccgcggtaagccaggacgagatcgaccaggcgatcgcttattgtcatgaccacgactggcttgacgatgggcgcttcgcacggcgctatgtcagccgccgcagcaaacaaggctatggcgaacagcgcattcgtatggaactgctgcagaaaggaatcaacagggacgacatcaatgcggccttcgccgaagcggagatcgatcgtacggcgcaggcgttcgccgtggcggtgaaaaagttcgggcagccactgccggccgagccgcagtccaaaatcaaagtgcagagttatctactctcccgcggcttttcctttgacgaaatccggtctatttatacaaatttataaatagatggcgtgcgggattttacttcgcaccaaagaaaatttatcttattcccactttttacgatcctgaacgctactgcagcgccttactactgcgctattctgttcacgattcgatcttttttttgcatgattccgggacaactatgagcaagagcactgctgagatccgtcaggcgtttctcgactttttccat

SEQ ID NO: 3041 - protein, 355 aa, primary endosymbiont of Sitophilus oryzae
MAIDENKQKALAAALGQIEKQFGKCSIMRLGEDRSMDVETISTGSLSLDIALGAGGLPMGRIVEIYGPESSGKTTLTLQVIAAAQREGKTCAFIDAEHALDPIYAKKLGVDIDNLLCSQPDTGEQALEICDALTRSGAVDVIIVDSVAALTPKAEIEGEIGDSHMRLAARMMSQAMRKLAGNLKNANTLLIFINQIRMKIGVMFGNPETTTGGNALKFYASVRLDIRRIGSVKEGDVVVGSETRVKVVKNKVAAPFKQAEFQIMYGEGINIRGELVDLGVKHKLIEKAGAWYSYNGEKIGQGKANACTFLKDHPELAAELDKKLRDMLLHSADGNSLVSDVESEDESASESNEEF

SEQ ID NO: 3042 - DNA, 1110 bp, Azospirillum lipoferum
  CDS (1)..(1110)
atgtcgtccgcacagcttcgtttggtcgagaaggattccatggacaagcagaaggcgctcgatgccgccctgagccagatcgaacgcgcgttcggcaagggctcgatcatgaagctcggcgcccgtgagaacctggtcgagacggaggtcatttccaccggctccctgggtctcgatatcgcgctgggcatcggtggcctgccgaagggccgcatcgtcgaaatctacgggccggaaagctcgggcaagaccacgctggcgctgcacgccatcgcccaggcccagaaggccggcggcacctgcgccttcgtggacgccgaacacgcgctcgacccgtcctatgcccgcaagctgggcgtcaacatcgacgagttgctgatctcccagccggatgccggcgagcaggcgctggagatcgccgatacactggtgcgctccggcgccatcgacgtgctggtcgtcgactcggttgccgcgctggttccgcgcgccgaactggaaggcgagatgggtgacgccatgtcgggcctgcatgcccgcctgatgagccaggcgctgcgcaagctgaccggctcgatctccaagtcgaattgcctggtgatcttcatcaatcagatccgcctgaagatcggcgtgatgttcggcaacccggagacgacgaccggcggcaacgcgctgaagttctacgcctccgttcgtctcgacatccgccgcatcggctcgatcaaggaccgcgacaccgtcgtcggcaaccagacccgcgtcaaggtggtgaagaacaagatggccccgccgttccgcgtggtcgagttcgacatcatgtatggcgagggtgtgtcgaaggtcggcgagttgctcgacctcggcatccaggccggtgtggtcgataagtcgggtgcgtggttcagctatgacggcacccgcatcggccagggccgcgagaatgccaagacctacctgcgcaacaaccccgagatggccgatgcgatcgaggccaagatccgcggcaacgccggtctggtcgccgacgccatgatgggcacccggaagccgacggcgaagcctccacaccggagtgaggttcccagcgagcaggaagcccgctgctga

SEQ ID NO: 3043 - protein, 369 aa, Azospirillum lipoferum
MSSAQLRLVEKDSMDKQKALDAALSQIERAFGKGSIMKLGARENLVETEVISTGSLGLDIALGIGGLPKGRIVEIYGPESSGKTTLALHAIAQAQKAGGTCAFVDAEHALDPSYARKLGVNIDELLISQPDAGEQALEIADTLVRSGAIDVLVVDSVAALVPRAELEGEMGDAMSGLHARLMSQALRKLTGSISKSNCLVIFINQIRLKIGVMFGNPETTTGGNALKFYASVRLDIRRIGSIKDRDTVVGNQTRVKVVKNKMAPPFRVVEFDIMYGEGVSKVGELLDLGIQAGVVDKSGAWFSYDGTRIGQGRENAKTYLRNNPEMADAIEAKIRGNAGLVADAMMGTRKPTAKPPHRSEVPSEQEARC

SEQ ID NO: 3044 - DNA, 1017 bp, Geobacter sulfurreducens
  CDS (1)..(1017)
atgacccaagaacgcgaaaaggcgatagagcttgcgctcagccagatagaaaagcagttcggcaagggggcgatcatgcgcctcggggcggatgaggccctccccgatgtggccgccatccccaccggttccctctccctcgacctggccctcggcgtcggcggcgtcccccgcgggcggattatcgagatctacggacccgagtcgtcgggcaagacgacgctcgccctgcacatcgcggccgaggcccagaaaatgggcggcatcgctgccttcgtcgacgccgagcacgcgctcgatatcggctatgcccgcaaactcggcgtcaagacggacgacctgctcgtctcccagcccgacaccggggagcaagccttggaaattgccgagatgctcgtcagaagcggcgctgtggacgtcctcgtcatcgactcggtggcggcactggttcccaaggccgagatcgaaggggagatgggcgactcccacatggggctccaggcccggctcatgtctcaggccctgcgcaagctcaccggcataatctccaagtccaactgctgcgtcatcttcatcaaccagatccggatgaagatcggcgtcatgttcggcaaccccgaaaccaccaccggcggcaacgccctcaagttttacgcctcggtacgtctcgatatccgcaagatcgcatccctcaagcaagggcaggacgtcatcggctcccgcaccaaggtgaaggtggtcaagaacaaggtggctccccccttcaaagaggtggagttcgacatttactacggtgagggcatttcccgcgagggcgacatcctcgacctggccgtggagaaggggatcgtggacaagagcggcgcctggttctcctacggcggagaccggattggccaggggcgcgaaaattcccgccttttcctcaaggagcggccagaactggtgaacgagatcgaagggaaggtttacgacgtggccggcattccccgcaaaggggcgaaggaagcggcatag

SEQ ID NO: 3045 - protein, 338 aa, Geobacter sulfurreducens
MTQEREKAIELALSQIEKQFGKGAIMRLGADEALPDVAAIPTGSLSLDLALGVGGVPRGRIIEIYGPESSGKTTLALHIAAEAQKMGGIAAFVDAEHALDIGYARKLGVKTDDLLVSQPDTGEQALEIAEMLVRSGAVDVLVIDSVAALVPKAEIEGEMGDSHMGLQARLMSQALRKLTGIISKSNCCVIFINQIRMKIGVMFGNPETTTGGNALKFYASVRLDIRKIASLKQGQDVIGSRTKVKVVKNKVAPPFKEVEFDIYYGEGISREGDILDLAVEKGIVDKSGAWFSYGGDRIGQGRENSRLFLKERPELVNEIEGKVYDVAGIPRKGAKEAA

SEQ ID NO: 3046 - DNA, 1230 bp, Mycobacterium paratuberculosis
  CDS (1)..(1230)
atgtcggccggcctttcgcggctgctgcgacgcccgcggcgtgtcgaacttgaatcgaacacctgttcggctactgtgggggacgttcgcagcgtcaacttgtcggtggccttctctagtgtcaccgccaaccgaccgataccggtcagaagacacaccgactataggagaggcaccatgacgcaagcccccgaccgcgagaaggctctcgaactggcgatggcccagatcgaaaagagctacgggaaaggctcggtgatgcgtctcggcgacgagatgcgtcaaccgatctcggtcatcccgaccggatccatcgccctggacgtcgccctgggcatcggcggcctgccccgcggccgggtcgtggagatctacggcccggaatcctcgggtaagaccaccgtcgccctgcacgcggtggccaacgcccaggccgccggcggtgtcgcggcgttcatcgacgccgagcacgcgctggaccccgagtacgccaagaagctcggcgtggacaccgattcgctgctggtcagccagccggacacgggggagcaggcgctcgagatcgccgacatgctgatccgctccggcgcgctggacatcctggtcatcgactcggtggccgcgctggtgccgcgcgccgagctggagggcgagatgggggacagccacgtcgggctgcaggcccggctgatgagccaggcgctgcggaaaatgactggcgcgctgaacaattcgggcaccaccgcgatcttcatcaaccagctgcgggagaagatcggggtgatgttcggcagcccggagaccacgacgggtggcaaggcgttgaagttctacgcctcggtgcgcatggacgtgcgccggatcgagacgctcaaggacggcaccaacgcggtcggcaaccgcacccgggtcaagatcgtcaagaacaaggtgtcgccgccgttcaagcaggccgagttcgacatcctctacggccgcgggatcagccgggagggctcgctgatcgacatgggtgtggatcagggcttcatccgcaagtccggttcctggttcacctatgagggcgagcagctcggccagggcaaggagaacgcccgcaccttcttgatggagaacgacgaggtcgccaacgagatcgagaagaagatcaaggaaaagctcggcattggcgcggtcgtgaccgatgacttgtccgatgacggcgtcctgcccgcccccgtcgacttctga

SEQ ID NO: 3047 - protein, 409 aa, Mycobacterium paratuberculosis
MSAGLSRLLRRPRRVELESNTCSATVGDVRSVNLSVAFSSVTANRPIPVRRHTDYRRGTMTQAPDREKALELAMAQIEKSYGKGSVMRLGDEMRQPISVIPTGSIALDVALGIGGLPRGRVVEIYGPESSGKTTVALHAVANAQAAGGVAAFIDAEHALDPEYAKKLGVDTDSLLVSQPDTGEQALEIADMLIRSGALDILVIDSVAALVPRAELEGEMGDSHVGLQARLMSQALRKMTGALNNSGTTAIFINQLREKIGVMFGSPETTTGGKALKFYASVRMDVRRIETLKDGTNAVGNRTRVKIVKNKVSPPFKQAEFDILYGRGISREGSLIDMGVDQGFIRKSGSWFTYEGEQLGQGKENARTFLMENDEVANEIEKKIKEKLGIGAVVTDDLSDDGVLPAPVDF

SEQ ID NO: 3048 - DNA, 1083 bp, Lactobacillus johnsonii
  CDS (1)..(1083)
atggctaaagatgataaaaagaaggctttagacattgccttaaagaagattgaaaaagactttggaaaaggcgcagtgatgcgcatgggtgaaaaagtagacactcaaatttccactattccttccggttcactagctttagatgcagctcttggagttggtggctatcctcgtggacgaattattgaagtatatggaccagaaagttctggtaaaacaactgtggctcttcatgctgttgcagaagttcagaagcgtggaggaacggcagcttatatcgatgcggaaaatgcgatggatcctgcttatgccgaagcattaggtgttgatattgattccttaattttatctcaaccaaacactggtgaagaaggtctgcaaattgcagatacgcttattgcgagtggtgcaattgatatcttagttgtggattccgtggctgcgttagtaccaagagccgaaattgacggtgacatgggagattcacatgttggtttacaagccagattaatgagtcaggctttacgtaaactctcaggaaatatctctaaaactaaaactattgctgttttcattaaccaaattcgtgaaaaagttggggttatgtttggaaatccagaaactactcctggtggacgtgctttgaagttttactctacgattagattagaagtacgtagagcagaacaaattaaacaaggatcagacgtaattggtaaccgagttaaattaaaggttgtaaaaaataaagttgctcctccatttaaagtggcagaagtcgatatcatgtatgggaaaggaatttctcaaactggtgagttaattgatatggctgctgataaagatatcattaagaaagctggctcgtggtattcatatggggatgatcgcattggacaaggccgcgagaatgctaagcaatatctagaagagcatcctgatgtttacgaagaagtaaaagaaaaagttcgtgaagcttatggaattgatgctaaagcaattgaagaacgagaaaatcctgaaaaggtaaaacaggacaaggaagtaccagtaaacaaagatgcttccgatgaaaaaaaataa

SEQ ID NO: 3049 - protein, 360 aa, Lactobacillus johnsonii
MAKDDKKKALDIALKKIEKDFGKGAVMRMGEKVDTQISTIPSGSLALDAALGVGGYPRGRIIEVYGPESSGKTTVALHAVAEVQKRGGTAAYIDAENAMDPAYAEALGVDIDSLILSQPNTGEEGLQIADTLIASGAIDILVVDSVAALVPRAEIDGDMGDSHVGLQARLMSQALRKLSGNISKTKTIAVFINQIREKVGVMFGNPETTPGGRALKFYSTIRLEVRRAEQIKQGSDVIGNRVKLKVVKNKVAPPFKVAEVDIMYGKGISQTGELIDMAADKDIIKKAGSWYSYGDDRIGQGRENAKQYLEEHPDVYEEVKEKVREAYGIDAKAIEERENPEKVKQDKEVPVNKDASDEKK

SEQ ID NO: 3050 - DNA, 1245 bp, Treponema denticola
  CDS (1)..(1245)
atggcaaaagcaaaaaacgaagtaccggcagttgcaaacccggatgataagttaaaggctctggaggctgcccgccttcaaatcgaaaaacaattcgggcaaggctctttgatgaagttagggaataattccgctatcggaaacatagaaattattccttcgggaagcatccttttggatgaagctctgggaatcggcggttatccccgcggcagaattatcgagatattcggccccgaatcttcgggtaagactacgatagctcttcatgccgtcgccgaggcacaaaagcagggaggcatagccgcctttatcgatgccgaacatgccttggatccccaatatgcaaaagccttgggagtaaatattgatgagctttgggtttcccaacccgataccggagaacaggcccttgaaatagcagaaagccttgtacgctccggagccgtggacgtaatagtaattgactcggtcgcagccctaacgcctcaggcagaaattgccggagaaatgggagactctcatatgggcttacaggcccgcttgatgagccaagccttgagaaaacttaccgccattataggcaagtccaactgtatgataatatttatcaaccaaatccgaatgaagataggcgttatgttcggaagtcctgaaacaactacgggaggaaatgcccttaaattttacgcctccgtccggctggatgtacggaaaattgaaactctcggcaaggacgatgatgaagcatggggaaataagattcgtgtaaaggttgtaaaaaacaaggtcgctcctccttttagaaaggtagaaatggaaatcctttttggaaagggcgtttgtccctatggaagtctcttggattctgctgtcaaacaagagataataggcaagagcgggtcgtggtattcttacggggacgacaaaatcggtcaaggcaggcccaatgccgttaaattcttagaagaaaacatagacatagctcaaaagattgaaaaagaattgagagaaaaactcttcccgggcaggccctttgtttcaagttttgtcgaaaaaacaaaagaacaaaaagaagcccaggaaaaggccgtagaagctcttaaaaaagaagagggttcaaaggaagatgctctgacaggcaataaagatgaaaccgatgattccgctcaaaaaaattcggccgcttcaaaggcaaaaagggctgaagttgtaggccttccggcggacgacagtcttttttaa

SEQ ID NO: 3051 - protein, 414 aa, Treponema denticola
MAKAKNEVPAVANPDDKLKALEAARLQIEKQFGQGSLMKLGNNSAIGNIEIIPSGSILLDEALGIGGYPRGRIIEIFGPESSGKTTIALHAVAEAQKQGGIAAFIDAEHALDPQYAKALGVNIDELWVSQPDTGEQALEIAESLVRSGAVDVIVIDSVAALTPQAEIAGEMGDSHMGLQARLMSQALRKLTAIIGKSNCMIIFINQIRMKIGVMFGSPETTTGGNALKFYASVRLDVRKIETLGKDDDEAWGNKIRVKVVKNKVAPPFRKVEMEILFGKGVCPYGSLLDSAVKQEIIGKSGSWYSYGDDKIGQGRPNAVKFLEENIDIAQKIEKELREKLFPGRPFVSSFVEKTKEQKEAQEKAVEALKKEEGSKEDALTGNKDETDDSAQKNSAASKAKRAEVVGLPADDSLF

SEQ ID NO: 3052 - DNA, 1068 bp, Wolbachia pipientis wMel
  CDS (1)..(1068)
atggcaagtaacccagaagaaagaaatagtgataaacaaaaagcgctagataacgcaataagccagattgaaaaagcattcggtaaaggtgcaataatgaagttgaagcaaaaccctgtagaaaaaatagacacaatatccacaggatcaattgcgcttgattcggctctaggtgttggaggtctgccaaaagggcgtataattgaaatatttggccccgagagttctggtaaaaccactcttgccttgcacgtgattgctgaagcacaaaaaaaaggaggatcatgcgcatttatcgatgcagaacatgcattggatgtcttatatgctcgtaaacttggggtaagcactgatgatttagtgatttcacaaccagacactggagagcaggcgttgcatattgttgagtatttagtgtgttctggtgcggttgatgtgatagttattgactctgtcgcagcattaactccaagagctgaaattgaaggtgatatgggtgatcaacatatggggctgcaagcaaggcttctaagtcatgggctacggaaactaacctctgccgtttcaaaagcgaactgtatattgatatttattaatcaaattcgtatgaaaataggagtagtgtatggaaatcctgaaactaccacgggtggaaatgcattaaaattctatacttctgtaaggcttgatataagaaaagttggtgtaataaaagacaaagaaaatattacaggtaatgaaacaagagttaaagttgtaaaaaataaagttgctcctccatttagagaagcgaaatttgatataatgtacaatgaaggtatatcaaaactcggagaaataatagatatgggagcaaagcttggtgtgcttgaaaaagcaggcgcttactattcatataacaacacacgtcttgggcaaggaagagagaatgtaaaaacttacctaaaaacaaacaaagaagtcgcaaatgaaatagaaacgaaaatcagagatttactcagaaatcatgataattctatcataatagacgaggatagtgagcaacttttagaagaatcagttttctga

SEQ ID NO: 3053 - protein, 355 aa, Wolbachia pipientis wMel
MASNPEERNSDKQKALDNAISQIEKAFGKGAIMKLKQNPVEKIDTISTGSIALDSALGVGGLPKGRIIEIFGPESSGKTTLALHVIAEAQKKGGSCAFIDAEHALDVLYARKLGVSTDDLVISQPDTGEQALHIVEYLVCSGAVDVIVIDSVAALTPRAEIEGDMGDQHMGLQARLLSHGLRKLTSAVSKANCILIFINQIRMKIGVVYGNPETTTGGNALKFYTSVRLDIRKVGVIKDKENITGNETRVKVVKNKVAPPFREAKFDIMYNEGISKLGEIIDMGAKLGVLEKAGAYYSYNNTRLGQGRENVKTYLKTNKEVANEIETKIRDLLRNHDNSIIIDEDSEQLLEESVF

SEQ ID NO: 3054 - DNA, 1074 bp, Desulfovibrio vulgaris
  CDS (1)..(1074)
atggcgaagaaaccgagcctcagccccgaagagatgcgccgcgaggcattggagaccgctcttagcaccatcgagcggaagtacggtctgggggcggtcatgaaactgtccgacgaggcgcatgtcgccatccccgtcatccccaccggttccatcggccttgacctcgcactgggcgtaggtggcgttccgcgcggtcgcgtgacggaaatctacggccctgaatcctcgggcaagaccacgctgaccttgcacatcatcgccgaagcccagaaacgcgggggtacggcggcgttcatcgacgccgaacatgcgctcgacgtggcctatgcccgccgtcttggcgtcaacaccgaagagctgctcatctcgcagcccgacttcggggaacaggctctcgacatcgccgacatgctcgtgcgttctgcggcggtcgaccttgtggtcatcgactccgtcgccgcgctcatcccgcaggccgaactcgaaggcagcatgggcgacacgcaggtgggcggtcaggcgcgcctcatgtcgcacgcactgcgcaagctcaccggcaccatccacaagtcgcgcaccgccgtcatcttcatcaaccagatacgcatgaagatcggcaccatgggctacggcagccccgagacgaccaccggcggcaacgcactcaagttctacagttccgtccgtatggacatccgcaagatacagaccctcaaggacaaggaagaggtctacggctcgcgcacccgggtcaagatcgtgaagaacaaggtcgccccgcccttccgcgaggccctgttcgacatcctctacggcaccggcatctcgcgcaccggtgaaatcatcgacctcggttccgatgcgggcatcatcgacaagagcggctcgtggttcgccttcggttcagagagactgggccagggcaaggagaacgtccgcgcccttctcgaagagaacgcccccctgcgcgaggccatcgaagccaagctcatcgaacaccttggcatgactcccaccaaattcgcctcatcaggcgaagagcccgccaacgacgaagagaacgacctctag

SEQ ID NO: 3055 - protein, 357 aa, Desulfovibrio vulgaris
MAKKPSLSPEEMRREALETALSTIERKYGLGAVMKLSDEAHVAIPVIPTGSIGLDLALGVGGVPRGRVTEIYGPESSGKTTLTLHIIAEAQKRGGTAAFIDAEHALDVAYARRLGVNTEELLISQPDFGEQALDIADMLVRSAAVDLVVIDSVAALIPQAELEGSMGDTQVGGQARLMSHALRKLTGTIHKSRTAVIFINQIRMKIGTMGYGSPETTTGGNALKFYSSVRMDIRKIQTLKDKEEVYGSRTRVKIVKNKVAPPFREALFDILYGTGISRTGEIIDLGSDAGIIDKSGSWFAFGSERLGQGKENVRALLEENAPLREAIEAKLIEHLGMTPTKFASSGEEPANDEENDL

SEQ ID NO: 3056 - DNA, 1557 bp, Bacillus licheniformis
  CDS (369)..(1415)
gatatcggcatcagcttcactggagtagccgggccgaatacgcaagaaggccatccggctggaaaggtgtttatcggcatctccgtgaaggaccaggctgaggaagcgttcgaatttcagttcgccggatccaggtctgcggtgcggaagcgttctgccaaatacggctgccatctgttgctgaaaatgatggaaaaataagcggaaaccggattttcggaatatctttctttcgaaaaaggccattccattttaggagatcgatttttcctcttaaaaaaatcgaatatgcgttcgcttttttcttggcaaatccgcataaacaaggtatagtagatatagcggaagtgataaaggaggaaaatagaatgagtgatcgtcaggcagccttagatatggcgcttaaacaaatagaaaagcagtttggtaaaggttcgattatgaaactcggcgaacaaactgaaacgagaatttcaacagttccgagcggttctttagcgctcgatgcggctcttggagtgggcggatacccgcgcggccggattattgaagtatacgggcctgaaagctccggtaaaacgacggtggcgcttcatgcgattgccgaagttcagcagcagggcggacaagcggcgttcatcgacgccgaacacgcgcttgatcccgtctatgcacaaaagctgggcgtcaacattgatgagcttttgctgtcacagcctgatacgggcgagcaggcgctcgaaatcgctgaagcccttgtcagaagcggagcggtggatatcgttgtcatcgactctgtagcagcgcttgtgccgaaagctgaaatcgaaggagatatgggggattcccacgtcggtttgcaggccagactgatgtctcaggcgcttcgcaagctttccggagcgatcaataaatcgaagaccatcgcgatctttatcaaccagattcgtgaaaaagtcggtgtcatgtttggaaatcctgagacgacgccaggcggaagagcgctgaaattctactcttctgtccgccttgaagtgcgccgcgcagagcagctgaaacaaggcaacgacgtcatggggaacaagacgaaaatcaaagtcgtgaaaaacaaagtggcacctccattccggacagccgaagtggacattatgtacggggaaggaatttcaaaagaaggggaaatcatcgacctcggaacagagcttgacatcgttcaaaagagcggtgcatggtactcttatcaggaggaacgccttggacaaggccgtgaaaacgccaaacagttcctgaaagaaaacaaggatatccttttgatgattcaagagcagatccgggagcactacggtttggatactggaggcgctgctcctgcacaggaagacgaggcccaagctcaggaagaactcgagttttaatcatgaaacgtgtgaaaggctgccggcccgatcggcagccttttactttattcttcgctttcaggcgcttctcttccatccattctcttaatgagggcagtttgaaaggcgtttaatccagaaacgttaagaccgtaagctt

SEQ ID NO: 3057 - protein, 348 aa, Bacillus licheniformis
MSDRQAALDMALKQIEKQFGKGSIMKLGEQTETRISTVPSGSLALDAALGVGGYPRGRIIEVYGPESSGKTTVALHAIAEVQQQGGQAAFIDAEHALDPVYAQKLGVNIDELLLSQPDTGEQALEIAEALVRSGAVDIVVIDSVAALVPKAEIEGDMGDSHVGLQARLMSQALRKLSGAINKSKTIAIFINQIREKVGVMFGNPETTPGGRALKFYSSVRLEVRRAEQLKQGNDVMGNKTKIKVVKNKVAPPFRTAEVDIMYGEGISKEGEIIDLGTELDIVQKSGAWYSYQEERLGQGRENAKQFLKENKDILLMIQEQIREHYGLDTGGAAPAQEDEAQAQEELEF

SEQ ID NO: 3058 - DNA, 1119 bp, Corynebacterium diphtheriae
  CDS (1)..(1119)
atggcgccaagaaaaaatagtaagacgcagcaaccaactggagataatcgcaagaaagcgctcgatgcggctcttgcgatgatcgaaaaagattttggtaaaggtgcggttatgcgtcttggtgacgagaatcgtccgccgattagtgctatctccagcggtaacactgctatcgacgtagctttaggaattggcggctttcctcgtggacgtatcgttgaggtatatggtccggagtcatcgggtaagaccaccgtcgcattacatgctatcgcgcaggctcaaaaagccggaggtattgcggcttttattgatgctgagcatgctctagatcctgattacgcacgcaaactgggtgtagatactgatgcattgcttgtttctcaacctgataccggcgaacaggctttggagatcgcagatatgcttgtgcgttctggtgctattgacatcattgtcatcgactcagttgcagcattgactccaaaggcggaaattgaaggcgaaatgggagatagccatgttggccttcaagctaggttgatgagtcaggcgctccgtaagatgactggtgcgctttataactcaggcactacggcaatctttattaaccagcttcgtgagaagatcggtgttatgttcggttcgcccgaaacaacgaccggtggtaaagccttgaaattctatgcctcagttcggtgtgatgtccgacggattcagacacttaaagatggtcaagatgccattggtaaccggactcgcttgaaagtggtcaaaaataaggtttcgccaccgtttaagatcgcagaattcgacatcatgtacggtgagggaatttcacgagaatcttcgattattgacctgggtgttgataacggaattatcaaaaaatctggttcttggttcacatatgaaggcgaccagctcggacaaggaaaagaaaaagtacgtctctatcttaaagaaacgccagaactggccgatgagattgaagacaagatcttcagagcgcttcatattggaaaatacgctgcattgaaggatgctgacgatgcgctgactgatgatccagtagacatggttcctaacgtagatttcgatgactcagatgacgattga

SEQ ID NO: 3059 - protein, 372 aa, Corynebacterium diphtheriae
MAPRKNSKTQQPTGDNRKKALDAALAMIEKDFGKGAVMRLGDENRPPISAISSGNTAIDVALGIGGFPRGRIVEVYGPESSGKTTVALHAIAQAQKAGGIAAFIDAEHALDPDYARKLGVDTDALLVSQPDTGEQALEIADMLVRSGAIDIIVIDSVAALTPKAEIEGEMGDSHVGLQARLMSQALRKMTGALYNSGTTAIFINQLREKIGVMFGSPETTTGGKALKFYASVRCDVRRIQTLKDGQDAIGNRTRLKVVKNKVSPPFKIAEFDIMYGEGISRESSIIDLGVDNGIIKKSGSWFTYEGDQLGQGKEKVRLYLKETPELADEIEDKIFRALHIGKYAALKDADDALTDDPVDMVPNVDFDDSDDD

SEQ ID NO: 3060 - DNA, 1038 bp, Mycoplasma mycoides
  CDS (1)..(1038)
atgagtacagaaatacaaaaaatagaagataataatttaaaagaatcacaaatgtgaaattcaaaagaactaaaagaagctattaaagaaattgaaaaaatgtttggtaaaggttctattatggttcttggtcaaagtgataatttaaatgtcgaaactttttcatcaggttcacttttattagataatgctttaggaattggtggttatcctaaaggaagaattattgaaatttatggtcctgaatcatctggaaaaaccactttatcactacatgctatttgtgaaattcaaaaattaggaggaattgctgcttttattgatgcagaacattcattagatccaaaatattgtcataatttaggtatagatactaacaaattattagttagtcaaccagataatggtgagcaagcattagatattttagaaatgttaattaattcaaatagtattgatttaattattgttgattcagtagctgctttagtaccaaaaactgaattagaaggtgaaatgagtgatcagtcaattggactacaagcaagaatgatgtcaaaagctttaagaaagttaaatggtttaattgcaaaatctaatacaactgtgatttttattaatcaattaagagaaaaaattggagttatttttggaaatccagaaactacaacaggtggtaaagctttaaagtttttttcatcaattagactagaagttagaaaatcagaaaatattctttcaaactcagaaattattggtaataaaattaaaataaaaattgttaaaaataaaactgctattccttttaaaactgcaaccatatcacttttatataataaaggtattgataaaattggtgaattagttgatttattagtaagttatgaaattgttgaaaaatctggtgtttgatattcttatcaaaatgaaaaaataggacaaggaaaaactagtgttattcagtgattaaatgctgatgaaaaaagaactaatgaattaatacaacaagttaaaaaaataatagaacaaaaagaataa

SEQ ID NO: 3061 - protein, 345 aa, Mycoplasma mycoides
MSTEIQKIEDNNLKESQMWNSKELKEAIKEIEKMFGKGSIMVLGQSDNLNVETFSSGSLLLDNALGIGGYPKGRIIEIYGPESSGKTTLSLHAICEIQKLGGIAAFIDAEHSLDPKYCHNLGIDTNKLLVSQPDNGEQALDILEMLINSNSIDLIIVDSVAALVPKTELEGEMSDQSIGLQARMMSKALRKLNGLIAKSNTTVIFINQLREKIGVIFGNPETTTGGKALKFFSSIRLEVRKSENILSNSEIIGNKIKIKIVKNKTAIPFKTATISLLYNKGIDKIGELVDLLVSYEIVEKSGVWYSYQNEKIGQGKTSVIQWLNADEKRTNELIQQVKKIIEQKE

SEQ ID NO: 3062 - DNA, 1134 bp, Bdellovibrio bacteriovorus
  CDS (1)..(1134)
atggcaaacgctactgtagacaacaaagcgaactcagaaaaaatcaaagctcttgaattggctgtttcgactatcgaaaagcaattcggtaaaggctccatcatgcgtttgggcgcgaacgaatctttggttaaagacgttgaagcgatcagcacgggtgcattgagcttggatatcgctttgggtatcggcggtcttcctaaaggtcgtatctgtgaaatctatggaccagagtcctctggtaaaacaactctgtgcttgtctgttatcgctcaagctcagaaaaagggcggcgttgtcgctttcgttgatgccgaacacgctttggatatcaactatgctcgtaaactgggtgtgaacacggaagatcttttgatctctcagccagacactggtgaacaagctttggaaatcactgaaacacttgttcgttccggcgcgattgacgtattggttgtcgactccgtagcagccttggttcctcgtgcagagatcgaaggtgacatgggtgattcccacgttggtttgcaggctcgtttgatgtcccaggctttgcgtaagctgactgcggcgatcaaccgttccaacactcttgttatctttattaaccaaatccgtatgaaaatcggtgttatgttcggtaaccctgaaacaactacgggtggtaacgctttgaaattctactcttctgttcgtttggatgtacgccgtgtgggcgcgatcaaaaacggtgaggacgtgactggtaaccgtactgcggtgaaagttgttaagaataaaatggcgcctccgttcaccaaagttgaattcgacttgatgtacggtgaaggtatctctgaagagggtgaccttctggatctggcagtgactgcgaacatggttgaaaaatccggtgcgtggttctctatcaatggtgagcgcatgggccaaggccgtgatgctgcgaagaacttcctgaaagagcacccagaatacatggttgaacttcgtaagaaaatccttgcagcaaacggtatcggcaaacttttggttgataccaacggcaacaacggtgaagaccacgaaggtacagagccagttgaaatcgaagcagaagatgctgctccgaaaaaaggcaaaaaaggcaaacactag

SEQ ID NO: 3063 - protein, 377 aa, Bdellovibrio bacteriovorus
MANATVDNKANSEKIKALELAVSTIEKQFGKGSIMRLGANESLVKDVEAISTGALSLDIALGIGGLPKGRICEIYGPESSGKTTLCLSVIAQAQKKGGVVAFVDAEHALDINYARKLGVNTEDLLISQPDTGEQALEITETLVRSGAIDVLVVDSVAALVPRAEIEGDMGDSHVGLQARLMSQALRKLTAAINRSNTLVIFINQIRMKIGVMFGNPETTTGGNALKFYSSVRLDVRRVGAIKNGEDVTGNRTAVKVVKNKMAPPFTKVEFDLMYGEGISEEGDLLDLAVTANMVEKSGAWFSINGERMGQGRDAAKNFLKEHPEYMVELRKKILAANGIGKLLVDTNGNNGEDHEGTEPVEIEAEDAAPKKGKKGKH

SEQ ID NO: 3064 - DNA, 1086 bp, Parachlamydia sp
  CDS (1)..(1086)
atgtctcaatcagcccctccagattctgaacgtaaaaaagcacttggcctggccgtttctcaaattaaaaaacaatttggtgaaggtgctattatgtcttttggcaagcactcttctgaaaaagaaatgagtgtgattaaaacaggtgctcttgctctggatatcgccttaggaattggcggtgttccacgtggacgcgttgtagaaatttatggacctgaatcatctggtaagtcaactttagctcttcatatcgtagctaatgctcaaaaaaatggggggttagctgcttatattgatgcggaacatgcccttgaccctagttatgctggtaaaattggtattaatatagatgatttgatgatttcacaacctgatagtggggaagaagctttaaacattgcagagatgcttgcacgttctaacgctgtagacgtgattgtcattgactctgttgccgctctcgttcctaaatctgaacttgagggagaaattggagatcaattcatgggtcttcaagctcgcatgatgtcacaagcattaagaaaattaacggcctctctctcaaaaagcaatacatgtgctatttttattaaccaaattcgagataaaatagggatcgtttatggaaatccagaaacgacaacagggggacgtgccttaaaattttactcttcggtacgattagatattcgtcgtacaggaggaattaaaggaccggacaatactgaaattggtaatcgggtaaaagtaaaagttagtaaaaataaaatggctcctccttttcaaattgctgaatttgatatcttatttaatgaaggtatttctcgtacaggttctgcgattgatatggcaacagagtataatattgttgataaaaaaggggcctggtttagctacaaagggcaacgcttaggtcaaggaagagaagcggtcagagaagagtttaaaaataatccaacgcttttagaagaaatagaagcgctaattttacaacagtataaagaaaatcgttccaagcccgcatccaaaaaaacttctatcggtgctgcaatagaagaaattgaaggggcattgaacgaataa

SEQ ID NO: 3065 - protein, 361 aa, Parachlamydia sp
MSQSAPPDSERKKALGLAVSQIKKQFGEGAIMSFGKHSSEKEMSVIKTGALALDIALGIGGVPRGRVVEIYGPESSGKSTLALHIVANAQKNGGLAAYIDAEHALDPSYAGKIGINIDDLMISQPDSGEEALNIAEMLARSNAVDVIVIDSVAALVPKSELEGEIGDQFMGLQARMMSQALRKLTASLSKSNTCAIFINQIRDKIGIVYGNPETTTGGRALKFYSSVRLDIRRTGGIKGPDNTEIGNRVKVKVSKNKMAPPFQIAEFDILFNEGISRTGSAIDMATEYNIVDKKGAWFSYKGQRLGQGREAVREEFKNNPTLLEEIEALILQQYKENRSKPASKKTSIGAAIEEIEGALNE

SEQ ID NO: 3066 - DNA, 1071 bp, Photobacterium profundum
atggagagtcgaatggacgataataagcagaaggctcttgccgcagcattaggccagattgaaaagcagtttggtaaaggctcaatcatgagattgggcgataataagacaatggatatcgaaacggtatcgacaggttctttagctctggatattgctctaggtgctggcggtttgccaatggggcgtattgtcgagatttacggtcctgaatcatcaggtaaaacaaccctaactcttgaagttattgcctccgctcagaaagccggtaagacatgtgcttttattgatgctgaacatgctcttgatcctatctatgcacagaagctgggtgtcgatattgaccaactactgtgttctcagcctgatacgggtgagcaagcgctagaaatcgtcgatgcactcgcacgttctggtgccgttgatctgattgttgtcgattctgtagcggcattgaccccgaaagccgaaattgaaggtgaaatgggcgacagccatatgggattgcaagctaggatgttgtcgcaggccatgcgaaaactgactggtaatttaaaaaatgcaaattgcatgtgtatcttcattaaccaaattcgaatgaagattggtgtaatgtttggcaatccagaaacgactactggtggtaatgcccttaaattctacgcctctgttcgtcttgatattcgccgtactggtgcaattaaagatggtgatgaagttgttggtaacgaaacacgcatcaaggttgttaaaaataaaattgccgcgccgtttaagcaagctgaaacacaaattctttatggtcaaggcttcaaccgtaacggtgagctaattgatctaggtgttaagcataagctggtagaaaaagcgggtgcttggtacagctataaaggtaataagattggtcaaggtaaggctaattcttgtaagcacctagttgaaaacccagcaatagctgaagagattgaaaaactactgcgtgacatgttgttatcaccagttggtgaagaagtagaaaaagcagatgtaaaaaaagatgcaaaaaaagatgcagctgaagcactaaaataa

SEQ ID NO: 3067 - protein, 356 aa, Photobacterium profundum
MESRMDDNKQKALAAALGQIEKQFGKGSIMRLGDNKTMDIETVSTGSLALDIALGAGGLPMGRIVEIYGPESSGKTTLTLEVIASAQKAGKTCAFIDAEHALDPIYAQKLGVDIDQLLCSQPDTGEQALEIVDALARSGAVDLIVVDSVAALTPKAEIEGEMGDSHMGLQARMLSQAMRKLTGNLKNANCMCIFINQIRMKIGVMFGNPETTTGGNALKFYASVRLDIRRTGAIKDGDEVVGNETRIKVVKNKIAAPFKQAETQILYGQGFNRNGELIDLGVKHKLVEKAGAWYSYKGNKIGQGKANSCKHLVENPAIAEEIEKLLRDMLLSPVGEEVEKADVKKDAKKDAAEALK

SEQ ID NO: 3068 - DNA, 24 bp, Primer
atggctatcgacgaaaacaaacag

SEQ ID NO: 3069 - DNA, 27 bp, Primer
ttaaaaatcttcgttagtttctgctac

SEQ ID NO: 3070 - DNA, 1320 bp, Escherichia coli K12
  CDS (1)..(1320)
atgccattaatcattattgcggcaggcgtcgcgctgcttcttatcctgatgatcggctttaaagttaacggctttattgccctcgttctggtagctgccgtcgtcggatttgccgaagggatggatgcacaggccgtcctgcactctatacaaaatggtatcggcagcacgctcggcgggctggcaatgatcctcggtttcggggccatgttaggcaagctgatttctgatacgggtgcggcacaacgtatcgccactacgctgattgctacttttggtaaaaaacgcgtgcaatgggcgctagtgatcaccggtctggttgtgggcctcgccatgttttttgaagtgggttttgtcctgctgttgccgttggtatttaccatcgtagcatcatcaggattacccctgttgtatgttggcgtaccaatggtagcagcgctctctgtaacccactgttttctgccgccacatccagggcctactgccatcgcgactatctttgaggctaatctcggaacgactttactgtatggatttatcattaccattccgacagttattgtcgcaggaccgctgttttctaaactgctaactcgctttgagaaagcaccaccggaaggcttatttaatcctcatctgtttagcgaagaggagatgccctccttctggaacagtattttcgctgccgtgatcccggtcatcctgatggctatcgccgccgtttgtgaaattacgttaccgaaaactaacaccgtgcgcctcttctttgaatttgtcggtaaccctgccgttgcgctgtttattgccattgttattgcgattttcacactgggccgacgtaatggacgcaccatcgagcaaatcatggatatcattggggattctataggcgctatcgcgatgattgtgtttattatcgctggcggcggcgcgtttaagcaggtattagtagatagcggtgtcgggcactatatttcacacttaatgaccggaactacactttcgccgttattgatgtgctggactgttgcggcgctgttgcgtatcgctctgggctctgccaccgtcgcggccattaccaccgcgggtgtggtgttgccgattatcaacgttacccatgccgatcccgctttaatggtactggcaaccggtgcgggcagcgtgatcgcgtcacacgtaaacgaccctggcttctggctatttaaagggtattttaatctgacggttggtgaaacgttgcgtacctggacggtgatggaaacccttatttctattatgggtttgctgggcgtgttagccattaacgccgtattgcactga

SEQ ID NO: 3071 - protein, 439 aa, Escherichia coli K12
MPLIIIAAGVALLLILMIGFKVNGFIALVLVAAVVGFAEGMDAQAVLHSIQNGIGSTLGGLAMILGFGAMLGKLISDTGAAQRIATTLIATFGKKRVQWALVITGLVVGLAMFFEVGFVLLLPLVFTIVASSGLPLLYVGVPMVAALSVTHCFLPPHPGPTAIATIFEANLGTTLLYGFIITIPTVIVAGPLFSKLLTRFEKAPPEGLFNPHLFSEEEMPSFWNSIFAAVIPVILMAIAAVCEITLPKTNTVRLFFEFVGNPAVALFIAIVIAIFTLGRRNGRTIEQIMDIIGDSIGAIAMIVFIIAGGGAFKQVLVDSGVGHYISHLMTGTTLSPLLMCWTVAALLRIALGSATVAAITTAGVVLPIINVTHADPALMVLATGAGSVIASHVNDPGFWLFKGYFNLTVGETLRTWTVMETLISIMGLLGVLAINAVLH

SEQ ID NO: 3072 - DNA, 1347 bp, Bacillus subtilis
  CDS (1)..(1347)
atgccgttaatcatcgttgcacttgggatcttagcattactatttctgattatgggcttaaaattaaacacatttatttccctgctggtcgtatcgttcggcgtggcactggcactcgggatgccgttcgataaagttgtcagctccatcgaagcaggaataggggggactcttggccacatcgcgctcatcttcggactcggtgcgatgctgggcaaactgatcgcggattcaggaggcgcacagcgcattgcgatgacgctcgtcaacaaattcggtgagaaaaatattcaatgggccgttgtcattgcctcattcattattgggattgcgttattttttgaagtaggactggttctattaattccgattgtctttgcgatttcaagagaattgaagatttctattttatttctcggaatcccgatggtcgcggcactatccgtcacacacggtttcctgccgccgcacccgggacctacggcgatcgccggtgagtatggcgcaaacattggagaagtgctgctgtacggctttatcgttgctgttccgacagtgctcattgcagggccgttatttacaaagttcgcgaaaaaaatcgttcctgcatcatttgcgaaaaacggcaatattgcatcactcggcacacaaaaaacatttaaccttgaagaaacacccggctttggaatcagtgtctttactgcaatgctcccgattatcatcatgtcggtcgcgaccattatcgacctgcttcaagaaacaatcgggtttgcagataacggagttttagcttttatcagattgattggaaacgcatcgactgctatgattatttcgttattggtcgcagtctatacaatgggcatcaagcgcaacattccagtcaaaaccgtgatggattcttgttcaactgccatttcacaaatcggcatgatgcttttgatcatcggaggaggcggcgccttcaaacaagtgctgatcaacggcggtgtcggcgattacgtagcagacttattcaaaggaacggcattatcgccaatcattctggcatggctcatcgcagcgatcctgcgcatttctctaggatcggcgactgttgccgcactaagcacaacaggtctggtcattccgttattgggccattctgatgttaacctggcgttagtcgtactcgcaacaggagccggaagtgtcatcgcttcacacgtcaatgacgccggcttctggatgttcaaggaatacttcggattaagcatgaaagaaacattcgccacatggacattgctggaaaccattatttccgttgctggactgggattcattttattgttaagtttagttgtatga

SEQ ID NO: 3073 - protein, 448 aa, Bacillus subtilis
MPLIIVALGILALLFLIMGLKLNTFISLLVVSFGVALALGMPFDKVVSSIEAGIGGTLGHIALIFGLGAMLGKLIADSGGAQRIAMTLVNKFGEKNIQWAVVIASFIIGIALFFEVGLVLLIPIVFAISRELKISILFLGIPMVAALSVTHGFLPPHPGPTAIAGEYGANIGEVLLYGFIVAVPTVLIAGPLFTKFAKKIVPASFAKNGNIASLGTQKTFNLEETPGFGISVFTAMLPIIIMSVATIIDLLQETIGFADNGVLAFIRLIGNASTAMIISLLVAVYTMGIKRNIPVKTVMDSCSTAISQIGMMLLIIGGGGAFKQVLINGGVGDYVADLFKGTALSPIILAWLIAAILRISLGSATVAALSTTGLVIPLLGHSDVNLALVVLATGAGSVIASHVNDAGFWMFKEYFGLSMKETFATWTLLETIISVAGLGFILLLSLVV

SEQ ID NO: 3074 - DNA, 1317 bp, Yersinia pestis
  CDS (1)..(1317)
atgccattaatcatcgtcgcagttggcgttgccatgctgctattactgatgatccgttacaaacttaacggatttatctcgctgatactggtcgcgttagcggtaggtatcatgcaagggatgccaatcgataaagttgtcggctcgatcaaagcgggtgtcggcggaacattaggtagcctggccttgattatgggcttcggggccatgctcggtaaattgctggccgattgtggcggcgctcaacgtatcgcgaccaccttgattgagaaatttggtcaaaaacatattcaatgggcggtggtactgaccggctttactgtgggttttgccctgttttatgaagtgggttttgtgctgttattgccactggtattcagcattgcggcctctgcccgcatccccttgctatatgtgggtgttcccatggcggcggcgctttctgtcactcatggttttctgccacctcacccaggcccgaccgccattgccaccattttcaacgccgatatgggcaaaacgctgctgtacggcacgttgctggcaatcccaaccgtgattttggcaggcccggtgtacgcccgctttctaaaaggaattgataagcctgttcctgaagggttgtataacccgaaaatctttaccgataaagagatgccaagctttggggtcagtgtcagtacggcgctggtaccggttattttgatggcattgcgggccgtagcagagatgattttgcctaaaggccattcgctgctcccctatgccgagttctttggtgatcctgtaattgctacgctgattgccgtgttaattgcaattttcacctttggtctaaaccggggccgctcagtggaatcggtcatggagaccctgtctgattccatcaagatcatcgcaatgatgctgttagttattggagggggcggtgctttcaagcaggttttagtcgatagcggcatagagcaatatattgctggcatgatgggcaatagcggggcatcacctattctgatggcatggtccatcgccgccttactgcgtatcgccctgggttctgcgacggtggcagcgatcaccgctgggggcattgtcgcaccgttaatcgcgaccaccggtgccagccctgagttgatggtcattgccgttggttccggtagcgtgatcttctctcacgtgaatgaccctggcttctggctattcaaggagtatttcaacctaaccattatggaaaccattaaatcgtggtcagtactggaaaccattatttcagtctgcgggttgatcggctgtttgttgctgtctctggttatttag

SEQ ID NO: 3075 - protein, 438 aa, Yersinia pestis
MPLIIVAVGVAMLLLLMIRYKLNGFISLILVALAVGIMQGMPIDKVVGSIKAGVGGTLGSLALIMGFGAMLGKLLADCGGAQRIATTLIEKFGQKHIQWAVVLTGFTVGFALFYEVGFVLLLPLVFSIAASARIPLLYVGVPMAAALSVTHGFLPPHPGPTAIATIFNADMGKTLLYGTLLAIPTVILAGPVYARFLKGIDKPVPEGLYNPKIFTDKEMPSFGVSVSTALVPVILMALRAVAEMILPKGHSLLPYAEFFGDPVIATLIAVLIAIFTFGLNRGRSVESVMETLSDSIKIIAMMLLVIGGGGAFKQVLVDSGIEQYIAGMMGNSGASPILMAWSIAALLRIALGSATVAAITAGGIVAPLIATTGASPELMVIAVGSGSVIFSHVNDPGFWLFKEYFNLTIMETIKSWSVLETIISVCGLIGCLLLSLVI

SEQ ID NO: 3076 - DNA, 1341 bp, Salmonella enterica subsp. enterica serovar Typhi
  CDS (1)..(1341)
atgagtacattaacactggttttaaccgccgtcggttccgtcttactgctgctgtttctcgtgatgaaggcgcgtatgcacgccttcgtcgcgttaatggtcgtctcaatgggcgcggggcttttttcagggatgccgcttgataaaatcgccgcgaccatggaaaaagggatgggcggcacgctgggcttcctggcgattgtggtcgcgctgggggcgatgttcggtaaaattctgcatgaaaccggcgcggtcgatcagatagccgtgaaaatgcttaaatcctttggccataaccgcgcgcactatgcgattggccttgccgggctgatttgcgcgctcccgctattctttgaagtggcgattgtgctgctgataagtgtggcgttctctatggcgcgtcataccggcacaaacctggtgaagctggtcattccgctgtttgcgggcgtggcggcagccgcggcgtttttgttgcctgggcctgcgccgatgctgctggcttcccagatgcatgctgatttcggctggatgatcctgattgggctgtgcgccgccattcctggcatgattatcgccgggccgctgtgggggaattttatcagccgttacgttgagctgcgtattcctgacgacattaccgagccgcatctgggcgaaggcaaaatgccttctttcggcttcagcctgtcgctgatcctgctgccgttggtgctggtaggactgaaaacgatcgccgcgcgctttgtgccggaaggttccaccgcttatgaatggtttgagtttatcggccaccccttcactgcgattctggtcgcttgtctggtagcgatttacggcctggcgatgcgccaggggatgccgaaagacaaagtgatggaaatctgcggccacgcgctacaaccggcgggcattattctgctggtgattggcgcaggcggggtgttcaaacaggtactggttgactccggcgtcggcccggcgctgggcgaagcgttaaccggtatgggactgccgattgccattacctgctttgtgctggcggcggcggtgcgcatcattcagggttccgcgaccgtggcgtgtttaaccgcggtcggtctggtgatgccggtcattgagcaactgaatttctccggcgcgcagatggcggcgctctctatctgtatcgccggcggttcaattgtggtttctcatgttaacgacgctggcttctggctgttcggtaaatttaccggcgcgaccgaagcgcagacgctgaagacctggacgatgatggaaactatcctcggcacggtcggcgcgattgtcgggatgattgctttccaactgctgagctga

SEQ ID NO: 3077 - protein, 446 aa, Salmonella enterica subsp. enterica serovar Typhi
MSTLTLVLTAVGSVLLLLFLVMKARMHAFVALMVVSMGAGLFSGMPLDKIAATMEKGMGGTLGFLAIVVALGAMFGKILHETGAVDQIAVKMLKSFGHNRAHYAIGLAGLICALPLFFEVAIVLLISVAFSMARHTGTNLVKLVIPLFAGVAAAAAFLLPGPAPMLLASQMHADFGWMILIGLCAAIPGMIIAGPLWGNFISRYVELRIPDDITEPHLGEGKMPSFGFSLSLILLPLVLVGLKTIAARFVPEGSTAYEWFEFIGHPFTAILVACLVAIYGLAMRQGMPKDKVMEICGHALQPAGIILLVIGAGGVFKQVLVDSGVGPALGEALTGMGLPIAITCFVLAAAVRIIQGSATVACLTAVGLVMPVIEQLNFSGAQMAALSICIAGGSIVVSHVNDAGFWLFGKFTGATEAQTLKTWTMMETILGTVGAIVGMIAFQLLS

SEQ ID NO: 3078 - DNA, 1344 bp, Yersinia pestis
  CDS (1)..(1344)
atggaatggattaatatcctgtgggtcatgttgggtattggcttaatgctagtgctcaatatccgctaccagattaactcaatggtcgcattgctgctggcagctctgctagtagggactctcgcgggcatggacctgcttaagctgctgcataccattaaggctgggtttggtggcacgctaggtgaactggcgataatcgtcgtatttggtgcggtgatcggcaaactgatggtggactctggcgctgctcatcagatagcccagacgctattgcgccgattcgggcttaaatatgttgaagccgcggtaattatcatcggcctgatctttggtctggcgatgttttatgaggttgcctttattattttggcaccactggtcattgctattgcggtcgaagccaagataccgttcctcaaactggcgatcccggcagttgctgcagcgacgacggctcactccctattcccaccacagccggggccggttgcgctggttgccgcttatggcgcagacatggggatggtttatatctatggagttctggttgctattccttcagtgatctgtgccgggcttattttgccaaagttcttgggcaatctggagcggccaattccgacgttcctgaagtctgacaacccgattgatgaaaacaatctgccgtcgttcagtacctcgattttggtaccgttaattcccgctttcatcatgatttttaccaccatagccaatatctggttggttaaagggaccacgtcgtacaccattctcaatttcattggctcatcacctattgccatgtttatcgccatgttggttgccttcgtacttttcggcaccggacgcggtcataaaatggaatgggtcatgcactcatttgaaggggcggtaaaaggcgttgccatggtcatcctgatcatcggtgcgggcggtgcgctaaagcaggtgatcattgataccgggatcggcgatacgattggcatgctgatgtctgctggtggtgtatcaccttatattatggcttggctgattacggtgctgattcgtctgacaacgggccaaggcgtggtttcggcgatgaccgccgcagggattatcggtgctgcggtaatggacccggtcactgggaccattacctcagtcgatccggcactgttggtgctggcgacagcggcaggttctaacacctttactcatatcaatgacgcctcattctggctgtttaaaggttattttgagctgtcgattaaagatacgctgaagacttggggcctgctcgaattgaccaactcggtggttggtttggcggtggtactgctgatcagcatgtttgtctag

SEQ ID NO: 3079 - protein, 447 aa, Yersinia pestis
MEWINILWVMLGIGLMLVLNIRYQINSMVALLLAALLVGTLAGMDLLKLLHTIKAGFGGTLGELAIIVVFGAVIGKLMVDSGAAHQIAQTLLRRFGLKYVEAAVIIIGLIFGLAMFYEVAFIILAPLVIAIAVEAKIPFLKLAIPAVAAATTAHSLFPPQPGPVALVAAYGADMGMVYIYGVLVAIPSVICAGLILPKFLGNLERPIPTFLKSDNPIDENNLPSFSTSILVPLIPAFIMIFTTIANIWLVKGTTSYTILNFIGSSPIAMFIAMLVAFVLFGTGRGHKMEWVMHSFEGAVKGVAMVILIIGAGGALKQVIIDTGIGDTIGMLMSAGGVSPYIMAWLITVLIRLTTGQGVVSAMTAAGIIGAAVMDPVTGTITSVDPALLVLATAAGSNTFTHINDASFWLFKGYFELSIKDTLKTWGLLELTNSVVGLAVVLLISMFV

SEQ ID NO: 3080 - DNA, 1269 bp, Salmonella enterica subsp. enterica serovar Typhi
  CDS (1)..(1269)
atgacgtcgatatccaccttgggagccattgccgcattggttgtggccatcgtattaattttaagaaaagtgtcgccagcctacggcatgatggcgggcgcgctggtcggcggtttgattggcggcgccgatcttctgcaaaccgtgtcgctgatggtgtcaggcgcgcagggcatcgttaatgccgtattgcgtattctggccgcaggcgtactggcgggcgtattaattgagtccggggcggcgaatacgattgctgagacgattgtccgcaaagtgggggaaacccgggcattattggcattagccattgccacactatgtttgaccgccgtcggcgtatttattgatgtggcggtgattaccgtcgcgccgattgcgctgtcgattgcgcgtaatgcaggcctgtcaaaaagcgctattctgctggcgatggtcggcggcggcaaagcgggtaacgtgatgtcacctaacccgaacgctattgccgcctccgatgcgtttcatgttcctcttacctctattatgctggcgggcgtggttccgggcatcgttgggcttattatcgcctatctgttagcgaaacggctgaataataaaggcgcgggcgtcgccgatcatgaagtgactcaccatgatgactctgtcgccaggcccggttttctggtggcgattagcgcgccgctggtcgctattttcctgctttctctccgtccgtttgtcggcatttccattgacccgttaattgccctgcccgtagggggattggtcggtctgctgttgatgggacgcgcgcgccactgtaaccagtacatggtcgccggtctgatgcgtatggcgcctgtcgctattatgttgctgggaaccggtacgctggccggcattatcgctaattccgaacttaaagatgtcctgattcatggcctcaccgcttcgggattgccgtcctggctgctggcgcccgtgtctggcgccatgatgtcaatggcgacggcctcaaccacagcgggaacggcggtggcgtccggcgttttctctcccacgttacttgaacttggcgtttccgccctggcgggagccgctatgatccatgcgggcgccacggtgctggaccatctgccgcatggcagctttttccacgcgacgggcggcagcgtcaatatgcaaattcatgaacgtttaaagctaatgccgtatgaaacgctggtggggttagccattacctttatttctactctgatgttcggtttctttggttttgcaggataa

SEQ ID NO: 3081 - protein, 422 aa, Salmonella enterica subsp. enterica serovar Typhi
MTSISTLGAIAALVVAIVLILRKVSPAYGMMAGALVGGLIGGADLLQTVSLMVSGAQGIVNAVLRILAAGVLAGVLIESGAANTIAETIVRKVGETRALLALAIATLCLTAVGVFIDVAVITVAPIALSIARNAGLSKSAILLAMVGGGKAGNVMSPNPNAIAASDAFHVPLTSIMLAGVVPGIVGLIIAYLLAKRLNNKGAGVADHEVTHHDDSVARPGFLVAISAPLVAIFLLSLRPFVGISIDPLIALPVGGLVGLLLMGRARHCNQYMVAGLMRMAPVAIMLLGTGTLAGIIANSELKDVLIHGLTASGLPSWLLAPVSGAMMSMATASTTAGTAVASGVFSPTLLELGVSALAGAAMIHAGATVLDHLPHGSFFHATGGSVNMQIHERLKLMPYETLVGLAITFISTLMFGFFGFAG

SEQ ID NO: 3082 - DNA, 1350 bp, Escherichia coli
  CDS (1)..(1350)
atgccactaattatcgttgtggcagggattgctttactcctgcttttaaccataaaaattaagcttaatacgtttgtttcgttaattattgtctcgattgctgtcgccatcgccagtggtatggatttgagtaaagtcgtcacctcagtcgaatccggacttggcggtacgctgggccatattggtttgatatttggcttcggtgttatgctcggtcgcttgctggccgatgcgggtggtgcgcagcgaatagcgctgaccatgctgaattatttcgggaaaaataaacttgactgggcagtggtctgttcggcgtttattgtcggtatcgcactttttttcgaagtcggtttaattcttctggtacctattttattcgctattgcccgtgaagcaaaaatatcaccgatgtttatgtgtgtgccgatgctttctggtttgctggtcgcacacggttttttgccgccgcaccccggcccgactgttatcgccagggaatatggcgctgatgtaggattggtactgatatacggtatcattgtcggcattccaacctttattctttgcggcccggtattgaataaattctgccagcgcattattccggacgcctttaaaaaagaggggaatatagcctctctcggcgcgacccgccgattcagcgaaagcgaaatgccaggctttgggatcagttttctcacggcaatgctgccggtgatcctgatggcggttgtcaccatcatccagatgactcatgccaaaagtgccgcggattcaggcttattttacaacgtgatactgttcttaggtaattcaacgatcgccatgctgatttcactgctattcgcgatctataccatgggcctggggcgcgggaaaacaatccctgacctgatggattcttgcggaaaagctatcgcgggtattgccggtctgctgctgattatcggtggtggtggtgcattcaagcaagttctcatcgactctggcgttggtcagtatatttccaccctggtttcgggtatggatattaacccgatcctgatggcctggggcgtggccgcattcctgcgtatttgtctgggttcagccaccgtcgcggcgatctctaccgccggtctggtcatcccattgttggcagtacatcccaataccaacctggccttgattacgctggctaccggtgccggatcctgtatttgttctcacgttaacgatgccagtttctggatgattaaagacttttttggcctgaccaccaaagaaacgctgttatcctggacgctgatgtccacactcttatccatcagtgggctgatttttattctgctcgccagcttagttttataa

SEQ ID NO: 3083 - protein, 449 aa, Escherichia coli
MPLIIVVAGIALLLLLTIKIKLNTFVSLIIVSIAVAIASGMDLSKVVTSVESGLGGTLGHIGLIFGFGVMLGRLLADAGGAQRIALTMLNYFGKNKLDWAVVCSAFIVGIALFFEVGLILLVPILFAIAREAKISPMFMCVPMLSGLLVAHGFLPPHPGPTVIAREYGADVGLVLIYGIIVGIPTFILCGPVLNKFCQRIIPDAFKKEGNIASLGATRRFSESEMPGFGISFLTAMLPVILMAVVTIIQMTHAKSAADSGLFYNVILFLGNSTIAMLISLLFAIYTMGLGRGKTIPDLMDSCGKAIAGIAGLLLIIGGGGAFKQVLIDSGVGQYISTLVSGMDINPILMAWGVAAFLRICLGSATVAAISTAGLVIPLLAVHPNTNLALITLATGAGSCICSHVNDASFWMIKDFFGLTTKETLLSWTLMSTLLSISGLIFILLASLVL

SEQ ID NO: 3084 - DNA, 1359 bp, Staphylococcus aureus
  CDS (1)..(1359)
atgtttaacgaaatatggccgttaatcagtgttgttttaggtatcgttattttattagtattaattattgggtttaaattaaatacatttatttcattaattatcacatcgatgattacagcgttaatgctaggtataccattgactaaaattatggagacgattgagaaaggaatgggcagtacgctcggccacattgcactgatattcggtttaggtgccatacttgggaaattgcttgctgatggtggtggtgcaactcgaatcgcagacacgttgattcaaaaatttggtcaaaaacatgtacaatgggcaatgcttgttgcagcatttatcgtcggtattgcattgttctttgaagtaggtttagtcttactgattccattagtatttacagtagcaaaacgcgcaaatgtttcagtgttaaaactaggactacctatggtaacagctttatcagtgacacatggctttttaccaccacatccaggaccggtagtcatcgcaaaagaattaaaggcaaatgttggagatgtattactgtatggtatgattattgccattccagttacactcattgcagggcctatatttaacaaagttgcacaaaaaatgattccgtctgcgtatacacgagaaggcgatatttcagcgttaggtgcacaaaaagaatttacggatcaagagatgccaggatttggtatgagtttattaacagcaacattaccagtcatattaatgttagtgtctacgataacgcaacttgtaactgggcatgacaaacctacaaatctatttgaatctatcatttatatgataggaacagcagggacagccatgctaatagcagtattatttgcaatcgttacgatgggattaatgagaaagcgtaagatgaatcatattatggaatcagtgacgaatgcgatttatccaatcggaatgatgttattgattattggcggtggcggtacatttaaacaagtattaattgacggcggtgtcggaaatacaattgctaaaatgtttgaaggtacagagatgtctccgattttactagcatggattgttgcagctgtgctacgtatcgcattaggttcggctacagtagctgcgatttcaactacaggtattgtcttaccattattacaatcatcagatgtaaatgttgcattagttgtacttgcgataggtgcaggtagtgtgattttgtctcatgtaaatgacgcaggattttggatgtttaaagaatattttggtttaactgtaaaagaaacattcttaacatggtcattattagaaacgattatttccgtttcaggtatcatcttcattttattcattagcttatttgtttag

SEQ ID NO: 3085 - protein, 452 aa, Staphylococcus aureus
MFNEIWPLISVVLGIVILLVLIIGFKLNTFISLIITSMITALMLGIPLTKIMETIEKGMGSTLGHIALIFGLGAILGKLLADGGGATRIADTLIQKFGQKHVQWAMLVAAFIVGIALFFEVGLVLLIPLVFTVAKRANVSVLKLGLPMVTALSVTHGFLPPHPGPVVIAKELKANVGDVLLYGMIIAIPVTLIAGPIFNKVAQKMIPSAYTREGDISALGAQKEFTDQEMPGFGMSLLTATLPVILMLVSTITQLVTGHDKPTNLFESIIYMIGTAGTAMLIAVLFAIVTMGLMRKRKMNHIMESVTNAIYPIGMMLLIIGGGGTFKQVLIDGGVGNTIAKMFEGTEMSPILLAWIVAAVLRIALGSATVAAISTTGIVLPLLQSSDVNVALVVLAIGAGSVILSHVNDAGFWMFKEYFGLTVKETFLTWSLLETIISVSGIIFILFISLFV

SEQ ID NO: 3086 - DNA, 1467 bp, Haemophilus influenzae
  CDS (1)..(1467)
atgtttggcttaccgattccaattattggattattaatcgctgtatttgttctcgtttttctcgtattaagaacgcgagttcatgctttcatcgcaatgctaattgcagcttcaattgcaggtttagtaggtggtatgtcagctgatgaaaccttaaattccatcacaaaaggatttggtggcacactaggtagtattgggattgttatcggacttggtgtaatgatgggtagcgtcttagaagtttctggtgcggcagaaaaaatggcatatagttttatcaaaatgctaggtcagaaaaaagaagaatgggcattagctattacaggttacgtagtgagtattccaattttcgtagattctgcatttgttatcctttatccagtagcaaaagctctcgcaaaaaatggtaaacgctcattattaactctaggcgttgctttggctggtggcttggctgtgacacaccacaccgttccaccaacaccaggtccattgggagtagctgggttatttggtgtagatattggtgcaatgttactcactggaatgtgtatggctttcttgcctgttgtaggaatagttctgtatgctaaatggttagataaaaaataccctaactttaatcaagaagtgttcacggaagaagaattaaaacaaaaatatgatagttatattgaaagtcgtgagaaaaaagaacttcctagtttagggctttctttactaccaattgtattaccgatagtattaatctttattaaagcagttgtacatttattcgttaaagatgtacctgaagcattgacaagtataccttatcaaatcgtttcattccttggtcaccctgttattgttttagcattaagcgtattaatttctgtttacacattattaccaaaagccgataaaaatacgactgcacttcatcttgaagaaggtgttaaaacagctggtattatcttattagtaacaggtgcgggtggtgcattaggtgcggtattacgcgatagtggtgctggaaaacaattagcagaacagatcgcaaacttacctatttcaccaattttaattccatttatcgtatcgaccttagtgcgttttattcaaggttcaggtacggttgcaatgattacagctgcttcaatttcatccccaatccttgcacaaatacctggtgtcaatatgctattagccgctcaagctgctaccatgggatcgcttttctttggctatttcaatgatagtttattctgggtggttaaccgtatgatgggaattaatgatgtgaaaaaacaaatggtcgtttggtctgtaccaaccacgattgcttgggggattggtggtatttcagtaattctggctaacttgatttttggcaacgatggctctgtatttgatctgcttttccctgttgtcgtgttagccagcattttattctatatcaaacttcagaataaaaatctttaa

SEQ ID NO: 3087 - protein, 488 aa, Haemophilus influenzae
MFGLPIPIIGLLIAVFVLVFLVLRTRVHAFIAMLIAASIAGLVGGMSADETLNSITKGFGGTLGSIGIVIGLGVMMGSVLEVSGAAEKMAYSFIKMLGQKKEEWALAITGYVVSIPIFVDSAFVILYPVAKALAKNGKRSLLTLGVALAGGLAVTHHTVPPTPGPLGVAGLFGVDIGAMLLTGMCMAFLPVVGIVLYAKWLDKKYPNFNQEVFTEEELKQKYDSYIESREKKELPSLGLSLLPIVLPIVLIFIKAVVHLFVKDVPEALTSIPYQIVSFLGHPVIVLALSVLISVYTLLPKADKNTTALHLEEGVKTAGIILLVTGAGGALGAVLRDSGAGKQLAEQIANLPISPILIPFIVSTLVRFIQGSGTVAMITAASISSPILAQIPGVNMLLAAQAATMGSLFFGYFNDSLFWVVNRMMGINDVKKQMVVWSVPTTIAWGIGGISVILANLIFGNDGSVFDLLFPVVVLASILFYIKLQNKNL

SEQ ID NO: 3088 - DNA, 1377 bp, Vibrio cholerae
  CDS (1)..(1377)
atggaccccttactacaaacctctgatcctacgtatctattaaccgtggcggcggtcgccattattgcgctactgctgctgattattcgttttaaaatccacgcttttgcttcactgaccttagtcagtttaggcaccgccattgccactggcgtggcgtctgacaaagtggtgtcgaccatgatgacaggctttggtggcacgctggcttcggtcgcgctgctggtcggccttggcgctatgattggtaaaatattggaagtgacgggcggtgcgaaagtgctggcagacacgctgatcggccgctttggcgagcagcgcgcaccgtttgcactcggcgtggcatcgctgctgtttggcttccccatcttctttgatgcgggcctgattgtgatgatgccgatcatcttcagcgtcgcgaaacgctttggtggctcaccccttaaatacgcgctgccatcagcaggtgcgtttgcggtcatgcacgcctttgtgccaccgcatccggggccggttgccgcggcagaactgctcggcgcaaacatcggcttgctgctgattgttggtttgcttgtggccatcccgacttggtacttgggcgcttacctatttggtctgtatgccggtaagaaattcgatattcctttgtcgaaagccttcttcaataccgatgcgatcattgacgaagctaaactgcccaaatttgctacggtcatgaccattctggtactgccagtgctgctgatttttatggataccggtttgaacacccttgcggtcgcgggcatgattgatggtaaagctcccgcagtcgaattcctgcgtatgctgggtaaaacaccgattgctctgctgatcactctgctcgtctgtatcgcagcgttcgccaaagattacggcatggcacgcctagaaaaactgtgtggtgattcgcttgcccccatctgcgcggtgattttagtcaccggtgcgggcggcatgttcggtggcgtactgcgcgcgagcggcattggtagcgcactggctggcgtgctgtcggataccggtatgcccgttgtggtcgccgcatttgtgattgcgacctgtttacgcgtcgcgcaaggttcggctacggtcgctctgaccacgacggccgccctgattgcaccgacggtggcggcgaccacaggcctgtctgatcttgacctgtgctttatcgtgatttcgattgccggcggtgctactgtgctttcacactttaacgattctggtttctggctggtgtcgcgtttgatggagatggatgagaaaaccactctaaaaacgtggactgtgatggaaacccttttgggcggtatcgccttcctgattgtggcaacactcagctttattctgtag

SEQ ID NO: 3089 - protein, 458 aa, Vibrio cholerae
MDPLLQTSDPTYLLTVAAVAIIALLLLIIRFKIHAFASLTLVSLGTAIATGVASDKVVSTMMTGFGGTLASVALLVGLGAMIGKILEVTGGAKVLADTLIGRFGEQRAPFALGVASLLFGFPIFFDAGLIVMMPIIFSVAKRFGGSPLKYALPSAGAFAVMHAFVPPHPGPVAAAELLGANIGLLLIVGLLVAIPTWYLGAYLFGLYAGKKFDIPLSKAFFNTDAIIDEAKLPKFATVMTILVLPVLLIFMDTGLNTLAVAGMIDGKAPAVEFLRMLGKTPIALLITLLVCIAAFAKDYGMARLEKLCGDSLAPICAVILVTGAGGMFGGVLRASGIGSALAGVLSDTGMPVVVAAFVIATCLRVAQGSATVALTTTAALIAPTVAATTGLSDLDLCFIVISIAGGATVLSHFNDSGFWLVSRLMEMDEKTTLKTWTVMETLLGGIAFLIVATLSFIL

SEQ ID NO: 3090 - DNA, 1353 bp, Pseudomonas aeruginosa
  CDS (1)..(1353)
atgttcggcatgtcacacgatgcctacctgctcctcgacgccctggtgaccatcatcggcctgatcgtgctgatcacccgcttcaaggtgcatcccttcatcgccctgatcatcgccgccggcttcctcggcctgacctcggggatgccggtggagaagatcgtcaaatccttccaggacggcttcggcggcgtgctcggcttcgtcggcgtgatcctcgccctgggcaccatgctcggcaagctgatggccgattccggcggcgccgaccagatcgcccgcaccctgatccgcgccttcggcaaggagcgggtgcactggtcgatgatgctcgccgcgttcctggtgggcatcccgctgttcttcgagatcggcttcatcctgctgatcccgctggtgttcatcgtcgcccggcgcagcggcgtgtccctgatcaagatcggcatcccgttgctcgccggcctttccgcggtgcacggtctggtgccgccgcatcccggcccgctgctggcgatcggcgtgttcggcgccgacatcggcaagaccatcctctacggcctgatcgtcgccctgcccaccgccgccatcgccggcccgctgttcggcgcgctggtctcgcgctacatacccggcacgccatcggcggaactggtcgagcagatcgcccacgagcccgagacccaggacctgcccagcttcggcgtgaccctggcgaccgtgctgctgccggtgttcctgatgctgctgaagaccttcgccgacgtcgccttccccgatggccacgcgttccgcgcctggatggacatgatcggccatccgatcagcgccctgctcctggccctgctggtggcgctctataccttcggctacgcccgtggcttcgactcgaagaagatcctcaggctgctcgaccagagcctggcaccgaccgccgccatcgtgatgatcatcggcgccggcggcggcttcaagcagatgctggtggccagcggggtcggcgacgtcatcggccatctcgcggtgaacgcgcagatctcgccgatcctgctggcctggctggtggccgcggtgatccgcatcgccaccggctcggccaccgtcgccaccatcaccggggccggcatcgtggtgccggtgatcgacctgattcccggcgtcaaccgcgagttgctggtgctcgccaccggcgccggctcgctgatcctctcccatgtcaacgacgccgggttctggctggtcaagcagtacttcaacatgagcgtcagcgagaccttcaagacctggaccgcgatggagaccatcctctccgtggtcggcctggtcttcatcctgttgctgtcgctggtgctctga

SEQ ID NO: 3091 - protein, 450 aa, Pseudomonas aeruginosa
MFGMSHDAYLLLDALVTIIGLIVLITRFKVHPFIALIIAAGFLGLTSGMPVEKIVKSFQDGFGGVLGFVGVILALGTMLGKLMADSGGADQIARTLIRAFGKERVHWSMMLAAFLVGIPLFFEIGFILLIPLVFIVARRSGVSLIKIGIPLLAGLSAVHGLVPPHPGPLLAIGVFGADIGKTILYGLIVALPTAAIAGPLFGALVSRYIPGTPSAELVEQIAHEPETQDLPSFGVTLATVLLPVFLMLLKTFADVAFPDGHAFRAWMDMIGHPISALLLALLVALYTFGYARGFDSKKILRLLDQSLAPTAAIVMIIGAGGGFKQMLVASGVGDVIGHLAVNAQISPILLAWLVAAVIRIATGSATVATITGAGIVVPVIDLIPGVNRELLVLATGAGSLILSHVNDAGFWLVKQYFNMSVSETFKTWTAMETILSVVGLVFILLLSLVL

SEQ ID NO: 3092 - DNA, 1371 bp, Bacillus halodurans
  CDS (1)..(1371)
atggaagtttcaggagctcaaatgattttaggtcttgtcattgccattatggttttaatttttctagtcatcaaaacgaaagtgcatgtctttttagccctgatcatcgcggcttcaataaccggtctagtcggagggatggcaccgcctgatgttgtaagcgccatcacagaaggatttggaagcacgctcgggtctgtggcgatcattatcggtttcggtgtaatgatgggacgaatattagaagtatctggagcggccgaacgactagcttatacggtcgtcaaagtgttaggaaagcgcaaagaggagtgggcgatggctgttacgggctatatcgtatcgattcctatatttgtagattctgcctttattatattaagtacattagcgaaagcgctatcaaagaaaacagggaagtccattgttacgctcgccattgcccttgctggtggagcggtcgttatgcaccatgctgtaccaccgacacctgggccgctaggggttgcaggaatttttggtgtggacgttggcttaatgatcttatcggggttgatctttgggattccgattatcattgttaccgttttatatgcaaaatggatcgggaaaaaaatctatcagcttcccgatgatgacggcttaggatggattagaccagagcaagaggtgaacgtcgaggattggcttgaagagaaagaaaacaaagagctaccatcgttgcttcgctccgctgcaccgatcgtcgtaccgattctcttaattttcatgaatacgacggtaacggccatcggattagaaggaacgctcgtagagtacgttcaatttttcggttcccccgtgatcgctgttgggattgcagtcctccttgccatctatggattattcaaccacgtgaagcgctcggaagctcttgatcgaatggaggaagggattcagacagctgggataatcttgttagttacaggagcaggtggagcccttggttatgtgctacgccaaacaggagctggagattatatagccgaacttgtagttgatacaggaattcctgcgattttgcttccgtttgtgatcgcttcgctcgtccgcttgattcaaggaagcgggacggttgccatgataacggctgcgtcaatttctgcgccaatcttaacagggatggatgtgaaccttgtcctagccgcgcaagcagcggccctcggagcgatggtgttttcctacttcaatgatagtctgttttgggtcgtgaaccgcacgattgggattaaagacccgaaagagcaaatgctcgtttggtctgtcccaacaacgctcagctggttaacggcactcgtttgcttacttatcgccaatctcattttcggataa

SEQ ID NO: 3093 - protein, 456 aa, Bacillus halodurans
MEVSGAQMILGLVIAIMVLIFLVIKTKVHVFLALIIAASITGLVGGMAPPDVVSAITEGFGSTLGSVAIIIGFGVMMGRILEVSGAAERLAYTVVKVLGKRKEEWAMAVTGYIVSIPIFVDSAFIILSTLAKALSKKTGKSIVTLAIALAGGAVVMHHAVPPTPGPLGVAGIFGVDVGLMILSGLIFGIPIIIVTVLYAKWIGKKIYQLPDDDGLGWIRPEQEVNVEDWLEEKENKELPSLLRSAAPIVVPILLIFMNTTVTAIGLEGTLVEYVQFFGSPVIAVGIAVLLAIYGLFNHVKRSEALDRMEEGIQTAGIILLVTGAGGALGYVLRQTGAGDYIAELVVDTGIPAILLPFVIASLVRLIQGSGTVAMITAASISAPILTGMDVNLVLAAQAAALGAMVFSYFNDSLFWVVNRTIGIKDPKEQMLVWSVPTTLSWLTALVCLLIANLIFG

SEQ ID NO: 3094 - DNA, 1317 bp, Clostridium acetobutylicum
  CDS (1)..(1317)
atgccattattaattgttgttattggcgtcgcattactattactacttatgattaaattcaaagtaaacggattcatatccctaattcttgtagctttggttgttggtatcgccgaaggtatgaatcctgcaaaagctgtttcttcaattcaaaacggtgttggaagcaccttaagcagtttggcactaattttaggttttggtgctatgtttggaaaattaatagctgattctggtgctgctcaaaggatttctagaagtttaattaataaatttggtgtaaaaaaaattcaatgggctgttgtattaacgggtttcatagttggcattgctatgttctatgaggtaggttttgttctacttatacctcttgtttttactattgctgaattcacagaacttcctcttttatacataggcgttcctatggctgcagctttatctgtcactcacggatttttacctcctcaccctggacctgttgcaatagctacaatatatggtgcaagcattagcatgactcttgtatatggaattgtaatagctatacctacagtaatagttgcaggacctgttttgactaagtttttaaaacgttttgatcataaatcttcaaaaaacctttttaaaactaaggtctttgatgaagatgaaatgccaagtttctcattaagcgtattaactgctattgttcctcctattcttatggccttttcagctgtttgtgaaatcacactaccaaaaacatctcctataagacattttgcagaattcgttggaagtcctatgatggcaatgtttatatcaatcattgtagctatctttactcttggtataatgcgcggaaagaaaatggaagaaataatgagaactttagctgaagccgcaagttccattgcaatgatccttttaatagtagctggaggtggtgccttcaagcaagtactaatagacagtggtgttggaaaatatatcgcttctattatggttggaagtaatatatctcctctaatcttggcttgggcgattgcagcaattttaagattatctcttggttctgccactgtttctgctatgactactgccggtatagtacttcctcttattccttcaacccatgcaaacccagcattaatggttttagcaactggcgcaggtagtcttattttctctcatgtaaacgatccaggtttctggatgttcaaagaatattttggacttagcataggagaaacaatggcttcatggtctactttagaaactataatttcaattatggggttaattggtgttttagctttaaatatggttggatag

SEQ ID NO: 3095 - protein, 438 aa, Clostridium acetobutylicum
MPLLIVVIGVALLLLLMIKFKVNGFISLILVALVVGIAEGMNPAKAVSSIQNGVGSTLSSLALILGFGAMFGKLIADSGAAQRISRSLINKFGVKKIQWAVVLTGFIVGIAMFYEVGFVLLIPLVFTIAEFTELPLLYIGVPMAAALSVTHGFLPPHPGPVAIATIYGASISMTLVYGIVIAIPTVIVAGPVLTKFLKRFDHKSSKNLFKTKVFDEDEMPSFSLSVLTAIVPPILMAFSAVCEITLPKTSPIRHFAEFVGSPMMAMFISIIVAIFTLGIMRGKKMEEIMRTLAEAASSIAMILLIVAGGGAFKQVLIDSGVGKYIASIMVGSNISPLILAWAIAAILRLSLGSATVSAMTTAGIVLPLIPSTHANPALMVLATGAGSLIFSHVNDPGFWMFKEYFGLSIGETMASWSTLETIISIMGLIGVLALNMVG

SEQ ID NO: 3096 - DNA, 1353 bp, Vibrio cholerae
  CDS (1)..(1353)
atgagtctgatcttaatcctgttagcggtaattgtctttattgtgctcgctaccaccaagttcaaagtacaccctttcttagcattacttctggctgcattccttggcgcatttgcttatggtttgcctgctgacacgattgccaaaaccattaccacaggctttggtggtatcctcggttacatcggcttggtgattgtactgggtaccatcattggcgtgatcttagaaaaaagcggcgcagccattactatggcggatactgtcatcaagctattgggtgagcgttttccaacgttgaccatgagtatcatcggttacattgtttcgattccagtattctgcgactcaggctttgtgatcctcaattcattaaaagaatcgctggccaaacgtttagccacctccagtgtggccatgagtgtggcgcttgctacgggtctctatgctacgcatacctttgttccaccgactccgggaccgattgcggcggcgggtaacttgggcttggaatcccaactaggtttagttattgccattggcctgtttgtcgcggcggttgcggcgattgctggtatgttgtgggcgaaccgtttccaagcggttgaggctgatatcattgattcgcaagaaagcccaaaaaaagattggcaagcccttaaggcttcttacggccagttaccttctgccagtcaagcgtttgctcccatctttgtgcccattttgctgatctgttttggttctatcgcgaaattcccgagtttcccttttggtcaaggtatgctgtttgaggtgttgggcttccttggtcagccattgacggcactgctgatcggtttgcttcttgccgtacgcttattgaaatctgccgacaaagtggctgagtttggcgagcgtatcagtcaaggtattaccgctgccgcaccaattctactgattacgggggctggcggtgcatttggtgcagttttgaaagccacaccactaggtgattacctcggaaccacgttgtcggcgttgggtgtcggcatctttatgccatttattgtggctgcagcactgaaatcggcacaaggatcttcgactgtggccttggtcaccacttctgcattggttgcgccacttttaggccaactgggcttggacagtgaaatgggacgagcattaaccgtaatggcgattggtgcgggtgcaatgacggtttctcatgccaatgacagtttcttctgggttgtgtcgcagtttagccgcatgagtgtaggtttggcctaccgcgcacaaaccatggcaactctagtccaagggggcactgcgatggctgtggtatatgttctaagcttagtattgttataa

SEQ ID NO: 3097 - protein, 450 aa, Vibrio cholerae
MSLILILLAVIVFIVLATTKFKVHPFLALLLAAFLGAFAYGLPADTIAKTITTGFGGILGYIGLVIVLGTIIGVILEKSGAAITMADTVIKLLGERFPTLTMSIIGYIVSIPVFCDSGFVILNSLKESLAKRLATSSVAMSVALATGLYATHTFVPPTPGPIAAAGNLGLESQLGLVIAIGLFVAAVAAIAGMLWANRFQAVEADIIDSQESPKKDWQALKASYGQLPSASQAFAPIFVPILLICFGSIAKFPSFPFGQGMLFEVLGFLGQPLTALLIGLLLAVRLLKSADKVAEFGERISQGITAAAPILLITGAGGAFGAVLKATPLGDYLGTTLSALGVGIFMPFIVAAALKSAQGSSTVALVTTSALVAPLLGQLGLDSEMGRALTVMAIGAGAMTVSHANDSFFWVVSQFSRMSVGLAYRAQTMATLVQGGTAMAVVYVLSLVLL

SEQ ID NO: 3098 - DNA, 1335 bp, Bacillus subtilis
  CDS (1)..(1335)
atgccgattttaattgtagctgtcggagtgctgattctgttatttctcattattaaagtaaaattaaatacctttgtctcactgattgtcgtttcatttttagtagccatcggacttggaatggatatcaataaaattgttctttcaattgagactggaattggcgggcagctggggcatttagctttagtgtttggacttggcgcgatgcttgggaggcttgtctcagatgctgggggcggctaccggatcgccattacgctgattgacaaattcgggaggaaacgaatacaggcggcggttgtggttgcctcttttatcatcgggattgccctattttttgaagtcggtcttgttctgttgataccgattgtttacgcgattgctaaagaattaaaaatgccttttctgtatctgggaatcccgatggccgccgccttaaatgttactcacggatttttgcccccgcatcctgctccaactgctatctcagttgcatatggtgcccatattggccaggtgctgctttttggaatcatcatcgctgttccgacaactgtgattgccgggcctttatttaataaatttgcgatgaaacggtttcctggtgcgtatcaaaagcatggaaacctatcggggttaggaccaaggaaagaatttcagctggatgaaacaccgggctttgcgatcagtgctgtcacgtctttattcccggttatctttatggcaatggcaacaattttttctttattattgagtgaacattcaaaaggaaaagacattatagaatttatcggcactccgggaacggcaatgctcatttcgctgttgcttgcactctatacgatgggatatgcccgtaaaatatctatgcaggaaatcggcagatctatttcagaatcaatttcgcaaattgcgatgatgctgctcatcataggagggggaggagcgtttaaacaggtgctgattgacggcggagtcggcgattatgtcgctgattttttccgtcaaacaaacatgtcgccgctattcgttgcatggaccatcgccgcggttctgcgtctgtgtctaggctctgctaccgtggctgcgcttaccacagcgggaatggcagctccgcttatggaggctggcagtgtaaaccctgcgttaatggtgcttgcaacaggagccggcagtgtcattgcgtgtcatgtaaatgatgcaggattttggatggtaaaggaatttttcggcttgagcatgaaagaaacatttcaaacctggacgctgcttacaacagttctttcggttacagggctcggctgtgtgttattggcagggcttgtgatgtaa

SEQ ID NO: 3099 - protein, 444 aa, Bacillus subtilis
MPILIVAVGVLILLFLIIKVKLNTFVSLIVVSFLVAIGLGMDINKIVLSIETGIGGQLGHLALVFGLGAMLGRLVSDAGGGYRIAITLIDKFGRKRIQAAVVVASFIIGIALFFEVGLVLLIPIVYAIAKELKMPFLYLGIPMAAALNVTHGFLPPHPAPTAISVAYGAHIGQVLLFGIIIAVPTTVIAGPLFNKFAMKRFPGAYQKHGNLSGLGPRKEFQLDETPGFAISAVTSLFPVIFMAMATIFSLLLSEHSKGKDIIEFIGTPGTAMLISLLLALYTMGYARKISMQEIGRSISESISQIAMMLLIIGGGGAFKQVLIDGGVGDYVADFFRQTNMSPLFVAWTIAAVLRLCLGSATVAALTTAGMAAPLMEAGSVNPALMVLATGAGSVIACHVNDAGFWMVKEFFGLSMKETFQTWTLLTTVLSVTGLGCVLLAGLVM

SEQ ID NO: 3100 - DNA, 1386 bp, Neisseria meningitidis
  CDS (1)..(1386)
atggacggctggacacagacgctgtccgcgcaaaccctgttgggcatttcggcggcggcaatcatcctcattctgattttaatcgtcaaattccgcatccacgcgctgctgacactggtcatcgtcagcctgctgacggctttggcaaccggtttgcccacaggcagcattgtcaacgacgtactggtcaaaaacttcggcggcacgctcggcggcgtggcgcttctggtcggcctgggcgcgatgctcggacgtttggtcgaaacatccggcggcgcacagtcgctggcggacgcgctgatccggatgttcggcgaaaaacgcgcaccgttcgcgctgggcgttgcctcgctgattttcggcttcccgattttcttcgatgccggactaatcgtcatgctgcccatcgtgttcgccaccgcacggcgcatgaaacaggacgtactgcccttcgcgcttgcctccatcggcgcattttccgtcatgcacgtcttcctgccgccccatccgggcccgattgccgcttccgaattttacggcgcgaacatcggccaagttttgattttgggtctgccgaccgccttcatcacatggtatttcagcggctatatgctcggcaaagtgttggggcgcaccatccatgttcccgttcccgaactgctcagcggcggcacgcaagacaacgacctgccgaaagaacctgccaaagcaggaacggtcgtcgccatcatgctgattcccatgctgctgattttcctgaataccggcgtatcggccctcatcagcgaaaaactcgtaagtgcggacgaaacctgggttcagacggcaaaaataatcggttcgacaccgatcgcccttctgatttccgtattggtcgcactgtttgtcttgggacgcaaacgcggcgaaagcggcagcgcgttggaaaaaaccgtggacggcgcactcgcccccgtctgttccgtgattctgattaccggcgcgggcggtatgttcggcggcgttttgcgcgcttccggcatcggcaaggcactcgccgacagcatggcggatttgggcattcccgtccttttgggctgtttccttgtcgccttggcactgcgtatcgcgcaaggttcggcaaccgtcgccctgaccaccgccgccgcgctgatggctcctgccgttgccgccgccggctttaccgactggcagctcgcctgtatcgtattggcaacggcggcaggttcggtcggttgcagccacttcaacgactccggcttctggctggtcggccgcctcttggacatggacgtaccgaccacgctgaaaacctggacggtcaaccaaaccctcatcgcactcatcggctttgccttgtccgcactgctgttcgccatcgtctga

SEQ ID NO: 3101 - protein, 461 aa, Neisseria meningitidis
MDGWTQTLSAQTLLGISAAAIILILILIVKFRIHALLTLVIVSLLTALATGLPTGSIVNDVLVKNFGGTLGGVALLVGLGAMLGRLVETSGGAQSLADALIRMFGEKRAPFALGVASLIFGFPIFFDAGLIVMLPIVFATARRMKQDVLPFALASIGAFSVMHVFLPPHPGPIAASEFYGANIGQVLILGLPTAFITWYFSGYMLGKVLGRTIHVPVPELLSGGTQDNDLPKEPAKAGTVVAIMLIPMLLIFLNTGVSALISEKLVSADETWVQTAKIIGSTPIALLISVLVALFVLGRKRGESGSALEKTVDGALAPVCSVILITGAGGMFGGVLRASGIGKALADSMADLGIPVLLGCFLVALALRIAQGSATVALTTAAALMAPAVAAAGFTDWQLACIVLATAAGSVGCSHFNDSGFWLVGRLLDMDVPTTLKTWTVNQTLIALIGFALSALLFAIV

SEQ ID NO: 3102 - DNA, 1359 bp, Pseudomonas aeruginosa
  CDS (1)..(1359)
atgaccctggtcctgatcctgctggcgttgatcgcctttatcgtcctgtccaccacgcgactcaagctgcacccgttcctcgccctgctggcggccgcgctgatcgccggcttcgcctaccaggtacccacggcggaaatcgtcaagaccgttaccggcggcttcggcagcatcctcggctacatcggcatcgtcatcgtgctcggcaccatcatcggggtgatcctcgagcgcagcggtgcggcgatcaccatggcggaaagcgtgatccgcctgctcggcgaacgcttcccgaccctgaccatgtcgatcatcggctacctggtgtcgatcccggtgttctgcgattccggcttcgtcatcctcaactcgctgaagaacgccctggcggcgcggatgaagatatccaccatcgccatgagcgtggccctggccaccggtctctacgccacccacaccttcgtgccgccgaccccgggaccgatcgccgcggccggcaacctcggcctggacgccagccttggcctggtgatcgtggtcggcctggtggtcgccttcgtcaccgcgatggccggcatgtggtgggccaatcgcttcgtcggcaaggacattcccctggtcgacgacggccaggtcgtccagaccgaagaggacttcagcgagctgcgtgcccgctacggcaagctgcccagcgcgacccaggcgttcgcgccgatcttcgtaccgatcctgttgatctgccttggctcggtcgcggtattcccgagcaagccgctgggcgagggcgtactgttcgcctgcctgaacttcctcggtcaaccggtgatcgccctgctggtcggcctggcgctggcctgcaccctgctcaagggccagagcaagcgcgaggaattccatgagcgcgtggtggaaggcatccagtcggccgcgccgatcctgctgatcaccggcgccggcggcgccttcggtgcgatgctgaagatcactccgctcggcgactacctgggcagcaccctgtcagcgttgggcatcggcctgttcatgccgttcgtggtggcggccgcgctgaagaccgcacagggctcgaccaccgtggcgctggtcaccacctcggcgctggtcgctccgctgctgccgcagctcggcctggacagcgagatgggccgggtgctgacggtcatggcgatcggtgccggagcgatgacggtgtcccacgccaatgacagcttcttctgggtggtcacacagttcagccgcatgaccgtatccactgcctatcgcgcccagaccctggcgaccctggtccagggtatcgccggtatgctcgcggtatggctgctcagccttgtgctgctctga

SEQ ID NO: 3103 - protein, 452 aa, Pseudomonas aeruginosa
MTLVLILLALIAFIVLSTTRLKLHPFLALLAAALIAGFAYQVPTAEIVKTVTGGFGSILGYIGIVIVLGTIIGVILERSGAAITMAESVIRLLGERFPTLTMSIIGYLVSIPVFCDSGFVILNSLKNALAARMKISTIAMSVALATGLYATHTFVPPTPGPIAAAGNLGLDASLGLVIVVGLVVAFVTAMAGMWWANRFVGKDIPLVDDGQVVQTEEDFSELRARYGKLPSATQAFAPIFVPILLICLGSVAVFPSKPLGEGVLFACLNFLGQPVIALLVGLALACTLLKGQSKREEFHERVVEGIQSAAPILLITGAGGAFGAMLKITPLGDYLGSTLSALGIGLFMPFVVAAALKTAQGSTTVALVTTSALVAPLLPQLGLDSEMGRVLTVMAIGAGAMTVSHANDSFFWVVTQFSRMTVSTAYRAQTLATLVQGIAGMLAVWLLSLVLL

SEQ ID NO: 3104 - DNA, 1347 bp, Bacillus licheniformis
  CDS (1)..(1347)
atgccattactgatcgtagcaatcgggattgtggcattattgcttttgattatggggttaaaactgaatacgtttgtttccttgattatcgtatcgttcggggttgcattggcgcttggaatgccgcttgacgacatcgtcaaaacgattgaagaaggccttggcggaacgctcggccatatcgcattgatcttcgggctcggcgccatgctgggcaggctgatcgcggattcagggggcgctcagcgcattgcgatgaccctcgtcaacaaattcggagaagaaaacatccaatgggcggtcgtcatcgcctcctttatcatcggggtagcattattcttcgaagtcgcattggtattattgattccaattgtattcgccatttcaaaagaattggagatatctatttcataccttggaattccaatgacggcggccttatccgtcacacacggcttcctgcccccgcatccgggaccgacggctatcgcgggagagctcggcgccaatatcggggaagtgctgctctacggtatcattgttgcaattccaaccgttcttttggccggacctttatttacgaaactggcgaaaaaaatcgtcccgcaatcatttgagaaaatgggcagcatcgcttcactcggtgagcagaaaacgttcaagcttgaagagacgcccggcttcggcatcagcgtcttcacagctatgcttccggtcattatcatgtctatttcgactgttattacgcttattcaagaaacgatgggccttgcagacaacagcctgctggcagcggttcgtttaatcgggaatgcctcgacttcgatggtcatctccctgttggtcgcgatctatacgatggggatcgccagaaagatcccgatcaaacaagtgatggattcctgttcaaccgccattacacaaatcggaatgatgctcttgatcatcgggggcggcggcgccttcaaacaagtcttgatcaatggcggagtaggcgactatgtagctgaattattcaaaggaacagccatgtcgccgatcttgctcgcctgggtcatcgccgcaattctgcgcatctccttaggatccgcgacagttgctgcattaagcacaaccggactcgttcttccgatgctcggacaaagcgatgtcaatcttgcgctggttgtgcttgcaacaggggccggaagtgtaatcgcttcccatgtcaatgacgcaggcttctggatgttcaaagagtatttcggactaagcatgaaagagacatttgccacctggacactgcttgaaaccattatcgcggtggccggattaggatttactttattgttaagcctatttgtataa

SEQ ID NO: 3105 - protein, 448 aa, Bacillus licheniformis
MPLLIVAIGIVALLLLIMGLKLNTFVSLIIVSFGVALALGMPLDDIVKTIEEGLGGTLGHIALIFGLGAMLGRLIADSGGAQRIAMTLVNKFGEENIQWAVVIASFIIGVALFFEVALVLLIPIVFAISKELEISISYLGIPMTAALSVTHGFLPPHPGPTAIAGELGANIGEVLLYGIIVAIPTVLLAGPLFTKLAKKIVPQSFEKMGSIASLGEQKTFKLEETPGFGISVFTAMLPVIIMSISTVITLIQETMGLADNSLLAAVRLIGNASTSMVISLLVAIYTMGIARKIPIKQVMDSCSTAITQIGMMLLIIGGGGAFKQVLINGGVGDYVAELFKGTAMSPILLAWVIAAILRISLGSATVAALSTTGLVLPMLGQSDVNLALVVLATGAGSVIASHVNDAGFWMFKEYFGLSMKETFATWTLLETIIAVAGLGFTLLLSLFV

SEQ ID NO: 3106 - DNA, 1314 bp, Escherichia coli
  CDS (1)..(1314)
atgccattagtcattgttgctatcggtgtaatcttgttgttgctcctgatgatccgcttcaaaatgaacggcttcatcgctctcgtcctcgtggcgcttgctgttggattaatgcaaggaatgccgctggataaagttattggctccatcaaagccggtgtcgcggacgtcggtagccttgccctgatcatgggttttggcgcaatgctgggcaaaatgctggcagactgcggtggcgcacaacgtatcgccaccacgctgattgccaaatttggtaaaaaacacatccagtgggcggtggtactgaccggttttaccgttggttttgccctgttctatgaagtgggctttgtgctgatgctgccgctggtgtttaccatcgcggcttctgcgaatattccactgctgtatgttggtgtaccaatggcggctgcactgtctgtgacccacggcttcctgccaccgcatccgggtccgactgcgattgccaccattttcaatgccgatatgggtaaaaccctgctgtacggtactattctggcaatcccgaccgtgattctcgccggtccggtttacgctcgcgtgttgaaaggtatcgataagccaattccggaaggtctctacagcgcgaaaaccttcagcgaagaagagatgccgagctttggcgtcagcgtctggacctctctggtgccggtagtactgatggcgatgcgtgcgattgccgaaatgatcctgccgaaaggtcacgctttcctgccggtagcggagttcctcggtgacccggtaatggcaacgctgattgccgtgctgattgcgatgttcacctttggtctaaaccgtggtcgttcaatggatcagattaacgacacgctggtttcttccatcaaaatcattgcgatgatgctgttgatcatcggtggtggcggtgcgttcaagcaggtgctggtagacagcggcgtggacaaatacattgcttccatgatgcacgaaaccaacatttctccgctgctgatggcctggtcgattgctgccgtactgcgtatcgcgctgggttccgcaaccgttgcggcaatcactgcgggtggtatcgcggcaccgctgattgcaacgacgggtgttagcccggagctgatggttattgcggttggttccggtagtgtgattttctctcatgtgaacgatccgggcttctggctgttcaaagagtactttaacctgactatcggcgagaccatcaaatcctggtcgatgctggaaaccattatctcggtgtgcggtctggtaggctgtctgctgctgaatatggtgatttga

SEQ ID NO: 3107 - protein, 437 aa, Escherichia coli
MPLVIVAIGVILLLLLMIRFKMNGFIALVLVALAVGLMQGMPLDKVIGSIKAGVADVGSLALIMGFGAMLGKMLADCGGAQRIATTLIAKFGKKHIQWAVVLTGFTVGFALFYEVGFVLMLPLVFTIAASANIPLLYVGVPMAAALSVTHGFLPPHPGPTAIATIFNADMGKTLLYGTILAIPTVILAGPVYARVLKGIDKPIPEGLYSAKTFSEEEMPSFGVSVWTSLVPVVLMAMRAIAEMILPKGHAFLPVAEFLGDPVMATLIAVLIAMFTFGLNRGRSMDQINDTLVSSIKIIAMMLLIIGGGGAFKQVLVDSGVDKYIASMMHETNISPLLMAWSIAAVLRIALGSATVAAITAGGIAAPLIATTGVSPELMVIAVGSGSVIFSHVNDPGFWLFKEYFNLTIGETIKSWSMLETIISVCGLVGCLLLNMVI

SEQ ID NO: 3108 - DNA, 1761 bp, Escherichia coli
  CDS (377)..(1714)
cagctgattgatacggtgacttaccgcactggggctcagcgacaattcctctgccgccagggcgaaggactgatgcctggcagccacttcaaaagtatgcatttttgataattgccagccgttaagcagccgatttcttatttcacgaaggggttccataatcacctcatttttcgcttaagtgtaaaaaaatagcggcaaaatttcagctatgagatgagctaaagtgaaccatatctcaattcaccttcatttttagatgtaaatcactccattgatgcaatttacctcatgtgaaaggcaaattttatcgtttgtcagcctgcgttgtttttttgtccaatatcatcaggttaatcacaggggaaggtgagatatgcactctcaaatctgggttgtgagcacgctgcttatcagcatcgtgttaattgtactgaccatcgtgaagttcaaattccacccgtttctggcgctgttgctggccagcttcttcgtgggaacgatgatgggcatggggccactggatatggtaaatgctattgaaagtggaattggcggaacgctggggttcctcgcagcggttatcggccttggcacgatactgggaaaaatgatggaagtatccggggccgcagaaagaattggtctgacacttcaacgctgccgctggctttcagttgatgtcattatggtgctggttggcctgatttgtggcatcacgctgtttgttgaagtgggcgtcgtgctattgattcctctggctttttcaattgccaaaaaaaccaatacctcattattaaagcttgccattccgctatgtaccgcattgatggcagtgcactgcgtggttcctccacatccggctgctttatatgttgccaataagctgggcgcagatatcggttcggtgatcgtctacggtttgctggttgggctgatggcatcactgatcggtggcccacttttccttaaatttctgggtcaacgactgccctttaaacctgtacccacagagtttgcagatctcaaagttcgcgatgaaaaaacactaccgtcattaggcgcaacgttattcaccatactgctacccattgcgctgatgttggttaaaacgattgccgaattgaatatggcgcgtgagagtggtttgtatatcttggttgagtttattggcaaccctatcactgccatgtttatcgccgtgtttgtcgcctattatgtgttgggtatacgccagcatatgagcatggggacgatgctcacacatacggaaaatggcttcggttctattgctaatattttgctgattatcggggccggaggcgcattcaacgccattttaaaaagcagcagtctcgctgatacgctggcagttattctctccaatatgcatatgcacccgattcttctggcctggttagtggctcttattctgcatgcggcagtgggctccgctaccgtggcaatgatgggggcaacggcaattgttgcacccatgctgccgctgtatcccgacatcagcccggaaattattgcgattgctatcggttcaggtgcaattggctgcactatcgttacggactcgcttttctggctagtgaagcaatattgcggcgctacgctcaatgaaacatttaaatactatacgacagcgacatttatcgcttcagtcgtcgctctggcgggcacattcctgctgtcatttatcatctaagcgcaaagagacgtactatggaaaacgctaaaatgaactcgctcatc

SEQ ID NO: 3109 - protein, 445 aa, Escherichia coli
MHSQIWVVSTLLISIVLIVLTIVKFKFHPFLALLLASFFVGTMMGMGPLDMVNAIESGIGGTLGFLAAVIGLGTILGKMMEVSGAAERIGLTLQRCRWLSVDVIMVLVGLICGITLFVEVGVVLLIPLAFSIAKKTNTSLLKLAIPLCTALMAVHCVVPPHPAALYVANKLGADIGSVIVYGLLVGLMASLIGGPLFLKFLGQRLPFKPVPTEFADLKVRDEKTLPSLGATLFTILLPIALMLVKTIAELNMARESGLYILVEFIGNPITAMFIAVFVAYYVLGIRQHMSMGTMLTHTENGFGSIANILLIIGAGGAFNAILKSSSLADTLAVILSNMHMHPILLAWLVALILHAAVGSATVAMMGATAIVAPMLPLYPDISPEIIAIAIGSGAIGCTIVTDSLFWLVKQYCGATLNETFKYYTTATFIASVVALAGTFLLSFII

SEQ ID NO: 3110 - DNA, 1491 bp, Salmonella enterica subsp
  CDS (1)..(1491)
atgacgataataaaaagctacgccgccaaagaggcgggcggcgagctcgaactctatgaatatgacgcgggagaactccaaccggaagatgtcgaggtacgggtcgactactgcgggatctgccattccgatctgtcgatgatcgacaatgaatgggggttctctcaataccctctggttgccggacacgaggtcatcggtcgggtggccgcactcggtagcgcggcacaggataagggactaaaagtcggccagcgcgttggaatcggctggacggcgcgcagctgcggacactgcgatgcctgtatcagcggcaatcaaattaactgcctggaaggggcagtgcccactatcctcaatcgtggcggttttggcgcgatgctgggaagattaatttccgataccggcgccgcgcagcgcattgcgacgacgctcattaatacgttcggcaaaaaacgcgtgcaatgggcgctggtgatcaccgggcttatcgtcggcctggcaatgttttttgaagtcggattcgtactgctgttgccgctcgtttttacaattgtggcctcatcgggactgccattgctgtatgtcggggttccaatggtcgccgccttatccgttacgcactgcttcctgccgccgcatcccggccctaccgctattgcgacaatttttgaggcaaatctcggtacgaccctgctgtatgggttaatcattaccataccgaccgtgattgttgccggccctctgttttcaaaattgctggcgcgatttgaaaaagcgccgcctgaaggattatttaatcctcatctattcagtgaagaggagatgccgtcattctggaacagtatttttgccgccgtgatcccggtcattctgatggccatcgcagcggtatgtgaaatcacgctgccaaaaacgaatgccgtgcgggttttcttcgaatttatcggtaatccagcagtggcgttgtttattgccattatcatcgccatttttacgctggggcgacgcaatggacgtacggttgagcaggtgatggatatcgtcggcgagtccattggcgctattgcgatgattgtttttatcatcgcgggcggcggcgcgtttaagcaagtgctggtggatagcggcgtgggtcaatatatctcgcaattaatgaccggcacctcgctatctccgttattaatgtgctggacggtagccgccgtgctgcgtattgcgttaggttccgcgaccgtggccgcgataaccacagcgggcgtcgtattgccgattattaacgtaacccacgccgatccggcgttaatggtactggcgacaggcgcgggaagcgttattgcatcacatgttaacgatcccggtttttggctgtttaaagggtattttaatcttagcgtcggggaaaccctacgcacctggaccgttatggaaacattgatttctgtcatggggttgctgggcgtactggcgctgaatgcggttctgcattaa

SEQ ID NO: 3111 - protein, 496 aa, Salmonella enterica subsp
MTIIKSYAAKEAGGELELYEYDAGELQPEDVEVRVDYCGICHSDLSMIDNEWGFSQYPLVAGHEVIGRVAALGSAAQDKGLKVGQRVGIGWTARSCGHCDACISGNQINCLEGAVPTILNRGGFGAMLGRLISDTGAAQRIATTLINTFGKKRVQWALVITGLIVGLAMFFEVGFVLLLPLVFTIVASSGLPLLYVGVPMVAALSVTHCFLPPHPGPTAIATIFEANLGTTLLYGLIITIPTVIVAGPLFSKLLARFEKAPPEGLFNPHLFSEEEMPSFWNSIFAAVIPVILMAIAAVCEITLPKTNAVRVFFEFIGNPAVALFIAIIIAIFTLGRRNGRTVEQVMDIVGESIGAIAMIVFIIAGGGAFKQVLVDSGVGQYISQLMTGTSLSPLLMCWTVAAVLRIALGSATVAAITTAGVVLPIINVTHADPALMVLATGAGSVIASHVNDPGFWLFKGYFNLSVGETLRTWTVMETLISVMGLLGVLALNAVLH

SEQ ID NO: 3112 - DNA, 1386 bp, Photorhabdus luminescens
  CDS (1)..(1386)
atggaacactacattccggtcgttggtctgggtgtagccgtatttacgttgatctttctggtgctacgtacccgtgttcatgctttattagccatgctcatcgcagcagcgatcgctgggctctctggtggcttaaccgcagcaaataccattgatgttatgactaaaggttttggctccacactgggcagtatcggaattgttatcggtctgggggtcatgatgggacgggtgctggaagtttccggcgccgcggaacagatagcctacagctttatcaaatggttaggtaaaaaacgcgaagagtgggcattagcgatcaccggttatatcgtcagtatcccaattttcgtcgactctgcctttgttatcctctacccactggcaaaagcactcgcaaaaaagggaaaacgtcatcttctaacgcttggcgtggcactggctggcggattggttgttacccaccacactgttccgccaacaccggggccactgggggttgctggtattttcggtgtcgacattggtgccatgatgttaaccggtatggttctggcggtgccttgcgttattggcattgtattttatgccaaatggttagcagtaaaatatcctgaatttcaacccattgatgaagcagaagaagcgcaagatctacaaacaatccaccaacgctacatggaagagaaagcgaacaaaccgctaccgagcctatttctttccctgctgccgattattgtccctatcgttttgatcttcattaaagccattaatagcctattattaaacactaaaactttgactggacaagaaaacaacttctattttcagacatttgatttccttggtgcacccgttattgctttagccatcagcgtattattggcggtttataccttgatgccaaaagccaataaacatgaagtcattgaccgtctggaagaaggtttacaggctgccggtattattttattggtgacaggcgcaggcggtgcgttaggagcggtattgcgcgaaagtggtaccggcaccattctggcgcaatatatagccactctcccactaacaccggtgctgattccatttatcatcgcaacactggttcgcttaattcaaggttccggcacggtggcaatgattactgctgcttctatttctgcgccaattattagtcaaattccggggatcaacatgctggttgccgcacaagcagcaacgatgggctcattattctttggttattttaatgacagcctattctgggtcgttaaccgcatgatgggaatcaaagatgccaaacaacagatgttcgtttggtcaatacccaccactattgcatgggcgattggcttgtgtggtgtcatcatcttggatctggtgttatag

SEQ ID NO: 3113 - protein, 461 aa, Photorhabdus luminescens
MEHYIPVVGLGVAVFTLIFLVLRTRVHALLAMLIAAAIAGLSGGLTAANTIDVMTKGFGSTLGSIGIVIGLGVMMGRVLEVSGAAEQIAYSFIKWLGKKREEWALAITGYIVSIPIFVDSAFVILYPLAKALAKKGKRHLLTLGVALAGGLVVTHHTVPPTPGPLGVAGIFGVDIGAMMLTGMVLAVPCVIGIVFYAKWLAVKYPEFQPIDEAEEAQDLQTIHQRYMEEKANKPLPSLFLSLLPIIVPIVLIFIKAINSLLLNTKTLTGQENNFYFQTFDFLGAPVIALAISVLLAVYTLMPKANKHEVIDRLEEGLQAAGIILLVTGAGGALGAVLRESGTGTILAQYIATLPLTPVLIPFIIATLVRLIQGSGTVAMITAASISAPIISQIPGINMLVAAQAATMGSLFFGYFNDSLFWVVNRMMGIKDAKQQMFVWSIPTTIAWAIGLCGVIILDLVL

SEQ ID NO: 3114 - DNA, 1338 bp, Photorhabdus luminescens
  CDS (1)..(1338)
atggattcacaaccttgggtgattggtacgttactcacaagtattgcgttaattgtatttacgataattaaattaaaaattcacccttttcttgctctattgttagccagtttttatgtcggtgccttaatgggaatgaaccctgttgaaatggtgaacgccattcaagggggaatcggagatacgctaggttttttagccgtagtgattggtctggggaccattcttggtaagatgatggagatatccggcgcggcagagcggattggtatcacattgcaaaaatgccgatggctatcacctgatatcattatggtactgattggtttggtttgtggtattacgctgtttgttgaagtcggggtggtattgttaattccattggcattttctattgccaggaaaaccaatacatcattgctgaaattagcgatcccattatgtacagcgttgatggcggttcactgtattattcctccgcacccggctgcattatttgtgacgaataaactgggtgcggatattggctcggtgattgtttatgggttgatagttggcctgtttgccgctttggtgggggggccattatttctgaaatttctcggtagccgtctgccttttaaatcggttccggctgaattttctgaaattgcagttcgtcaagaagaggatttaccctctttaggcatgacattgtttactgtgttattgccaattgggttaatgttgactaaaacggctgctgaattaaatatggaaaaaggtaccacgttttatacggtgctggaatttattggtaatcctattacagccatgttcattgccgcgtttgttgcctattacaccttgggcattaagcaaaatatgggaatgagtacactgttgacgaagacggaagattgtttctcttctatcgccaatattttattaattatcggcgcgggcggggcatttaatagtattttaaaagtcagtggccttagtgatacgttggccgttattttgtcgagtctggatatgcacccaattcttttgtcttggttggttgccattattttgcatgcggcggttggttcagcaacggtcgcaatgatgggggcaacagcgattgtttcgcctatgttgccgttatatccagatattagccctgaaatcattacattggcgattggttctggtgctatcggctgtactattgtgacggattcactgttttggttggttaagcaatattgcggaacaacgctcagtgaaacttttaagtattatacaaccgcaacatttattgcctctgtggttgcgttggttgggacgtttcttctttctaccatcgtgtag

SEQ ID NO: 3115 - protein, 445 aa, Photorhabdus luminescens
MDSQPWVIGTLLTSIALIVFTIIKLKIHPFLALLLASFYVGALMGMNPVEMVNAIQGGIGDTLGFLAVVIGLGTILGKMMEISGAAERIGITLQKCRWLSPDIIMVLIGLVCGITLFVEVGVVLLIPLAFSIARKTNTSLLKLAIPLCTALMAVHCIIPPHPAALFVTNKLGADIGSVIVYGLIVGLFAALVGGPLFLKFLGSRLPFKSVPAEFSEIAVRQEEDLPSLGMTLFTVLLPIGLMLTKTAAELNMEKGTTFYTVLEFIGNPITAMFIAAFVAYYTLGIKQNMGMSTLLTKTEDCFSSIANILLIIGAGGAFNSILKVSGLSDTLAVILSSLDMHPILLSWLVAIILHAAVGSATVAMMGATAIVSPMLPLYPDISPEIITLAIGSGAIGCTIVTDSLFWLVKQYCGTTLSETFKYYTTATFIASVVALVGTFLLSTIV

SEQ ID NO: 3116 - DNA, 1338 bp, Photorhabdus luminescens
  CDS (1)..(1338)
atgagtactttaaccttagtgctgacagcggtgggttctgtgcttttactattgtttttggtgatgaaggccagaatacatgcttttgttgcgctaatactggtttctatgggagcgggtgttttttctggtatgccactggataaaattgctgaaacaatgcaagaaggaatgggaggaacgttaggttttctggctattgttgtcgcactgggcgcgatgtttggtaaagttctgcatgaaacaggcgcactggatcagattgcggttaagttactaaatagtttcggtgaaaagaatgctcattattcattggggatcgctggcttggtttgtgctttgcctttgttctttgatgtagctattgttttattgattggcgtggcgttcgcagtcgcgcgtcgtactggcggtaatgtagtgaagttggttattcctctgtttgctggtgtcgcagccgcagcggcatttttgttacctggtccagcgccgatgttgttggcttcacagatgaatgctgattttggctggatgatcttgatcggtatcagtgcagcgattcctgggatgttactggcggggccaatcttcggtaattttatcagtaagtatgtcactctggatttgcccgtggatataagtgagccaagccttggtcaaggtaagatgccatcttttggtttgagtttgtcactggttctgttccctttggctttggttgggttaaaggctattggtgagaattttgttgaacagagttctgagttgtatcagtggcttgaatttatcggtcatccattttctgcgattttggttgcttgtttgattgctatttatggtttggcaattcgtcgtgggatgagtaaagagaaagtgatggatatttgctcttcggctattcaaccggcgggaattattttattggtgactggggctggtggtgtattcaaacaagtattagtggattctggtgttggccctgctttgggaaacgcattgattggggcgggtctgcctattgcattagcgtgtttcatccttgctggtacagtacgcgttattcaaggttctgcaactgttgcctgtttgacaactgttggtctgattttgcccgttgttgatcttctgggatattctggtgcccagcttgccgctctttcaatttgtattgcgggtggttctttggtattgagccatgttaatgactcaggcttttggttatttggtaaatttactggtgcaacagaatctcaaacactgaaaacttggtcaattatggaaactattcttgggacaataggtgccattgttggaatggttttctttgccatgttgtaa

SEQ ID NO: 3117 - protein, 445 aa, Photorhabdus luminescens
MSTLTLVLTAVGSVLLLLFLVMKARIHAFVALILVSMGAGVFSGMPLDKIAETMQEGMGGTLGFLAIVVALGAMFGKVLHETGALDQIAVKLLNSFGEKNAHYSLGIAGLVCALPLFFDVAIVLLIGVAFAVARRTGGNVVKLVIPLFAGVAAAAAFLLPGPAPMLLASQMNADFGWMILIGISAAIPGMLLAGPIFGNFISKYVTLDLPVDISEPSLGQGKMPSFGLSLSLVLFPLALVGLKAIGENFVEQSSELYQWLEFIGHPFSAILVACLIAIYGLAIRRGMSKEKVMDICSSAIQPAGIILLVTGAGGVFKQVLVDSGVGPALGNALIGAGLPIALACFILAGTVRVIQGSATVACLTTVGLILPVVDLLGYSGAQLAALSICIAGGSLVLSHVNDSGFWLFGKFTGATESQTLKTWSIMETILGTIGAIVGMVFFAML

SEQ ID NO: 3118 - DNA, 1452 bp, Rhodopirellula baltica
  CDS (1)..(1452)
atgacgatctggtggttggtcgcgctcgccgtgacgatggtgctggtctcgatcctcgcgttccgactgcatccgtttctggcgttgctatcgacggcaatcatggtggcgatgctgaccacgccggctcaattgtcatcgtttgcatcggcaagattggccgacggcaaattcacagacgccgaagccaccgccttcgtcggacaatccgcgtccgcacgagtcgcagatgccttcggtgcgaccgccggttccattggaatcgtgatcgcattggccagcgtcattggcggattgctgatgcagtccggtgcggcggcgagaatcgttgacacgatgctccgctggaccggggaacaacgtgctcccgaagcaatggccgcggcgtcgtttgttcttggcatccccgtgttcttcgacacggttttctacctgatgctcccgctggccaggtcactgcgccgcaaaacggggaagaactatgtcttgttcatcttggccatcttggcaggtggatcgatcacgcactcgttgatcccgccgacgcctggcccacttcaagtggccgctttcttggaagtcgaaatcggtgcgatgttgatcgccgggctcggtatcggaagcatcaccagcgtgattgcgttggccgccgccagagtcatcaatcactttgtcgatctgccacttcgcgacgaagatggcgaggagattcgccccaagacgcagcgactggcatcagccggcgatcaatcaacagagatcccacccaaaccgccattgtggctgtcgctgttcccaattgccttgccggtggttctgatcgcgctcggatcgaccatcaaatccgtttacggaagcgaagccgtcgcggaatccgaactgctgggatggatccttcggttgggcgacaagaacctcgcgttggggttaggttgcctcgtcgcgttcggattgatccgctgggttcccaacgaccaacgacgcaaagtggtttccgctgcgatcgcctccgccggatccatcattctgatcaccgccgccggtggggcaatgggtaaaatgctctatcaagccggcatcgcagaagtcgtcggttccatcgccaaaggattccccgggctttggttgcttccgttggcattcctcgtgacgaccgcgatccgaacgatccaaggctcggcgaccatcgcgatgatcacttcggccagcattctgcaatcactggcaaccagcggcgagcttccgtttcacccggtctacctggcgatggcgatcggtgcgggaagcaaaccgatctcatggatgaccgacagcgcgttttggatcatctccgaaatgacgggcatgaccgagaaagaagccctgcgaacgatctctccgatgagtgccgcgttgggtgtttcagcgttgctggtcaccgttgttgccgcggcgatctttcccgccgtgtga

SEQ ID NO: 3119 - protein, 483 aa, Rhodopirellula baltica
MTIWWLVALAVTMVLVSILAFRLHPFLALLSTAIMVAMLTTPAQLSSFASARLADGKFTDAEATAFVGQSASARVADAFGATAGSIGIVIALASVIGGLLMQSGAAARIVDTMLRWTGEQRAPEAMAAASFVLGIPVFFDTVFYLMLPLARSLRRKTGKNYVLFILAILAGGSITHSLIPPTPGPLQVAAFLEVEIGAMLIAGLGIGSITSVIALAAARVINHFVDLPLRDEDGEEIRPKTQRLASAGDQSTEIPPKPPLWLSLFPIALPVVLIALGSTIKSVYGSEAVAESELLGWILRLGDKNLALGLGCLVAFGLIRWVPNDQRRKVVSAAIASAGSIILITAAGGAMGKMLYQAGIAEVVGSIAKGFPGLWLLPLAFLVTTAIRTIQGSATIAMITSASILQSLATSGELPFHPVYLAMAIGAGSKPISWMTDSAFWIISEMTGMTEKEALRTISPMSAALGVSALLVTVVAAAIFPAV

SEQ ID NO: 3120 - DNA, 1956 bp, Rhodopirellula baltica
  CDS (1)..(1956)
atgggcagactgcactgccccccaaaactctggtcttcacaatcgacattggatacgaatcggatgatgccttgggataatgggtcggcgatgaaacgcttggccgcttgtttgggtttgctctcgctcgtgatgttctcgggcaacctcgatgctgctgaagccgccgctgaggttggttcacaagctgctgaatccatctccatgactcccatttggatggtcctggcaggcatcgtcagtgttttggccatgatcattgggctgaaactcaacgccttcctggctctgatcatctcggcgcttttcgtcagtctcttggttggatttcaatccggagccgatgcgggatcccggatggaagccgtcgtctcggcctttggagattcggcgggtggcgttggcatcgtcatcgccatggcggcgatcatcggcaagtgcatgctagacagcggttcagccgaccggatcgttcgcaccgcggtcggtgtcaccggtgaaaagaaagcctcgctgggtttgatggtcagcggtttcattctcgccgtgccggtgttcttcgataccgttttctatctgctggtccccctggctcgcagccttcacaaacgaacgcaatccaactacctgcgatatttgatggccatcgccaccggcggggcgatcacacacacgttggttccaccgactcccggcccgctattggtgtccgccattttgggagtggacatcggaatgatgatggccgtcggtgctgccgttgccatcccatcagcgatactcggactcgtgttttcaatcatcgttgacaaaaagatgccggtcccgatgcggccgctcggtgccaatgaagacaaacacgaaccgttggccgaagaacaattgccgtcgctttgggcttcgatgttaccggtcattctgccagtggccttgattggcgcgggcaccctggcgacgacgttggccgacaaggaagatcgtgcggcgatcaccgctgctgacatcgaaagctttgaattgctcagcgagaagttcaccgacgccagcgccatgtcaccggccggtcgtttggtcggcagctcgaaactgaccgacgaacaacgcgaaacgctgaagactccaccgaccagccctgaacaagaagccttgtttgtcgaagcgatgaacgacgctttgcttgatcctaatttttacgatgccgatgcctttgacgatgtcgatatccccgaagtcagcagcaaattgatggctgccaaccaacttcgaatgaaaccggtcgatcgtcgtcgcatgaaccgtgctctcttggatgcggcctacccggaactgctcgccgctcatcgctgggacagctcgatgcgaaagaccgccaattcactcggtctatggagcaacccgaactttgctctgctgttggctgcactatcggcgattctgaccttcaaaatcgttcgtcagttgtcatggagggaggtcggcgtcgatgtcgaagagtcgttgatgagtggcggcgtcattatcttgatcaccgccgccgggggtgcgttcggagcgatgctcagtgcgaccgaaatcgctgacacgatccagcaattcttcgaagggcgcgaagccgccggattggcgattctcttgctcgcatggtcgatctcggccgtgttgaaagtcgcccaaggcagcagcaccgtcgcgatgatcattggtgccgggatgatggccgcgatccttggcgggcaacagcctccattccacttggtctacgtcgcgacggccgtgggcagtggatcgctgatgggaagctggatgaacgacagtggattctgggtgttcaccaaaatgggcggactgaccgaaagcgaatcccttcgaagctggacgccgttgttggcaaccctgtccatcggcggtttggtcaccacgatcatcctcagccaagtcatcccaatggcaagctaa

SEQ ID NO: 3121 - protein, 651 aa, Rhodopirellula baltica
MGRLHCPPKLWSSQSTLDTNRMMPWDNGSAMKRLAACLGLLSLVMFSGNLDAAEAAAEVGSQAAESISMTPIWMVLAGIVSVLAMIIGLKLNAFLALIISALFVSLLVGFQSGADAGSRMEAVVSAFGDSAGGVGIVIAMAAIIGKCMLDSGSADRIVRTAVGVTGEKKASLGLMVSGFILAVPVFFDTVFYLLVPLARSLHKRTQSNYLRYLMAIATGGAITHTLVPPTPGPLLVSAILGVDIGMMMAVGAAVAIPSAILGLVFSIIVDKKMPVPMRPLGANEDKHEPLAEEQLPSLWASMLPVILPVALIGAGTLATTLADKEDRAAITAADIESFELLSEKFTDASAMSPAGRLVGSSKLTDEQRETLKTPPTSPEQEALFVEAMNDALLDPNFYDADAFDDVDIPEVSSKLMAANQLRMKPVDRRRMNRALLDAAYPELLAAHRWDSSMRKTANSLGLWSNPNFALLLAALSAILTFKIVRQLSWREVGVDVEESLMSGGVIILITAAGGAFGAMLSATEIADTIQQFFEGREAAGLAILLLAWSISAVLKVAQGSSTVAMIIGAGMMAAILGGQQPPFHLVYVATAVGSGSLMGSWMNDSGFWVFTKMGGLTESESLRSWTPLLATLSIGGLVTTIILSQVIPMAS

SEQ ID NO: 3122 - DNA, 1326 bp, Bacillus cereus
  CDS (1)..(1326)
atgaatatgtaccttttaatgattacattattatcaattgtaattgttattttaggggtttcgtggtggagatggcatgcgtttattagtttaacggttgcaagtttgtttttagcaattatgtctggaatgccaatggataaaatagtgagtgcttatgaaacgggagttgggagtgttctcgggcatttagtaggtattttagttttaggtacaattttagggaaaatgatggcagagtcaggtgctggaatgcaagtggcagagttctttattaaatcctttgggataaaaaacttaccgtgggctatgttaattgcaggttttattattggaattccggtgttttttgaagtaggtattttaatattgttgccgttagtaatttcaattcataaaactacgaaacaaaatattttattgatagcgttaccagcaattgctgggctatctgtcgtacatggcctagttcctccgcatccaggggcaatcgttgcaattggtatttataaagcgaaccttgggaaggtactattgtattcactcattattacattttttgcagcgattattgcaggtcctatattcgctaaatggattcacaaacgtgtaattcctgaaaatgagccagaattgattcgtgtaaatacaaaatcaacgaaattaccaggaataggagtttcatttttagtcatattgttaccagttatgttaatggttttagctgcagcggctccttatgttccactttctactactttgatgaagattatcacattaatcggtagtcctatcattgcgttattgattgcatgttttgcagcgttttattttcttggatttcgccaaggtatcgataaaaaggctattaagaaggtaacagaagatagcttattaccaatcggttcaattgttgcgattattggtgccggcgggggatttaagcaaattcttatcgatagtggtgtaggcaatgctattgctcaaatgtctgagcatttagctctatctccaattgtattagcatttatagtagcaggactaattcgaattgcgacagggtcagcgacagtcgctttaacaacagcagcaggcatcgtttcaccaatcattgaaaatacgacaggtgtgaatttagagttgctcgtcattgcaacaggtgcaggagcattaatgttttcacacgtaaacgatgctgggttctggatggtaaaagaatacttaggtttaacagtgaaagaaacatttaaaacatggacggtattagaaacgttactttcatttatcgcttttggaggagttttactacttgatatgtttgtttaa

SEQ ID NO: 3123 - protein, 441 aa, Bacillus cereus
MNMYLLMITLLSIVIVILGVSWWRWHAFISLTVASLFLAIMSGMPMDKIVSAYETGVGSVLGHLVGILVLGTILGKMMAESGAGMQVAEFFIKSFGIKNLPWAMLIAGFIIGIPVFFEVGILILLPLVISIHKTTKQNILLIALPAIAGLSVVHGLVPPHPGAIVAIGIYKANLGKVLLYSLIITFFAAIIAGPIFAKWIHKRVIPENEPELIRVNTKSTKLPGIGVSFLVILLPVMLMVLAAAAPYVPLSTTLMKIITLIGSPIIALLIACFAAFYFLGFRQGIDKKAIKKVTEDSLLPIGSIVAIIGAGGGFKQILIDSGVGNAIAQMSEHLALSPIVLAFIVAGLIRIATGSATVALTTAAGIVSPIIENTTGVNLELLVIATGAGALMFSHVNDAGFWMVKEYLGLTVKETFKTWTVLETLLSFIAFGGVLLLDMFV

SEQ ID NO: 3124 - DNA, 1359 bp, Bacillus cereus
  CDS (1)..(1359)
atgggagaaatggtagttgggatcgtactagcggcagttgtcatactacttttacttattacggtagtaaaatggcatccatttgtcgcattaattttaacagcaattggtgtaggattagcaatgggaatgcctttaattggaacttcaccaaaagatccagggattattgattctattaaactagggcttggtaatacattagggtttttagcaatagttttagcactaggaacgatgcttggaaaaatgatggccgaatctggtggtgctgaacgtatcgctaacacattaattaatcgttttgggaagaaacgagttcactgggcgatgatgttcgttgcatttttagtagggattccggtatttttccaagttggatttgtactattaattccgttagtatttacaattgcgttagaaactggggtatcacttattacaattggtattccgctagtagcaggactgtcagtcgtacacggacttgttccaccgcatccagcggcaatggcggcagttggtatttttaaagcagatgtggggaagacaattttatatgcgttaattgtcggacttccaactgcaattatttcaggtccactttacgggaaatggattggtgctcgtatacataaggaagtaccattagatatagcggagcaatttgttgaaaaagataataaaaaagagcttcctagcttttggaatacattgtttacaattttacttccagtatttcttatgcttggtgcatcaatagcagaagttgcattaaataaaacgagtcaactagcacaagtattacactttattggagatccgattgtggctttattaattgcaaccatttactctttctttagtcttggatatgcaaaaggtttctcaaaagataaagtgttacaatttacaaatgattgccttggacctattgcaaacatattgttagtgattggtgcaggcggcgcatttaataaagtattattagattctggaattggaacgacaattgcagatatggcgaaagaatcacatatttcaccgatattattagggtggggaattgcggcactaatccgaattgcaactggatcggcaactgtttctatgatgacagcagctggtattgttgcgccgattgcagcaagcacaccaggtgtaaatgttgaattattagcacttgcaactggtgcagggtcattaattttatcacacgtgaatgattcaggattttggatgattaaagagtatttcggaatgactgtgaaagaaacattattaacatggactgcaatggagactatattatctgtagtagcacttgggctaatttcgatattaaatatatttgtatag

SEQ ID NO: 3125 - protein, 452 aa, Bacillus cereus
MGEMVVGIVLAAVVILLLLITVVKWHPFVALILTAIGVGLAMGMPLIGTSPKDPGIIDSIKLGLGNTLGFLAIVLALGTMLGKMMAESGGAERIANTLINRFGKKRVHWAMMFVAFLVGIPVFFQVGFVLLIPLVFTIALETGVSLITIGIPLVAGLSVVHGLVPPHPAAMAAVGIFKADVGKTILYALIVGLPTAIISGPLYGKWIGARIHKEVPLDIAEQFVEKDNKKELPSFWNTLFTILLPVFLMLGASIAEVALNKTSQLAQVLHFIGDPIVALLIATIYSFFSLGYAKGFSKDKVLQFTNDCLGPIANILLVIGAGGAFNKVLLDSGIGTTIADMAKESHISPILLGWGIAALIRIATGSATVSMMTAAGIVAPIAASTPGVNVELLALATGAGSLILSHVNDSGFWMIKEYFGMTVKETLLTWTAMETILSVVALGLISILNIFV

SEQ ID NO: 3126 - DNA, 1326 bp, Bacillus anthracis
  CDS (1)..(1326)
atgaacatgtaccttttaatgattacattattatcaattgtaattgttattttaggggtatcgtggtggagatggcatgcgtttattagtttaacgattgcaagtttgtttttagctattatgtctggaatgccaatggataaaatagtgagtgcttatgaaacgggagtcggaagtgttcttgggcatttagtaggtattttagtattaggtacaattttagggaaaatgatggcagagtcaggtgctggaatgcaagtggcagagttctttattaaatccttcggaataaaaaacttaccatgggcgatgttaattgcgggttttattattggaattccagtattttttgaagtaggcattttaatattattgccgttagtaatttctattcataaaacaacgaaacaaaatattttattgatagcattaccagcaattgctgggttatctgtcgtacacggccttgttccttcgcatccaggggcaatcgttgcaataggtatttataaagcgaatcttgggaaggtattattgtattcactcattattacattttttgcagcgattattgcaggtcctatattcgctaaatggattcacaaacgtgtaattcctgaaaatgagccagaattgattcgtgtaaatacaaaatcaacgaaattaccaggaataggagtttcgtttttagttatattgttacctgtaatgttaatggtgttagcagcagcagctccttatgttccgctttctactaccttgatgaagattgtcacattaatcggtagtcctatcattgcacttttgattgcatgttttgcagcgttttattttcttggatttcgtcaaggtatcgataaaaaggcgattaagaaggtaacagaagatagcttattaccaatcggttcaattgttgcgattattggtgctggcggcggatttaagcaaattcttatcgatagtggtgtagggaatgctattgctcaaatgtctgaacatttagcgctatctccaattgtattagcatttatggtagctggattaattcgaattgcgacagggtcagcgacagtcgccttaacaacagcagcgggtatcgtttcgccaatcgttgaaaatacgacaggtgtgaatttagaattactcgtcattgcaacgggtgcaggagcattaatgttttctcacgtaaacgatgctgggttctggatggtaaaagaatacctaggtttaacagtgaaagaaacatttaaaacatggacagtattagaaacattactttcatttatcgcttttggaggagttttactactcgatatgtttatttaa

SEQ ID NO: 3127 - protein, 441 aa, Bacillus anthracis
MNMYLLMITLLSIVIVILGVSWWRWHAFISLTIASLFLAIMSGMPMDKIVSAYETGVGSVLGHLVGILVLGTILGKMMAESGAGMQVAEFFIKSFGIKNLPWAMLIAGFIIGIPVFFEVGILILLPLVISIHKTTKQNILLIALPAIAGLSVVHGLVPSHPGAIVAIGIYKANLGKVLLYSLIITFFAAIIAGPIFAKWIHKRVIPENEPELIRVNTKSTKLPGIGVSFLVILLPVMLMVLAAAAPYVPLSTTLMKIVTLIGSPIIALLIACFAAFYFLGFRQGIDKKAIKKVTEDSLLPIGSIVAIIGAGGGFKQILIDSGVGNAIAQMSEHLALSPIVLAFMVAGLIRIATGSATVALTTAAGIVSPIVENTTGVNLELLVIATGAGALMFSHVNDAGFWMVKEYLGLTVKETFKTWTVLETLLSFIAFGGVLLLDMFI

SEQ ID NO: 3128 - DNA, 1347 bp, Bacillus anthracis
  CDS (1)..(1347)
atgccattagtcattgtagcaattgggattttagcattacttttactgattatgcgctttaaattaaatacctttatttcattaatcattgtatccgtcggggttgctttagcacttggaatgccaccagaaaagatttttaaaaccattgaagcgggattaggcggaacacttgggcacttagcactcgtttttggacttggtgcgatgttaggtaagttgctttcagattctgggggtgcacaacgcattgccatgacccttgtgaaaaaatttggtgaaaagaacattcaatgggctgttgtgactgcctcatttattatagggattgcattattttttgaagtaggattagtattattaattccgattgtatttgcaatttcaagagaattaaaagtttctatcttatatctcggtatctcgatggcagctgctttatctgtaacacacggatttttaccaccacacccaggaccaactgctatcgctggtgaattgcatgcaaacatcggtgaagtattactttacggttttatgatagcggttccaacggttgtgttagctggacctgtatttactaaacttgcaaaaaaactagtacctgaggcgttcacaaaaaccggtaatatccaatcattaggtgagcagaaagtatttaaacttgaagaaactcctggttttggaatcagtgtttttaccgctttactgcctgttcttttaatggcagtcgctacaattattactttgttgcaaaaaacaatgggattcaaagataatagtttactagcaacgatcgagtttattgggaatgcggatactgccatgttgatatccttactagttgcgatctatacaatgggattggcaagaaatattccaatcaaaagcgtgatggaatcttgtacaacagcgatctcgaatattgggatgatgctcttaattattggtggaggcggcgctttcaaacaagtattaattgatggcggcgttggtaactatgtagccgaattattcaaaggaacttcattatcaccgatcttgctcgcatggattatcgctgccatcttacgtatttcattggggtctgctacggttgctgcattaacaactgtcggtttagtgattccgatgttaggtcaatctgatgttaaccttgctttagttgtccttgcaacaggggctggtagtttaattgcttcacacgtgaacgatgctggtttctggatgttcaaagagtactttggtttaagcatgaaagaaacatttgcaacatggactttacttgagactatcgtttctgtagccggattaggatttactttattattaagtttatttgtatag

SEQ ID NO: 3129 - protein, 448 aa, Bacillus anthracis
MPLVIVAIGILALLLLIMRFKLNTFISLIIVSVGVALALGMPPEKIFKTIEAGLGGTLGHLALVFGLGAMLGKLLSDSGGAQRIAMTLVKKFGEKNIQWAVVTASFIIGIALFFEVGLVLLIPIVFAISRELKVSILYLGISMAAALSVTHGFLPPHPGPTAIAGELHANIGEVLLYGFMIAVPTVVLAGPVFTKLAKKLVPEAFTKTGNIQSLGEQKVFKLEETPGFGISVFTALLPVLLMAVATIITLLQKTMGFKDNSLLATIEFIGNADTAMLISLLVAIYTMGLARNIPIKSVMESCTTAISNIGMMLLIIGGGGAFKQVLIDGGVGNYVAELFKGTSLSPILLAWIIAAILRISLGSATVAALTTVGLVIPMLGQSDVNLALVVLATGAGSLIASHVNDAGFWMFKEYFGLSMKETFATWTLLETIVSVAGLGFTLLLSLFV

SEQ ID NO: 3130 - DNA, 1488 bp, Streptomyces avermitilis
  CDS (1)..(1488)
atgatctcgtatccgctcgcagcgacggccccggccacccccgagacgccaccccacaccggcggcctgctcctgctcatggacggcaccgcgggcctgctcacggtcgccgccctcggaatcgccctcctcctgatcctgatcatcaaggtcagactccagccgttcgtcgccctgctcgccgtctccatagccgtcggcctcgcggccggactgtcggtcaccgaactcttcggcacggtccagcggtccaccgcggtgtcggtcgtcgaaagcggcatgggcggcatcctcggccatgtggcgatcatcatcggcctgggcacgatgctcggcgcgatcctcgaagtcagcggtggcgccgaggtgttggcgacccggctgctgaacctcttcggtgagcggcgtgccccgctcgccatgggcctgaccggcctgatcttcggtatcccggtcttcttcgacgtcggcatcttcgtcctcgcgccgatcgtgtacgcggccgccaagcgctccggcaagtcgatcctcctctactgcctgccgctgctggccggcctgtcgatgacccacgcgttcctgccgccgcaccccggcccggtggccgcggccggcctcctgcacgtgcagctcggctgggtcatcctgatgggcgtcgtctgcggcatcccggccgtgctcgccgcctgggtctactccgcctggatcggcaggcggatcttcgtcgccgtaccgcaggacatggtcgaggcggcggccgaggccaagctggccgtcatcgaggaacagcgcgcgcagggtgtcgagccgcgtgaggagcccgtccccctcggcacggtcctcggcatcatcggtacgccgctggtgctgatcctggccgccaccttctcctcgatcgccctcgacccctccacgctccgctcggtcatcgagttcttcggcagcccgttcgtcgccctcaccatcgccctgctgctcgcgtactacctgctcggcatccggcgcggctggtcccgcaagtccctggagacggtgtcgacttcgtccctcaagccggtcggcaacatcctgctcgtggtcggcgcgggcggcatcttcggggccgtcctgaaggccagcggcgtcgcccaggcgctctccgacaccttcaacgacgtcggcctgccggtgatcgtcctctcgtacctgatctccgtggtcctgcgggtcgcccagggctcggcgacggtcgccatcgtcacgacggccgggatcgtggcgcccctgctcgccgcgggcgaccactcccaggccttcgtcgccctggtcatcatggccatctcggcgggctccatcttcgcctcgcacgtcaacgacggcggcttctggatggtgtcgaagtacttcggcatcagcgagcgggacacactcaggacgtggaccgtgctggagtcggtgctgtccgtcgccgggttcgcggtggcggcggtggtgagcacgttcgtctag

SEQ ID NO: 3131 - protein, 495 aa, Streptomyces avermitilis
MISYPLAATAPATPETPPHTGGLLLLMDGTAGLLTVAALGIALLLILIIKVRLQPFVALLAVSIAVGLAAGLSVTELFGTVQRSTAVSVVESGMGGILGHVAIIIGLGTMLGAILEVSGGAEVLATRLLNLFGERRAPLAMGLTGLIFGIPVFFDVGIFVLAPIVYAAAKRSGKSILLYCLPLLAGLSMTHAFLPPHPGPVAAAGLLHVQLGWVILMGVVCGIPAVLAAWVYSAWIGRRIFVAVPQDMVEAAAEAKLAVIEEQRAQGVEPREEPVPLGTVLGIIGTPLVLILAATFSSIALDPSTLRSVIEFFGSPFVALTIALLLAYYLLGIRRGWSRKSLETVSTSSLKPVGNILLVVGAGGIFGAVLKASGVAQALSDTFNDVGLPVIVLSYLISVVLRVAQGSATVAIVTTAGIVAPLLAAGDHSQAFVALVIMAISAGSIFASHVNDGGFWMVSKYFGISERDTLRTWTVLESVLSVAGFAVAAVVSTFV

SEQ ID NO: 3132 - DNA, 1353 bp, Vibrio parahaemolyticus
  CDS (1)..(1353)
atgaaccttatattaatcctgctcggggtgatcgcatttattgtgctcacgaccaccaaattcaaattacatccctttttagcgctgatcatcgcggcgttccttgcggcatttgcttacggcttaccggcagatagcattgccaaaaccattgcttctggctttggcggcatccttggttacattggcttggttatcgttttaggtaccatcatcggtgttattttggagaaaagtggtgcggcgatcaccatggccgatacggttattaaagtgttgggtgagcgtttcccaacattgaccatgagcatcatcggttacatcgtttctgttccggtattttgtgattcaggctttgtcattctgaactcgctaaaagaatcactcgcgaagcgtttaaaaacctcaagcgttgcgatgagtgtagcgttggctactggcctatacgcgacgcacacgtttgtgccgccaactcctggcccgattgccgctgcgggtaacttaggcctggaatctaaccttggtttagtgattggtgtgggtgtgtttgttgcagcggttgcggcgttagcgggtatgttgtgggcgaaccgattccaacatgttgaaccagatggcattgaagccgcagatgaaattcagcatgactggcaagcactcaaagcgtcttacggcaaattgccaacggcgagccaagcattcgctcctatttttgttccaatcttattgatctgttttggctctatcgcgaaattcccaagcctaccgctgggcgaaggttttgtgtttgatgttctgactttcttaggacagccactaacggcattggtgattggcctattcctttctgttcgcctactcaaatcagacaacaagattgaagaatttggcgagcgaatcagccaaggtattacggctgctgcgcctattcttttgattaccggtgcgggtggtgcatttggcgcggtattaaaagcaacgccgctaggtgaatacttgggtacgacgctatcggcgctgggcgtgggtattttcatgccatttatcgttgcggctgcgctaaaatcggcgcaaggttcgtcaacggttgcactggtgaccacatcggctttggttgcgcctatgcttacgcaattggggctagattcagaaatgggccgcgtattaacggtgatggcgatcggtgcaggtgcgatgacggtttctcatgcaaacgacagcttcttctgggtagtttcgcagtttagccgcatgtcagtgggcttagcgtaccgcgcgcaaaccatggctacgctcgttcaaggtgtcacggcaatggcattggtgtacattttgagtctcgttctcttataa

SEQ ID NO: 3133 - protein, 450 aa, Vibrio parahaemolyticus
MNLILILLGVIAFIVLTTTKFKLHPFLALIIAAFLAAFAYGLPADSIAKTIASGFGGILGYIGLVIVLGTIIGVILEKSGAAITMADTVIKVLGERFPTLTMSIIGYIVSVPVFCDSGFVILNSLKESLAKRLKTSSVAMSVALATGLYATHTFVPPTPGPIAAAGNLGLESNLGLVIGVGVFVAAVAALAGMLWANRFQHVEPDGIEAADEIQHDWQALKASYGKLPTASQAFAPIFVPILLICFGSIAKFPSLPLGEGFVFDVLTFLGQPLTALVIGLFLSVRLLKSDNKIEEFGERISQGITAAAPILLITGAGGAFGAVLKATPLGEYLGTTLSALGVGIFMPFIVAAALKSAQGSSTVALVTTSALVAPMLTQLGLDSEMGRVLTVMAIGAGAMTVSHANDSFFWVVSQFSRMSVGLAYRAQTMATLVQGVTAMALVYILSLVLL

SEQ ID NO: 3134 - DNA, 1377 bp, Vibrio parahaemolyticus
  CDS (1)..(1377)
atggagcaattaacccaagccccagatcctacgttcctactgacgattgcaggccttgccattgcagcgttactcgttctgatcattaaactgaaagtccatgcttttgcttcccttactatggtgagtttaggcacagcaatcgccactggcgttccttctgagaaagtcgtatcgaccatgatgggcggcttcggcggcacactggcttccgtggcattgctggttggtcttggtgcgatgatcggtaaaattcttgaagtgactggcggtgcgaaagtgctggcagacactttgattggtcgctttggtaaagagcgcgcaccatttgctttgggcgtcgcttcattactgtttggcttcccaatcttcttcgatgctggccttgtagtgatgatgccaatcatcctaagtgtggcggctcgttttggtggctcaccaattaaatacgcgttgcctgcagctggtgcttttgcggttatgcacgcgtttgttccaccacacccaggtccggttgcagcggcagaattccttggcgcaaacatcggtctgctattggtggtgggtattttggttgctattccaacttggtaccttggcgcttacctatttggtttgtacgcgggcaaaaaattcgatatcccactatctaaagccttctttaatggcgaagcaatggtggatgagcgcaacgcaccaaaatttggcacggttatgaccatccttgtgctgccagtcctgctaatctgtttggatacggtattgaacacactggcggttgcaggtttgattgatggcaaaacggcactggttgagttcctacgtatgctaggtaaaactccagtcgcgttgctgattactttgattgtctgtctggctgtgtttgccaaagactacggcatggcaaaactagaaaaattgtgtggtgagtcattggctccaatctgtggcgttatccttgtaacgggtgctggtggcatgtttggcggcgtactgcgttcaagcggcatcggtgatgcactggctgacgttcttacagacacaggtatgcctgtgattgtggcggcgtttgtgatttcaacctgtttgcgtgttgctcaaggctcggcaaccgtagcgctaaccactacggcggctcttatcgcgccagttgtggctgcatcaacaggtttgagtgaactagacctttgctttatcgtaatcgcgattgcgggtggtgcaacggtactgtctcacttcaatgactctggtttctggttggtatctcgtctgcttgagatggatgagaaaaccacattaaaaacttggacggtaatggaaacgttacttggcggtatcgcgtttattatcgtcgcaacattaagctttattctttag

SEQ ID NO: 3135 - protein, 458 aa, Vibrio parahaemolyticus
MEQLTQAPDPTFLLTIAGLAIAALLVLIIKLKVHAFASLTMVSLGTAIATGVPSEKVVSTMMGGFGGTLASVALLVGLGAMIGKILEVTGGAKVLADTLIGRFGKERAPFALGVASLLFGFPIFFDAGLVVMMPIILSVAARFGGSPIKYALPAAGAFAVMHAFVPPHPGPVAAAEFLGANIGLLLVVGILVAIPTWYLGAYLFGLYAGKKFDIPLSKAFFNGEAMVDERNAPKFGTVMTILVLPVLLICLDTVLNTLAVAGLIDGKTALVEFLRMLGKTPVALLITLIVCLAVFAKDYGMAKLEKLCGESLAPICGVILVTGAGGMFGGVLRSSGIGDALADVLTDTGMPVIVAAFVISTCLRVAQGSATVALTTTAALIAPVVAASTGLSELDLCFIVIAIAGGATVLSHFNDSGFWLVSRLLEMDEKTTLKTWTVMETLLGGIAFIIVATLSFIL

SEQ ID NO: 3136 - DNA, 1350 bp, Pseudomonas syringae
  CDS (1)..(1350)
atgtcgccgtcacccggtatttcgctgttggtctacgccgctgtcgcaatcattgccttgatcgtgctgatcgcgcggtatcggctcaatccatttattgtcattacgcttgtttcggtcgggctggcgctggttgcagggatgccggccagtggcgtggttgcctcttatgaggccggggttggcaaaacgctggggcatatcgcgctggttgtggcgctgggcaccatgcttggcaagatgatggccgagtccggcggggccgagcaggtggcgcgcacgctgattgaccgctttggtgagcgtaatgcgcactgggccatggtctgtattgcgtttctggtcggcttgccgctgttttttgaagtgggttttgtgctgctggtgccgattgcgtttaccgtagcgcgtcgtgtcggggtgtcgattctgatggtcggcctgccgatggtggccggtctgtcggtggtacacgcgctggtgccgccgcaccctgcggcgatgctggccgttcaggcttatcaggcgtcggtggggcagaccctgttttacgccattctgatcggcatacccacggcaatcattgcagggcccgtgtatgccaaatttatcgtgccgcgcatccatttgccggctgaaaacccgctggcgaagcagtttctcgaccgggaaccccgtgcaaagctgcccagcttcggcctgaccatggcgaccatcctgttgccggtggtgctgatgttgttgggcggctgggcgaacctgatcagcgcgccgggcagcgcgttcaatggctttctgttgttcatcggcaactcggtgatcgctctgctgctggccactttgctgagcttctggacgctgggcatcgctcaaggattcaatcgcgactcgattctgaaattcaccaatgagtgcctggcacctaccgccagtatcaccttactggtcggcgccggtggcggtttgaaccgtattctggtcgacagcggcgtgaccaaccagatcgtcggtctggcgcaggactttcatctgtcgcccttgctgatgggctggctgttcgcagcactgatgcgtgtggcgacgggctcggcgacggtggcgatgaccaccgcatcggggatcgttgcgcctgtggcaatgggcctgggttacccacatcccgagttgctggtgctggcgacgggcgcaggctcggtaatcttttcccacgtcaacgacggcggtttctggcttatcaaggaatacttcaacatgaccgtagcgcaaacattcaagacctggacggtactggagacgctgatttccgttgtcgcctttgccttgacgcttggcctggcgcaggtgctctga

SEQ ID NO: 3137 - protein, 449 aa, Pseudomonas syringae
MSPSPGISLLVYAAVAIIALIVLIARYRLNPFIVITLVSVGLALVAGMPASGVVASYEAGVGKTLGHIALVVALGTMLGKMMAESGGAEQVARTLIDRFGERNAHWAMVCIAFLVGLPLFFEVGFVLLVPIAFTVARRVGVSILMVGLPMVAGLSVVHALVPPHPAAMLAVQAYQASVGQTLFYAILIGIPTAIIAGPVYAKFIVPRIHLPAENPLAKQFLDREPRAKLPSFGLTMATILLPVVLMLLGGWANLISAPGSAFNGFLLFIGNSVIALLLATLLSFWTLGIAQGFNRDSILKFTNECLAPTASITLLVGAGGGLNRILVDSGVTNQIVGLAQDFHLSPLLMGWLFAALMRVATGSATVAMTTASGIVAPVAMGLGYPHPELLVLATGAGSVIFSHVNDGGFWLIKEYFNMTVAQTFKTWTVLETLISVVAFALTLGLAQVL

SEQ ID NO: 3138 - DNA, 1458 bp, Pseudomonas syringae
  CDS (1)..(1458)
atgacgccgctcatgttgatggtcgtggccggtgcgggcatcgcactgctgttgtttctggtgctcaagtataaatttcagccgttcgttgcgttgatgctggtcagcatcatcgtggcgctggtcgccggtgttaagccggcagatctggtggcaaccattgaaggcggcatgggcaagaccctcggccacatcgcgatcatcatcgccctgggcgcgatgatcggacgcatcatcgagctgtcgggcggggccgaagcactggccaagacgctgatcaaccgtttcggcaacaggcgcacgccgctggcgctgaccgttgccggcttcatggtgggtattccggtgttcttcgaggtcggcgtgatcattctcatgccgttggcctacggcgtggcccgtgcggcgcgcaaaccgctgctgattttcgcgctgccgatgtgtgctgcgttgctggcggtgcatgcgttcctgccgccacaccctggcgccgttgctgcggccagccagttgggcgcggacctgggtcgtgtgttgatgctgggtatcccgattgtcgcggtgctgtgcatgatcggctacttcgtggcaggccgcatgactcgcaagacctacccgatgaccgatgatattcgcgcagaagtctacggcccgcatgtcaccaacgaagacctggaagcttgggcgcgcaacgattattccggcgcgcgtgaagccaccgaaaccaaaaccctgggcgcggaagaaagcgccagcagcctggcgagcaaactgcctccagcgcctgcaccgggtttcgggctgatcattgcgctgattctgctgccgatcgtgctgatcctgatgggcacgctggccaccactttgctgcctgcgacgtccacgctgcgtgcagtgctgacggttctcggcgcgcctctggtggcgctactgatcgacacactgctgtgcgcctggctgctgggttcgcgtcgtggctggagccgcacgcaggtgtccgacgtaatcggctctgccttgccgggtgtggcgatggttatcctgattgccggtgccggtggcgtgttcggcaaggtgctggtggataccggtatcggtgcggtggtttccgaggcgttgcgcaataccggtttgccggtgctggcgctgggctttctgctgacgctgttgctgcgcgcggtgcagggctcgaccaccgttgcgctggtgaccactgccggcattctcagcccgctgatcgccacgctggacctgagcgccaaccacttggctctgttgtgtctggcgatgggcggtggcggtctggccatgtcgcacatcaacgatgccggttactggatgttcaccaagctggcgggcctcaacgtcgccgacggcttgcgcacctggaccgtactggtcacgctgctcggcacgctgggctttgtgatcaccctgctgctttggccattcgtctga

SEQ ID NO: 3139 - protein, 485 aa, Pseudomonas syringae
MTPLMLMVVAGAGIALLLFLVLKYKFQPFVALMLVSIIVALVAGVKPADLVATIEGGMGKTLGHIAIIIALGAMIGRIIELSGGAEALAKTLINRFGNRRTPLALTVAGFMVGIPVFFEVGVIILMPLAYGVARAARKPLLIFALPMCAALLAVHAFLPPHPGAVAAASQLGADLGRVLMLGIPIVAVLCMIGYFVAGRMTRKTYPMTDDIRAEVYGPHVTNEDLEAWARNDYSGAREATETKTLGAEESASSLASKLPPAPAPGFGLIIALILLPIVLILMGTLATTLLPATSTLRAVLTVLGAPLVALLIDTLLCAWLLGSRRGWSRTQVSDVIGSALPGVAMVILIAGAGGVFGKVLVDTGIGAVVSEALRNTGLPVLALGFLLTLLLRAVQGSTTVALVTTAGILSPLIATLDLSANHLALLCLAMGGGGLAMSHINDAGYWMFTKLAGLNVADGLRTWTVLVTLLGTLGFVITLLLWPFV

SEQ ID NO: 3140 - DNA, 1353 bp, Pseudomonas syringae
  CDS (1)..(1353)
atgttcggtatgacccatgagacgttcctgctcgtcgatgcgttggtgaccatcgtcggccttgtgctactgatcaccaccttcaaggttcaccctttcgtcgcgctgacactggcggcaggctttcttggcctgacgtcgggaatgccagtagaaaaagtcatgaagtccttccaggagggcttcggcggcgtgctgggtttcgtcggtatcatccttggcctgggcaccatgctcggcaagctgatggccgattcggggggtgcggaccagattgcgcagaccctgatccgcacctttggtaaacagaaagtgcattgggcaatgatgttctccgcgtttctggtgggcatcccgctgttcttcgagatcggttttgtgctgctgatcccgctggtgttcatcgtcgcccgtcgtaccggcgtgtccatcgtcaagatcggcatcccgttgctggctggcctgtcggccgtacacggcctggttccaccgcacccgggcccgctgctggccatcggcatttttggtgctgatatcggcaagaccattttttatggcctgatcgtcgcgctgccaaccgccatcatcgcgggtcccatctacggcaactggatctccaagcgcatccccggtacgccgtcgcaggagttgatggaccagatcgccaaggagtcgagcactgaaaacctgccgggctttggcatcacgctgatcaccatcctgctgcctgtgttcctgatgctgctcaagacctttgctgacgtggtgttgccggaaaacaacatgttccgcatctggatggacctgatcggtcacccgatcactgccctgctggcagcgctgttgctggcgttctacacctttggtgcggcacgcggctttgaccgcaccaaaatcatgaaactgctggaccagagccttgcaccggttgcagccatcgtcctgatcgtcggcgcaggtggcggcttcaagcagatgctggtggccagcggtgtgggtgatgtcatcgggcacatggccgtacaggcacagatcaacccgatcatgctggcttggctggtggcggcggtgattcgcattgcgactggttcggctaccgtggcgaccattaccggtgcagggattgtggcgccagtggttggcctgattccaggcgtcaatcgcgagctgctggtgctggccacgggtgccggctcgttgatcctgtcgcacgtcaacgatgccggtttctggctggttaaacagtatttcaacatgaccgttgccgaaacgttcaagacctggacagtgatggaaaccatcctgtcggtggtcggcctgatcttcatcatgctgttgtcgatggcactttaa

SEQ ID NO: 3141 - protein, 450 aa, Pseudomonas syringae
MFGMTHETFLLVDALVTIVGLVLLITTFKVHPFVALTLAAGFLGLTSGMPVEKVMKSFQEGFGGVLGFVGIILGLGTMLGKLMADSGGADQIAQTLIRTFGKQKVHWAMMFSAFLVGIPLFFEIGFVLLIPLVFIVARRTGVSIVKIGIPLLAGLSAVHGLVPPHPGPLLAIGIFGADIGKTIFYGLIVALPTAIIAGPIYGNWISKRIPGTPSQELMDQIAKESSTENLPGFGITLITILLPVFLMLLKTFADVVLPENNMFRIWMDLIGHPITALLAALLLAFYTFGAARGFDRTKIMKLLDQSLAPVAAIVLIVGAGGGFKQMLVASGVGDVIGHMAVQAQINPIMLAWLVAAVIRIATGSATVATITGAGIVAPVVGLIPGVNRELLVLATGAGSLILSHVNDAGFWLVKQYFNMTVAETFKTWTVMETILSVVGLIFIMLLSMAL

SEQ ID NO: 3142 - DNA, 1353 bp, Pseudomonas putida
  CDS (1)..(1353)
atgttcggactggctactgataccttcctgctgctcgacgcgctggttaccatcgtcgggctgatcctgctgatcacccacttcaaggttcaccccttcgtcgccctcaccctcgcggccggcttcctgggcctgacttccggcatgccggtggccaaggtcatgaaatcgttccaggacggttttggcggcgtactcggcttcgtcggtatcgtgctcgccctgggcaccatgctcggcaagctgatggccgactccggtggtgccgaccagatcgcgcaaaccctcatccgcgccttcggcaagaagaacgtgcattgggcgatgatgttcgccgccttcctggtgggcatcccgctgttcttcgaaatcggctttgtgctgctgattccactggtgttcatcgtcgcccggcgctcgggcgtctcgttggtgaaaatcggcattccgctgctggccggcctgtcggtggtgcacggtctggtgccaccacacccgggccccttgctggcgatcggcattttccacgctgacattggcaagaccatcttctacggcctgatcgtcgcactgcccaccgcgatcatcgccggccctctgttcggtaacttcatttcccgctacatcccgggcaacccgtcccaggagctgatggaccagatcgccaaggactccgatcagggcaacctgccaagcttcagcattaccctggtcactgtactgctgccggtcgcgttgatgctgctgaaaacgttcgccgacgtggtgctgcctgccgagcacatcgtgcgccagtggatggacctgatcggtcacccgatcaccgccctgctcgccgccctgttactggccttctacaccttcggctcggcccgcggcttcaaccgccagcagatcatgaagatgctcgaccagagcctggcaccgactgccgccatcgtgctgatcgtcggcgctggcggtggcttcaagcaaatgctggtggataccggcgtaggcaacgtgatcgggcagatggctgtccaggcagaaatttcgccgatcatgctggcatggctggtggcggcggtgatccgcatcgcgaccggctccgccacggtcgccaccatcaccggcgcgggtatcgtggcaccggtgatcgacctcgtgccgggggtgaaccgtgagctgttggtactggccaccggtgccggctcgctgatcctgtcgcatgtgaacgatgccggtttctggctggtgaagcagtacttcaacatgaccgtggcagaaaccttcaagacctggagcatgatggagacgatcctgtccatcgtcggcatcattttcatcatgttgctgtcgctggtggtgtag

SEQ ID NO: 3143 - protein, 450 aa, Pseudomonas putida
MFGLATDTFLLLDALVTIVGLILLITHFKVHPFVALTLAAGFLGLTSGMPVAKVMKSFQDGFGGVLGFVGIVLALGTMLGKLMADSGGADQIAQTLIRAFGKKNVHWAMMFAAFLVGIPLFFEIGFVLLIPLVFIVARRSGVSLVKIGIPLLAGLSVVHGLVPPHPGPLLAIGIFHADIGKTIFYGLIVALPTAIIAGPLFGNFISRYIPGNPSQELMDQIAKDSDQGNLPSFSITLVTVLLPVALMLLKTFADVVLPAEHIVRQWMDLIGHPITALLAALLLAFYTFGSARGFNRQQIMKMLDQSLAPTAAIVLIVGAGGGFKQMLVDTGVGNVIGQMAVQAEISPIMLAWLVAAVIRIATGSATVATITGAGIVAPVIDLVPGVNRELLVLATGAGSLILSHVNDAGFWLVKQYFNMTVAETFKTWSMMETILSIVGIIFIMLLSLVV

SEQ ID NO: 3144 - DNA, 1389 bp, Pseudomonas putida
  CDS (1)..(1386)
atgactcccttagatatacagctattactgacggcattggccagtgttctggtgctggtggcgctcatcgtttcgcgcctgaaaatgcacccgctgctggccttgctggtggtgtccattggcgtgggcttcgcgacgcatatggcgccaggcagcatcgtctcccacctgctcaccggcgccggcaagacactgggcgcagtgggggtggtgattgcgctgggtgcgatgctcggcaagatcctggctgacgctggcgtcacggagcaggtcgcggatgtcatcctcaagcgcacccccgaccgcatgatcccttgggccatgatgctggttgcctttgtcattggcatccccatgtttttcgaagtcggcctggtgatcatgctgccgctgatattcagcgtggcgcgcaaactggaaagcaaggcgcgcttcaaaggctcggcgtacgtgtatgtaggtgtgccggtcatttcggcgcttgccgccatgcacggcatggtaccgccgcacccaggccccctgaccgccattgccgtgctcaagacctcggtggggcccaccatgctctatggcttccttgccgccattccggcaatgatcctgggcggcccgctgtacggcatgttcatttcaccgcgcatgaacacgcggcccgatcaggcattgctggaccagttcacactggctgaaaaagccgatggccaaccccgccccggggtaatggtcggcatgctggccgcattgctgccggccatcctgatgctggtgcatgccgtcgccgagatgctgctgcccaaaggcaatgcgctgctggagatggccagcttcctgggcaacccgctgatcgccatgctgctgggcgtgctgttcgccggcgccagcctggtgcttgcgcgcggcggcgacgccgaacagctgcgcgatgcactgggcaaaagcctcaagccgatcgcctcgatcatcatgatcattgccggtggcggtgcctttcaagagatgctgaccagcgccaaggtaggcgatgccattgtgcacctgacccagcaatctgccttccctcccctgattctggggtggctgatcgcgatgctgctctcggtgtctaccggttccgccacggtcggtatcgtaggggctgccggcttgctggcgccgctggcaggtgcagacccaagccttaacctgcctttgctggccctgtccatcggctgcggttcgctgttcttcaactatgcgaaccatgcaggcttctggatggtgaaagaatcctttggcatgaccatgggcgaagccaccaagaccatttcggtggtgcagtccatcgtggcggtggttgggctgatggtggtgttgatgttgaatgcggccatcaccataggttgatag

SEQ ID NO: 3145 - protein, 461 aa, Pseudomonas putida
MTPLDIQLLLTALASVLVLVALIVSRLKMHPLLALLVVSIGVGFATHMAPGSIVSHLLTGAGKTLGAVGVVIALGAMLGKILADAGVTEQVADVILKRTPDRMIPWAMMLVAFVIGIPMFFEVGLVIMLPLIFSVARKLESKARFKGSAYVYVGVPVISALAAMHGMVPPHPGPLTAIAVLKTSVGPTMLYGFLAAIPAMILGGPLYGMFISPRMNTRPDQALLDQFTLAEKADGQPRPGVMVGMLAALLPAILMLVHAVAEMLLPKGNALLEMASFLGNPLIAMLLGVLFAGASLVLARGGDAEQLRDALGKSLKPIASIIMIIAGGGAFQEMLTSAKVGDAIVHLTQQSAFPPLILGWLIAMLLSVSTGSATVGIVGAAGLLAPLAGADPSLNLPLLALSIGCGSLFFNYANHAGFWMVKESFGMTMGEATKTISVVQSIVAVVGLMVVLMLNAAITIG

SEQ ID NO: 3146 - DNA, 1356 bp, Lactobacillus plantarum
  CDS (1)..(1356)
atgccatttgttgttcttacactcggcatcctactactattactattaattattaaattcaagctgaatacttatattgcactgattgttacggccgtcgtcgtcggaatcggactagggatgccattaactaagattgctactagtattcagaacgggattggcagtcaactgggtgagttagcactagtcttcggcttcggtgccatgctcggccgcttagtagccgatgctggtggtgcttacacgatttccacgacactattggatattttcgggcgcaaacggctacaaattgccatcgtagtcgcctcatttatcatcgggattgccctcttcttcgaagttgggatcgtcttgttgattccaatcgtctttgccattgcgatcgaagcacaagttcccgttctctatctggggattcccatgggcgccgcattatctgttactcacggattcttaccaccgcacccggcaccaactgcaattgcgacgacgctaaatgcgaacgtgggtcatgtgctactattcgggatcattattgcgattccaactgtttatatcgcaggaccgctcttttcacgctgggcgcaaaagatggttcctgacgcattcaccggtaaaccacacctgccacttagcagtaacaaacgtcaattcaaagtatctgaagcacccgggtttggactcagtgtcttaacggcgctcttccccgtgattctgatgacaatcaccaccgtctacgaattagtcgttgatcacggtgtgacacctaaaaacccgtcgacccttgaccaaatcattcgtttgattggggcacccggaattgccatgttaatttcactattattcgccctctggtcaatggggattcaccaacacaagaccaataaggccatcacggccaccatcgaagatgccactaagtcaattgccatgttattactaatcatcggtgggggtggcgccttcaaacagatcttaattgatgggggtgttggtaaggccgtggcccagttgttcagtggcagcagcatctcaccactgattcttggctggctagtcgctgtcatcttacgggtctcactcggctccgctaccgtagcggccctcacggcagccggcctagttgcgccgttaatgacgcaagctggtatcgaccccgccctgatggtaattgccatcggctctgggagtgtcgccgcttctcacgtgaacgacgctggtttctggatgttccgggaatacttcgacctgaccgtcaagcaaacgctgcttacatggacaatgttagaaacgatcatcgctgtctgcggtctcggaggcgtgttggcgctcaacgccatcttccattaa

SEQ ID NO: 3147 - protein, 451 aa, Lactobacillus plantarum
MPFVVLTLGILLLLLLIIKFKLNTYIALIVTAVVVGIGLGMPLTKIATSIQNGIGSQLGELALVFGFGAMLGRLVADAGGAYTISTTLLDIFGRKRLQIAIVVASFIIGIALFFEVGIVLLIPIVFAIAIEAQVPVLYLGIPMGAALSVTHGFLPPHPAPTAIATTLNANVGHVLLFGIIIAIPTVYIAGPLFSRWAQKMVPDAFTGKPHLPLSSNKRQFKVSEAPGFGLSVLTALFPVILMTITTVYELVVDHGVTPKNPSTLDQIIRLIGAPGIAMLISLLFALWSMGIHQHKTNKAITATIEDATKSIAMLLLIIGGGGAFKQILIDGGVGKAVAQLFSGSSISPLILGWLVAVILRVSLGSATVAALTAAGLVAPLMTQAGIDPALMVIAIGSGSVAASHVNDAGFWMFREYFDLTVKQTLLTWTMLETIIAVCGLGGVLALNAIFH

SEQ ID NO: 3148 - DNA, 1398 bp, Streptomyces coelicolor
  CDS (1)..(1398)
atgaccagactcagcgtcgagatgctggcagcggaccccgtcgagccgatcacctcggcgggccacgcccagctgggcatcgccgtgctcctgggcatcgccgtcatcgtcctgctcatcaccaagttcaagctgcatgccttcctgtcgctgaccatcgggtcgctggcgctcggcgcgttcgccggtgcgccgctggacaaggtcatcaccagcttcaccgccggactcggctccaccgtcgcgggcgtcggcgtcctgatcgccctcggtgcgatcctcggcaagatgctcgccgactccggcggcgccgaccagatcgtggacaccatcctggcgaaggccacgccccgttcgatgccgtggacgatggtgctgatcgcctcggtcatcggactgccgctgttcttcgaggtcggcatcgtgctgctgatcccggtcgtcctgatggtcgccaagcgcggcaactactcgctgatgcggatcggcatcccggcgctggccggtctgtccgtgatgcacggcctggtcccgccgcaccccggcccgctggtcgccatcgacgcggtggacgccaacctcggtgtgaccctggcgctgggcgtgctgatcgcgatccccaccgtgatcatcgccggtccggtcttctcgaagtacgcggcccgctgggtggacgtcccggcccccgaccgcatgatcccgcagcgcgcctccgagcggctggacaagcgtccgagcttcggcgccacgctggccacgatcctgctgccggtcgtgctgatgctgctcaaggccctggtcgacatcatcatcgacgaccccgacaacgtggtgcagcgcaccttcgacgtcatcggcaacccgctgatcgccctgctggtctcggtgatcgtcggcatcttcacgctgctgcggcccgccgggttcggcaaggaccgtctctccggcctggtcgagaaggggctggcgcccatcgccggcatcctcctgatcgtcggcgcgggcggcggcttcaagcagacgctgatcgactcgggcgtgggccagatggtcctggacatctccaaggactggtcgatcccggcgctgctgctcgcctggctgatcgcggtggtgatccggctggcgaccggttcggcgacggtggcgaccgtctcggcggccggtctggtcgcgccgctggcggccgacatgtcgaccacgcacgccgccctgctggtcctggccatcggcgccggttcgctcttcttcagtcacgtcaacgacgccggcttctggctggtgaaggagtacttcgggctgaacgtggggcagaccatcaagacctggtccgtcatggagacgatcatctcggtggtcgccggtgccctggtcctgctgttgtccctggtcatatag

SEQ ID NO: 3149 - protein, 465 aa, Streptomyces coelicolor
MTRLSVEMLAADPVEPITSAGHAQLGIAVLLGIAVIVLLITKFKLHAFLSLTIGSLALGAFAGAPLDKVITSFTAGLGSTVAGVGVLIALGAILGKMLADSGGADQIVDTILAKATPRSMPWTMVLIASVIGLPLFFEVGIVLLIPVVLMVAKRGNYSLMRIGIPALAGLSVMHGLVPPHPGPLVAIDAVDANLGVTLALGVLIAIPTVIIAGPVFSKYAARWVDVPAPDRMIPQRASERLDKRPSFGATLATILLPVVLMLLKALVDIIIDDPDNVVQRTFDVIGNPLIALLVSVIVGIFTLLRPAGFGKDRLSGLVEKGLAPIAGILLIVGAGGGFKQTLIDSGVGQMVLDISKDWSIPALLLAWLIAVVIRLATGSATVATVSAAGLVAPLAADMSTTHAALLVLAIGAGSLFFSHVNDAGFWLVKEYFGLNVGQTIKTWSVMETIISVVAGALVLLLSLVI

SEQ ID NO: 3150 - DNA, 1359 bp, Staphylococcus epidermidis
  CDS (1)..(1359)
atgtttggagagatttggccactcatcagtgttgtattaggaattattatcttattaacattaattattggattgaagcttaatacgtttatttcattaatcattacctcaatgataacggcgttattattaggtatgccacttaacaaaattatggaaaccattgaaaatggtatgggtagtacgttaggtcatattgctttaatctttggcttaggtgcgatattaggtaaattattagccgacggtggtggcgcaacacgtattgctgatacacttattgcaaagtttggtcagaaacatgttcaatgggctatgttgatagcagcatttatcgttggtattgcgctattttttgaagtaggtcttgtactattaataccactcgtatttacagtagctaaacgcgcaaatgtatcaatattaaaattgggactaccaatggtcacagcgttatctgttacacacggattcttaccaccacatcctggacccgttgtcatcgctaaggagcttaaagcaaatataggtgaagttttgttatatggtatgattattgctatccctgtaacacttattgcaggtccaatctttaatcgatttgcacaaaagatggttccaacagcgtataagagagaaggggatatttcttctttaggtactcaaaaggaatttaaagaagaagagatgcctggtttcggaataagtttattgactgctattttacctgttattcttatgttgatttctacaattgtgcaactgattacaggacacgaagaagcaacaaatgtattcgaacaaattgtttacttcataggaactgctggtactgcaatgcttatcgcagtgatatttgcaatctttacaatgggaatgaagcaacaacgaaaaatggaagacattatgaaatcagttacgcatgctatttatccaatcggcatgatgttactcatcatcggtggtggtggtacatttaaacaagtgctcatcgatggtggcgtaggtgatacaatcgctaagatgtttgaaggaacaagcatgtcgcccattttattagcatggattgtagctgcagtcttaaggatttcattaggatcagctacagttgctgccgtatcaacaacaggcattgtgttaccacttttagaacattcagatgttaatgtagctttggtcgttcttgcaataggtgcaggtagcgtaattctctctcacgtcaatgatgctggattctggatatttaaagaatatttcgggctgacagttaaagaaacatttttaacatggtcgttattagagacaattatttcagtatcaggtgttatatttattttatttatcagtttatttgtatag

SEQ ID NO: 3151 - protein, 452 aa, Staphylococcus epidermidis
MFGEIWPLISVVLGIIILLTLIIGLKLNTFISLIITSMITALLLGMPLNKIMETIENGMGSTLGHIALIFGLGAILGKLLADGGGATRIADTLIAKFGQKHVQWAMLIAAFIVGIALFFEVGLVLLIPLVFTVAKRANVSILKLGLPMVTALSVTHGFLPPHPGPVVIAKELKANIGEVLLYGMIIAIPVTLIAGPIFNRFAQKMVPTAYKREGDISSLGTQKEFKEEEMPGFGISLLTAILPVILMLISTIVQLITGHEEATNVFEQIVYFIGTAGTAMLIAVIFAIFTMGMKQQRKMEDIMKSVTHAIYPIGMMLLIIGGGGTFKQVLIDGGVGDTIAKMFEGTSMSPILLAWIVAAVLRISLGSATVAAVSTTGIVLPLLEHSDVNVALVVLAIGAGSVILSHVNDAGFWIFKEYFGLTVKETFLTWSLLETIISVSGVIFILFISLFV

SEQ ID NO: 3152 - DNA, 1377 bp, Vibrio vulnificus
  CDS (1)..(1377)
atggagcaattagcccacacccctgatcctacatatcttttaaccatagcagcgctggcgattgcggcgttgctcgtgctgatcatcaaactcaaagtgcatgcttttgcctcactgaccattgtcagtttaggcaccgccattgccacaggcgtgacctcggacaaagtggtgcccaccatgatgggtggctttggcggcacgctcgcctctgttgcactgttggtcggccttggcgccatgattggtaaaattttggaagtgacaggcggggccaaagtgctggccgacacgctgattggtcgctttggtaaagatcgcgccccgttcgcgctgggtattgcgtcgctgctgtttggtttcccaatcttctttgatgccggccttgtggtgatgatgcctatcatctttagcgtggcgaaacgctttggtggctcgccaatcaaatacgccttaccgtctgcgggtgcgtttgcggtgatgcacgcctttgtgcctccccatccgggcccggtggcggcagcggaatttttgggtgccaacatcggtttgctgctggttgtgggtatcctggttgcgattccaacttggtatcttggcgcgtacctatttggtttgtacgcgggtaagaaattcgacatcccactttctaaagcattttttaacagcgatgcgattgtcgatgaaagcaaattgccaaaatttgccacagtaatgaccatcttagtgctgcccgtattactgatctgcttggataccggcctaaacacgctggcagtagcgggggtgattgatggtaaaacaccgttggtggaattccttcgcatgctaggtaaaacgccagtcgcgcttcttattaccttgatcgtgtgcttggtggtgtttgccaaagattacggcatggctaaacttgaaaaattgtgtggcgactcactggctccgatctgtggcgttatcctcgttactggtgcgggcggcatgtttggtggcgtattgcgcgccagcggcattggtaatgccttggccgatgtattgaccgacacaggcatgccagtgattgtggctgcgtttgtgatttcaacctgtttgcgtgtggcgcaaggttctgccaccgtggcactgacgaccaccgctgcgctgattgccccggttgtggcggcaaccacaggtttgagtgagttagacctctgctttatcgtgattgctatcgcaggcggtgcaacggtactttctcactttaacgattctggtttctggctggtctctcgtctgcttgagatggatgagaaaaccacgctgaaaacttggacggtaatggaaaccttgcttggtggtattgctttccttatcgtcgctgtattgagctttattctttag

SEQ ID NO: 3153 - protein, 458 aa, Vibrio vulnificus
MEQLAHTPDPTYLLTIAALAIAALLVLIIKLKVHAFASLTIVSLGTAIATGVTSDKVVPTMMGGFGGTLASVALLVGLGAMIGKILEVTGGAKVLADTLIGRFGKDRAPFALGIASLLFGFPIFFDAGLVVMMPIIFSVAKRFGGSPIKYALPSAGAFAVMHAFVPPHPGPVAAAEFLGANIGLLLVVGILVAIPTWYLGAYLFGLYAGKKFDIPLSKAFFNSDAIVDESKLPKFATVMTILVLPVLLICLDTGLNTLAVAGVIDGKTPLVEFLRMLGKTPVALLITLIVCLVVFAKDYGMAKLEKLCGDSLAPICGVILVTGAGGMFGGVLRASGIGNALADVLTDTGMPVIVAAFVISTCLRVAQGSATVALTTTAALIAPVVAATTGLSELDLCFIVIAIAGGATVLSHFNDSGFWLVSRLLEMDEKTTLKTWTVMETLLGGIAFLIVAVLSFIL

SEQ ID NO: 3154 - DNA, 1359 bp, Shewanella oneidensis
  CDS (1)..(1359)
atgaacttagtgctcatcctcatcggcgtgattgcatttattgttatcgcgacctcaaaatttaagctccatccatttttaactttaattctagccgcctttattgccgccttcgcctatggtttacccagtggcgatattgccaaaaccattaccacaggctttggtaatattctcggttatatcggccttgtgatcgtgctcgggacgattatcggcatcattctcgaaaaaagtggcgccgccattaccatggcagatgtggtgattaaagtgttgggtaaacgcttcccaacactcactatgtcgattatcggctatatagtgtccattccggtgttttgtgactcgggtttcgtgatcttaaactcgctcaaacaatccatggccaaccgcatgcaagtctctagcgtgtccatgagcgtggccttagcgacgggtttatacgcgacacacacctttgtccccccgacaccaggccctatcgcagcggcgggtaacttaggcttagagtcaaatttaggcttagtaataggtgtcggtttatttgttgctgctgttgcctcgtttgcaggtatgttgtgggccaaccgctttgcaggggttgaacccgatggtgaaggcgcagaagaactcaaagcccaagcaaatgactttgaatccttaaaacaaagctatggcacactccccagtccattaaaggcttttgccccgatttttgtgcctattctattaatttgtttgggttctgttgctaatttcccttctgcgccattcggaaaagaaggtctgtttagcctattagtgttcctcggccaacccgtaaacgcgctattgattggcctgttcctatccgcgctgttactgaaaagtaccaacaaaatcgccgagtttagcgagcgcattagccaaggcttagttgcggcagcccccatcattttgatcaccggtgccggaggtgcctttggcgctgtattaaaagcaacacccataggcgactttttaggcagctcattatcggcgctcggcgttgggattttcatgccctttatcgtcgctgcagcgctgaaatcggcccaaggttcatcaacggtcgccctggtcgcaacctcggccttagtcgctccgatgctgggcgatattggtcttggcagcgaaatgggccgcgtactgacagtcatggcgattggtgcaggcgccatgaccgtctcccacgctaacgacagtttcttctgggttgtaactcaatttagccgtatgagtgttacgcaggcctataaagcccaaaccatggcgaccctgatccaaggcgtcacctccatgctggccgtgtatgtactaagcttagtgctgctctaa

SEQ ID NO: 3155 - protein, 452 aa, Shewanella oneidensis
MNLVLILIGVIAFIVIATSKFKLHPFLTLILAAFIAAFAYGLPSGDIAKTITTGFGNILGYIGLVIVLGTIIGIILEKSGAAITMADVVIKVLGKRFPTLTMSIIGYIVSIPVFCDSGFVILNSLKQSMANRMQVSSVSMSVALATGLYATHTFVPPTPGPIAAAGNLGLESNLGLVIGVGLFVAAVASFAGMLWANRFAGVEPDGEGAEELKAQANDFESLKQSYGTLPSPLKAFAPIFVPILLICLGSVANFPSAPFGKEGLFSLLVFLGQPVNALLIGLFLSALLLKSTNKIAEFSERISQGLVAAAPIILITGAGGAFGAVLKATPIGDFLGSSLSALGVGIFMPFIVAAALKSAQGSSTVALVATSALVAPMLGDIGLGSEMGRVLTVMAIGAGAMTVSHANDSFFWVVTQFSRMSVTQAYKAQTMATLIQGVTSMLAVYVLSLVLL

SEQ ID NO: 3156 - DNA, 1347 bp, Oceanobacillus iheyensis
  CDS (1)..(1347)
atgccattaattattgtagcattagctgtagtattactattgctactcataatgaaatggaatttaaatacatttatttcattgattattgtatcattcctaactgccttggctttagggatgccattaggagaaattgttacatcgattgaaggtggacttggcggtacattaggtgacattgccctcatctttggttttggtgcaatattagggaaactagttgcagatgctggtggggcacagcgaattgctctgacattgattcacaaatttggagaaaaacgaatccaatgggcggtagtaattgcatcattcattattggtgtagcgttattcttcgaagtagggttagttctactaataccgattatataccaaattgcaaaagaaattaaaatacctttattatatttaggtttaccaatgacggcagcgttatccgtaacgcatggttttttaccaccacatccgggtccaacagtaattgctcagcaatacggagcaaatattggaatggtacttatttatgggattattattgcggttccaacggttattttagctgggccactatttactaaagttgctaagaaaattgttccagatgcattttcaaaagttggtaatcttggatcacttggtggggcaaaatcatttccagaagaggaaacaccgagctttgcagttagtgcattaaccgcactattccctgtaattttaatggcaattacaacagtagttgatttactgcaagatatcggtgatgtgtcggataatattctttttgaaattatgcgcatgattggacaaccaacaacagcattattgatttctttattacttgcaatctatacaatgggtattgctcgtaaaataccgatgaaacaattgatgacatctgcagaagaatctgttcgcgctataggtatgatgttacttattattggtggtggcggagccttaaaacaagtcttaattgatggcggggtcggtgactctgttgctgctttatttgatggaacgagtatgtccccaatatttcttgcttggttgattgctgcaatcttaagaattgcacttggttctgcaactgtagcagcattaacaactgtaggtatggtaatcccattaatggaaggtacagatgtaaaccttgccttaatggtgttagcaactggtgcaggtagcttgattgcgtcccacgtaaatgatacaggattctggatctttaaagaatactttaatttatccatgaaagaaaccttcgcaacatggacgttacttgaaacagtaatttcagtcgcaggtctagtgtttacactagcgttaagtttaattgtataa

SEQ ID NO: 3157 - protein, 448 aa, Oceanobacillus iheyensis
MPLIIVALAVVLLLLLIMKWNLNTFISLIIVSFLTALALGMPLGEIVTSIEGGLGGTLGDIALIFGFGAILGKLVADAGGAQRIALTLIHKFGEKRIQWAVVIASFIIGVALFFEVGLVLLIPIIYQIAKEIKIPLLYLGLPMTAALSVTHGFLPPHPGPTVIAQQYGANIGMVLIYGIIIAVPTVILAGPLFTKVAKKIVPDAFSKVGNLGSLGGAKSFPEEETPSFAVSALTALFPVILMAITTVVDLLQDIGDVSDNILFEIMRMIGQPTTALLISLLLAIYTMGIARKIPMKQLMTSAEESVRAIGMMLLIIGGGGALKQVLIDGGVGDSVAALFDGTSMSPIFLAWLIAAILRIALGSATVAALTTVGMVIPLMEGTDVNLALMVLATGAGSLIASHVNDTGFWIFKEYFNLSMKETFATWTLLETVISVAGLVFTLALSLIV

SEQ ID NO: 3158 - DNA, 1362 bp, Oceanobacillus iheyensis
  CDS (1)..(1362)
atgtccaacactactatgttgattatggttacgatacttggtatagcgctattacttttcttggttatgcgatcaaagctgcaagcttttgttgcattacttatttccagtatctttatcggtattttatccggaatggatttaaatgatcttatagctaccatggaagaaggtatgggaggaaccttaggttttattgcagtcgtagttggccttggtgcaatgttcggtgaaatgctccgagtttctgggggcgcggaacgtttagcattaacgttagttaataaatttggcgatgggaaagttcagtgggcacttggtttaacagggtttattgtagcaataccggtttttctagatgttgccttggtaatcttaatcccaattgtatatagtttagctcaaaaaacgaaaaaatcattattatatttcggtatccctttactagcaggattagctgttacccatagtttcataccacctactccaggaccaatatcggtggcttctattataaatgccgatctaggttgggtaattttatttggtgctttagcaggtttacctgcgatgattatagcaggaccgatatttggtaattatatttctaaaaaaattcatttagaagttcctaaatatattgtagataaagaatatcttgaaaacgaagtagaaaaaacgaatcgtgaactaccaagctttaaaactgtatgtctattaatattaattccactctttttaatacttattaacactgtatttggattaatattagaagaaggaacgtttatacattcattccttacatttatcggacatccatttattgctttaacaatatctaccctattaacattctatatattgggtacaaaaagaggatattcaaaagaagaagtacagaatattgcaacgaaatcattagaacctgcaggtattattatccttattactggtgcaggcggagttttcaaacaaacgttaattgatagtggtgtaggtgatgtactaggtaatatgttagcgacatcaaaccttcctttagtactggcagcattcatcatttcgacttttgtgcgaatagcacaaggttcagctacagttgctatgattactgctgcaggcttaatgtcgccaattattggtatgatggaagtttctgaacctatgttaggtttaattgttatatccatagcgagtggtgctacagtattctctcatgtaaatgattcaggattctggttagttaatagatttttcggaatgacagaaaagcaaaccttacaaacatggacagtaatggaaactatcattggttttgttggatttgcagtcgtatttgcaattagcttctttgtctaa

SEQ ID NO: 3159 - protein, 453 aa, Oceanobacillus iheyensis
MSNTTMLIMVTILGIALLLFLVMRSKLQAFVALLISSIFIGILSGMDLNDLIATMEEGMGGTLGFIAVVVGLGAMFGEMLRVSGGAERLALTLVNKFGDGKVQWALGLTGFIVAIPVFLDVALVILIPIVYSLAQKTKKSLLYFGIPLLAGLAVTHSFIPPTPGPISVASIINADLGWVILFGALAGLPAMIIAGPIFGNYISKKIHLEVPKYIVDKEYLENEVEKTNRELPSFKTVCLLILIPLFLILINTVFGLILEEGTFIHSFLTFIGHPFIALTISTLLTFYILGTKRGYSKEEVQNIATKSLEPAGIIILITGAGGVFKQTLIDSGVGDVLGNMLATSNLPLVLAAFIISTFVRIAQGSATVAMITAAGLMSPIIGMMEVSEPMLGLIVISIASGATVFSHVNDSGFWLVNRFFGMTEKQTLQTWTVMETIIGFVGFAVVFAISFFV

SEQ ID NO: 3160 - DNA, 1344 bp, Escherichia coli O6
  CDS (1)..(1344)
atgcatgtgcttaacattctctgggtggtattcggcattggcctgatgctggtactgaatttgaagttcaaaatcaattcaatggtggccttgttggtggcggcgctgtccgtcgggatgctggcgggcatggatttgatgtcgctgctgcacaccatgaaagcgggcttcggcaacacgctgggggaactggcgatcatcgtggtgttcggtgcggtcatcggtaaattgatggtcgactccggcgcggctcaccagatagcgcatacgctgctggcgcgtctcggtctgcgctatgttcagatatcagtgattatcatcggacttatttttggtctggcgatgttctatgaagtggcctttattatgctggcgccgctggtgatcgtaattgccgccgaagccaaaatcccgttcctgaaactggctattccggcagtagcggcggccaccaccgcacattcactgttccctccgcaaccgggtccggtggcgctggtgaatgcttacggcgcagatatggggatggtttatatctatggcgtcctggtgactattcccagcgtaatctgtgcgggactgatcttgccgaaattcctcggcaaccttgagcgcccgacaccgtcatttctgaaagcggatcaaccggttgatatgaacaacctgccctcttttggtgtctcgattctggtgccgctgatcccggcgatcattatgatctccaccaccatcgccaatatctggctggtaaaagatacccctgcctgggaagtggttaactttatcggttcctcgccgattgcaatgtttattgcgatggtggttgcattcgtactctttggtaccgcgcgtggtcatgacatgcagtgggtgatgaacgcttttgaaagcgcggtgaagagcattgcaatggtgattctgatcatcggtgcgggtggcgtgctgaagcagaccatcatcgacaccggcatcggcgacaccatcggcatgttgatgtcccacggtaatatctcgccctacatcatggcatggctgatcaccgtactgattcgtctggcgacgggacagggtgtggtttcagcgatgaccgccgccgggattatcagtgctgcaatccttgatccagcaaccggtcagctggttggcgtgaatccggcgctgctggtactggcgacggctgcgggttccaacaccctcacccacattaatgatgcctcattctggctgttcaaaggttactttgacctgtcggtaaaagacacgttgaaaacctggggactgctggagctggtcaactccgtggttgggctgattattgtgctgattattagcatggtagcgtaa

SEQ ID NO: 3161 - protein, 447 aa, Escherichia coli O6
MHVLNILWVVFGIGLMLVLNLKFKINSMVALLVAALSVGMLAGMDLMSLLHTMKAGFGNTLGELAIIVVFGAVIGKLMVDSGAAHQIAHTLLARLGLRYVQISVIIIGLIFGLAMFYEVAFIMLAPLVIVIAAEAKIPFLKLAIPAVAAATTAHSLFPPQPGPVALVNAYGADMGMVYIYGVLVTIPSVICAGLILPKFLGNLERPTPSFLKADQPVDMNNLPSFGVSILVPLIPAIIMISTTIANIWLVKDTPAWEVVNFIGSSPIAMFIAMVVAFVLFGTARGHDMQWVMNAFESAVKSIAMVILIIGAGGVLKQTIIDTGIGDTIGMLMSHGNISPYIMAWLITVLIRLATGQGVVSAMTAAGIISAAILDPATGQLVGVNPALLVLATAAGSNTLTHINDASFWLFKGYFDLSVKDTLKTWGLLELVNSVVGLIIVLIISMVA

SEQ ID NO: 3162 - DNA, 1341 bp, Escherichia coli O6
  CDS (1)..(1341)
atgactacattaacgcttgttttaacagcagtagggtctgttttactgctgctgtttttagtcatgaaggcgcgtatgcacgctttcctggctttaatggtggtgtccatgggggctggccttttttctggtatgccgctcgataaaatcgcagcgacgatggaaaaagggatgggaggcaccctcggcttcctggcggtggttgtcgccctgggagccatgtttggtaagatcttacatgaaaccggcgcggtcgatcagattgccgtcaaaatgctcaaatccttcggtcacagccgcgtgcattatgccatcggccttgcggggctggtttgtgcgctaccgctgttctttgaagtggcgattgttctgctgattagcgttgctttctcaatggcgcgccacaccggcacgaacctggtgaagctggtaatcccattattcgccggcgtggcggcagcggctgcgttcctggtgcctgggccagcgccaatgctgctggcatcgcagatgaatgccgattttggctggatgatcctgattggcctgtgcgcggcaattccgggaatgattattgccgggccgctgtggggtaatttcatcagccgctacgtggagttgcatattcctgacgacatcagcgaaccgcatctcggcgaaggcaaaatgccgtccttcggattcagcctgtcgctgatcctgttgccactggtgctggtggggctgaaaaccattgccgcgcgttttgtgccagaaggctctactgcttacgaatggttcgagtttatcggccatccgtttaccgcgattctggttgcttgcctggtggcgatttacggtctggcaatgcgtcagggtatgccaaaagacaaagtgatggagatttgcggtcacgcgctgcaaccggcggggatcattctgctggtgattggtgcgggcggcgtgttcaaacaggtgctggttgactctggtgtcggtccggcactgggcgaagcgttaaccggcatgggcctgccgattgccatcacctgcttcgtgctggcagctgcagtgcgcatcattcagggttctgccaccgttgcctgtttaacggcggtgggactggtgatgccggtcattgaacaactgaactactccggtgcgcaaatggcggcgctgtcgatttgtattgccggtggttcgattgttgtcagccacgttaacgacgcgggtttctggttgttcggtaaatttaccggcgcgaccgaagccgaaacgcttaaaacctggaccatgatggaaaccatcctcggcactgtcggtgccatcgttgggatgattgcgttccagctgttgagttaa

SEQ ID NO: 3163 - protein, 446 aa, Escherichia coli O6
MTTLTLVLTAVGSVLLLLFLVMKARMHAFLALMVVSMGAGLFSGMPLDKIAATMEKGMGGTLGFLAVVVALGAMFGKILHETGAVDQIAVKMLKSFGHSRVHYAIGLAGLVCALPLFFEVAIVLLISVAFSMARHTGTNLVKLVIPLFAGVAAAAAFLVPGPAPMLLASQMNADFGWMILIGLCAAIPGMIIAGPLWGNFISRYVELHIPDDISEPHLGEGKMPSFGFSLSLILLPLVLVGLKTIAARFVPEGSTAYEWFEFIGHPFTAILVACLVAIYGLAMRQGMPKDKVMEICGHALQPAGIILLVIGAGGVFKQVLVDSGVGPALGEALTGMGLPIAITCFVLAAAVRIIQGSATVACLTAVGLVMPVIEQLNYSGAQMAALSICIAGGSIVVSHVNDAGFWLFGKFTGATEAETLKTWTMMETILGTVGAIVGMIAFQLLS

SEQ ID NO: 3164 - DNA, 1365 bp, Escherichia coli O6
  CDS (1)..(1365)
atgtccacaattacattgttatgcattgcgttagctggcgtaatcatgctgttgctactggtcatcaaggcaaaggtacaaccattcgttgctctgctcctcgtcagcctgttagtcgcacttgcggcgggtataccggcgggcgaagtgggtaaagtgatgatcgccgggatgggcggtgtgcttggttccgtcactattattattggtctgggcgctatgctggggcgtatgatcgaacactctggtggtgcagagtcactggctaattatttcagtcgcaagttaggtgacaaacgaactatcgctgcgctgactctggcagcgttcttcctcggtattcccgtcttctttgatgtcggctttattattcttgcgccaatcatttacggttttgccaaggttgccaaaatatcaccactcaaatttggcctgcctgtcgctgggatcatgctcactgttcacgtggcggtaccgccgcatccaggccctgtcgccgcagcggggttactccacgcagacatcggctggctaaccatcatcggtattgcgatttctattcccgtagggattgttggctactttgcagcgaaaataatcaataagcgccaatatgcgatgtcggtcgaggtactggaacagatgcaactggctccggccagtgaggaaggcgcgacaaaattaagcgataaaataaatccaccgggcgtcgcgctggtcacctcgctaattgttattcctatcgcgattatcatggcgggtacggtttctgcaacactgatgccgccttcgcatcccctgcttggtacgctacagttgataggctcaccaatggtagctctaatgattgcgctggtgctggcattctggttattggctttacgtcgcggctggagcttacaacacaccagcgacattatgggctctgcccttcccactgcggcggtagtgattttggttactggtgctggaggggtatttggcaaagtgctggtggaatcgggcgtcggtaaagcccttgccaacatgttacaaatgattgacctgcctctgttaccagccgcatttattatttcactggcgctgcgtgcatcgcaggggtcagcaaccgtagcaatcctgacaaccggcgggttactctcagaagcggtgatgggattaaatccgattcagtgcgtattggtgacgctggcagcctgctttggtgggcttggcgcgtcacatattaatgactcagggttctggattgtgaccaaatatctggggttgtcggtagcagacggtctgaaaacctggacagtgttaacgaccattctcggttttaccggattcttaattacctggtgcgtatggctcgtcatctaa

SEQ ID NO: 3165 - protein, 454 aa, Escherichia coli O6
MSTITLLCIALAGVIMLLLLVIKAKVQPFVALLLVSLLVALAAGIPAGEVGKVMIAGMGGVLGSVTIIIGLGAMLGRMIEHSGGAESLANYFSRKLGDKRTIAALTLAAFFLGIPVFFDVGFIILAPIIYGFAKVAKISPLKFGLPVAGIMLTVHVAVPPHPGPVAAAGLLHADIGWLTIIGIAISIPVGIVGYFAAKIINKRQYAMSVEVLEQMQLAPASEEGATKLSDKINPPGVALVTSLIVIPIAIIMAGTVSATLMPPSHPLLGTLQLIGSPMVALMIALVLAFWLLALRRGWSLQHTSDIMGSALPTAAVVILVTGAGGVFGKVLVESGVGKALANMLQMIDLPLLPAAFIISLALRASQGSATVAILTTGGLLSEAVMGLNPIQCVLVTLAACFGGLGASHINDSGFWIVTKYLGLSVADGLKTWTVLTTILGFTGFLITWCVWLVI

SEQ ID NO: 3166 - DNA, 1395 bp, Corynebacterium efficiens
  CDS (1)..(1395)
atggaaacctgggaacaaacattaggcgccgggcctctgctcggtatcgcggccggggccatcgccctgatcctcgtcctcgttattgtcttcaagctccatgcctttctgacactggttctggtgtctgtcctcaccgcgttggtggccgggatcccggttgacgcgatcgtcgatacgctcctggatggcttcgggggcacgctggcctcggtggctctcctggtgggtctcggtgccatgctcggcagattggtggagacctccggtggtgcagcctccctggccaacaccctggtccgtctcttcggggagaaacgtgcaccgctggccctgggtgtggcctcattgatcatgggtttccccatcttcttcgacgccggcctggtggtcatgctacccatcatcttcgcggtggcccgccggatgaacggatccgtcctgacctatggcatccccgccgccggtgccttctccgtcatgcacgtcttcgtcccaccgcatcccggtcccatcgcggcctccgagttctatgatgcccaggtgggttttgtgctgctcgtgggcctggtcatcgccatacccacctggtatgtcaccggttatctgctgggcaagtatgtcggtcgtaaattccccctgccggttcctgacctgttggctggcggcaagacctccggtgaacagcctgacaacccggccggcgccggggtggtgatcgccattctcctgatccccatggtgttaatcttcggtaacaccggcactgacatggcggccaccgccggatgggtcgatgcggattccccggtggtcagtgttctcagcttcctcggcgccacccccatagccctgttactgacaaccctcattgcactctgggccctgggtgcccgtcgtggggtcagcggttccgccctgggcaaggctgtggaaggcgcgctcggtccgatctgttcagtggtgctgattaccggcgccggtggcatgttcggtggtgtcctgcgtgcctccggcatcggtgatgtcctcgccgattccatggcagaactgggcctgcccgtcatcgtggcctgtttcgtagtggccgctgtgctacgcatagcccagggttccgccaccgtggccctgaccacggccgcggcattgatggctccggctgtggctgctgccggatacaacgatttccagctcgcggcgatcgtgatggccaccgctgcggggtcggtgatcgccagccatgtcaacgattcgggattctggctcgtcggtcgactcatgggaatggatgtctccaccaccctgaagacctggacagtgaaccagaccgcaatcgctatcgtcggtttcgccctggcctgggccctgttcggggtcactgccgggctggggtga

SEQ ID NO: 3167 - protein, 464 aa, Corynebacterium efficiens
METWEQTLGAGPLLGIAAGAIALILVLVIVFKLHAFLTLVLVSVLTALVAGIPVDAIVDTLLDGFGGTLASVALLVGLGAMLGRLVETSGGAASLANTLVRLFGEKRAPLALGVASLIMGFPIFFDAGLVVMLPIIFAVARRMNGSVLTYGIPAAGAFSVMHVFVPPHPGPIAASEFYDAQVGFVLLVGLVIAIPTWYVTGYLLGKYVGRKFPLPVPDLLAGGKTSGEQPDNPAGAGVVIAILLIPMVLIFGNTGTDMAATAGWVDADSPVVSVLSFLGATPIALLLTTLIALWALGARRGVSGSALGKAVEGALGPICSVVLITGAGGMFGGVLRASGIGDVLADSMAELGLPVIVACFVVAAVLRIAQGSATVALTTAAALMAPAVAAAGYNDFQLAAIVMATAAGSVIASHVNDSGFWLVGRLMGMDVSTTLKTWTVNQTAIAIVGFALAWALFGVTAGLG

SEQ ID NO: 3168 - DNA, 1338 bp, Methanosarcina mazei
  CDS (1)..(1338)
atgcatcctgtcctcattttccttttcgcacttatagccatactgctttttacggcaaaattcaggcttcaccctttccttagtcttgttcttgtatctcttctaacagggattcttgcaggagagcccatacgcactatcgaagcagttactgaaggactgggaagcgttttttcccgttttgccattattattacgagtgggagcatcatcggacttctgctccagaaaaccgggggaatgtctttaatagcttctgacattacgcgctttttcaaaaatcccctgcttgccctgagctttcttggatttcttttttccgtgccaacaatgtgctatatccttgcttacgttatctttatcccgatagcaaaagaactgtcttccaggttcaattaccccccgatttccactgcaactgcacttgcattgggagccgttgcttcatttaatctggtttatccttcccctgtgatcatttcggcagcagaagaactttcagcaaacagggatatgcttattctactgggatttcttaccgctgttcccacttctttttcaggatatctttatgcgaggagtcttggaaaggctgaagtttccggaatgaatgagggtggggtaatacgggaaaaaaccattgtaaaggagaaaaaagacctgtcacaggaaaatggtgcgttgcaaaggacagaaaatagaaaaccaggaaggtttgaagcttatgctccgatttttattcctctatttctcatccttttcgaggctgtattaaataatcctaatactctattcacctttctgggaaatccgaatgttgcattacttattggggtccttctttctattttttccgggagagtgctgggacttccaatgataagggtccaggtcgaaaaagccataaaaagaagcggtgttgtcctgctcgacctttgtgggggtggagctcttggtgcaactcttgccatgacaggagcaggggaagcccttggaaagtttttcctgcagttcaacctgcctcatattcttgtgccttttcttgttgcagcagccctccaaacagtgcagggctcaagagttgtaacgatgctcgtcgctccgtcccttttactcccccttgtccctgagcttggactccctccggaaattttgatcctttcaatggcttcaggcacttttatgatttcacacgttaatgacccgtttttctggattttcggagaactcgcagaactgacaccctctgaggttttcaggtcaaatacacttggaaacgcccttatgggagtagtaagctttctgatcgtctccggaatatattttttcttttactga

SEQ ID NO: 3169 - protein, 445 aa, Methanosarcina mazei
MHPVLIFLFALIAILLFTAKFRLHPFLSLVLVSLLTGILAGEPIRTIEAVTEGLGSVFSRFAIIITSGSIIGLLLQKTGGMSLIASDITRFFKNPLLALSFLGFLFSVPTMCYILAYVIFIPIAKELSSRFNYPPISTATALALGAVASFNLVYPSPVIISAAEELSANRDMLILLGFLTAVPTSFSGYLYARSLGKAEVSGMNEGGVIREKTIVKEKKDLSQENGALQRTENRKPGRFEAYAPIFIPLFLILFEAVLNNPNTLFTFLGNPNVALLIGVLLSIFSGRVLGLPMIRVQVEKAIKRSGVVLLDLCGGGALGATLAMTGAGEALGKFFLQFNLPHILVPFLVAAALQTVQGSRVVTMLVAPSLLLPLVPELGLPPEILILSMASGTFMISHVNDPFFWIFGELAELTPSEVFRSNTLGNALMGVVSFLIVSGIYFFFY

SEQ ID NO: 3170 - DNA, 1350 bp, Fusobacterium nucleatum
  CDS (1)..(1350)
atgaatgtaacatttactatttttgctattttattatcaatattattactggttttattaacaattaaagttaaacttcatccattctttgcattaacagtcagtgcttttttctttggattaatatcaggacactcaattcctgatataattggagcatactcagatggacttggaggaacaattgctggaataggtgtagttatagcaattggaactgttatgggagctctattagaaaatagtggagctgctgaaactatggccgaaactattttaaaaattacaggaaagaaaaatgctgatattggtctagctgttacaggctattttgtttctattcctgttttttgtgattctgcatttgttttattgtctccattggcaaaaagagtaagtaaagatacaggtggaagtatgactacgatggcagtagcattagcaatgggacttcatgcaactcacatgttagttccaccaactccaggacctttagccgttgctggaattttaggagctaatttaggattagttattttatgtggaatgcttgtttctatccctgtaacaatagttgctattattgctggaagaatttttggtaaaaaataccattttcttcctgaaatagaagaagttcatacagatgagaaggctaaaaatttaccaagtccttttatgagcttttcacctattatagtaccaataattttaatgttattaaaaacagtgggaagtttagaatcaaaaccttttggaacaggagtactatataatatttttgattctttagggcaaactatagtagctctatttattggactcattattgcattttttacatataaatctgtttatccatatgataaaaatgtttggacttttgatggaatatttggagaatctttaaaaacagcaggacaaattgtattaattgttggagcaggaggagcttttgcaacagtattaaaactgtctaatttacaagaaattgtaatgaatctattcacaggtatttctataggtattatagttccttatattattggtgcaatttttaggactgcaataggttcaggaacagttggtatgataactgctgcttctatgttgctaccactactagacattcttggatttaatacaccaatgggactagtaattgccatgttagcttgtgcagctggtggatttatggtttttcatggaaacgatgattttttctgggttgttgtttctacatcaggtatgaaacctgaagttgcttataaaactttcccaattataagtgtacttcagtcagtaactgcacttatttgtgtttttatattaaaaattattttcttataa

SEQ ID NO: 3171 - protein, 449 aa, Fusobacterium nucleatum
MNVTFTIFAILLSILLLVLLTIKVKLHPFFALTVSAFFFGLISGHSIPDIIGAYSDGLGGTIAGIGVVIAIGTVMGALLENSGAAETMAETILKITGKKNADIGLAVTGYFVSIPVFCDSAFVLLSPLAKRVSKDTGGSMTTMAVALAMGLHATHMLVPPTPGPLAVAGILGANLGLVILCGMLVSIPVTIVAIIAGRIFGKKYHFLPEIEEVHTDEKAKNLPSPFMSFSPIIVPIILMLLKTVGSLESKPFGTGVLYNIFDSLGQTIVALFIGLIIAFFTYKSVYPYDKNVWTFDGIFGESLKTAGQIVLIVGAGGAFATVLKLSNLQEIVMNLFTGISIGIIVPYIIGAIFRTAIGSGTVGMITAASMLLPLLDILGFNTPMGLVIAMLACAAGGFMVFHGNDDFFWVVVSTSGMKPEVAYKTFPIISVLQSVTALICVFILKIIFL

SEQ ID NO: 3172 - DNA, 1359 bp, Fusobacterium nucleatum
  CDS (1)..(1359)
atggaacaacaaattttaattggtttattagttggtattatttgtttaatttttatgatagtaaaaactaaaattcatacttttttagctttgatagttgcaactattatagttggaattgttggaggaatagaatatcctcaaattattggtagtattacaaaaggttttggtggaaccttaggaagtattggaatcataataggttttggagttatgatgggacaactttttgaagtttctggggctgcaaaaaaaatggctctatgcttcttaaaaatttttggaaaaggtaaagaagaattagcaatggctataacaggttttctagtttctatccctatattttgtgattcaggttttgttattttaactccattgataaaagctatttctaaggaaactaaaaaatcaattgtatctttggggctagctcttgcatcaggactggtaatcactcactctcttgttccacctactcctggtccagttggtgttgctggaatctttggtgtcagtgtttcaagtattattttatatggaattataatttcaatcccaatggttttagcttgcttagtatttgcaaaatatgcaggaaataaaatttggcaaatacctactagtaatggaaaatggacaagagataaaaattatgtagatgatttaaaaacttcaagtgtttatgatgaatctaacttaccttctgcatttttatctttttctccaatcgtagttcctattattttaattttattaggaactgttacagatacaatgaaacttgagggaaagattatatcatttattcaattcataggaactcctgtaatagcagtaggaattggcttgcttattacaatttatggtttaacaagaagtttagataaacaaaaagttttagaagaagttgaaattggaataaaatcagctggaacaattattttaattactggtgctggtggagcttttggaatgttaatcagagatagtggtgtaggagatgttatcgctaaatcattagttgatacagcattaccacctattttattaccttttataattgcaactttaattcgttttattcaaggaagtggtactgttgctatgattacagcagcttctattactgctccaatcattacaaaattaaatgttaatcctgttctcgctgctcttgcagcctgtgtaggttctcttttcttctcatatttcaatgatagtttcttctgggttatcaatcgttcaataggaattacagaaggaaaagaacaattaagactttattctgttgcaagtacaattgcttgggcagtaggaattattattttattaatacttaatatatttattaaataa

SEQ ID NO: 3173 - protein, 452 aa, Fusobacterium nucleatum
MEQQILIGLLVGIICLIFMIVKTKIHTFLALIVATIIVGIVGGIEYPQIIGSITKGFGGTLGSIGIIIGFGVMMGQLFEVSGAAKKMALCFLKIFGKGKEELAMAITGFLVSIPIFCDSGFVILTPLIKAISKETKKSIVSLGLALASGLVITHSLVPPTPGPVGVAGIFGVSVSSIILYGIIISIPMVLACLVFAKYAGNKIWQIPTSNGKWTRDKNYVDDLKTSSVYDESNLPSAFLSFSPIVVPIILILLGTVTDTMKLEGKIISFIQFIGTPVIAVGIGLLITIYGLTRSLDKQKVLEEVEIGIKSAGTIILITGAGGAFGMLIRDSGVGDVIAKSLVDTALPPILLPFIIATLIRFIQGSGTVAMITAASITAPIITKLNVNPVLAALAACVGSLFFSYFNDSFFWVINRSIGITEGKEQLRLYSVASTIAWAVGIIILLILNIFIK

SEQ ID NO: 3174 - DNA, 1470 bp, Methanosarcina acetivorans
  CDS (1)..(1470)
atggagtctggatatatgcaccctgctcttattttccttttcgcccttatctccatactgctgcttacagcaaaattcaggcttcatccatttcttagccttgttctcgtatctctgctcacgggagtgcttgcaggagaacctataggtgcagtcgaagcggtaactaggggacttggcagtgttttttcccgttttgctataattatcacctgcgggagtatcatcggaattttgctccagaagaccggtggaatgtctttaatagcttctgacattatgcacttttccagaaaccctctgcttgccctgattattcttggttttcttttttccgtgccaatgatgtgctatatccttgcttatgtcatctttatttctatagcaaaagagttagctgccaagcttaattaccccttcatttccactgcaacctcacttgcactcggagctgttgcatcatttaatctggtgtatccttctcctgtaattatttcggcagcagaagaactttcggcaaacacggatacactcattcttctaggattttttattgctgttcccacttctactgcaggttatttctatgccagaagcctggggaagactgaaacctcaataagttctgaaaacgacaatctcgggcaagttcagcttggatttgcacaggcagaagtttcagaaattgaagagcccctacaaaagggggagacaggagtagtacaggaaaaagatatcggcgttaaggaaaaagatggagtgcacagggaagaagtggtacaaagaaaaggtgaagtgaaggtaagatgtaggattcatggaaatgatactggagagccgaacaggcttgaagcatatgccccaatctttcttcctttgcttctgatccttttccaggctggttttgagcatccttctcctctgtttgcttttctgggaaacccgaatgttgcactccttatcggagttctgctctccattttttccggcaggacactggggtttgaaatggtcaggactctggttgaaaaagctgtaaagagaagtggtgtagtcctactcgacctgtgcgggggaggtgccctaggagcgactcttgccatgaccggggcaggagaagcccttggtaggtttttcctgcagattaacctgcctcatatccttgttccttttcttgttgcagtagcccttcaaaccgtacaggggtcaagggttgtaacaatgcttgtcgcaccgtcccttttgcttcctctggttccggaacttgggcttcctgtggaaatcctgatccttgcaatggcttcaggtacattcttgttttcacacgtcaacgatccatttttctggattttcggggagctggcagaacttgaaccctccgaggttttcaggtcaaatactcttgggaacgctctgatgggcgtggtaagtttcctgctggttgccggagtgtatgttttcctctattga

SEQ ID NO: 3175 - protein, 489 aa, Methanosarcina acetivorans
MESGYMHPALIFLFALISILLLTAKFRLHPFLSLVLVSLLTGVLAGEPIGAVEAVTRGLGSVFSRFAIIITCGSIIGILLQKTGGMSLIASDIMHFSRNPLLALIILGFLFSVPMMCYILAYVIFISIAKELAAKLNYPFISTATSLALGAVASFNLVYPSPVIISAAEELSANTDTLILLGFFIAVPTSTAGYFYARSLGKTETSISSENDNLGQVQLGFAQAEVSEIEEPLQKGETGVVQEKDIGVKEKDGVHREEVVQRKGEVKVRCRIHGNDTGEPNRLEAYAPIFLPLLLILFQAGFEHPSPLFAFLGNPNVALLIGVLLSIFSGRTLGFEMVRTLVEKAVKRSGVVLLDLCGGGALGATLAMTGAGEALGRFFLQINLPHILVPFLVAVALQTVQGSRVVTMLVAPSLLLPLVPELGLPVEILILAMASGTFLFSHVNDPFFWIFGELAELEPSEVFRSNTLGNALMGVVSFLLVAGVYVFLY

SEQ ID NO: 3176 - DNA, 1353 bp, Ralstonia solanacearum
  CDS (1)..(1353)
atggccccgttgcaaggcaactcgctgctgctggccgccgcgctggcggtggtcgcgctgatctacctgatcgcggtgcgcaagctcaacccgttcgtcacgctgatcgtcgtgtcgctggtgctgggcgtggccgtcggcatgccgatgggcaatatcgtcaaggcgttcgagaccggcgtgggcaacacgctcggccacatcgcgctggtggtgggcctggggaccatgctgggcaagatgatggcggagtccggcggcgccgagcgcatcgccagaacgctgatccgggccttcggcgagaaaaacgcgcactgggcgatgatggtggtggccttcatcatcggcctgccggtgttcttcgaggtgggcttcgtgctgctgatcccgatcgccttcaacgtggccaagcgcaccggcacgccgatcctgatggtgggcctgccgatggtggccggcctgtcggtggtgcacggcctcatcccgccgcacccggccgccctgctggcggtgacggcttaccaggcggacatcggcaagaccatcctgtacgcgctgatcgtcggcctgccgaccgccatcctcgccgggccgctgtttgcgatgctgatctcgcgccacgtcaagccggacccggacaacccgctggaaaagcagttcgtcgaggccgacagcagccgcgagctgccgccgttcggcatcacgctgttcacgatcctgctgccggtggtgctgatgctgatcggcagctgggccgacctgctcgccgcgcccaagtcgctggccaacgatctgctcaagctggccggcaattcggtgatggcgctactgatcgcggcgctggtgagcttctacaccttcggccgcgcgcgcggcttcagccgcgaggccatcctcaagttcaccaacgagtgcctggcgccgatcgccaccatcacgctggtggtgggcgcgggcggcggcttcggccagattctgcgcgattcgggggtgtccaaggcgatcgtggccgtggccatgggcgcgagcctgtcgccgctgctgctgggctgggtggtggcggtgatgatccgcatcgccaccggctcggccacggtggccatgaccaccgcctgcggcatcgtcgcgccgatcgcggcggcctccggcgcggccgtgcggccggagctgatggtgctggccaccggcgccggctcgctgatcctctcgcacgtcaacgacggcggcttctggctggtcaaggaatacttcaacctgaccgtgccgcagaccttccagacgtggaccgtgctggagaccatcatctcgatcgtggcgctgctgctgacgctggcgctcgccacggtgatctga

SEQ ID NO: 3177 - protein, 450 aa, Ralstonia solanacearum
MAPLQGNSLLLAAALAVVALIYLIAVRKLNPFVTLIVVSLVLGVAVGMPMGNIVKAFETGVGNTLGHIALVVGLGTMLGKMMAESGGAERIARTLIRAFGEKNAHWAMMVVAFIIGLPVFFEVGFVLLIPIAFNVAKRTGTPILMVGLPMVAGLSVVHGLIPPHPAALLAVTAYQADIGKTILYALIVGLPTAILAGPLFAMLISRHVKPDPDNPLEKQFVEADSSRELPPFGITLFTILLPVVLMLIGSWADLLAAPKSLANDLLKLAGNSVMALLIAALVSFYTFGRARGFSREAILKFTNECLAPIATITLVVGAGGGFGQILRDSGVSKAIVAVAMGASLSPLLLGWVVAVMIRIATGSATVAMTTACGIVAPIAAASGAAVRPELMVLATGAGSLILSHVNDGGFWLVKEYFNLTVPQTFQTWTVLETIISIVALLLTLALATVI

SEQ ID NO: 3178 - DNA, 1320 bp, Salmonella typhimurium
  CDS (1)..(1320)
atgccattaataattattgcggcaggcgttgcgctgctgttggttttaatgattggctttaaagttaacggctttatcgcccttgttctggttgccgccgtggtgggatttgccgaagggatgggcgcgcaagacgtcctgcactccatacaaaacggaattggcggtactctgggcggactcgccatgatcctcggttttggcgcgatgctgggaagattaatttccgataccggcgccgcgcagcgcattgcgacgacgctcattaatacgttcggcaaaaaacgcgtgcaatgggcgctggtgatcaccgggcttatcgtcggcctggcaatgttttttgaagtcggattcgtactgctgttgccgctcgtttttacgattgtggcctcatcgggactgcccttgctgtatgtcggggttccaatggtcgccgccttatccgttacgcactgcttcctgccgccgcatcccggccctactgctattgcgacaatttttgaggcaaatctcggtacgaccctgctgtatgggttaatcattaccataccgaccgtgattgttgccggccctctgttttcaaaattgctggcgcgctttgagaaagcgccgcctgaaggattatttaatcctcacctattcagtgaagaggagatgccgtcattctggaacagtatttttgccgccgtgatcccggtcattctgatggccatcgcagcggtatgtgaaatcacgctgccaaaaacgaatgccgtgcgggttttcttcgaatttatcggtaatccagcagtggcgttgtttattgccattatcatcgccatttttacgctgggccgacgcaacggacgtacggttgagcaggtgatggatatcgtcggcgagtccattggcgctattgcgatgattgtttttatcatcgcgggcggcggcgcgtttaagcaagtgctggtggatagcggcgtgggtcaatatatctcgcaattaatgaccggcacctcgctatctccgttattaatgtgctggacggtagccgccgtgctgcgtattgcgctaggttccgcgaccgtggctgcgataaccacagcgggcgtcgtattgccgattattaacgtaacccacgccgatccggcgttaatggtactggcgacaggcgcgggaagcgttattgcatcacatgttaacgatcccggtttttggctgtttaaagggtattttaatcttagcgtcggggaaaccctacgcacctggaccgttatggaaacattgatttctgtcatggggttgctgggcgtactggcgctgaatgcggttctgcattaa

SEQ ID NO: 3179 - protein, 439 aa, Salmonella typhimurium
MPLIIIAAGVALLLVLMIGFKVNGFIALVLVAAVVGFAEGMGAQDVLHSIQNGIGGTLGGLAMILGFGAMLGRLISDTGAAQRIATTLINTFGKKRVQWALVITGLIVGLAMFFEVGFVLLLPLVFTIVASSGLPLLYVGVPMVAALSVTHCFLPPHPGPTAIATIFEANLGTTLLYGLIITIPTVIVAGPLFSKLLARFEKAPPEGLFNPHLFSEEEMPSFWNSIFAAVIPVILMAIAAVCEITLPKTNAVRVFFEFIGNPAVALFIAIIIAIFTLGRRNGRTVEQVMDIVGESIGAIAMIVFIIAGGGAFKQVLVDSGVGQYISQLMTGTSLSPLLMCWTVAAVLRIALGSATVAAITTAGVVLPIINVTHADPALMVLATGAGSVIASHVNDPGFWLFKGYFNLSVGETLRTWTVMETLISVMGLLGVLALNAVLH

SEQ ID NO: 3180 - DNA, 1338 bp, Salmonella typhimurium
  CDS (1)..(1338)
atgcacgctcaaatctgggtagtgagcacgctgctgatcagcatcgtgttaatcgtattgaccatcgtgaagtttaaattccaccccttcctggcgttactgctcgccagtttctttgtcggcgcgatgatgggcatggggccgctggagatggtcacggcgatagaaaacggaataggcggtacgctcggttttctggccgccgttatcggtcttggcaccatcctcggcaaaatgatggaggtttccggcgcggcggaacgcatcgggcttacgctccagcgctgccgctggctctctgctgacgtgatcatggtactggtggggctgatttgcggtatcacgttgttcgtggaagtgggcgtcgtgttgctcatcccactggcgttttctatcgctaaaaagacccatacctcgctgctgaagctggccattccgctgtgtaccgcgctgatggccgtccattgcgtggtaccgccgcatccggctgcgctgtttgtcgcaaataaactgggggcggatatcggctcggtgattgtctacggtctactggtcgggctgatggcatcattggtcggcggtccgctgttcttaaagtttctgggtaatcgtctgccgttcaagcccgtaccgacagagtttgcggatcttgaagtgcgcgccgaaaacaccctgccgtcgctgggcgcaacgctgtttaccgttctgctgccgattggcctgatgctggtgaaaaccgtcgctgaactgaatatggcgaaagacggcacgttgtatacgctgctggagtttatcggtaatccgatcaccgcaatgtttatcgctgtctttgtggcgtattacatactcggtctgcgccagcatatgggtatgggcacactacttacccacaccgaaaacggctttggcgccattgcgaacatcctgctgattatcggcgcgggcggcgcgttcaacgccattctcaaaagtagcgggctggcggacacgctggcggtgatcctctcaaatatgcatatgcacccgattctgctggcatggctggtagcgctgattctgcacgcggcggtcggatctgcgacggtggcgatgatgggcgccaccgcgattgttgcgcccatgctgccgctctatcctgacgtcagcccggagatcattgcgattgccattggttccggcgccattggctgcacgatcgtgaccgattccctgttctggctggtcaagcagtattgcggcgctacgctgaatgaaacgtttaaatactatacgacggccacgtttatcgcatctgtcgttgcactggctggcacattcctgctttcctttatcatctga

SEQ ID NO: 3181 - protein, 445 aa, Salmonella typhimurium
MHAQIWVVSTLLISIVLIVLTIVKFKFHPFLALLLASFFVGAMMGMGPLEMVTAIENGIGGTLGFLAAVIGLGTILGKMMEVSGAAERIGLTLQRCRWLSADVIMVLVGLICGITLFVEVGVVLLIPLAFSIAKKTHTSLLKLAIPLCTALMAVHCVVPPHPAALFVANKLGADIGSVIVYGLLVGLMASLVGGPLFLKFLGNRLPFKPVPTEFADLEVRAENTLPSLGATLFTVLLPIGLMLVKTVAELNMAKDGTLYTLLEFIGNPITAMFIAVFVAYYILGLRQHMGMGTLLTHTENGFGAIANILLIIGAGGAFNAILKSSGLADTLAVILSNMHMHPILLAWLVALILHAAVGSATVAMMGATAIVAPMLPLYPDVSPEIIAIAIGSGAIGCTIVTDSLFWLVKQYCGATLNETFKYYTTATFIASVVALAGTFLLSFII

SEQ ID NO: 3182 - DNA, 1317 bp, Salmonella typhimurium
  CDS (1)..(1317)
atgccattagtcatcgttgctatcggtgttatcttgttacttcttctgatgatccgcttcaaaatgaacggatttatcgcccttgtcctggtagcgctcgctgtcgggttgatgcagggaatgcctctggataaagtcatcggctccatcaaagccggtgtcggtggtacgcttggcagtctggccctgattatggggttcggcgccatgctgggcaaaatgcttgccgactgcggcggcgctcaacgtatcgccactaccctgatcgcgaaatttggtaaaaagcatattcagtgggccgtagtgttaaccggctttaccgtcggcttcgctctgttctatgaagtgggcttcgttctgatgctgccgctggtattcaccattgccgcagcggcgaatatcccgctactgtacgtcggcgtgccgatggccgcggcgctctccgtcacacacggcttcctgccgccgcacccgggtccaaccgcaatcgccacgattttccatgccgatatgggtaagacgctgctgtttggtacgattctggcgatcccgaccgtgatccttgccggaccggtttacgcccgtttcctgaaaggcatcgataagccgatcccagaaggcctgtacagcgcgaaaacttttacggaagaagagatgccgggctttggcgtcagcgtctggacgtcgctggttccggttattctgatggcgatgcgtgcgattgccgagatgattctgccaaaaggccacgctttcctgcccgttgccgagttcctgggcgacccggtaatggctacgttaattgccgtactgattgcgatgttcacctttggcctgaaccgcgggcgttccatggatcagattaacgatacgctggtctcttccatcaaaattatcgccatgatgctgctgatcatcggcggcggcggcgcattcaagcaggtgctggtcgatagcggcgtggataaatacatcgcttcaatgatgcatgaaaccaatgtctctccgctgttgatggcgtggtctatcgcggcggttctgcgtatcgcgctgggctctgcgactgtcgcggcgattaccgcaggcggcattgcggcgccgctgatcgccactaccggcgttagccctgaactgatggttatcgcggtcggttccgggagcgtgattttctctcacgtcaacgacccgggcttctggctgttcaaagagtatttcaatttgactatcggcgagaccattaaatcctggtcgatgctggaaacgatcatctccgtctgcggcctgatcggctgtctgctgttgggtatggtggtttaa

SEQ ID NO: 3183 - protein, 438 aa, Salmonella typhimurium
MPLVIVAIGVILLLLLMIRFKMNGFIALVLVALAVGLMQGMPLDKVIGSIKAGVGGTLGSLALIMGFGAMLGKMLADCGGAQRIATTLIAKFGKKHIQWAVVLTGFTVGFALFYEVGFVLMLPLVFTIAAAANIPLLYVGVPMAAALSVTHGFLPPHPGPTAIATIFHADMGKTLLFGTILAIPTVILAGPVYARFLKGIDKPIPEGLYSAKTFTEEEMPGFGVSVWTSLVPVILMAMRAIAEMILPKGHAFLPVAEFLGDPVMATLIAVLIAMFTFGLNRGRSMDQINDTLVSSIKIIAMMLLIIGGGGAFKQVLVDSGVDKYIASMMHETNVSPLLMAWSIAAVLRIALGSATVAAITAGGIAAPLIATTGVSPELMVIAVGSGSVIFSHVNDPGFWLFKEYFNLTIGETIKSWSMLETIISVCGLIGCLLLGMVV

SEQ ID NO: 3184 - DNA, 1497 bp, Salmonella typhimurium
  CDS (1)..(1497)
atgacaagtttaccgaccccaattatcggtctgatcgttgccgttttcgtgctggtatggctggtgttacgcacccgtgttcatgcgctgatcgcgatgctggcggcggcctgtattgccggtctgttggggggaatgggcattgataaaacgctctctgtcatcaccagcggattcggtacgacgctgggcagcattggcctggtgattggtctcggcgtaatgatggggcgcttgctggaggtttccggcgcggcggagcgtatcgcctggagctttatcaaatggctggggaaacgccgtgaagagtgggcgctggcgatcacgggttatattgtcagcatccccattttcgtcgattccgcttttgtcattctttatccggtggcgaaagcgctggcgaaaagcggtaagcgttcgctactgacgctgggcgtcgcgctggcgggcgggctggtggtcactcaccatacggtacctccgacgcccggtccgctgggggtagccgggatttttaacgtcgacatcggcgcaatgttattgaccgggatggcgctggcggtgccctgtgtgatcggcattgtgttctatgcgcagtggctggataaacgctaccctgatttcgtgccgcgcacgctgaacgccgatgaagtcaatgccgcgctggagcagtacaataaagagaaagagcaaaaggaactgccgagcctgacgctttctctgctgcctattgtggtgccgatcgtgctgatcttcctgaaggctatctgttccaccctcgccactgtagaaggatggtccggcctggcgacgcatccggtggtacaggcaatcaactttgtgggaagtccggtgatcgcgttggccatcagcgttctgctggcggtgtatacgctggtgccgcgcatggataaacataccaccgcagagcgtctggaagagggcttgcaaagcgccgggattatcttactggtcacgggcgctggcggcgcgttgggcgcgatcctgcgcgacagcggcgcggggcaacagctggcggagcaggttgccaacctgccgatctcgccgatcctgatcccgtttatcgtggcgacgttggtacgcctgattcagggatcggggacggtggcgatgatcactgccgcctcgatttccgcgccgatcctggcgcagatccccggcatcaatatgttgcttgccgctcaggccgcaacgatggggtcgctgttcttcggctacttcaacgatagcctgttctgggtggttaaccgcatgatgggtgtctctgatgtcaaacagcagatggtggtttggtctgtaccgacgaccattgcctgggcgattggcggcaccggcgtggtgctgattaacctgctgttcggttccggcggtagttggctcgatccgttactgccgattgttgttctggcggcaattatgctgtgggtgcgttggcaggcgcaggggatcaaagacaagctggtagttaaggattaa

SEQ ID NO: 3185 - protein, 498 aa, Salmonella typhimurium
MTSLPTPIIGLIVAVFVLVWLVLRTRVHALIAMLAAACIAGLLGGMGIDKTLSVITSGFGTTLGSIGLVIGLGVMMGRLLEVSGAAERIAWSFIKWLGKRREEWALAITGYIVSIPIFVDSAFVILYPVAKALAKSGKRSLLTLGVALAGGLVVTHHTVPPTPGPLGVAGIFNVDIGAMLLTGMALAVPCVIGIVFYAQWLDKRYPDFVPRTLNADEVNAALEQYNKEKEQKELPSLTLSLLPIVVPIVLIFLKAICSTLATVEGWSGLATHPVVQAINFVGSPVIALAISVLLAVYTLVPRMDKHTTAERLEEGLQSAGIILLVTGAGGALGAILRDSGAGQQLAEQVANLPISPILIPFIVATLVRLIQGSGTVAMITAASISAPILAQIPGINMLLAAQAATMGSLFFGYFNDSLFWVVNRMMGVSDVKQQMVVWSVPTTIAWAIGGTGVVLINLLFGSGGSWLDPLLPIVVLAAIMLWVRWQAQGIKDKLVVKD

SEQ ID NO: 3186 - DNA, 1479 bp, Streptomyces coelicolor
  CDS (1)..(1479)
atgtcctactcgtccctccgtcttgccgccgccgaggccccaccccacaccggcggtctgctcaccctgatcgacggcaccgccggtctgctgaccgtcgccgccatcggcatcgcgctgctgctcttcctcatcatcaaggtgcggcttcagcccttcgtcgcgctgctcgccgtctccatagccgtcggcctgctcgccggcctgtcggtcaccgaactcttcggcaccgtgcagaagtcggacgccgtctcgaccatcgagtccggcatgggcggcatcctcggccacgtcgccatcatcatcggcctgggcaccatgctcggcgcgatcctcgaagtcagcggcggcgcccaggtgctggcctcccgcctgctcggcctcttcggggagaagcgggccccgctcgccatgggcctcaccggtctgatcttcggcatcccggtcttcttcgacgtgggcatcttcgtcctcgcgcccatcgtctacgccgccgccaagcgctccggcaagtcgatcctgctctactgcctgccgctgctggccggcctgtccatgacccacgccttcctgccgccgcaccccggcccggtggccgccgccggactgctgaacgtcaagctcggctggatcatcctcatgggcatcgtctgcggcatccccgccgtcctcgccgcctgggtgttctccgcctggatcggccgccgcatcttcgtgcccgtgccgcaggacatggtcgaggcgtccgaggaggccaagcaggccgtcatcgaggagcagcgcaaggccggcgtcgcgccgaacgagagccccgtcgcgctcggcaccgtcctcggcatcatcggcaccccgttggtcctgatcctcgccgcgaccttctcctccatcgccctggacccgtccaccctccgctcggtgatcgagttcttcggcaacccgttcgtcgcgctgaccatcgccctgctcctcgcctactacctgctcggcatccggcgcggctggtcccgcaagtccctggagaccgtctcgacggcctcgctgaagccggtcggcaacatcctgctggtggtcggcgcgggcggggtcttcggcgccgtcctcaaggccagcggcgtcgcccaggcactctccgacaccttcaacgacgtcggcctgccggtgatcgtcctcgcctacctgatctccgtggtgctgcgggtcgcgcagggctcggcgacggtggccatcgtgacgacggcgggcatcgtggcgccgctgctggccgagggcgaccactcgcaggcgttcgtcgcgctggtcatcatggccatctcggcgggctccatcttcgcctcgcacgtcaacgacggcggcttctggatggtcgccaagtacttcggcatcagcgagcgggacacgctcaagacgtggaccgtgctggagagcgtcctgtccgtcgccgggttcgtggtggccgcggtggtgagcctgttcgtgtag

SEQ ID NO: 3187 - protein, 492 aa, Streptomyces coelicolor
MSYSSLRLAAAEAPPHTGGLLTLIDGTAGLLTVAAIGIALLLFLIIKVRLQPFVALLAVSIAVGLLAGLSVTELFGTVQKSDAVSTIESGMGGILGHVAIIIGLGTMLGAILEVSGGAQVLASRLLGLFGEKRAPLAMGLTGLIFGIPVFFDVGIFVLAPIVYAAAKRSGKSILLYCLPLLAGLSMTHAFLPPHPGPVAAAGLLNVKLGWIILMGIVCGIPAVLAAWVFSAWIGRRIFVPVPQDMVEASEEAKQAVIEEQRKAGVAPNESPVALGTVLGIIGTPLVLILAATFSSIALDPSTLRSVIEFFGNPFVALTIALLLAYYLLGIRRGWSRKSLETVSTASLKPVGNILLVVGAGGVFGAVLKASGVAQALSDTFNDVGLPVIVLAYLISVVLRVAQGSATVAIVTTAGIVAPLLAEGDHSQAFVALVIMAISAGSIFASHVNDGGFWMVAKYFGISERDTLKTWTVLESVLSVAGFVVAAVVSLFV

SEQ ID NO: 3188 - DNA, 1392 bp, Corynebacterium glutamicum
  CDS (1)..(1392)
atggacacctgggaacaaacccttggaacagggccactgctaggcattgcagccggcgccattgccctcatcttggttctcgtcatcgtttttaaactccatgcttttctcaccctaatactggtttcaattgttaccgcacttgctgccggcattcccgtcaccgcagtagtggacactctccttgacggttttggtaaaacactcgcctcggtcgccctattggtaggcctgggtgccatgcttggtcgattggttgaaacatccggtggcgcaaaatctctagccgacactatggtgcgaatcttcggtgaaaaacgagcagctttcgcactcggtgtcgcatcgctgatcatgggattccctatcttcttcgatgctggcctcgtggtcatgctcccagtgatcttcgcagtagctcgacgcctcaacggctccgtccttacttttggtatccctgcagctggcgccttctctgtcatgcacgtgttcgtcccacctcacccaggcccaattgcagcctctgaattcttcggcgcacaagttggatacgtactaatcgctggcatcatcgttgcactacccacctggtatttaaccggttacctgctaggtaagttcttaggccgaaagttcccccttcccgtacccgatctactcagtggtggagcacaggaagatgatcagcctcagaacccagctaacgcagtgtcgatcattgtcattttgctcattcctatgctccttatttttggcaataccggaacatcaatggcagtttccgccggcctcctagatgcagaatccaccatggtgaaaattctaggattcctcggcgaaacaccagtggcactgctcattaccttgatcattgccctgttcttcctaggcaaccgacgtggcattaatggttctgctctagagaaaaccatcgaaggcgcactcggcccaatctgttcagtcgtattaatcactggcgccggtggcatgttcggtggagtgctacgcacgtctggaattggaggagcgcttgcagactccatggcagatctaggacttccagttatcgcaggttgtttcatcgtggcagccgtccttcgtgtcgcgcagggttctgccaccgttgcgctaaccaccgccgcagcactcatggcacctgctgttgccgctgctgactttaacgaattccagcttgctgccatcgttatttccactgccgctggttctgttattgccagccacgtcaacgactccggattctggctcgttggtcgactcatgaacgccgacgtacccaccacgctaaaaacttggaccgtaaaccaaacctgcattgcgattgtgggatttgtgatggcctatgcaatgttcggattggcatcgcttgcatag

SEQ ID NO: 3189 - protein, 463 aa, Corynebacterium glutamicum
MDTWEQTLGTGPLLGIAAGAIALILVLVIVFKLHAFLTLILVSIVTALAAGIPVTAVVDTLLDGFGKTLASVALLVGLGAMLGRLVETSGGAKSLADTMVRIFGEKRAAFALGVASLIMGFPIFFDAGLVVMLPVIFAVARRLNGSVLTFGIPAAGAFSVMHVFVPPHPGPIAASEFFGAQVGYVLIAGIIVALPTWYLTGYLLGKFLGRKFPLPVPDLLSGGAQEDDQPQNPANAVSIIVILLIPMLLIFGNTGTSMAVSAGLLDAESTMVKILGFLGETPVALLITLIIALFFLGNRRGINGSALEKTIEGALGPICSVVLITGAGGMFGGVLRTSGIGGALADSMADLGLPVIAGCFIVAAVLRVAQGSATVALTTAAALMAPAVAAADFNEFQLAAIVISTAAGSVIASHVNDSGFWLVGRLMNADVPTTLKTWTVNQTCIAIVGFVMAYAMFGLASLA

SEQ ID NO: 3190 - DNA, 1377 bp, Pasteurella multocida
  CDS (1)..(1377)
atgagtggtattgcattaatctgtgtttttgtcattgcaattattgtcatgatttggctgattgcaaaagtcaaagttcacccttttctcgctttgatgtccatttctcttgctctcgcctttattgcaggtattccattagctaaaatccccgccatgattggtgatgggtttagtggcactttcaaaagtattgggattgtgattattttcggtgccattattggtatggtgctcgaaaaaaccggtgcagcgttaaaattagccgatatggtcgtcaaatatgttgggcataaaagacctgaactggccatgttaattatgggttgggttgtgggtatccccgttttttgcgatagtggctttgtggtactgaatcctatcagagaagcattacgtaaaaaaatttccgcgaatcctgttagtatggcagtggcgcttagtgcaggtctttatgcttcccatgtctttattccaccgacacccggtcctattgcagccgcaggggctgtcggattaagtcataacttattattagttatcggcatgggcgtagtggtatccattcctgttctgtttgccagctacctgttcgctaaatgggtaagccgtaatatgaccttgaatgaagaggacagtgatactgtcattgagaaaagttatgaagcattattaaaacaatacggcaccttgccgagcggtcgcttaagccttgccccaatttgcgtaccaattttgctcatggctttaggttctatcagtaagattctcggtctagaaggcaatgttggcattctactgcaatttttaggtcacccaatcattgctctcgcccttggtgtgatttgtgctgtggtattgttaatcaaaacagagaaaatcagtggctttgatcagcttacaaatgataccttaaaaatcgttggtccgattctctttattactgcggctggtggtgtattgggtaaagtcatcacgcaagcaggttttgtcgaatacattaagcaaaatgcacacatcattagtaccgcaggcattttctttccattcttaatttcagccattttaaaaactgcacaaggtagctcaactgtcgccattatcaccacggcttcaattatgggcatgtttagtgcgcaagattctttaatgagcgccttaggcttaacctctgaaattgccgccgccttaaccgtgatggcgatcgctgcaggggcaatgtgtgtttctcatgctaacgacagctattattgggtggttacgaattttaccaaaatgaccccacaacaaggttaccgtacacaaactgctttaacactgattatgggtatcgttgggattatcaccgtatatctactttcacttattttattgtaa

SEQ ID NO: 3191 - protein, 458 aa, Pasteurella multocida
MSGIALICVFVIAIIVMIWLIAKVKVHPFLALMSISLALAFIAGIPLAKIPAMIGDGFSGTFKSIGIVIIFGAIIGMVLEKTGAALKLADMVVKYVGHKRPELAMLIMGWVVGIPVFCDSGFVVLNPIREALRKKISANPVSMAVALSAGLYASHVFIPPTPGPIAAAGAVGLSHNLLLVIGMGVVVSIPVLFASYLFAKWVSRNMTLNEEDSDTVIEKSYEALLKQYGTLPSGRLSLAPICVPILLMALGSISKILGLEGNVGILLQFLGHPIIALALGVICAVVLLIKTEKISGFDQLTNDTLKIVGPILFITAAGGVLGKVITQAGFVEYIKQNAHIISTAGIFFPFLISAILKTAQGSSTVAIITTASIMGMFSAQDSLMSALGLTSEIAAALTVMAIAAGAMCVSHANDSYYWVVTNFTKMTPQQGYRTQTALTLIMGIVGIITVYLLSLILL

SEQ ID NO: 3192 - DNA, 1467 bp, Pasteurella multocida
  CDS (1)..(1467)
atgtttggattacctattccaataatcggcttattagtggccgtttttgtgctcgtctttttagtgttaagaacgcgcgttcatgcttttattgctatgttaattgcggcagcgatagcagggcttattggtgggatgaatgttgaccaaacactgggtgcaattaccaaaggctttggaggtacgttaggggggattggtattgtaattggactcggtgtcatgatgggaagtatccttgaggtttcgggtgccgcagagaaaatggcttatagctttattaagtttttaggcaagaagaaggaagaatgggcattggctattactggctatattgtgagtattccaatctttgtggattcagcctttgtgattttgtatccagtagcaaaagcgttagctaaaaatgggaaacgttctttattgactttaggggtagcattagcaggtggcttagttgttacgcaccatactgttcctccaacacccggcccattaggtgtagccggcttatttaatgttgatattggggcaatgttattagtcgggatgtcgttggccgttttacctgtagttgggatggtgctgtatgctaaatggttagacaaaaagtatccaacctttaatcaggaagtgtttagtcaagaagaattaaaacaaaagtatgatgattatattgaaagccgtgagaagaaaaacttaccaagtttaggtttatcattattaccgattgttttaccgattgcgcttattttcattaaagccattttaggtttactggctaaaaacactcctgaacttgcacaaaacaccctataccaagtgtttaactttattggtcatccgatgattgctcttgcaatcagtgtgttagtcgctgtgtacacattattgcctaaagccgataaaaccacgacagcactgcatttagaagaaggggtaaaaacggcgggcattattttattagtaacgggtgctggtggtgcgctcggtgcggtattacgtgatagtggagcgggtaaagaattggcagaacaagttgctgccttacctatttcacctatcttgattccgtttattgtttcaacattagtacgctttattcagggatcaggtacggtagccatgatcaccgcggcttcgatttctgcgccaattctagcacagattccgggggtgaatatgttactcgcggcacaggctgcgactatgggctccttgttcttcggttattttaatgacagcttgttctgggtcgtgaaccgcatgatgggcattaatgatgtgaagaaacaaatgattgtttggtctgtaccaacgacaatcgcatgggcaattggtggtagctcagtgattttggcgaacttagtttggggcaacgatggttcgattacagacttggtgttaccgctcggtgtgttggcgggaattctgctttatgtcaatttacagagtaaaaaactctaa

SEQ ID NO: 3193 - protein, 488 aa, Pasteurella multocida
MFGLPIPIIGLLVAVFVLVFLVLRTRVHAFIAMLIAAAIAGLIGGMNVDQTLGAITKGFGGTLGGIGIVIGLGVMMGSILEVSGAAEKMAYSFIKFLGKKKEEWALAITGYIVSIPIFVDSAFVILYPVAKALAKNGKRSLLTLGVALAGGLVVTHHTVPPTPGPLGVAGLFNVDIGAMLLVGMSLAVLPVVGMVLYAKWLDKKYPTFNQEVFSQEELKQKYDDYIESREKKNLPSLGLSLLPIVLPIALIFIKAILGLLAKNTPELAQNTLYQVFNFIGHPMIALAISVLVAVYTLLPKADKTTTALHLEEGVKTAGIILLVTGAGGALGAVLRDSGAGKELAEQVAALPISPILIPFIVSTLVRFIQGSGTVAMITAASISAPILAQIPGVNMLLAAQAATMGSLFFGYFNDSLFWVVNRMMGINDVKKQMIVWSVPTTIAWAIGGSSVILANLVWGNDGSITDLVLPLGVLAGILLYVNLQSKKL

SEQ ID NO: 3194 - DNA, 1350 bp, Pasteurella multocida
  CDS (1)..(1350)
atgttaattttgattatgatcatcgcagtcttagtcttattgctgctgattatgaaattccgcgtgcatgcgttcgttgcactaattatcgtcagtttactgaccgcacttgcgacaggcgttccagttaataaaattctgcctacgctattgactggctttggtaatacccttgctgcggttgcattactcgttggtttaggcgctatgattgggcgattactcgaaattacaggcggcgccaaagtcttggcagatacgctcattaacaaattcggcgagaaaaaagcgccttttgccttaggggtcgcgtccttactgtttggtttcccaattttctttgatgcgggtttagtggtgatgttaccaatcattttcagtgtagctaaacaatttggtggctcaacattacgctatgccttaccttctgcgggtgcctttgccgtcatgcatgctttccttccgcctcatccgggtccagttgcatcgggtgatttattaggcgctaatatgggtttactcgtgattgttggtttaatttgcgcgattccaacatggtatatcgctgcttatttattcggtttatattccggtaagaaaatcaacttagcactgcctaaagcctttttatcaggtaatgctattcatgaaacggctgctcaaaatccaccgagtttcaaaaaagtgctatttattcttctgttacctatctgtttaattctatttgacacaggtttaaatacattaagtgttgccaaagtgattgatggctcacaagtgtgggtcgaaagcttacgcttattaggcaaaacccctatcgcactccttattactttgattgttgccatcattttattaaaagaacaacgtagctatgaacaaattgaaaaaatttgtgataacgctttaggcccaatttgtgccattgtcttggttaccggtgctggtgggatgtttggcggtgtattacgcgcgagcggcattggtaacgaattatccgcaatgctgtctgatacaggtttacctgttattgttgctgcatttattattgcacttgccttacgtgttgcccaaggttcagccactgttgccttaaccaccgcctctgcgctcattgcaccaactgttgctgcaacaactggactcagtcaactcgatttatgctttattgtgattgccattgcctctggtgcaacagctttatcacacgtcaatgactcaggtttctggcttgtgagccgtttcttagaaatggatgaaaaaaccacattaaaaacctggaccgtgatggaaaccttaattggtcttgttggtttcgctctggctgttattggtagtattctcttttaa

SEQ ID NO: 3195 - protein, 449 aa, Pasteurella multocida
MLILIMIIAVLVLLLLIMKFRVHAFVALIIVSLLTALATGVPVNKILPTLLTGFGNTLAAVALLVGLGAMIGRLLEITGGAKVLADTLINKFGEKKAPFALGVASLLFGFPIFFDAGLVVMLPIIFSVAKQFGGSTLRYALPSAGAFAVMHAFLPPHPGPVASGDLLGANMGLLVIVGLICAIPTWYIAAYLFGLYSGKKINLALPKAFLSGNAIHETAAQNPPSFKKVLFILLLPICLILFDTGLNTLSVAKVIDGSQVWVESLRLLGKTPIALLITLIVAIILLKEQRSYEQIEKICDNALGPICAIVLVTGAGGMFGGVLRASGIGNELSAMLSDTGLPVIVAAFIIALALRVAQGSATVALTTASALIAPTVAATTGLSQLDLCFIVIAIASGATALSHVNDSGFWLVSRFLEMDEKTTLKTWTVMETLIGLVGFALAVIGSILF

SEQ ID NO: 3196 - DNA, 1356 bp, Zymomonas mobilis
  CDS (1)..(1356)
atgcactctaatggaacaatgctccttttatatgcattggcgtccatcatcattcttattttgatgattgcaaagtggcgtctaaacccttttgtttcccttattttagtttcaatcggtatgggtgccgtaacgggcatgcccttaaccaaagttttgtcggcctttcaagatggtcttggttctggtatcggttccacagcgagtgttatcgcactcggcaccatgcttggtaagatcttggctgagtctggtggtgcggaacgtatcgctacgacgacgatcaaaatctttggccccaaacttatccactgggcgatgctggtcattgcctttatcgtgggtattccgatcttctatcaggtcggttttatcctgttgattccgctcgtctttaccttaggacgtgccagcgggatttctcttgtcaaattaaccattccgctttgtgccggtttggcgaccgttcatggtttgctgcctccgcatccgggttcaatgcaatgcgttgaaatgctccatgctgatgtgggtaaaaccattctttacggtttcatcgtcggtttccctgccgctatccttgccggtccgctttacggcaattggattacgcctcgcattcagctgcctgcccacaacccatttgcagaaagtcttgaaggtagcagcgatcaggataaaaatttgccgggtttctggctgacgattttctcgattttgcttcctgttttgctgatggttttttccagcggcgccaatatcttcctgccccacggtaacaacattcgcgctttcatgaacttcatgggtgatccggttgtttccttgcttatcgctttgctggtcagcatggtcaccttgggtttctggcgtggtttcagcagtgctgatcttctgaaattcaccaatgactgcttgggcccgacggctggcattctgttgctgatcggtgctggtggcggatttagtgaaattctgtatcgcgccggtgtcagtaacgccatggccgatctgtctcacgtcatgcatctgtccccgattatgctcggctttatcattgcggcggttatccgcgttgcaaccggttcacagacggtggcaatgtcgatgtccggcggtatgttagccccgatcatcttcagcaccccgggcttccacagccctgaattgctggttctttcgatcggtgccggttcgtccattctgtctcacgtcaatgacggtgctttctggctgttaaaagaatatctgaatatgacggtcagccagaccttcaagacctggacggtttctgtcaccatcgcttcgattgcagccctgatcctcacctttggtcttcaggcattgggtctttaa

SEQ ID NO: 3197 - protein, 451 aa, Zymomonas mobilis
MHSNGTMLLLYALASIIILILMIAKWRLNPFVSLILVSIGMGAVTGMPLTKVLSAFQDGLGSGIGSTASVIALGTMLGKILAESGGAERIATTTIKIFGPKLIHWAMLVIAFIVGIPIFYQVGFILLIPLVFTLGRASGISLVKLTIPLCAGLATVHGLLPPHPGSMQCVEMLHADVGKTILYGFIVGFPAAILAGPLYGNWITPRIQLPAHNPFAESLEGSSDQDKNLPGFWLTIFSILLPVLLMVFSSGANIFLPHGNNIRAFMNFMGDPVVSLLIALLVSMVTLGFWRGFSSADLLKFTNDCLGPTAGILLLIGAGGGFSEILYRAGVSNAMADLSHVMHLSPIMLGFIIAAVIRVATGSQTVAMSMSGGMLAPIIFSTPGFHSPELLVLSIGAGSSILSHVNDGAFWLLKEYLNMTVSQTFKTWTVSVTIASIAALILTFGLQALGL

SEQ ID NO: 3198 - DNA, 1356 bp, Treponema denticola
  CDS (1)..(1356)
atgcaaggtatagcacttattattacatttgttattgctattgctcttatgattttcgctatttcaaagctgaaaattcatccctttttatcgattatgggagtttcgctccttttggctctggccgcaggaataccgttggtaaagattcccggcacaataggagccggttttagcggaacttttacaagtatcggtattgttattattcttggtgccctaatcggaacaatccttgaaaaaacaggagcagccctaaagctctccgatatggttatcaaggttgtaggtaaaaagcatcctgaacttgctatgctgattatgggctggatagtttcaattcccgtattttgtgacagcggttttgttattctaaacccgatacgaaaggctcttgtgcaaagaacaagaatatcgagcgttgcaatgactgtagccctatcggccggtttgtatatttctcacgtatttattccgcctacacccgggcctattgcagctgcaagctctctcggcataggaaacaaccttcttttagtaatcggtatgggagccctagcttctatcttccccctcatagcaggttatttttttgcaagatatataggaactaaggtaaaggcttcagaagacagctctacagatgaggtttcacaatcctatgaagaactggttgcaagttacggatctcttccaaacggttttactgccatagctcctattattgtgccgatcctcctcatggctctttcttcagttgcttctatggcaaatatgagcggtaccggtgccgatatcttaaaattcctcggagcccctattatggccttagcggtaggtctcattttcggtgtcatactttttgcaagccaaaaaaagacagaggacttttatattctcacaaatgaaaccttaaaggttgtaggccccattctctttgtaactgccgcaggcggtgttttaggcaaggttatagcttcatcaagcttagtaggttatattactgaacatgctgccgttttaaaaaccgtcggcattttcttcccattcctcttggctgctattttaaaatctgcacaaggttcatcgacggttgcgattacaactacggcaggaatccttgctcctcttatggcacccctaggccttgctaccattcccttatcggccttaaccgttatggcaatcggagcaggagcaatgaccgtttctcatgcaaatgacagttatttctgggtagtcacaaccttcggcggtttaaaggctgaggacggatacaagacgcaaacccttatgactcttgtaatcggtattgccgcaattataggtatatttatcatatccttatttttatag

SEQ ID NO: 3199 - protein, 451 aa, Treponema denticola
MQGIALIITFVIAIALMIFAISKLKIHPFLSIMGVSLLLALAAGIPLVKIPGTIGAGFSGTFTSIGIVIILGALIGTILEKTGAALKLSDMVIKVVGKKHPELAMLIMGWIVSIPVFCDSGFVILNPIRKALVQRTRISSVAMTVALSAGLYISHVFIPPTPGPIAAASSLGIGNNLLLVIGMGALASIFPLIAGYFFARYIGTKVKASEDSSTDEVSQSYEELVASYGSLPNGFTAIAPIIVPILLMALSSVASMANMSGTGADILKFLGAPIMALAVGLIFGVILFASQKKTEDFYILTNETLKVVGPILFVTAAGGVLGKVIASSSLVGYITEHAAVLKTVGIFFPFLLAAILKSAQGSSTVAITTTAGILAPLMAPLGLATIPLSALTVMAIGAGAMTVSHANDSYFWVVTTFGGLKAEDGYKTQTLMTLVIGIAAIIGIFIISLFL

SEQ ID NO: 3200 - DNA, 1326 bp, Bacillus cereus
  CDS (1)..(1326)
atggatatatacttattaatcgtcacgttacttgcaattgcgattgttattttaggggtatcatggtggaaatggcatgcatttattagtttaacagttgcgagtttatttttagctatcatgtctggattgaatttgacgaaaatagtgactgcctatgaaactggtgtcggtagtgtactagggcatttagttggtattctagctctcggaacaattttaggaaaaatgatgtccgattcaggggccggcatgcaagtggcagatttctttattcgatttttcggtgtgaagaaactaccgtgggctatgttatttgcaggatttgttatagggattccggtattttttgaagtggggatcgtcattttattaccactcgttatttccatacgaaaaacgacgaagcaaaatatattattaattgcgttacctgttattgcgggattatctatcgtacatgggctcgtgccaccacatccaggagcgatgacagcaatcggtatttataacgcgaacttaggaaaggtactattatattcattacttatcgcgttaccaacagccattatcgcgggaccgatatttgcaaagtgggtagataaaaaggttatacctgaaaatgaaccagagcttattcgagttacgactgtctcaactgatttaccgagtcgtaaagtttcattctttattattttattaccagttgtattgatgattttatcggtcgttgcaccttatatttcattaccgaaaaagatgactgaatttttcgtttttgtaggaagcccagtaattgccttacttatttcatgttttgcagcattttatttacttggaatcagacaaggtattaataaaaagatgattaaaaaattaacagatgaaagtttactaccggtcggttctattattttaataattggtgcaggcggtggatttaaacaaatattaattgaaagcggcgttggcacggcgattgcgcaaatggcagaacatatatcgttatcaccaattgtacttgctttcatggtagctggtttaattcgaatcgcgaccggatcggctacagtagcattaacgacagcggcagggattgtttcaccagttattcagcatatgtcaggtgtaaatttagaattgctcgttatagcaaccggagcaggttcattaatgttttctcacgtaaatgatgcagggttctggcttgtaaaagagtatttaggtttgacggtgaaggaaacgtttaaaacgtggacggtactggagacattgttatcatttattgcatttggttttgcgcttttattgaatatgtttctttag

SEQ ID NO: 3201 - protein, 441 aa, Bacillus cereus
MDIYLLIVTLLAIAIVILGVSWWKWHAFISLTVASLFLAIMSGLNLTKIVTAYETGVGSVLGHLVGILALGTILGKMMSDSGAGMQVADFFIRFFGVKKLPWAMLFAGFVIGIPVFFEVGIVILLPLVISIRKTTKQNILLIALPVIAGLSIVHGLVPPHPGAMTAIGIYNANLGKVLLYSLLIALPTAIIAGPIFAKWVDKKVIPENEPELIRVTTVSTDLPSRKVSFFIILLPVVLMILSVVAPYISLPKKMTEFFVFVGSPVIALLISCFAAFYLLGIRQGINKKMIKKLTDESLLPVGSIILIIGAGGGFKQILIESGVGTAIAQMAEHISLSPIVLAFMVAGLIRIATGSATVALTTAAGIVSPVIQHMSGVNLELLVIATGAGSLMFSHVNDAGFWLVKEYLGLTVKETFKTWTVLETLLSFIAFGFALLLNMFL

SEQ ID NO: 3202 - DNA, 1389 bp, Corynebacterium diphtheriae
  CDS (1)..(1389)
atggaagattgggttcccacccttagtgctggccccttattggggatcgccgccgcggcgattgcactcattttggtcctcgtcattgtgttcaagctccacgctttcctcacactgatcatcgtttccgcagctaccggactcgccgccggcatcccactggagggcatcgtgcccaccatgaccaaaggcttcggaagtacactcgcctcagttgccctcctcgtcggcctcggagcaatgctcggccggcttgtcgaaacctccggcggtgcaaaaagcctcgccgaaaccctcgtcgcccgcttcggtgaacaacgcgcccccttcgccctcggcgtagcctccctgctgatgggtttccccatcttcttcgacgccggcctgatcgtcatgctgcccgtcatcttcgccgtggcacgccgactcaacggccccgtcctggcctacggcatccccgccgccggcgcgttctccgtcatgcacatctacctgccaccgcacccagggccaatctcagctgcagaattctacagcgcagacatcggcctcgtcatgctcctcggcctaatcatcgcgatccctacctggctgatctccggcctctggctcggtaaaaccctcggccgccgctacccactgccagttcctgacatcctagccggtggcccccaagcaaccgacgtgaaaaaccccgccacaccagggcttatcgtctccctcttgttgcttcctatgctgctcatcttcggcaacaccagcatgggccttgccacctccgcaggctgggtagacaagagctcgagcctcgtgcgcgccctacaattcgtgggcagcacccccattgccttgctgatctcaaccctcgtggcgctgtacttcctcggcattcgtcgcggccagcccaaagctgacctagaaaagcttctcgacggtgccctcggacccatctgctccgtcgtattgatcaccggtgccggtggcatgttcggtggcgtactgcgcacctccggcatcggcgacgccctagccgactccatgtccgacctcggtgtccccgtcgtcctcggctgttggctcgtcgccgccatcctgcgcctcgcccaaggctcggccaccgtggcactgaccaccgccgcagcactgatggcacccgccgtcgccgccggcggctacagcgaattccaaatcgcactcatggtgctggcctccgcagccggctccgttttcgcaggccacgtcaacgactctggcttctggctcgtcggccgcctcatgggtatggacgttgccacgaccctgcgcacctggacactcaaccaagcgctcgttggagccgtgggctttgtattcgtcctcgtcttctacggagtcagctttgccttctaa

SEQ ID NO: 3203 - protein, 462 aa, Corynebacterium diphtheriae
MEDWVPTLSAGPLLGIAAAAIALILVLVIVFKLHAFLTLIIVSAATGLAAGIPLEGIVPTMTKGFGSTLASVALLVGLGAMLGRLVETSGGAKSLAETLVARFGEQRAPFALGVASLLMGFPIFFDAGLIVMLPVIFAVARRLNGPVLAYGIPAAGAFSVMHIYLPPHPGPISAAEFYSADIGLVMLLGLIIAIPTWLISGLWLGKTLGRRYPLPVPDILAGGPQATDVKNPATPGLIVSLLLLPMLLIFGNTSMGLATSAGWVDKSSSLVRALQFVGSTPIALLISTLVALYFLGIRRGQPKADLEKLLDGALGPICSVVLITGAGGMFGGVLRTSGIGDALADSMSDLGVPVVLGCWLVAAILRLAQGSATVALTTAAALMAPAVAAGGYSEFQIALMVLASAAGSVFAGHVNDSGFWLVGRLMGMDVATTLRTWTLNQALVGAVGFVFVLVFYGVSFAF

SEQ ID NO: 3204 - DNA, 1338 bp, Corynebacterium diphtheriae
  CDS (1)..(1338)
atgacgggcatggcgctcctaggactcggcgtcgtagcagtcgcggtccttctattgctcgtgatttggctacgggtaccggccttcgtggcattaatcggtgtatctatcgccacggctttgtgctccggtgtccctttaggggacgcggtttccaccgttaccgacggtgttggaaaaacgcttggatcagtaattgtcgtggtcggccttggtgccatgctcggcaagatgatagaggtatccggcggcgcagaggcggttgctcaatactttacgacccgtcttggtcccgcaaaagtcgccggcgcggtgacacttgctgcgttcatcctaggcatccccgtatttttcgacgtcggattcattattctcgcgccgataatatttggattttcggcggtagccaagcaaaatcctctcaagatcggtctgccggttgctggcgcgttgttaactgtccatgtcacgcttccaccgcacccgggaccagtcgcggtagctggggtcttagactcggatgtgggcatgatgcttacgtttggtttgcccatcgcggcaatcactgctgcgatcggtttctttgcagccaagctactgaaagttgagaagattgagcgcgacaagtctccagtcgagctcgaggacacggacccgactggagtggcaccgtcgccgtttctcatcctcggtctgatcctacttccgattgttctgatcatggtgggaactaccggtgcgatgctgacaaaagaagatacgacggtgaatactttcgtaagcttcattggcagctctccggtcgcgctcctgatagctgtgatcgttgcgtggttcttcatcggtcgccagcagcattggaacctcgaacggggagccagcgtcatggattcagcgcttccggcagtggcggtcattatttttgtcactggtgctggcggtggcttcgctaatgttctcgtgaaatccggtattggaaaggttctatcagacatccttgtgaacgcacatatgccgttgattctcatggcgttcttgctctcgttggcacttcgcgcgtcacaaggatccgctacggtagcgatgcttacaacggcgggtttgattaatcagccgattattgatgacggtcttagcactgctcagacttcgttggtcatgttgacaatcggttttggtgctcttggtctatcgcacatcaatgactctggtttctggattgttaccaagtacttgggaatgtcagtgaaacaggggcttaagtcgtggacgcttctttcgactgtattcggagtaaccggattcctcctgacgtggggcgtttacgccatcgtttaa

SEQ ID NO: 3205 - protein, 445 aa, Corynebacterium diphtheriae
MTGMALLGLGVVAVAVLLLLVIWLRVPAFVALIGVSIATALCSGVPLGDAVSTVTDGVGKTLGSVIVVVGLGAMLGKMIEVSGGAEAVAQYFTTRLGPAKVAGAVTLAAFILGIPVFFDVGFIILAPIIFGFSAVAKQNPLKIGLPVAGALLTVHVTLPPHPGPVAVAGVLDSDVGMMLTFGLPIAAITAAIGFFAAKLLKVEKIERDKSPVELEDTDPTGVAPSPFLILGLILLPIVLIMVGTTGAMLTKEDTTVNTFVSFIGSSPVALLIAVIVAWFFIGRQQHWNLERGASVMDSALPAVAVIIFVTGAGGGFANVLVKSGIGKVLSDILVNAHMPLILMAFLLSLALRASQGSATVAMLTTAGLINQPIIDDGLSTAQTSLVMLTIGFGALGLSHINDSGFWIVTKYLGMSVKQGLKSWTLLSTVFGVTGFLLTWGVYAIV

SEQ ID NO: 3206 - DNA, 25 bp, Primer
atgccattaatcattattgcggcag

SEQ ID NO: 3207 - DNA, 25 bp, Primer
ttagtgcaatacggcgttaatggct

SEQ ID NO: 3208 - DNA, 1659 bp, Saccharomyces cerevisiae
  CDS (1)..(1659)
atgtccgtaacttttaaggacgatgttcatcggattctgaagtttgttgctaattgcaatggcaggtttgaagattccaaatgtgatataagagaatcgcctctcggtggattgggtgtctttgcaaagactgatattgcagaaggtgagtcaatattgacgttgaacaaatcctcgattttttctgcatctaacagctccattgccaatttgttatgtgacagtagcatcgatggaatgttagctctaaacatcgcattcatttacgaaactacagttttcagaaattctagtcattggtacccatttctgcgaactatccgaattcgtgatgacgaagggcacttaaacctgccgccaagcttttggcatgcggatgctaagcgacttttaaaaggaaccagtttcgataccttattcgattcgttggcaccagaagaagaaatcatggaaggatttgaaattgctgtggatttggcacacaaatggaacgacgagtttgggttggaaattccaaaaggcttcctagacgttagtgaggagaatcatgaagaagattacaatttgaaattagaaaagtttatatcggtggcatatactttatcatcaagaggatttgaaattgacgcgtaccatgagacagctttggtgcccatcgcagacctgttcaatcatcatgtttccgacccggatttaaagtttgtatcgctatatgatgtgtgcgataaatgtggtgaaccagacatgtgtaaacatctcatagcagaggaatacttggaagcagaaaatctagacaaaaatatgcccaaagtcgcaagtatggagactcgtgtcatcgatgaagacttaatcaaaagtttagaaaatgatttagagaaagaatactctaatgttacggcaaacatcgaggatgatgatggcggtattgaaaaccctgacgaatgtgtcgatttagtgttaaagaatgacgtcgcacaaggccaagaaatatttaattcctatggtgagctctcaaacgtctttttgttggccagatatggtttcaccgtacctgagaatcagtatgatattgttcatttaggacctgattttatgaaaatcttaaagaaagaagaaaaatatcaagaaaaagtcaagtggtggagccaagtcggtcatggcttgttttcagcatggtatgctcaaatgcgccaagaagatgaagaagacgaagacggtcaagcaaaatcagacaatctgtctgacgatatagagagcgaagaggaagaggaagaggaagagggtgatgatagcttggaatcatggctttcccagctttacatagactcaagtggcgagccttcaccctcaacgtgggccttagctaaccttttgactttaacggccgttcaatgggaatcattgttttccaaaaaggccactcctcacatcagtgattctatagttaacgaagaaaagctgcccttcctggccaaaaaagacaatccccattccaagaaactgctttccaacttacttaaggaaaagcaactaccttgcataaaaggcgacaactcgtcaaagataacaagtgctactaaaagcatgctccaaaatgctcgaacacttgtacaatcggagcataatatcttagatagatgtctcaagagactatcctaa

SEQ ID NO: 3209 - protein, 552 aa, Saccharomyces cerevisiae
MSVTFKDDVHRILKFVANCNGRFEDSKCDIRESPLGGLGVFAKTDIAEGESILTLNKSSIFSASNSSIANLLCDSSIDGMLALNIAFIYETTVFRNSSHWYPFLRTIRIRDDEGHLNLPPSFWHADAKRLLKGTSFDTLFDSLAPEEEIMEGFEIAVDLAHKWNDEFGLEIPKGFLDVSEENHEEDYNLKLEKFISVAYTLSSRGFEIDAYHETALVPIADLFNHHVSDPDLKFVSLYDVCDKCGEPDMCKHLIAEEYLEAENLDKNMPKVASMETRVIDEDLIKSLENDLEKEYSNVTANIEDDDGGIENPDECVDLVLKNDVAQGQEIFNSYGELSNVFLLARYGFTVPENQYDIVHLGPDFMKILKKEEKYQEKVKWWSQVGHGLFSAWYAQMRQEDEEDEDGQAKSDNLSDDIESEEEEEEEEGDDSLESWLSQLYIDSSGEPSPSTWALANLLTLTAVQWESLFSKKATPHISDSIVNEEKLPFLAKKDNPHSKKLLSNLLKEKQLPCIKGDNSSKITSATKSMLQNARTLVQSEHNILDRCLKRLS

SEQ ID NO: 3210 - DNA, 1596 bp, Arabidopsis thaliana (mouse-ear cress)
  CDS (1)..(1596)
atggccacaaggagattaagagcattcaagagatggatgcaagctaacggcgttgattgcagcgaagctctcaacctcgtcgacgacgaaaacgatggtgtctctgtgagagcattctgcgatttgaaggaaggagatgttgttgccaatatctcaaaaactgcttgtctcactatcaaaaccagtggagctcgtgagatgatcgaatctgctgatttagatggaagtttaggtctctctgtggctctcatgtacgagagaagcttaggtgaagaatctccttgggctggttatcttcagattcttcctattcaagaagatttgcctcttgtttggtctcttgaagacttagattctctcttatctggaactgagcttcataagttggtgaaggaagatcatgttcttatatatgaggattggaaagaaaacattttgccgcttacctcttcactgcctcagaatgttgattctgattcgtttggaatcaaagagtatcttgctgctaagagtttaattgcttcacggtctttcgaaatcgatgattaccatggatccgggatggttcctcttgcagacctctttaatcataaaactggggcagaagacgttcacttcactcatgaatccgattctgaagctgatgaatctgacaacgatgatgctgcaaatgagaccactgatgaagacgagccttccagtaaaatttcttcctcgcctgagcagtcttttgaggaagttcctggtgaaaacactgatgacgaagccaaagaagaagaagaagaagaagaagaagaagaagaaggagaagaagaagaagaaggagaagaggaagaagaaaactcttcaatgctgcaaaatgatcaatccggtctaaaaatgattatggtgaaggatgtctcagctggagctgaggtattcaatacatacggtttgatgggtaatgctgcattactccacaggtacggatttacagagctcgataatccatatgacatagtaaacatagatctagaattagtaaccgaatggagcacatcctcattcacaagccggtacactcgagctagactggccttgtggagaaaactaggttacacaggatgcgagagtcaaaactcagaatactttgaggtatcttcaaccggagaaccccaaaccgagctcctgatcctactctatatactgctcttaccagacgacacatacaataaactggatctagctgaatcaacaacaggagcttctccctcgaaagaaggaaaaagatcttcttcttacgagataacaattgggaaacacaagtttgtgtatggagaaagcggaaatgatattcttctgacagatggtgtttgtgaagctcttctaactattgtggataagcgagagagtttatatggatcattgagctcattggaagatgacattgttagggtgaagacttgttgtcttccgagagacaggagactatatcattcgcttgtgttgcgtgtgagtgagaggaagattctaaagaagcttaggagctacatccatacccagaccaatgagtcttccagcggaaagcgccggaagaagatggttccaaaatcctag

SEQ ID NO: 3211 - protein, 531 aa, Arabidopsis thaliana (mouse-ear cress)
MATRRLRAFKRWMQANGVDCSEALNLVDDENDGVSVRAFCDLKEGDVVANISKTACLTIKTSGAREMIESADLDGSLGLSVALMYERSLGEESPWAGYLQILPIQEDLPLVWSLEDLDSLLSGTELHKLVKEDHVLIYEDWKENILPLTSSLPQNVDSDSFGIKEYLAAKSLIASRSFEIDDYHGSGMVPLADLFNHKTGAEDVHFTHESDSEADESDNDDAANETTDEDEPSSKISSSPEQSFEEVPGENTDDEAKEEEEEEEEEEEGEEEEEGEEEEENSSMLQNDQSGLKMIMVKDVSAGAEVFNTYGLMGNAALLHRYGFTELDNPYDIVNIDLELVTEWSTSSFTSRYTRARLALWRKLGYTGCESQNSEYFEVSSTGEPQTELLILLYILLLPDDTYNKLDLAESTTGASPSKEGKRSSSYEITIGKHKFVYGESGNDILLTDGVCEALLTIVDKRESLYGSLSSLEDDIVRVKTCCLPRDRRLYHSLVLRVSERKILKKLRSYIHTQTNESSSGKRRKKMVPKS

SEQ ID NO: 3212 - DNA, 1581 bp, Dictyostelium discoideum
  CDS (1)..(1581)
atgaataaccaagtaaaaccaactttatcaaataaagcagaaataataaataaatggttaattgataatggtgtaagaattaataataaattaattaaaatagtttatttaggaaaggaaaataattttgagcaaactgaaaatacaacagcaacaactactacaagtgaaagaataaatgattcaattgtatcaggattaggtgttattagtttaaaagaattaaaagttgatgatattgtagcaaaaattccaaaatcaattattttatcgattcatacatcctcaatttcaaatatattagagaaatataaaattgaaaataatataggtacatcgattgcattaatacatgaagcatcattaggtgaaaaatcaaaatggtatggatatatttcatcattaccacgtaaagttgatgtaccaattctatgggattcagaatcaagaaagcttttaaaaggtacagcaatagaagatgttttaaatgatgatgatattttaattaatcaagtttacgcagatgtaattgaatcaattctctcaaaaaatcatccagaaatatttggagataaagaactatatagtattgaaaactttaaaattgcaaattcaatcatttcatcaagagcattttgtgttgattcttatcatggtgactcattagtaccattggcagatatattcaatcatcaaactgcaagagaacatgttcatattgaatcaaatggtgatgtctgtaataaatgtggttcaattaaaacctgtaaacatagaaaagttgtaactcaacatcatactgttaattcaacaaaaggtaaaagaactcataaagttgctggtataccatcatctaaaaaacatattcataaaggtaattgttgttcaacaacaaccacaaaaactaatgaagaagataaagatacaattattgaagaagatgatgaacatttatatattaaagttgttaaaggtgttgaagcaaataaagaagtttataatacatatggtgatcatgataatgcaattcttttaagtaaatatggatttttagagatggataatccatgtgatagattatcaattgataaacaattagttgataaagaattagaattgattggagcagagaatcaaataactagaatggatttatttaatcgtattagtttttatgctgaaatgtttgatattgattccagaaataatcatgcaattgaaaatgatggtagattagatgatgcattagtttgttcagttggtattgcattagcaccacaatcaattttccaaagttggaaatcaatgtctgaacataaaagagagaaatactttgaacaattagaagctgaagatatcgtcaaacaaagtcaattagtacgtaatactttattatcaattttaaataaattattttcaaattataataattcaaatgaaacaacagcaacaacaacaattgaacaagatcaagaaaaattatcaactttaaaaaatcaaagagaaattattgctcaatctttaaaaatttgtgaaaaaactttaattaataaatcaattaattattataaaaatttataa

SEQ ID NO: 3213 - protein, 526 aa, Dictyostelium discoideum
MNNQVKPTLSNKAEIINKWLIDNGVRINNKLIKIVYLGKENNFEQTENTTATTTTSERINDSIVSGLGVISLKELKVDDIVAKIPKSIILSIHTSSISNILEKYKIENNIGTSIALIHEASLGEKSKWYGYISSLPRKVDVPILWDSESRKLLKGTAIEDVLNDDDILINQVYADVIESILSKNHPEIFGDKELYSIENFKIANSIISSRAFCVDSYHGDSLVPLADIFNHQTAREHVHIESNGDVCNKCGSIKTCKHRKVVTQHHTVNSTKGKRTHKVAGIPSSKKHIHKGNCCSTTTTKTNEEDKDTIIEEDDEHLYIKVVKGVEANKEVYNTYGDHDNAILLSKYGFLEMDNPCDRLSIDKQLVDKELELIGAENQITRMDLFNRISFYAEMFDIDSRNNHAIENDGRLDDALVCSVGIALAPQSIFQSWKSMSEHKREKYFEQLEAEDIVKQSQLVRNTLLSILNKLFSNYNNSNETTATTTIEQDQEKLSTLKNQREIIAQSLKICEKTLINKSINYYKNL

SEQ ID NO: 3214 - DNA, 1488 bp, Oryza sativa
  CDS (1)..(1488)
atggaagcttccgcctccacctccaccgcacgccgcctacgggccttcaggcggtggatgcgggaccacggcgtcgtctgcagcaacgcgctccgcctcgacgccgccgaggacggtggcggcggcgtctacgtgcgcgccctcgccgcgctccgggagggggacctcgtggccaccatcccgcggggcgcgtgcctgaccccgcgcacctccggcgccgccgaggccatcgaggccgcggagctcggcgggcccctcgcgctcgccgtcgccgtcatgtatgagcgcgcgcgcggcgccgagtcgccgtgggacgcctacctccgcctgatccccgagcgggagcccgtgccgctcgtctggcccgccgatgaggccgagcgcctcctggccggcaccgagctcgataagatagtgaagcaagacaggcagttcatatgtgaggactggaaagagtgtattgagccactcattttgtcaggagaacttgaggttgacccagatgattttagcctggagaattatttctctgctaagagtctactttcgtcgaggtccttccgaatagatagctatcatgggtctggaatggttcccctggctgacctttttaaccacaagactggtggggaacatgtccacttcacttcagtgttagaagcctcggactcagatagtgaagatggtgaagatccaaacaatgcttctgctgatgaacagtcaactatagaaaattctgccgacatcccttcaggagatgacgatgaagatttggaaatgattgttgtgagagatgtcaatgaaggggaggaggtttttaacacatacggtaccatgggaaatgctgctttgcttcatcgatatggcttcacagagatggacaactcatatgacatcgtcaacatcgacttagctctggttactaagtggtgctcttctaagtactcccgtcgatatgcaagagcaagggtatcactctggcataatctgggctattcaggttgcaccagccaagatgctgactactttgagatttcatatgatggagagccccagcttgaacttttgatcctgctttatatcatctccttgaagtctgatgcttatgacaagctggccagcgtggctcatgatctgattggtgatgatgaggtcgacagcattagtagtgtgcttaaggttgtcagagtaacaagctccaatcaacatccagatattagcgggcttgaaaaattgcctgatgttaagaagctattgcttaatgagagcgtttgttctgcacttgtatcccttgttgacatgagggagagcctctatggttcaaacactttggaagatgacaggcaaaaactgcaagcatgctcttctgtcaacgaaaggaatctctatcattctttggtgctgcgggtgagcgagagaacaatacttcacaaattgaagaaacatgcatctagttggtcaaagaccaagaagaggaaacagctctag

SEQ ID NO: 3215 - protein, 495 aa, Oryza sativa
MEASASTSTARRLRAFRRWMRDHGVVCSNALRLDAAEDGGGGVYVRALAALREGDLVATIPRGACLTPRTSGAAEAIEAAELGGPLALAVAVMYERARGAESPWDAYLRLIPEREPVPLVWPADEAERLLAGTELDKIVKQDRQFICEDWKECIEPLILSGELEVDPDDFSLENYFSAKSLLSSRSFRIDSYHGSGMVPLADLFNHKTGGEHVHFTSVLEASDSDSEDGEDPNNASADEQSTIENSADIPSGDDDEDLEMIVVRDVNEGEEVFNTYGTMGNAALLHRYGFTEMDNSYDIVNIDLALVTKWCSSKYSRRYARARVSLWHNLGYSGCTSQDADYFEISYDGEPQLELLILLYIISLKSDAYDKLASVAHDLIGDDEVDSISSVLKVVRVTSSNQHPDISGLEKLPDVKKLLLNESVCSALVSLVDMRESLYGSNTLEDDRQKLQACSSVNERNLYHSLVLRVSERTILHKLKKHASSWSKTKKRKQL

SEQ ID NO: 3216 - DNA, 1518 bp, Ashbya gossypii
  CDS (1)..(1518)
atgtcagctacgcagcaggcagacgtcgatgatattctttcattcgtgcaagagtcaggtggccgattcctccgtccgcagtgcagcatccagctgtcgcccgagggtggcctcggcgtgttcgcagccgaagacatcgcagccaacaccgtcctgctgcgcgttccgaagtccgccgtcttttcggcccccaacagcagcattgccaatctcctactcgaggagggcctccatggaatgctcgcgctggtgattgcgttcatctacgagacgaccgggttccggaatgccagccactggtgcaagtacctgcatagcatcaggtacacagatgcccggggcaacctcgtgctgccgccgtccttctggcctgccaagtccaagcacccccttcgcgtcaccgcgctaaatacgctgcaccatgcccttgacgcggagcccgaggtcgtggacgggtatgagcgcgccgtagcttgtgcttacaaatggcgtacggaggccgatttaccgattcccccgctacttcgccgtccagagaccgatgatcagcgaacccgcgggttgcgtcggtttgtcgctgtgacctacgcgctcgcctcgagagcgttcgatatcgacgacttccatggaaatggccttgtccctattgctgatcttttcaaccatcatgtaacccgcccgcacgtccgcttcgaggccgctgctgatgtatgcgtcatctgcggggagtccggtccatgcgggcattcccacactggcttgcaagccgaaagtcaacccctgttgcctaatgcggagctatgcgtccgcgaacccgtcgaacgaccggtgtcgcttacggccaagatacaagaggatcatgcggcagacacaagtacaggcacacctccggaggcgtcttggctctcttttcctgcggatgactgtgtcgatatcagggctgtcgcggatatccggcgtgacactgagatctacaacacctatggggaactctccaatccattacttctggcgaggtatggatttcgggtattgcacaacccgcatgacgtcgcgcattttgccccggaggttcgtcgattgtgtaaccagggaggccagggtcttgtgtcgcgactacgctggtggcagcagaccgggtacgctctctactgcaaagttactggcgcttcagacgatggggactcgtggcaagatgcagtatacgccgatagcagcggagagccttcgcccgcgctctgggcgctcgcagagctactttcgggtgcggggaacggctggcgcatgatgcggcgcagccctgtaaccgcggccagcgtgtggagccgacggaatgcaaacggagggcggaatcggcgggcgctgaccgtacttcgcagacttgcggcgctgaaacgagcgttacttttagcagcactgcccgagcggcattcaatgggcacagagctgttagaggatgaaataagcattgtaaatcgactcctggaaaagctcggccgctccaggaaagcactctag

SEQ ID NO: 3217 - protein, 505 aa, Ashbya gossypii
MSATQQADVDDILSFVQESGGRFLRPQCSIQLSPEGGLGVFAAEDIAANTVLLRVPKSAVFSAPNSSIANLLLEEGLHGMLALVIAFIYETTGFRNASHWCKYLHSIRYTDARGNLVLPPSFWPAKSKHPLRVTALNTLHHALDAEPEVVDGYERAVACAYKWRTEADLPIPPLLRRPETDDQRTRGLRRFVAVTYALASRAFDIDDFHGNGLVPIADLFNHHVTRPHVRFEAAADVCVICGESGPCGHSHTGLQAESQPLLPNAELCVREPVERPVSLTAKIQEDHAADTSTGTPPEASWLSFPADDCVDIRAVADIRRDTEIYNTYGELSNPLLLARYGFRVLHNPHDVAHFAPEVRRLCNQGGQGLVSRLRWWQQTGYALYCKVTGASDDGDSWQDAVYADSSGEPSPALWALAELLSGAGNGWRMMRRSPVTAASVWSRRNANGGRNRRALTVLRRLAALKRALLLAALPERHSMGTELLEDEISIVNRLLEKLGRSRKAL

SEQ ID NO: 3218 - DNA, 25 bp, Primer
atgtccgtaacttttaaggacgatg

SEQ ID NO: 3219 - DNA, 25 bp, Primer
ttaggatagtctcttgagacatcta

SEQ ID NO: 3220 - DNA, 2313 bp, Saccharomyces cerevisiae
  CDS (387)..(2066)
aacgcgttgcgcgtttcctttatctctggtacttaacagtatatggagttaaaagtgtgggattgtttgtcgtctaagtaaaaccatgtgtgagtaatctgtgaacgatcaaggatagtgtaaaatagcttagcaacaatagtcttttaacatgcggacataaggtcactttttggcacaagatgatagtaaatgttgcacattatgagcagtattttaatacatcacttcggacgatgcggcatatccagaattgcagatttagtaaatcacaagctccagggaactgttgaaacctctattaaaagacgcaaagacaactaaggagacattcaacagggctagacaagtcacggcttactgctaaataacgtatacaatacgctatgatggaagaattctcgtacgatcacgattttaacacacattttgctacagatttggattatttgcaacatgaccaacaacaacaacaacagcaacaacatgatcaacaacataatcaacagcaacaaccacaaccacaaccaattcaaactcaaaacctggagcacgaccacgaccaacatactaatgatatgagtgcttcatcgaatgcatcagatagtggacctcaaaggcccaagaggactcgcgcaaagggtgaagcactagatgtgctaaagcgtaaatttgaaataaatccaacaccctctttggtagaaagaaagaaaatatcagatctgataggaatgcctgaaaaaaacgtcagaatttggtttcagaacagaagagctaaattgaggaaaaagcagcatggaagtaataaggacacaatcccctcgtcacaatcccgtgatattgccaacgattacgatcgtgggagtacagacaacaatttggtcactacaacaagtacttcatccatatttcacgatgaagacctgacttttttcgaccgtattccgctgaacagcaacaacaactattatttttttgacatttgctcaattactgtgggaagttggaatagaatgaaaagcggcgcactgcaaagaaggaactttcagtctataaaggagttgagaaacctatcgccaataaagattaataacataatgtcgaatgccacagatttaatggttttgatatccaagaaaaactcagaaataaactatttttttagtgccatggcaaataatactaaaattctcttcaggatctttttcccattaagttcagtcacgaattgctctctaactttagaaactgacgacgatataataaatagtaacaacacaagcgataaaaacaatagtaatactaataatgatgatgataacgacgataacagtaatgaagacaatgataatagtagtgaggataagaggaatgctaaggataactttggagaattgaagctaacagtcaccagatcacccacttttgctgtttactttttaaataatgctcctgatgaagatccaaatttgaacaatcagtggtccatatgtgatgatttctcagaaggtagacaggtaaatgacgcatttgttggtggttcgaatattcctcacactttgaaaggtttacagaaatcattaagattcatgaattctctaattctagactataaatcatcgaatgaaatattacctacgatcaatacagcgatccccactgctgcagttccacaacagaatattgcccctccctttctgaatacaaattcaagtgcaacagactcaaatccaaatacaaatttagaagattctctcttcttcgatcatgatctgttatcgagttcgataaccaacaccaacaacggacaaggctctaataatggacgtcaagctagcaaggatgatacgctcaatttactggatactaccgtcaacagcaataacaatcataatgctaataatgaggagaatcatctagcgcaagaacatttatccaacgatgctgatattgttgcaaatccaaatgatcatttgttgtctttaccgactgatagtgaactcccaaatactccagattttttgaagaacactaacgaactaactgacgagcatagatggatatgatgaaaataattctgtttttttttttttgcgattgcattttcaactctaaatattactctaacagtatttcctaattatttcataggtaacattgtatgacattttaattttattgtccttattattttacttacttagctgacttttttgaacattatcagatgggtatatagatatttacaagctcgcgttataggtggagacatgtgtccttatataaatcgcaaaaagaatcgatcagacattt

SEQ ID NO: 3221 - protein, 559 aa, Saccharomyces cerevisiae
MMEEFSYDHDFNTHFATDLDYLQHDQQQQQQQQHDQQHNQQQQPQPQPIQTQNLEHDHDQHTNDMSASSNASDSGPQRPKRTRAKGEALDVLKRKFEINPTPSLVERKKISDLIGMPEKNVRIWFQNRRAKLRKKQHGSNKDTIPSSQSRDIANDYDRGSTDNNLVTTTSTSSIFHDEDLTFFDRIPLNSNNNYYFFDICSITVGSWNRMKSGALQRRNFQSIKELRNLSPIKINNIMSNATDLMVLISKKNSEINYFFSAMANNTKILFRIFFPLSSVTNCSLTLETDDDIINSNNTSDKNNSNTNNDDDNDDNSNEDNDNSSEDKRNAKDNFGELKLTVTRSPTFAVYFLNNAPDEDPNLNNQWSICDDFSEGRQVNDAFVGGSNIPHTLKGLQKSLRFMNSLILDYKSSNEILPTINTAIPTAAVPQQNIAPPFLNTNSSATDSNPNTNLEDSLFFDHDLLSSSITNTNNGQGSNNGRQASKDDTLNLLDTTVNSNNNHNANNEENHLAQEHLSNDADIVANPNDHLLSLPTDSELPNTPDFLKNTNELTDEHRWI

SEQ ID NO: 3222 - DNA, 1674 bp, Saccharomyces cerevisiae
  CDS (184)..(1671)
gaattctcgtacgatcacgattttaacacacattttgctacagatttggattatttgcaacatgaccaacaacaacaacaacagcaacaacatgatcaacaacataatcaacagcaacaaccacaaccacaaccaattcaaactcaaaacctggagcacgaccacgaccaacatactaatgatatgagtgcttcatcgaatgcatcagatagtggacctcagaggcccaagaggactcgcgcaaagggtgaagcactagatgtcctaaagcgtaaatttgaaataaatccaacaccctctttggtagaaagaaagaaaatatcagatctgataggaatgcctgaaaaaaacgtcagaatttggtttcagaacagaagagctaaattgaggaaaaagcagcatggaagtaataaggacacaatcccctcgtcacaatcccgtgatattgccaacgattacgaacgtgggagtacagacaacaatttggtcactacaacaagtacttcatccatatttcacgatgaagacctgacttttttcgaccgtattccgttgaacagcaacaacaactattatttttttgacatttgctcaattactgtgggaagttggaatagaatgaaaagcggcgcactgcaaagaaggaactttcagtctataaaggagttgagaaacctatcgccaataaagattaataacataatgtcgaatgccacagatttaatggttttgatatccaagaaaaactcagaaataaactatttttttagtgctatggcaaataatactaaaattctcttcaggatctttttcccattaagttcagtcacgaattgctctctaactttagaaactgacgacgatataataaatagtaacaacacaagcgataaaaacaatagtaatactaataatgatgataataacgacgataacagtaatgaagacaatgataatagtagtgaggataagaggaatgctaaggataactttggagaattgaagctaacagtcaccagatcacccacttttgctgtttactttttaaataatgctcctgatgaagatccaaatttgaacaatcagtggtccatatgtgatgatttctcagaaggtagacaggtaaatgacgcatttgttggtggttcgaatattcctcacactttgaaaggtttacagaaatcattaagattcatgaattctctaattctagactataaatcatcgaatgaaatattacctacgatcaatacagcgatccccactgctgcagttccacaacagaatattgcccctccctttctgaatacaaattcaagtgcaacagactcaaatccaaatacaaatttagaagattctctcttcttcgatcatgatctgttatcgagttcgataaccaacaccaacaacggacaaggctctaataatggacgtcaagctagcaaggatgatacgctcaatctactggatactaccgtcaacagcaataacaatcataatgctaataatgaggagaatcatctagcgcaagaacatttatccaacgatgctgatattgttgcaaatccaaatgatcatttgttgtctttaccgactgatagtgaactcccaaatactccagattttttgaagaacactaacgaactaactgacgagcatagatggatatgatga

SEQ ID NO: 3223 - protein, 495 aa, Saccharomyces cerevisiae
MSASSNASDSGPQRPKRTRAKGEALDVLKRKFEINPTPSLVERKKISDLIGMPEKNVRIWFQNRRAKLRKKQHGSNKDTIPSSQSRDIANDYERGSTDNNLVTTTSTSSIFHDEDLTFFDRIPLNSNNNYYFFDICSITVGSWNRMKSGALQRRNFQSIKELRNLSPIKINNIMSNATDLMVLISKKNSEINYFFSAMANNTKILFRIFFPLSSVTNCSLTLETDDDIINSNNTSDKNNSNTNNDDNNDDNSNEDNDNSSEDKRNAKDNFGELKLTVTRSPTFAVYFLNNAPDEDPNLNNQWSICDDFSEGRQVNDAFVGGSNIPHTLKGLQKSLRFMNSLILDYKSSNEILPTINTAIPTAAVPQQNIAPPFLNTNSSATDSNPNTNLEDSLFFDHDLLSSSITNTNNGQGSNNGRQASKDDTLNLLDTTVNSNNNHNANNEENHLAQEHLSNDADIVANPNDHLLSLPTDSELPNTPDFLKNTNELTDEHRWI

SEQ ID NO: 3224 - DNA, 1446 bp, Ashbya gossypii
  CDS (1)..(1446)
atggacaacttcgagtacccgggtggggagttcgggcggttcaaccaggagttcgggtcgccagaggagatgctgaacaacgggcacggggaactgcggtcggacaatggggaggcgacgggcaacagcaagtcgccgggtcatggggagcttgcggaggcggcggacggcggcaagccgaagtccaagcgcactcgcgcgacaggagaggccctggagctgctgaagaaggagttcgacatcaacccgaacccgaatgcgcagaatcggaagcgcatctcagagcagacggggctgccggagaaaaacgtgcggatctggttccagaaccggcgtgcaaagtaccgcaagagcgaccgcactttcaaccagcgcacggcagccacggacatgaacacgtttggctcgatctctgtgacggtggagtacgacaagatcccactgaacatcaacgacaactactatttcatagacgccaactctctgacggtggggagctggaagagactgaaaagtgggaacctgcaccgcgagagcctgtcgaacatcaagtatctctcgaatctctcaccgacgtcgatcaacatgatcatgtctaacgccaccgatctgatggtgctgatctccaagaagaactttgaggtaaactactttttctcggccattgccaataacacgaagattctattcaggatcttcttcccaatcaactccgtactgaactgctcgctgctacttcatgcagaaggtggtaaaaaggacgaggatgatgcgaataatgtagtgcaggaaactacggcacctgctgcggagcaggtctgcgaactgaagctgaacgtctccaagccgccgaactttgcggtgtatttttcggacatgaacgacgagctgacttctaatcagtggtcgatctgcgaagatttttccgagggtcgtcaggtcagcgatgcatatgtgggtggctccaactttccccatgtgctaactggccttgaggcgtcgctgaagtttatgagttcgctgatccttgattacaacagcacgacacatgtagtcccccatgctcaacctcaacctcatcctcattctcatccgcaccacagcagtgatccagcacaggcgatcgtcctacagccagagccccactccctggcacaatctgcattttttagaaattacggaccgcattctacagacgacatactcgatatacaggatccggatcagtatgagactgcgcagaccgcgaacaccgagtttccaagtacttcgaccgcagcaggttcgcatttcctcactgcgcaccttgctgacacacagatacccaaaacacccgaatttttaaaccaacatactgatttgcataatgatgatcaacacggattgaacaatctgttaaatttcaacgatcaaccacatacaagcaacgccgaacaaaattactga

SEQ ID NO: 3225 - protein, 481 aa, Ashbya gossypii
MDNFEYPGGEFGRFNQEFGSPEEMLNNGHGELRSDNGEATGNSKSPGHGELAEAADGGKPKSKRTRATGEALELLKKEFDINPNPNAQNRKRISEQTGLPEKNVRIWFQNRRAKYRKSDRTFNQRTAATDMNTFGSISVTVEYDKIPLNINDNYYFIDANSLTVGSWKRLKSGNLHRESLSNIKYLSNLSPTSINMIMSNATDLMVLISKKNFEVNYFFSAIANNTKILFRIFFPINSVLNCSLLLHAEGGKKDEDDANNVVQETTAPAAEQVCELKLNVSKPPNFAVYFSDMNDELTSNQWSICEDFSEGRQVSDAYVGGSNFPHVLTGLEASLKFMSSLILDYNSTTHVVPHAQPQPHPHSHPHHSSDPAQAIVLQPEPHSLAQSAFFRNYGPHSTDDILDIQDPDQYETAQTANTEFPSTSTAAGSHFLTAHLADTQIPKTPEFLNQHTDLHNDDQHGLNNLLNFNDQPHTSNAEQNY

SEQ ID NO: 3226 - DNA, 25 bp, Primer
atgatggaagaattctcgtacgatc

SEQ ID NO: 3227 - DNA, 25 bp, Primer
tcatatccatctatgctcgtcagtt

SEQ ID NO: 3228 - DNA, 603 bp, Saccharomyces cerevisiae; identical to SEQ ID NO: 1305
  CDS (1)..(603)

SEQ ID NO: 3229 - protein, 200 aa, Saccharomyces cerevisiae; identical to SEQ ID NO: 1306

SEQ ID NO: 3230 - DNA, 714 bp, Candida albicans; identical to SEQ ID NO: 1307
  CDS (1)..(714)

SEQ ID NO: 3231 - protein, 237 aa, Candida albicans; identical to SEQ ID NO: 1308

SEQ ID NO: 3232 - DNA, 24 bp, Primer
atggcaggtatcaagttgacgcat

SEQ ID NO: 3233 - DNA, 28 bp, Primer
tcattttgttaatagttttttgtatgct

SEQ ID NO: 3234 - DNA, 777 bp, Saccharomyces cerevisiae
  CDS (1)..(777)
atgggttccagaagatacgattccaggacaacaattttctcccctgagggacgtctatatcaggttgaatacgcgctagaatccatttcacatgcaggtaccgcaattgggattatggcatctgatgggattgttcttgcagcagaacgcaaagtcacaagtactttactagaacaagacacctctaccgaaaaactttataagttaaacgataaaattgcggttgccgttgctggactgactgcagatgcagaaattctaataaatacggctagaattcacgctcaaaattaccttaaaacctataatgaagatataccagtagaaattttggtgagaaggctaagtgatataaaacaaggttacacgcaacatggtggtttaagaccatttggtgtgtcctttatctacgccggttatgacgatagatacggttaccaattgtatacatctaatccatcgggaaactatacagggtggaaggctattagtgttggcgctaacacatcagcagcacaaaccctacttcaaatggactacaaggatgatatgaaagtcgatgatgccattgaactggctttaaaaacgttatccaaaactaccgacagtagcgcgctgacttatgacaggttggaatttgctactatcagaaagggtgctaatgacggagaagtgtatcagaagattttcaagcctcaagagataaaggatatattggtaaagactggtattaccaagaaggatgaagacgaagaagctgatgaagatatgaaataa

SEQ ID NO: 3235 - protein, 258 aa, Saccharomyces cerevisiae
MGSRRYDSRTTIFSPEGRLYQVEYALESISHAGTAIGIMASDGIVLAAERKVTSTLLEQDTSTEKLYKLNDKIAVAVAGLTADAEILINTARIHAQNYLKTYNEDIPVEILVRRLSDIKQGYTQHGGLRPFGVSFIYAGYDDRYGYQLYTSNPSGNYTGWKAISVGANTSAAQTLLQMDYKDDMKVDDAIELALKTLSKTTDSSALTYDRLEFATIRKGANDGEVYQKIFKPQEIKDILVKTGITKKDEDEEADEDMK

SEQ ID NO: 3236 - DNA, 705 bp, Saccharomyces cerevisiae
  CDS (1)..(705)
atgttcaggaacaattacgacggggacacagtcactttttctcctacaggccgtctgttccaagtggaatacgccttggaagctattaaacaagggagcgtcactgtggggttacgttcgaacactcatgctgttttagtagcgttgaaaagaaatgcagacgaattgtcatcataccagaaaaaaatcatcaaatgtgacgagcacatggggctctcgttagccgggttggctccagatgctagagttttaagtaattatttgagacaacagtgtaattactccagcttagtttttaacagaaagcttgccgtcgagagagcaggtcatttgctttgcgataaagcacagaaaaatacacaatcctatgggggcagaccctacggtgttggtttgttgatcatcgggtatgacaagagcggtgctcatcttttagaattccaaccttccggaaatgtcacagaactatatggtacagctattggcgcaagaagccaaggggcaaagacttatctagagagaactttagacacgtttataaaaattgacgggaacccggatgaactaatcaaagctggcgtcgaggctatcagccagtctctaagggacgaatccttgactgtagacaatctttcaatcgccatcgtgggtaaggatacgccttttacaatttacgatggagaagctgttgctaaatacatctag

SEQ ID NO: 3237 - protein, 234 aa, Saccharomyces cerevisiae
MFRNNYDGDTVTFSPTGRLFQVEYALEAIKQGSVTVGLRSNTHAVLVALKRNADELSSYQKKIIKCDEHMGLSLAGLAPDARVLSNYLRQQCNYSSLVFNRKLAVERAGHLLCDKAQKNTQSYGGRPYGVGLLIIGYDKSGAHLLEFQPSGNVTELYGTAIGARSQGAKTYLERTLDTFIKIDGNPDELIKAGVEAISQSLRDESLTVDNLSIAIVGKDTPFTIYDGEAVAKYI

SEQ ID NO: 3238 - DNA, 783 bp, Pyrococcus horikoshii
  CDS (1)..(783)
atggcattcgttccaccacaagcagggtacgatagggctattaccgtgtttagtccagatgggagattgttccaggttaactatgcaagggaagcggtaaaaagaggagctaccgctgttggtgttaagtgcaatgaaggtgttgttttagccgttgaaaagaggatcacaagtagattgatagaacccgaaagctatgagaaaatctttcaaattgacgatcatatagcggctgcttcgagtggtataattgcggatgctagggttcttgtaaatagggcgagacttgaggcccagattcacagactcacgtatggtgagcctgctccgttagctgtgatagtgaagaagatatgtgacttgaaacaaatgcatacccaatatggtggggttaggccttttggtgctgctctacttatggctggagttaatgaaaagcctgaactttatgaaacagatcctagtggcgcttattttgcgtggaaggccgtggcaataggaagtggaagaaatacagcaatggccatatttgaggaaaagtacaaggatgatatgagtctagaggaagcgataaagttggccatttttgctctagctaagacgatggagaaaccgagtgcggagaatatcgaagttgcgataataaccgtgaaggacaagaagtttaggaagctatcaagggaggagatagagaaatatctaaatgaggtaatgaaagaagttgaggaggaagaggttaaggaaaaggaggaggattattcagagctcgatagccactactga

SEQ ID NO: 3239 - protein, 260 aa, Pyrococcus horikoshii
MAFVPPQAGYDRAITVFSPDGRLFQVNYAREAVKRGATAVGVKCNEGVVLAVEKRITSRLIEPESYEKIFQIDDHIAAASSGIIADARVLVNRARLEAQIHRLTYGEPAPLAVIVKKICDLKQMHTQYGGVRPFGAALLMAGVNEKPELYETDPSGAYFAWKAVAIGSGRNTAMAIFEEKYKDDMSLEEAIKLAIFALAKTMEKPSAENIEVAIITVKDKKFRKLSREEIEKYLNEVMKEVEEEEVKEKEEDYSELDSHY

SEQ ID NO: 3240 - DNA, 777 bp, Aeropyrum pernix
  CDS (1)..(777)
atggcattccctatgccgccgcatcagactgcatatgatcgtgccgccactatattctctcccgagggcgatctataccaggttaggtacgccttcgaggctgtcaagaaggggtggacaagcctcggcattaagactaatgagggcgttgttatagcggctgagaagaggttcataggccccctcgtcgatattgacgatatagacaagatatacaagatagacgaccacataggtgtggccttcgcgggcatgggtggagacgggaggatattgatagactatgcccgtgtgttcactgttagacaccgcctactctacggcgagcccccgccagtcgagctcgtcgccaaggttgttgctgacgttaaacaggcgtacacccagcacggcggcgtaaggcccttcggcgttgccctcatattcgctggcgtaaacccggatggcacaacaaaagtctacaggacagaccctggaggccagtacttcagcttcaaagccatagctatagggagcggcgagcaggtggccaatgagatgttcgagaagcactataggagcgacatgagcctcgaagaagctaccaagctagccctaaagatactttacgctataataaggaagacggttgaggataaagagaaggcgatagcaacgctgcccgaccaagtagaactcgcctacataacagtcaaagaaaggatgttcacaaagatgactaaagaacaggtcaaagagattgtggacagcatgagggaggagctactacaactctaa

SEQ ID NO: 3241 - protein, 258 aa, Aeropyrum pernix
MAFPMPPHQTAYDRAATIFSPEGDLYQVRYAFEAVKKGWTSLGIKTNEGVVIAAEKRFIGPLVDIDDIDKIYKIDDHIGVAFAGMGGDGRILIDYARVFTVRHRLLYGEPPPVELVAKVVADVKQAYTQHGGVRPFGVALIFAGVNPDGTTKVYRTDPGGQYFSFKAIAIGSGEQVANEMFEKHYRSDMSLEEATKLALKILYAIIRKTVEDKEKAIATLPDQVELAYITVKERMFTKMTKEQVKEIVDSMREELLQL

SEQ ID NO: 3242 - DNA, 765 bp, Saccharomyces cerevisiae
  CDS (1)..(765)
atgagtggttacgatagagctttgtccattttctccccagatggacacattttccaagtggagtacgccctggaggcggtaaagaggggtacctgtgctgtaggtgtcaagggtaagaattgtgtagtattgggctgcgaaagaaggtctactttgaagctgcaagacactagaattacgccttccaaagtttccaaaattgactcgcatgtggtgttgtcattttctggtttaaatgcagattccagaattcttatcgagaaggctagagtggaggcccaaagtcacagactaacgttggaggatcccgtgacggtggagtatctcacacgttatgtcgctggtgtgcaacaaaggtacacgcagtcaggaggtgttagaccatttggtgtgtcgacgctgattgccggcttcgacccgagagatgatgaacccaagctttaccagaccgagccaagtggtatatactcttcgtggtccgctcagaccattgggagaaactccaagacggtacgtgagtttttggagaagaattacgatcgcaaagaaccaccagccacagtggaagaatgtgtcaaacttactgtaagatctctgttggaggtagttcaaacaggtgcaaaaaatattgaaatcactgttgttaagccggactcagatattgttgcgttgagcagtgaggaaattaaccagtacgtcacccaaatcgaacaagaaaagcaagagcagcaagagcaggacaaaaagaaaaaatctaaccattaa

SEQ ID NO: 3243 - protein, 254 aa, Saccharomyces cerevisiae
MSGYDRALSIFSPDGHIFQVEYALEAVKRGTCAVGVKGKNCVVLGCERRSTLKLQDTRITPSKVSKIDSHVVLSFSGLNADSRILIEKARVEAQSHRLTLEDPVTVEYLTRYVAGVQQRYTQSGGVRPFGVSTLIAGFDPRDDEPKLYQTEPSGIYSSWSAQTIGRNSKTVREFLEKNYDRKEPPATVEECVKLTVRSLLEVVQTGAKNIEITVVKPDSDIVALSSEEINQYVTQIEQEKQEQQEQDKKKKSNH

SEQ ID NO: 3244 - DNA, 741 bp, Archaeoglobus fulgidus
  CDS (1)..(741)
atgcatttaccgcaaatgggatatgatagggcaataacggtattcagccctgatggaagactgttccaggtggaatacgccagagaggctgtaaaaagaggagcaacggctataggcattaagtgcaaagagggtgtcatcctgatagctgataagagggtaggcagcaagcttctcgaggcggacacgattgagaagatatacaagattgacgagcacatctgtgccgcaacatctggactagtggcggatgcaagggtgcttatcgacagggcgagaatagaggcccagattaacaggcttacctacgatgagcctataacggtgaaggagcttgcaaagaaaatctgcgacttcaagcagcagtacactcagtacggaggtgtaaggccctttggcgtttcgcttctcatcgccggtgtcgatgaggttccgaagctatacgaaactgacccaagcggtgccctgctggagtacaaggcaacggccataggtatgggcagaaatgcagttaccgagttcttcgaaaaggagtaccgcgatgacctcagcttcgatgacgccatggttctcggactcgttgcaatgggactttccattgaatcggagctcgtcccggagaacatcgaggttggctacgttaaagttgacgacagaaccttcaaggaagtgtctcctgaggagctcaagccttacgtggagagagcgaacgagaggattagggagctgctgaagaagtga

SEQ ID NO: 3245 - protein, 246 aa, Archaeoglobus fulgidus
MHLPQMGYDRAITVFSPDGRLFQVEYAREAVKRGATAIGIKCKEGVILIADKRVGSKLLEADTIEKIYKIDEHICAATSGLVADARVLIDRARIEAQINRLTYDEPITVKELAKKICDFKQQYTQYGGVRPFGVSLLIAGVDEVPKLYETDPSGALLEYKATAIGMGRNAVTEFFEKEYRDDLSFDDAMVLGLVAMGLSIESELVPENIEVGYVKVDDRTFKEVSPEELKPYVERANERIRELLKK

SEQ ID NO: 3246 - DNA, 783 bp, Pyrococcus abyssi
  CDS (1)..(783)
atggcattcgttccaccgcaggcaggttacgatagggccattacggtcttcagtcctgatggtagactgttccaggttaactatgcaagggaagccgtaaagaggggggcaaccgctgtaggggttaagtgtaaggacggagtagttttagctgtagaaaagaggatcactagcaggttaatagagccggaaagttatgagaaaatctttcagattgatgatcatatagccgcggcttcaagcggtataattgccgatgctagggttttggttaacagggcaaggcttgaggcccagatacacaggctaacctatggtgagcccgcgccattggccgtgatagttaagaagatatgcgacctcaagcagatgcacactcaatatggtggcgttagaccgtttggtgccgcacttttaatggctggggtaaacgataagcctgagctttacgagactgatccaagtggagcgtacttcgcatggaaggctgttgcaataggaagcggaaggaacaccgcgatggctatattcgaggacaagtatagagatgacatgacgctggatgaggctataaagttagcaatcttcgccttagcaaagacgatggagaagccgagcgcagagaacatcgaagttgccgtgataaccgtgaaggataagaagttcaggaagttatccaaggaggaaatagagaagttcttgggtgaagtgatgaaggaggttgaagaggaggaggtgaaagagaaggaggaggattactcagagctcgatagccactattga

SEQ ID NO: 3247 - protein, 260 aa, Pyrococcus abyssi
MAFVPPQAGYDRAITVFSPDGRLFQVNYAREAVKRGATAVGVKCKDGVVLAVEKRITSRLIEPESYEKIFQIDDHIAAASSGIIADARVLVNRARLEAQIHRLTYGEPAPLAVIVKKICDLKQMHTQYGGVRPFGAALLMAGVNDKPELYETDPSGAYFAWKAVAIGSGRNTAMAIFEDKYRDDMTLDEAIKLAIFALAKTMEKPSAENIEVAVITVKDKKFRKLSKEEIEKFLGEVMKEVEEEEVKEKEEDYSELDSHY

SEQ ID NO: 3248 - DNA, 699 bp, nucleomorph Guillardia theta
  CDS (1)..(699)
atgtcaaggaatctatactctcacgatggtagagttgaacagttagaatttgcattagaattaattgataaaagtaattctgcaataggaataatctatgaaaagggaattcttttcgcaacaatggaaaaaaataaacataattctgaaaaagaatatcaaaatttcacttttgccttagaaaaaaatattatttgtattgcaagtggtaatatacctgatgctaacacaatcttattttatctgaaatctttcgctgatgaatacaaacttatgtttcaagagacagttccgattgaaaagatagttggttatctttctgatataatgcataaaccaacacagatgatttatcaaagacctctaggagtaagttttataataggaggatgggatgagtttaggggatttcagttattcaagattgatccttcaggaaatttttcaggatggagagctacatcaataggttttaacaatattttgaatcaaacattaatagaagagaattatcataataaaataaatcttaaagaatcaataggcattattgtaaaattatattacaaaaatctaaatgactataattttccaaattctttcaatttgcttaagttatattttgataaaaataaaaatatattgattcatagatttaataaaaaagaaataaaaatgttaagaaaagtatttaagtaa

SEQ ID NO: 3249 - protein, 232 aa, nucleomorph Guillardia theta
MSRNLYSHDGRVEQLEFALELIDKSNSAIGIIYEKGILFATMEKNKHNSEKEYQNFTFALEKNIICIASGNIPDANTILFYLKSFADEYKLMFQETVPIEKIVGYLSDIMHKPTQMIYQRPLGVSFIIGGWDEFRGFQLFKIDPSGNFSGWRATSIGFNNILNQTLIEENYHNKINLKESIGIIVKLYYKNLNDYNFPNSFNLLKLYFDKNKNILIHRFNKKEIKMLRKVFK

SEQ ID NO: 3250 - DNA, 762 bp, Halobacterium sp. NRC-1
  CDS (1)..(762)
atgcagggtcagaaccagcagcaggcctacgaccggggaatcaccattttctcccctgacggccggctctatcaggtggaatacgcgcgggaagcagtgaaacgagggacggccagcatcggcgtgcgcacccccgagggtgtcgttctcgtcgtcgacaagcagacccgttcgccgctgctcgaaggctccagcgtcgagaaactccacaagatcgacgaccacgtgggcgctgccagcgccggccacgtcgccgacgcccgccagctcgtggacttcgcacgccagcagtcccaggtcgagcgcgtgcgctacgacgagcccatcggcgtgcgcacgctcacgaagagcgtcaccgaccacatccagcagtacacccaggtcggcggcgcgcgcccgttcggcgttgcgctcctcatcgctggcgtcgagggcggcgaaccccgcctcttcgagaccgatccgtccggcacgtccaacgagtggaaggccgtcgccatcggctccaaccgcggggacatccaggagttcctcgaagacgaatacgacgccggcctctcggtcgacgacggcatcgacctcgcgctgcgcgccctcaacgagggccgcgaggacgccctcagcggtgacggcgtgggtgtcgggatcgtggacgccgacaccgggacctaccgcgagctcgcggccgacgagtcccagtcgtacatcgacgacatcgaggacgccgccgacgacagcgacgacgacgacgacgaggagtaa

SEQ ID NO: 3251 - protein, 253 aa, Halobacterium sp. NRC-1
MQGQNQQQAYDRGITIFSPDGRLYQVEYAREAVKRGTASIGVRTPEGVVLVVDKQTRSPLLEGSSVEKLHKIDDHVGAASAGHVADARQLVDFARQQSQVERVRYDEPIGVRTLTKSVTDHIQQYTQVGGARPFGVALLIAGVEGGEPRLFETDPSGTSNEWKAVAIGSNRGDIQEFLEDEYDAGLSVDDGIDLALRALNEGREDALSGDGVGVGIVDADTGTYRELAADESQSYIDDIEDAADDSDDDDDEE

SEQ ID NO: 3252 - DNA, 726 bp, Sulfolobus solfataricus
  CDS (1)..(726)
atggcgttcggaccagccgctatgggatatgatagggcaataaccatattctcgcccgacggatcactatatcaagtagactatgcatttgaagctgtaaaaaagggatggacagcaattggtattaaatcaaagtctagtgttgttattgcaagtgagaaaaggaaagctcaatctttactagatgtagatagcatagagaaagtatttttaatcgacgatcacgtagggtgcagttttgctggattagcttctgatggaagagttttaatagactatgcaaggaatatagcattacaacacaggttaatatatgatgaaccagttagcattgattatctaaccaaatcagttgctgatgttaagcaaatgtatacacaacatggaggagttagaccatttggcgttgccctagtaattgcgggaatagataaatcagttcctaaattatttatgactgaacctagtgggcaatatatgccatatcaagctgttgcaatagggcagggttactatacagctactgagtttttagagaagaattataaggaggatttgaatgtggaagagactatattgcttgctttaaaggccttatcggctactctaaagcctaatgaaaagttaactccaaatactgtggaaataggatatgcctcaacccagactgggttatttctgaaaatgactaatgaagataagaatatgtatttacagaagttataa

SEQ ID NO: 3253 - protein, 241 aa, Sulfolobus solfataricus
MAFGPAAMGYDRAITIFSPDGSLYQVDYAFEAVKKGWTAIGIKSKSSVVIASEKRKAQSLLDVDSIEKVFLIDDHVGCSFAGLASDGRVLIDYARNIALQHRLIYDEPVSIDYLTKSVADVKQMYTQHGGVRPFGVALVIAGIDKSVPKLFMTEPSGQYMPYQAVAIGQGYYTATEFLEKNYKEDLNVEETILLALKALSATLKPNEKLTPNTVEIGYASTQTGLFLKMTNEDKNMYLQKL

SEQ ID NO: 3254 - DNA, 747 bp, Methanobacterium thermoautotrophicum
  CDS (1)..(747)
atgcaaccacttcagagtgcaggatatgatagggccatcacagtattcagcccggatggcagactattccaggtggaatatgcaagggaagctgttaaaagaggaaccacttctcttggagtaaaatcaaaggaaggaatagttcttgttgtggacaagaggcccacaagcaagctggttgaaccgaaatccatagagaagatcttccagatagatgaacacatcggggctgcaacatccggactggtggcggatgcacgtgcaataattgagaaggcaaggcttgaggcccagataaacaggataacctacaacgaaccaataagggttgaaagcctggccaagaagatatgtgacatgaaacagatgtacacccagcatggaggtgtcagaccctttggaacggccctcataattggtggtgtcaatggcaggggttgcagactctttgaaaccgacccgagcggtgccctcatagagtacaaggccacggccataggggctggaaggccggcggcgatggaggaatttgagaagaagtacagcgacgacatgaacctcaaccaggccatagaactggcacttgacgcggtttatgaggccactgagggtaaaacaacacctgaaagtgttgagatagctgttatagaagccgcagataagaaatacagaaggcttcctgatgatgagatcagggaccatgttgaggagctcctgatcaggaaggaaaaggaggaagaggagtaa

SEQ ID NO: 3255 - protein, 248 aa, Methanobacterium thermoautotrophicum
MQPLQSAGYDRAITVFSPDGRLFQVEYAREAVKRGTTSLGVKSKEGIVLVVDKRPTSKLVEPKSIEKIFQIDEHIGAATSGLVADARAIIEKARLEAQINRITYNEPIRVESLAKKICDMKQMYTQHGGVRPFGTALIIGGVNGRGCRLFETDPSGALIEYKATAIGAGRPAAMEEFEKKYSDDMNLNQAIELALDAVYEATEGKTTPESVEIAVIEAADKKYRRLPDDEIRDHVEELLIRKEKEEEE

SEQ ID NO: 3256 - DNA, 786 bp, Methanococcus jannaschii
  CDS (1)..(786)
atgcaaatggtacctccaagtgcttatgatagggctattacagtgtttagcccagaaggtagattatatcaagtagagtatgcaagagaggcagtgagaagagggacaacagcgataggtattgcctgtaaagatggtgtagttttagcggtagatagaagaataacaagcaaactcgtaaaaatcaggtcaatagaaaagatattccaaattgacgaccacgttgctgctgctacctctggattggtagctgatgcgagagttttaatagatagagcgagattagaagcccaaatttacagattaacttatggagaggaaatatcaattgaaatgctggctaaaaagatttgtgatattaaacaagcttatactcaacatggtggagttagaccgtttggagtttcattattaattgctggaatagacaaaaatgaagcaagattatttgaaacagacccaagtggggctttaattgaatataaagcaacagcaataggtagtggaagacccgtagttatggaattattggagaaagagtatagagatgatataacattagatgaaggtttggaattagctataactgctttaacaaaagcaaacgaagacataaaacctgaaaatgttgatgtttgtatcataacggttaaagacgcacaatttaaaaaaattcctgtggaagagataaaaaaacttatagaaaaagttaaaaagaaattaaatgaagaaaataagaaagaggaagagaatagagaagaaactaaagaaaaacaagaagaataa

SEQ ID NO: 3257 - protein, 261 aa, Methanococcus jannaschii
MQMVPPSAYDRAITVFSPEGRLYQVEYAREAVRRGTTAIGIACKDGVVLAVDRRITSKLVKIRSIEKIFQIDDHVAAATSGLVADARVLIDRARLEAQIYRLTYGEEISIEMLAKKICDIKQAYTQHGGVRPFGVSLLIAGIDKNEARLFETDPSGALIEYKATAIGSGRPVVMELLEKEYRDDITLDEGLELAITALTKANEDIKPENVDVCIITVKDAQFKKIPVEEIKKLIEKVKKKLNEENKKEEENREETKEKQEE

SEQ ID NO: 3258 - DNA, 1024 bp, Arabidopsis thaliana (mouse-ear cress)
  CDS (119)..(868)
aaagatttggcttgtctctggcttgagaacaaagaaaacccctttcttcgatctcagcttaaatcactcgacgaagaagaaatcagaaaagagtcagagaaaaaaaaaatcaaggaagatgagtagcattggaactgggtacgatctctccgtcaccactttctctcccgatggccgtgttttccagatcgagtacgccgctaaagctgtcgacaacagtgggactgttgttggaatcaagtgcaaagatgggattgttatgggagttgagaaacttattgcatcaaagatgatgctaccaggttccaacaggagaatccattctgttcatcgtcatgctggcatggctgttgctgggcttgcagctgatgggaggcaaattgttgcgcgtgctaagtctgaagcacgaagctatgagagtgtttatggcgatgctgtacctgtgaaggaactttctgagcgtgttgcaagttatgtacatctgtgtaccctgtattggtggctcaggccttttggctgtggggttattcttggaggttatgatagagatggacctcaattgtacatgattgaaccatcaggcatatcatatagatactttggtgcggccattggcaaaggaaagcaagctgccaaaacggaaattgagaaattaaatttatctgagatgacatgcaaagaaggcgttatcgaggtggcgaaaatcatctacaagctacacgatgaagccaaggacaaggcttttgaattggagatgagctggatatgcgaggagtcaaaacgagagcatcagaaggtccctgatgatcttctggaagaagcaaagacggcagctaaaactgcgctcgaggagatggatgctgactaaaactgaggagtgtgttgaatttagatccgtcttattgcgtcgtttgatgtttcttatgtactctgaattgaattttgtctggagggacagttgttgcagtttcgcatgaaccattggagtcttttatcttattgctatcaacagttgctacgatga

SEQ ID NO: 3259 - protein, 249 aa, Arabidopsis thaliana (mouse-ear cress)
MSSIGTGYDLSVTTFSPDGRVFQIEYAAKAVDNSGTVVGIKCKDGIVMGVEKLIASKMMLPGSNRRIHSVHRHAGMAVAGLAADGRQIVARAKSEARSYESVYGDAVPVKELSERVASYVHLCTLYWWLRPFGCGVILGGYDRDGPQLYMIEPSGISYRYFGAAIGKGKQAAKTEIEKLNLSEMTCKEGVIEVAKIIYKLHDEAKDKAFELEMSWICEESKREHQKVPDDLLEEAKTAAKTALEEMDAD

SEQ ID NO: 3260 - DNA, 1480 bp, Homo sapiens (man)
  CDS (328)..(1137)
cgcgagccgggaccacgccgacccagcgtgcccaggccgaggaaagcgcggcggcggcagtccgaagacccaccggactgaaagagaaggacgaggtcatcttcggacgggaggggcaagccagccatcctgggaccccaggcgtgcaggttctctttgagggtattccaccctgcaaaaagcatgtattcatggtcagctctcagcaaggccagtagcagagtggtaaaggccttggccctccaaggctgggaaaagacaatgacaagtcaaatccagacctatgttggatgttggtctactaggtgactgtctcctggaaatgttatgcagctcagcaaggtgaagtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtaaaaaaaaaaaaaaaaaaaaaaaaaaaa

SEQ ID NO: 3261 - protein, 269 aa, Homo sapiens (man)
MQLSKVKFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 3262 - DNA, 955 bp, Gallus gallus (chicken)
  CDS (21)..(770)
ggcggcgcgcggcgccagccatgagctacgaccgggccatcaccgtcttctctccggacgggcacctcttccaggtggagtacgcccaggaggcggtgaagaagggctctacggcggttggggtcagagggaaggacatcgttgttctcggcgtggagaagaagtctgtggcaaaacttcaggatgaaagaactgtgcggaagatctgcgccctcgatgacaatgtctgcatggcttttgcagggctcacagctgatgccagaatagttataaacagagctcgtgtagaatgtcagagccacagactcaccgtggaggatccggtcaccgtggagtacatcacgcgttacatcgccagcctgaagcagaggtatacccaaagcaaacgtcgcagaccttttggtatctctgctctgattgtgggatttgactttgatggaaccccccggctgtaccagactgacccctctggcacataccatgcttggaaggctaatgccattggcagaggagctaaatctgtacgtgtggaattcgagaaaaactatactgatgaagccattgaaacagatgatctgaccattaagcttgtcatcaaggctcttcttgaggttgtgcagtctggtgggaagaacatcgagctggctgttatgagaagagatcagcccctgaagattctaacgtcccctgaagaaattgagaagtatgttgctgaaattgaaaaagaaaaggaagaaaatgaaaagaaaaagcagaagaagacatcatgatgaaccaaatccagcacctgctgagctgcttctttttaactgaagcaatgggttattctgtatagacaagatgtaggcatttccgttttatcatactgtgccctctggagacctacaataaacctactgatttttagccttaaaaaaacgagttttttttttttttttttttttttttttttttt

SEQ ID NO: 3263 - protein, 249 aa, Gallus gallus (chicken)
MSYDRAITVFSPDGHLFQVEYAQEAVKKGSTAVGVRGKDIVVLGVEKKSVAKLQDERTVRKICALDDNVCMAFAGLTADARIVINRARVECQSHRLTVEDPVTVEYITRYIASLKQRYTQSKRRRPFGISALIVGFDFDGTPRLYQTDPSGTYHAWKANAIGRGAKSVRVEFEKNYTDEAIETDDLTIKLVIKALLEVVQSGGKNIELAVMRRDQPLKILTSPEEIEKYVAEIEKEKEENEKKKQKKTS

SEQ ID NO: 3264 - DNA, 851 bp, Xenopus laevis (African clawed frog)
  CDS (40)..(744): n means a or g or c or t/u
tgctgcgcagagagaggaggagctatagtagcaggaaagatggctgagcgcggatacagtttctctctgactacattcagtccgtctggcaaacttgttcaaattgagtatgctttagcagcagttgcggctggtgctccctctgttggaatcaaagctacaaatggcgtcgtgttggcaactgaaaaaaaacagaaatcaatcttgtatgatgaacaaagtgcacataaagtggaaccaattaccaaacacataggcatggtgtacagcggtatgggacctgattacagagtccttgttcggagagcacggaaactagctcagcagtattacctggtgtatcaggaacccatcccaacagcccagctagtacagagagtggcttctgtcatgcaggaatatacacaatctggtggtgtacgtccatttggagtctcattattaattgcaggctgggatgaaggccgaccatatttatttcaatcagatccatctggggcatattttgcatggaaggcaaccgcaatgggaaaaaactacgtaaatggaaaaactttccttgaaaaaaggtacaacgaagatttggaacttgaagatgcaattcacacagccatcttaacgctgaaggaaagttttgaagggcaaatgacagaagacaatattgaagtcggtatttgcaatgaagctggatttaagaggcttactcctgctgaagttaaggattacttggctgctatagcataagtggcctaacaacactgggcgtttggttgatgtagttatttttcanccactaatggattcaatatgttttctttgcanatttttttgcatactttcttatttctacc

SEQ ID NO: 3265 - protein, 234 aa, Xenopus laevis (African clawed frog)
MAERGYSFSLTTFSPSGKLVQIEYALAAVAAGAPSVGIKATNGVVLATEKKQKSILYDEQSAHKVEPITKHIGMVYSGMGPDYRVLVRRARKLAQQYYLVYQEPIPTAQLVQRVASVMQEYTQSGGVRPFGVSLLIAGWDEGRPYLFQSDPSGAYFAWKATAMGKNYVNGKTFLEKRYNEDLELEDAIHTAILTLKESFEGQMTEDNIEVGICNEAGFKRLTPAEVKDYLAAIA

SEQ ID NO: 3266 - DNA, 970 bp, Rattus norvegicus (Norway rat)
  CDS (85)..(810)
gcggtgtggttgagtagggtgctgctttcagtcgtgtggcctttggaactccgcgtagcactgccgcctcctcctgtcctcgccatgttcctcactcggtccgagtacgacaggggtgtgaacactttttctcctgaaggaagattatttcaagtggaatatgccattgagggccataagcttggttctacggccattggcatccagacatcagagggtgtatgtctagctgtggagaagagaattacctcgccactaatggagcctagcagcattgagaaaatcgtagagattgatgctcatataggttgtgccatgagtgggctaattgctgatgctaaaactttaattgataaagccagagtggagacacagaaccactggttcacctataatgagacaatgacagttgagagtgttacccaggctgtgtccaatctggctttgcagttcggagaagaagatgcagatccaggtgctatgtctcgtccctttggagtagcattgttgtttggaggagttgatgagaaagggccccaactgtttcacatggacccatctgggaccttcgtacagtgtgatgctcgagcaattggttctgcgtcagagggtgcccagagctccttgcaggaagtttaccacaagtctacgactctgaaggaggccatcaagtcttcactcatcatcctcaagcaagtcatggaggagaagctgaacgcaactaacatcgagctggccacagtgcagcctggtcagaatttccacatgttcacaaaggaagaactggaggaggtgatcaaggacatttaaggaggggccatcctcgaacttctgtgggacagtttcagttctaatggctcttagactttatttccaactccacgtcgtgaaaatatccagtatatgtatgtgtgtttttttatgatgtctgtacataacagcaattctgaaataaaaaaaatttacaaat

SEQ ID NO: 3267 - protein, 241 aa, Rattus norvegicus (Norway rat)
MFLTRSEYDRGVNTFSPEGRLFQVEYAIEGHKLGSTAIGIQTSEGVCLAVEKRITSPLMEPSSIEKIVEIDAHIGCAMSGLIADAKTLIDKARVETQNHWFTYNETMTVESVTQAVSNLALQFGEEDADPGAMSRPFGVALLFGGVDEKGPQLFHMDPSGTFVQCDARAIGSASEGAQSSLQEVYHKSTTLKEAIKSSLIILKQVMEEKLNATNIELATVQPGQNFHMFTKEELEEVIKDI

SEQ ID NO: 3268 - DNA, 1137 bp, Rattus norvegicus (Norway rat)
  CDS (63)..(803)
gggggtgtgtgtgtgtgtgtgcgctacggggtgtagactgtgtctgaaatagcgggaacgccatgtcccgtggttccagcgccggttttgaccggcacattactattttctctcccgagggccgactctaccaagtagaatatgcttttaaggctattaaccagggtggacttacatctgtagctgtcagaggaaaggactgcgcagttattgtcacacagaagaaagtacctgacaaactactggattccagcaccgtgactcacttattcaagataacggaaaacattggctgtgtgatgacaggaatgacagctgacagcagatcccaggtacagagggcacgctatgaagcagctaactggaaatacaaatatggctatgagattcctgtggacatgctgtgtaaaagaattgctgatatttctcaagtctacacacagaatgctgaaatgaggccacttggttgttgtatgattttaattggtatagatgaagagcaaggccctcaagtgtacaagtgtgatcctgcaggctactactgtggctttaaagccaccgcagcaggagtgaagcagacagagtcaaccagcttcctcgaaaaaaaagtgaagaagaaatttgattggacatttgaacagacagtggaaactgcaatcacatgcctgtctactgttctgtcgattgatttcaaaccttcagaaatcgaagttggagtagttacagttgaaaatcctaaattcaggattcttacagaagcagagattgacgctcaccttgtggctctagcagagagagactgaacactcttatcagcttaccagatccatgatgccatgtgcctatgtgtttagtaacaacaaaccgacatcttagaggccctggattgaagatggaaactctcccactcctcctgccactgactggttaggactctgtataaataaaacagtgcttttggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3269 - protein, 246 aa, Rattus norvegicus (Norway rat)
MSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCCMILIGIDEEQGPQVYKCDPAGYYCGFKATAAGVKQTESTSFLEKKVKKKFDWTFEQTVETAITCLSTVLSIDFKPSEIEVGVVTVENPKFRILTEAEIDAHLVALAERD

SEQ ID NO: 3270 - DNA, 928 bp, Drosophila melanogaster
  CDS (78)..(872)
ggcaaccctacactgaatgacaagtaaattctgttcgttttgcaaaataaacttgtaaattggtatattccttagcaatggcgcgccgctatgattcccgcaccacgatcttctcgccggagggccgtttgtaccaggtggagtacgccatggaggccatctcgcacgccggaacctgcctgggaatcctcgccgaggacggcatcctgttggcagccgagtgccgcagcacaaacaaattgctggacagcgccattccttcggaaaagatctatcgccgtaacgacaacatggtctgttcggtggctggcatcacctccgatgccaatgtgctgacctcagaactgcgtctgattgcccagcgttaccagttcagctacggcgaggtgattccctgcgagcagctggtgtcgcacctctgcgacatcaaacaggcgtacactcagtacggcggaaagcgtcccttcggcgtctcgctgctctacatgggatgggacaacaagtacggctaccaactgtaccagtcggatcccagcggcaactacggcggatggaaggccacttgtattggcaacaacttcggtgccgcgatctccatgctgaagcaggagctggccgataaggagaacgtgaagctgacgctggcggacgccaaggatttggccatcaaggtactgagcatgaccctggacaccaccaagctgaccccggagaaggtcgagatggccacgctgcagcgtgtggacaataagaccgtatacagtgtcctggagaaacccgatgtggagaagctgatcgagaagtacacaaaggtacaggcggaggccgaggctgccaagaaggagaagcaagcgaagcagccgaccaagtaatcccaaggatgcattattattgattaagggtctatcctgatttttgtaaccgatcc

SEQ ID NO: 3271 - protein, 264 aa, Drosophila melanogaster
MARRYDSRTTIFSPEGRLYQVEYAMEAISHAGTCLGILAEDGILLAAECRSTNKLLDSAIPSEKIYRRNDNMVCSVAGITSDANVLTSELRLIAQRYQFSYGEVIPCEQLVSHLCDIKQAYTQYGGKRPFGVSLLYMGWDNKYGYQLYQSDPSGNYGGWKATCIGNNFGAAISMLKQELADKENVKLTLADAKDLAIKVLSMTLDTTKLTPEKVEMATLQRVDNKTVYSVLEKPDVEKLIEKYTKVQAEAEAAKKEKQAKQPTK

SEQ ID NO: 3272 - DNA, 1175 bp, Drosophila melanogaster
  CDS (147)..(896)
aatttagtaattttcatcgaacccatgctgcggtcacactgcggcatttcctcaaaaaagcatcatcattgcctggcgaattcgagaaggaaaaagctataagttaatattctgcaagtacctcagctattgaataaagcaacaagatgtcctcacgctacgatcgtgctgtaaccatattctctcccgacggtcacctcctgcaggtggagtatgcccaggaggccgttcgcaagggatcgactgcggtcggagttcgcggcgccaactgcgttgtgcttggcgtggagaagaagtcggtggcccaactgcaggaggatcgaaaggtgcgcaagatttgcatgctcgacaaccacgttgtaatggcttttgccggtctcacggccgacgctcgcatcatgatcaatcgtgcccaggtggagtgccagagccatcgtctcaatgtcgaggatcccgtgaccctcgagtacataaccagattcattgcccagctgaaacaaaaatacacgcagagcaatggccgccgtcccttcggtatttcctgccttattggcggcttcgatgccgatggctctgcgcatctgttccagactgagccgtcgggcattttctacgagtataaggctaacgccaccgggcgatcggcaaaggttgtgcgcgagttcttcgagaagtcctaccgcgaggaggaggtggccaacgagcacggagccgtcaaactggccatccgtgcgctgctcgaggtggcgcagtcaggccagaacaatctggaggtggccatcatggagaacggcaagccactgaaaatgctggacaccgatgtcattaccgattatgttaagatcatcgagaaggagaaggaggaggagctcgagaagaagaaacagaaaaagtaacacccagcagctgggacacttcttcgatggaaggccgttgcattgaatcgctttccatgcattcggcgacactatctggtgtcgccgcccacattctgtctgctcattgtagccaacctgatttgacttggaaaacgattcaaattgaattcggtgaaccgaatgcatactttttttaattaccactttctattcttcggaaccctgtaaaacggtatgaaaatatttgatctgtataaaatacatgcgtcatcatacattaggcggagctcctgttga

SEQ ID NO: 3273 - protein, 249 aa, Drosophila melanogaster
MSSRYDRAVTIFSPDGHLLQVEYAQEAVRKGSTAVGVRGANCVVLGVEKKSVAQLQEDRKVRKICMLDNHVVMAFAGLTADARIMINRAQVECQSHRLNVEDPVTLEYITRFIAQLKQKYTQSNGRRPFGISCLIGGFDADGSAHLFQTEPSGIFYEYKANATGRSAKVVREFFEKSYREEEVANEHGAVKLAIRALLEVAQSGQNNLEVAIMENGKPLKMLDTDVITDYVKIIEKEKEEELEKKKQKK

SEQ ID NO: 3274 - DNA, 1162 bp, Arabidopsis thaliana (mouse-ear cress)
  CDS (92)..(844)
aagtcgggaatcgtttactgtgaaataaaaacgagagagagtttttgaagaagaagaaagaacactcacaagatccagaaaaaggtaaaagatggcgagatacgatcgagcaatcactgtattctcccccgatggtcacctcttccaagtagagtatgccctagaagccgtccgaaagggtaacgccgccgtcggagtccgcggcacagatactgtcgtcctcgccgtcgaaaagaaatccacccctaagctccaggattccagatcagcaaggaagatagtgagccttgataatcacattgcattggcctgtgctggactgaaagcagatgctcgtgtcttgataaacaaggcgaggatagagtgtcaaagccacaggcttacgttggaggacccagttactgttgagtacattactcggtacatagcagggcttcaacagaagtatactcaaagtggtggtgtgaggccttttggtctttccactcttattgttgggtttgatccctacactcgtatacccgcgctttatcagaccgatccatctggtacattctctgcttggaaagctaatgcaactgggagaaactctaactcaattagggagtttctggagaaaaactacaaagaaagcgctggccaagaaactgttaagcttgctatccgtgctctgcttgaggttgttgagagtgggggaaagaacattgaggttgctgtaatgacacgagaggaaggtgttctgaagcaactagaagaagaagaaattgatatcattgtggctgagatcgaagcagagaaggctgcagctgaagcagccaagaaaggccctgcgaaggaaacatgaaccagatcttaaagtagcggtctcagattatgagttgtaatgctggttcaaagtcagggatattcaagggttgaatagaaaatctagaccgcatgaaatggtttgttggattactagcctatttgacactgttgctttaaatcttaaatgacattttagcggagtttcgatacttgtcagttggaactatggcatgttcagtattctagatgactttgcatttgcgctcaagagttgtagattttgattttggaaacgttgtttcttactaaacatgtctctcttcttattatctccattgtgtaacttaccgttttt

SEQ ID NO: 3275 - protein, 250 aa, Arabidopsis thaliana (mouse-ear cress)
MARYDRAITVFSPDGHLFQVEYALEAVRKGNAAVGVRGTDTVVLAVEKKSTPKLQDSRSARKIVSLDNHIALACAGLKADARVLINKARIECQSHRLTLEDPVTVEYITRYIAGLQQKYTQSGGVRPFGLSTLIVGFDPYTRIPALYQTDPSGTFSAWKANATGRNSNSIREFLEKNYKESAGQETVKLAIRALLEVVESGGKNIEVAVMTREEGVLKQLEEEEIDIIVAEIEAEKAAAEAAKKGPAKET

SEQ ID NO: 3276 - DNA, 917 bp, Drosophila melanogaster
  CDS (117)..(821)
gcattcagcattcggtcacactgccgcccaattgctgtgtcatttttgtttctgtgcgaaataagtcggctttttcattttacacatcaaatcactgcatttgcggcccaggaaatatggctaccgaacgatacagcttttcgttgaccacgttcagtccttccggaaaactcgtccaactggagtatgcattggcggccgtatctggcggagctccctccgtgggcattatagcttccaacggcgtcgtcattgccacagagaacaaacacaagtcaccgctgtatgagcagcacagtgtacatcgcgtggagatgatctacaaccacatcggcatggtgtactcgggaatgggtccggactaccgcctgctggtcaagcaggcccgcaagatcgcccagacgtactacctgacctacaaggagccgattccagtgtcacagctggtgcagcgcgtggccacgctcatgcaggagtacactcagtccggtggcgttcgtccctttggcgtttccctactgatctgcggctgggacaatgatcgtccgtatctctaccaatccgatccttcgggcgcctacttcgcctggaaggccactgccatgggcaagaacgcagtgaacggcaaaactttcctggagaagcgctacagcgaagatctggagctggacgacgctgttcacaccgccatccttacgctgaaagaaggttttgagggaaaaatgactgccgacaacattgagatcggaatctgcgatcagaacggattccagcgtctggaccccgcctcaatcaaggactacttggccagcatcccctaaacttaaacgccccgctaagattaccacaagctaagctttcttaataagtacgggacattaaaaaaccaataaaattttacaactggtgttatttga

SEQ ID NO: 3277 - protein, 234 aa, Drosophila melanogaster
MATERYSFSLTTFSPSGKLVQLEYALAAVSGGAPSVGIIASNGVVIATENKHKSPLYEQHSVHRVEMIYNHIGMVYSGMGPDYRLLVKQARKIAQTYYLTYKEPIPVSQLVQRVATLMQEYTQSGGVRPFGVSLLICGWDNDRPYLYQSDPSGAYFAWKATAMGKNAVNGKTFLEKRYSEDLELDDAVHTAILTLKEGFEGKMTADNIEIGICDQNGFQRLDPASIKDYLASIP

SEQ ID NO: 3278 - DNA, 974 bp, Xenopus sp. (clawed frog)
  CDS (65)..(832)
tgtggaggaacagaagaatcgaaagtgccgtctcaccgcctgccagtgtcctactcgctccaatatgagttctatcggtactgggtatgatctttctgcctccacattttcgccagatggccgggtatttcaagttgagtatgcagccaaagcagttgagaacagcagcactgcaattagcatcagatgtaaagatggagttgtgtttggagtagagaaacttgtgttgtccaaactatatgaagaaggttctaacaagcgcatctttaatgtagatcgtcatgtcggcatggcagtcgcaggtcttttggcagatgcacggtccttagctgatattgcacgagaggaagcctcaaatttccgggcaaactatggctatgacattcctttaaagcatctttcagacagagtagccatgtatgcgcatgcatacacactgtacagtgctgtccgaccatttggatgcagtttcatgttgggatcttataatgaagacgatggtgctcagttatacatggttgatccgtcaggcatttcctatggctactggggttgtgcgatcgggaaggccaaacaggctgctaagacagaaattgaaaagcttcagatgaaagaattgacctgccgtgatgtagtcaaagaggtagcaaaaataatctacattgtccatgatgaagtgaaagataagtcatttgaactggaactaagctgggttggcaaaataaccaacggaaaacatgaaattgtcccaaaagatattcgggaagaagcagagaaatatgcaaaggaatctttagaagaggaggatgattctgatgatgacaatatgtaacatcccgtggtatctctggctatatactaagaatactgtttttttatgtataaatatatgtatatggaaaggaacctgcaaaccccaatgtgtgacaaattggcagtaaaaaaatagttcttttcaaaaaaaaaaaaaaaaa

SEQ ID NO: 3279 - protein, 255 aa, Xenopus sp. (clawed frog)
MSSIGTGYDLSASTFSPDGRVFQVEYAAKAVENSSTAISIRCKDGVVFGVEKLVLSKLYEEGSNKRIFNVDRHVGMAVAGLLADARSLADIAREEASNFRANYGYDIPLKHLSDRVAMYAHAYTLYSAVRPFGCSFMLGSYNEDDGAQLYMVDPSGISYGYWGCAIGKAKQAAKTEIEKLQMKELTCRDVVKEVAKIIYIVHDEVKDKSFELELSWVGKITNGKHEIVPKDIREEAEKYAKESLEEEDDSDDDNM

SEQ ID NO: 3280 - DNA, 1066 bp, Xenopus sp. (clawed frog)
  CDS (107)..(892)
gtgtgctgtgtgactgagctgttttggccggctaggtggatatattccttcgggttctgccctttgaagctgacaagatcattgagtaaagtgaatatcatacaacatgtctcgaagatatgattccagaactaccattttctccccagagggtcgattgtaccaggtagaatatgccatggaagctattggccatgcaggcacatgtttggggattttggccaatgatggggttttgctagctgcagaaagacgcaatatacacaaacttctggatgatgtgtttttctctgagaaaatatataaactaaatgatgatatggcatgcagtgtggcaggaataacctcagatgccaatgttctaacaaatgagctgcgccttattgctcaaaggtatttactacagtatcaggagccaatcccctgtgaacagctggtcacagcactctgtgatataaaacaagcgtatacacagtttggaggaaaacgcccatttggcgtgtcacttctttacattggttgggacaagcactatggctttcagctttaccagagtgacccaagtgggaattatggaggctggaaagctacatgtattggcaataacagtgcggcagctgtgtctatgttaaaacaagactacaaggaaggaggaatgacgttgaaatccgctcttgctttagctgttaaggtcctcaacaagaccatggatgttagcaaattgtctgcggaaaaagttgagcttgctacactaacacgagaaaatggaaagacaaaaataagggttctgcaacagaaagaagttgaagagctgataaaacttcatgaagaggaagaagcgaagattgagcgggagaagaaagacaaggagcagaaagaaaaagataaataaggaaccaatctccaaaaataaaagagccagttcattttcctgtatattttccccttacaagaatgtcattgatttactcagagttgcttggttcatcttgtttaaagccataaaataaacccaactttttttaaaaaaaaaaaaaaaaaaaaaaaaaaaaaaaaaaaaaaaaaa

SEQ ID NO: 3281 - protein, 261 aa, Xenopus sp. (clawed frog)
MSRRYDSRTTIFSPEGRLYQVEYAMEAIGHAGTCLGILANDGVLLAAERRNIHKLLDDVFFSEKIYKLNDDMACSVAGITSDANVLTNELRLIAQRYLLQYQEPIPCEQLVTALCDIKQAYTQFGGKRPFGVSLLYIGWDKHYGFQLYQSDPSGNYGGWKATCIGNNSAAAVSMLKQDYKEGGMTLKSALALAVKVLNKTMDVSKLSAEKVELATLTRENGKTKIRVLQQKEVEELIKLHEEEEAKIEREKKDKEQKEKDK

SEQ ID NO: 3282 - DNA, 1152 bp, Arabidopsis thaliana (mouse-ear cress)
  CDS (96)..(932)
ggcttgaaggaaaagaaaagttttgtttctgaactttcgtctctataaaccctttcgacgacgagtgaagaagaaagcgagacgaagaagcaaagatgttcagaaaccaatacgacacagatgttacgacatggagtccaacaggtcgtttattccaagtggaatacgccatggaagcagtgaagcaaggatctgcagcaattggactcagatctcgttctcatgtcgttctcgcttgtgttaacaaagctcaatcggagctttcttcgcatcagaggaagatctttaaagtcgatgaccatatcggtgttgcaatcgctggtctcacagccgacggtcgtgtattgtctcggtatatgagatcggaatcgattaatcactcttttacttatgagtctcctcttcctgttggtcgtctcgttgttcatcttgctgataaagctcaggtctgtacccaacgatcatggaaacgaccctatggtgttggtttgctggtaggtggattggatgagtctggagcccacctttactacaactgtcccagcggaaactacttcgagtaccaagcttttgctattggatcccgttcccaagcagcaaagacctatctggaacgcaggtttgagagctttggggattcttctagagaagatctgatcaaagatgctattttggctgttagggagacattgcaaggggaaacactgaagagttctctctgcacagtcgctattctaggagtcgatgaaccgttccacttcctggaccaggaagcaatacagaaagtgatcgacacatttgagaaagtgccagaggaagaggaaggagaaggcgaggctggtgagggtgaggccgaagctgccgaggctgcaccagcagaacgaggtggtggtgttgcaggtgaccaagacgtggctccaatggaaatgtaaggcttgtgtgtgtaacgctggaactattttatttcgatgttagttggatttttactttgcaaaatggctgcgggtttagattatatgcttgagaagttgaaaccatttcgtcatttaaactcaatagctgccatcaagactttctcgtattctggtcttttggtttaaatctgaaatctgttcacgacttcctatctctttggttctgcaattccttgct

SEQ ID NO: 3283 - protein, 278 aa, Arabidopsis thaliana (mouse-ear cress)
MFRNQYDTDVTTWSPTGRLFQVEYAMEAVKQGSAAIGLRSRSHVVLACVNKAQSELSSHQRKIFKVDDHIGVAIAGLTADGRVLSRYMRSESINHSFTYESPLPVGRLVVHLADKAQVCTQRSWKRPYGVGLLVGGLDESGAHLYYNCPSGNYFEYQAFAIGSRSQAAKTYLERRFESFGDSSREDLIKDAILAVRETLQGETLKSSLCTVAILGVDEPFHFLDQEAIQKVIDTFEKVPEEEEGEGEAGEGEAEAAEAAPAERGGGVAGDQDVAPMEM

SEQ ID NO: 3284 - DNA, 780 bp, Thermoplasma acidophilum
  CDS (61)..(762)
aatttcatgataaaagaaatctttattattcgtctgattatagtggctggaggagataacatgcaacagggccagatggcttacgatagagcgattacggttttttcaccagatggtagacttttccaggtagagtatgcaagggaagcagttaagaaaggttcaacggcgctcggtatgaaattcgcaaatggtgtgctcttgatatccgataagaaggtaagaagcagacttattgagcagaattcaattgaaaagatacagcttatagatgattatgttgccgcagtgacgtccgggctggtggcagacgcgagagtacttgtggactttgccaggataagcgcccagcaggaaaaggtaacgtacggatcgcttgtaaatattgagaatctagttaagagagttgctgaccagatgcagcagtacacacagtacggtggcgtaaggccatacggtgtatcgctgatcttcgctggcatagatcagatcggcccaaggctgttcgactgcgatcccgccggtactataaatgagtacaaggcaacggccatcggatcgggcaaagatgccgttgtgagcttccttgagcgcgaatacaaggaaaacctgcccgagaaggaagcagtgacgcttggaataaaggcgctgaaatcttcccttgaggagggcgaagagcttaaggctccggagatcgcatcaataacggtgggaaataagtacaggatatacgatcaggaggaagttaaaaaattcctctgatgtgatatatttttattt

SEQ ID NO: 3285 - protein, 233 aa, Thermoplasma acidophilum
MQQGQMAYDRAITVFSPDGRLFQVEYAREAVKKGSTALGMKFANGVLLISDKKVRSRLIEQNSIEKIQLIDDYVAAVTSGLVADARVLVDFARISAQQEKVTYGSLVNIENLVKRVADQMQQYTQYGGVRPYGVSLIFAGIDQIGPRLFDCDPAGTINEYKATAIGSGKDAVVSFLEREYKENLPEKEAVTLGIKALKSSLEEGEELKAPEIASITVGNKYRIYDQEEVKKFL

SEQ ID NO: 3286 - DNA, 747 bp, Schizosaccharomyces pombe
  CDS (1)..(747)
atgtcaagaagctacgattctcgcacgactattttttcacctgaaggtcgtttataccaggttgaatatgcattggaagcgatcaaccatgctggcgttgctttagggattgtagctaaagatggaattgttttagctgctgaaaagaaggttaccagcaaactattagaacaagaagaatccgcagaaaagttatatcatataggagacaatatgttatgtgctgtggcagggcttaccgcagatgcaaacatcctaattaactacgctagaagggttgggcaacaatacttgcagacttttaatgaagagatgccttgtgagcaattagttcgtcgcgtttgtgacctcaaacaaggttatacacagtatggtgggctacgtccattcggtgtttcattcttatatgctggatgggatcatattcgtggatatcagctattccaatctaatccatctggaaattacggaagctggcaagcaaatagtatcggaggaaatagtactagtgttcaaagcttaatgcgacaggagtataaggatgatataaacttagatgaggcttctgctatggccgtgaaatttttgagtaaaacgttggacagtaactccctaactcatgaaaaaattgaatttgcaacaataacaaaggataccacgaaaaacaaaatggtttgcaaaatatggaagtcagatgaaataaatgaagtgctcaataagtaccaagagacccagcggcaatcttaa

SEQ ID NO: 3287 - protein, 248 aa, Schizosaccharomyces pombe
MSRSYDSRTTIFSPEGRLYQVEYALEAINHAGVALGIVAKDGIVLAAEKKVTSKLLEQEESAEKLYHIGDNMLCAVAGLTADANILINYARRVGQQYLQTFNEEMPCEQLVRRVCDLKQGYTQYGGLRPFGVSFLYAGWDHIRGYQLFQSNPSGNYGSWQANSIGGNSTSVQSLMRQEYKDDINLDEASAMAVKFLSKTLDSNSLTHEKIEFATITKDTTKNKMVCKIWKSDEINEVLNKYQETQRQS

SEQ ID NO: 3288 - DNA, 900 bp, Rattus norvegicus (Norway rat)
  CDS (38)..(802)
tggagcggcggcggcttgagctcgcgcgtccgcagtgatgagctacgaccgcgccatcaccgtcttctcgcccgacggccacctcttccaagtggagtacgcgcaggaggcggtcaagaagggctccaccgcggttggtgttcgaggaagggacattgttgttcttggtgtggaaaagaagtcggtggccaagctacaagatgaaagaacggtccggaaaatctgtgctctggacgataatgtctgcatggcctttgcagttgtagcctctgtctcaggtctcactgccgatgcaaggatagtcatcaacagagccagggtagagtgccagagccaccggctgaccgtgggggacccagtgactgtggagtacatcacccgctacattgccagtctgaagcagcgttacacacagagcaatgggcgcaggccatttggtatctctgccctaattgtgggtttcgacttcgatggcacccccagactctatcagactgacccctcaggcacataccatgcttggaaggccaatgccataggccggggtgccaagtcggtgcgtgaatttctggagaagaactacacagatgatgccattgaaacagacgatctgaccatcaaactggtgatcaaggcgctgctggaagtggtccagtcaggtggcaaaaacattgaacttgctgtcatgaggcgggatcagcccctcaagattctaagtcctgaagaaattgagaagtatgttgctgaaatcgagaaggagaaagaagaaaatgaaaagaagaaacaaaagaaagcatcatgagggcagcggtcagagcagctttgagcctccatccgagcaaacgggtgctgtgggccttgtggccatttgtcggagtccaataaactactacgtttttt

SEQ ID NO: 3289 - protein, 254 aa, Rattus norvegicus (Norway rat)
MSYDRAITVFSPDGHLFQVEYAQEAVKKGSTAVGVRGRDIVVLGVEKKSVAKLQDERTVRKICALDDNVCMAFAVVASVSGLTADARIVINRARVECQSHRLTVGDPVTVEYITRYIASLKQRYTQSNGRRPFGISALIVGFDFDGTPRLYQTDPSGTYHAWKANAIGRGAKSVREFLEKNYTDDAIETDDLTIKLVIKALLEVVQSGGKNIELAVMRRDQPLKILSPEEIEKYVAEIEKEKEENEKKKQKKAS

SEQ ID NO: 3290 - DNA, 783 bp, Saccharomyces cerevisiae
  CDS (1)..(783)
atgttcttaactagaagtgaatatgatcgtggtgtaagcacattttccccagaagggaggttattccaagttgagtattctttggaggccatcaaattaggatctacagcaattggtattgccacgaaagaaggtgttgtactaggtgtggagaaacgtgccacctcaccactattagaatctgattctattgagaaaatcgtggagattgatcgtcatattggttgtgcaatgagtgggcttacagcagatgctcgttccatgattgaacatgcgcgtactgctgcagtaacgcataatctatactacgatgaagacatcaatgttgagtccttaacgcaatcggtgtgtgatcttgctctaaggttcggtgaaggtgcctctggtgaagaaagactaatgtctcgaccattcggggttgccttgttaattgctggccatgatgcggatgatggttatcaacttttccatgcagaaccatctgggacattttaccgttataatgccaaagccattggttcaggctctgaaggagcacaagcagaattattgaatgaatggcattcttctttaactttgaaagaagctgagcttcttgttctaaaaatcctaaagcaagtgatggaagagaaacttgatgaaaataacgcgcaattgagttgtataacaaagcaagacggattcaaaatatatgataacgaaaaaactgctgaattgataaaagagttgaaagagaaagaagctgcagaaagtccagaagaagcggatgttgaaatgtcataa

SEQ ID NO: 3291 - protein, 260 aa, Saccharomyces cerevisiae
MFLTRSEYDRGVSTFSPEGRLFQVEYSLEAIKLGSTAIGIATKEGVVLGVEKRATSPLLESDSIEKIVEIDRHIGCAMSGLTADARSMIEHARTAAVTHNLYYDEDINVESLTQSVCDLALRFGEGASGEERLMSRPFGVALLIAGHDADDGYQLFHAEPSGTFYRYNAKAIGSGSEGAQAELLNEWHSSLTLKEAELLVLKILKQVMEEKLDENNAQLSCITKQDGFKIYDNEKTAELIKELKEKEAAESPEEADVEMS

SEQ ID NO: 3292 - DNA, 1183 bp, Drosophila melanogaster
  CDS (134)..(883)
ataatcattacactatgtgtagaacaaaggatttgacttcaaacttcaaatgtaagaaaattcatattgtttcaagtaataacttgtcacaagcaaattgttgttttgttttgcctgctaactaacccaaaggatgtcctcacgctacggtcgagctctaaccatattctcgccggatggccacctgttgcaggtggagtacggccaggaagctgttcgaaagggctccacagcggttggcgttcgtggagccaattgtgtggtgctgggtgtggagaagagctcggtgtccgagatgcaggaggatcggacggtgcgcaagatcagcatgctcgatcgccacgtggcgttggcatttgccggtctcacggctgatgcacggatccttataaatcgagggcaggtcgagtgccagagccatcgactcaacttcgaaaaccaggtgaccctcgagtacattaccagataccttgcccagctcaagcagaagtacacgcaggtcaatggacgtccgtctttcggtatatcgtgtctaataggaggcattgacgccgatggctctgcacgtctctttcataccgaaccatccgggatattccacgagtacaaggcgaccgcaactgggcgttgggcaaatactgtgagggagttttttgagaaggcctatagcgatcatgaagtgacaaccaaatgtgatgccatcaaactagccatgcgtgcccttctcgaagtaacccagatgagccagatgcgcctggaggtggccgtattggagaatggcaagccaatgaaaatgctggacagtgtagtaatttcggaaatagtcaagatcgttcagaacgaaaaggagctccaagcgaaggcacataaaatgaagagatgaattgctacacctacagatcgttgattttttatgttcatcaaattgttattagatattcatgttatattgttttggagctttgtttaaattttgttgtttttgttttgtttttaaattaattaatatacagttttaaccatgttttgatgtttgtgaaggattttatctttgtataatgcagtaattaattaagattacgactttaaatttataacttttgaatttcaaatatgcagatataaagcactcactctaacgcccacgaactgctcgtgcaggtcacccaggatagcaggtaca

SEQ ID NO: 3293 - protein, 249 aa, Drosophila melanogaster
MSSRYGRALTIFSPDGHLLQVEYGQEAVRKGSTAVGVRGANCVVLGVEKSSVSEMQEDRTVRKISMLDRHVALAFAGLTADARILINRGQVECQSHRLNFENQVTLEYITRYLAQLKQKYTQVNGRPSFGISCLIGGIDADGSARLFHTEPSGIFHEYKATATGRWANTVREFFEKAYSDHEVTTKCDAIKLAMRALLEVTQMSQMRLEVAVLENGKPMKMLDSVVISEIVKIVQNEKELQAKAHKMKR

SEQ ID NO: 3294 - DNA, 759 bp, Saccharomyces cerevisiae
  CDS (1)..(759)
atgtcgggtgctgctgctgcatctgctgctggttatgacaggcacatcactatcttttcccccgagggtcgtttatatcaagtagaatatgcctttaaagcgactaatcaaactaacataaactcactagcggtcagaggtaaagattgtacagtggtgataagtcagaaaaaagtccctgataaactgttggatccaactactgtttcgtatattttttgtatttcaagaacaattggtatggtagtgaacggaccaataccggatgcaagaaatgcggccctaagagccaaggctgaggctgcagaattccgttataaatatggttatgatatgccatgcgatgtattggctaagagaatggctaacctttcccaaatctatactcaaagagcatatatgagaccattaggtgttatactcacatttgtttcggtagatgaagaattgggtccctccatttacaaaactgaccctgcaggttattacgttggctacaaagctactgcgacaggaccaaaacaacaggagatcacaacaaacttagaaaaccatttcaaaaagagtaaaatcgaccatattaatgaagaatcatgggagaaggtggtagaatttgctattactcatatgattgacgcactgggtaccgaattttcaaagaatgacttggaagtcggtgtcgctacaaaggacaaattctttaccttgagtgctgagaacatcgaagaaaggctagtagcaattgctgaacaagattaa

SEQ ID NO: 3295 - protein, 252 aa, Saccharomyces cerevisiae
MSGAAAASAAGYDRHITIFSPEGRLYQVEYAFKATNQTNINSLAVRGKDCTVVISQKKVPDKLLDPTTVSYIFCISRTIGMVVNGPIPDARNAALRAKAEAAEFRYKYGYDMPCDVLAKRMANLSQIYTQRAYMRPLGVILTFVSVDEELGPSIYKTDPAGYYVGYKATATGPKQQEITTNLENHFKKSKIDHINEESWEKVVEFAITHMIDALGTEFSKNDLEVGVATKDKFFTLSAENIEERLVAIAEQD

SEQ ID NO: 3296 - DNA, 753 bp, Saccharomyces cerevisiae
  CDS (1)..(753)
atgaccgacagatattctttttcgttgaccactttttctcccagcggtaaattgggtcaaattgattacgccttgacggcagtaaaacaaggtgtcacctcattgggtataaaagctacgaatggtgtagtaattgccacagaaaagaagtcgtcctcgccactggccatgtcagaaacactttcgaaggtatccttactaacaccggacattggtgcagtatattccggtatggggcctgattatagagttttagtggataaatcaagaaaggtagcacatactagttataaacgaatttatggtgaataccctcccaccaaattactggtttctgaagtagccaaaataatgcaagaggctacacagtccggtggtgtcagaccctttggtgtttcactgttgattgctggccacgacgaatttaatgggtttagtttatatcaagtggatccttccggttcctacttcccttggaaagccaccgctataggaaaaggttctgtggcggcaaaaacgtttttagagaaaagatggaatgatgaactggaactagaagacgccattcatattgccttactaacgctgaaggagtcggtagagggcgaattcaatggtgacaccattgaactggctattattggcgatgagaaccctgacttgctaggctacactggtattccaaccgataaaggccctagatttagaaaattaacttctcaagaaataaatgatagattagaagcattatga

SEQ ID NO: 3297 - protein, 250 aa, Saccharomyces cerevisiae
MTDRYSFSLTTFSPSGKLGQIDYALTAVKQGVTSLGIKATNGVVIATEKKSSSPLAMSETLSKVSLLTPDIGAVYSGMGPDYRVLVDKSRKVAHTSYKRIYGEYPPTKLLVSEVAKIMQEATQSGGVRPFGVSLLIAGHDEFNGFSLYQVDPSGSYFPWKATAIGKGSVAAKTFLEKRWNDELELEDAIHIALLTLKESVEGEFNGDTIELAIIGDENPDLLGYTGIPTDKGPRFRKLTSQEINDRLEAL

SEQ ID NO: 3298 - DNA, 1037 bp, Drosophila melanogaster
  CDS (91)..(930)
agtttgtttgtgtctcccggcgtgccataactaactatcgggcatttctacttgtcatcattgagctcagcggcttgcatttcaaaagtcatgtttcgcaaccagtacgatagcgatgttactgtgtggagtccgcagggacgtctccaccaggtggagtacgcaatggaggccgtgaaacttggcaccgcaaccgtgggcctgaaaaataaagattacgctgtacttgtcgccctgtgtaagccgacatcggagctatcggatacccagcgcaagatcatcccaatcgacgatcacctgggcatttccattgctggcctcacggctgatgcccgcgtccttagccggtacttgcgctccgagtgcctgaactacaagcactcgtacgatacaacctatccagtctcgcgtctgatcactaacctgggcaacaagatgcagacgaccactcagcgctacgatcgccgtccgtatggagtgggccttttggtcgccggctacgatgagaggggtccgcacatctatcaggtcacgccatcggcgacctttttcaattgcaaggccaattcgatcggatcgcgttcacagagtgcacgcacctatctggagaagaatttgaacaagttcttggacagttccaaagatgaaatcatccgtcacggaattcgcgctatactcggtaccctgcctacggatgagcaaggcaaagatgccggtcagtatgacatcactgtggccatcgtcggcaaagaccagccattcacaattctctctaataaagacagcgccaagcatgtggcgattgccaaagagaatgacaatgatacgcccaggaacgacgatgacgatgatcgcccatcccccccagaggaaccagcagccggaccacgcgacccagaagtcctggttgcaaccgagcagcgtccataggcatttatagggctatgaaagcatcttaaccattaaaaatgtaagattcaaggatacaataaaattgttcatgcatttgcatagatcctaaaacggaacaaactgaa

SEQ ID NO: 3299 - protein, 279 aa, Drosophila melanogaster
MFRNQYDSDVTVWSPQGRLHQVEYAMEAVKLGTATVGLKNKDYAVLVALCKPTSELSDTQRKIIPIDDHLGISIAGLTADARVLSRYLRSECLNYKHSYDTTYPVSRLITNLGNKMQTTTQRYDRRPYGVGLLVAGYDERGPHIYQVTPSATFFNCKANSIGSRSQSARTYLEKNLNKFLDSSKDEIIRHGIRAILGTLPTDEQGKDAGQYDITVAIVGKDQPFTILSNKDSAKHVAIAKENDNDTPRNDDDDDRPSPPEEPAAGPRDPEVLVATEQRP

SEQ ID NO: 3300 - DNA, 705 bp, Homo sapiens (man)
  CDS (1)..(705)
atggcggagcgcgggtacagcttttcgctgactacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataa

SEQ ID NO: 3301 - protein, 234 aa, Homo sapiens (man)
MAERGYSFSLTTFSPSGKLVQIEYALAAVAGGAPSVGIKAANGVVLATEKKQKSILYDERSVHKVEPITKHIGLVYSGMGPDYRVLVHRARKLAQQYYLVYQEPIPTAQLVQRVASVMQEYTQSGGVRPFGVSLLICGWNEGRPYLFQSDPSGAYFAWKATAMGKNYVNGKTFLEKRYNEDLELEDAIHTAILTLKESFEGQMTEDNIEVGICNEAGFRRLTPTEVKDYLAAIA

SEQ ID NO: 3302 - DNA, 1189 bp, Homo sapiens (man)
  CDS (137)..(922)
gcgcatgcgcgggggccatattagcagcggttattcggtgagcggtggtggtttattcttccgcggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttgaaaaaaaaaaaaaaaaaaaaaaaaaaaaaa

SEQ ID NO: 3303 - protein, 261 aa, Homo sapiens (man)
MSRRYDSRTTIFSPEGRLYQVEYAMEAIGHAGTCLGILANDGVLLAAERRNIHKLLDEVFFSEKIYKLNEDMACSVAGITSDANVLTNELRLIAQRYLLQYQEPIPCEQLVTALCDIKQAYTQFGGKRPFGVSLLYIGWDKHYGFQLYQSDPSGNYGGWKATCIGNNSAAAVSMLKQDYKEGEMTLKSALALAIKVLNKTMDVSKLSAEKVEIATLTRENGKTVIRVLKQKEVEQLIKKHEEEEAKAEREKKEKEQKEKDK

SEQ ID NO: 3304 - DNA, 1199 bp, Rattus norvegicus (Norway rat)
  CDS (86)..(877)
ggggcttctttgacgatcaccgaaccgtagttgaggccgtgttcctgtgtccgctgctgtgtctggttgtaacctcgccggagctatgtttcgcaaccagtatgacaacgatgtcactgtttggagccctcagggcaggattcatcaaatcgaatatgcaatggaagctgtaaagcaaggctcagcgacagtcggcctgaagtcgaagacacatgcagtgctggtcgcgctgaagagagcacagtcagagcttgccgctcaccagaagaaaattctccacgttgacaaccatattggtatctcaattgcgggtctaactgctgatgccagactgttatgtaactttatgcgccaggagtgtttggattccagatttgtatttgacagaccacttcccgtatctcgccttgtgtctctaattggaagcaagacccagataccaacacagcgatatggccggagaccgtatggtgttgggctgctcattgctggttatgatgacatgggccctcacgttttccaaacctgcccatctgctaactattttgactgcagagctatgtccatcggagcccgttcccagtcagctcgcacttacctggagagacacatgtctgaatttatgcagtgcaatttggatgaactggttaagcatggtcttcgcgccttaagagaaacactccctgcagaacaggacctgaccacaaagaatgtttccattgggattgttggtaaagacttggaatttactatctatgatgatgatgatgtgtctccattcctggatggtcttgaagaaagaccacagagaaaagcacagccttcacaggctgctgatgaacctgcagaaaaagctgatgaaccaatggaacattaagtgataaaggttatgaggacatgaggatgcaggggcatacactggtgacaataatctgtattttaaaccaacagctgtaatgtattgggtggtatgttttagaaatcagtccaaatgtgagttttctctaagcagcttcacagaaaccatataatggggtgcattttctttgaaagggtctacataatcattttctaggacgtataggtatctatatcaatgtttttatatgaagaaaataagtgtctttgcagttttaaagacaactgtgaaataaaattgtttcaccaccaaaaaaaaaaaaaaaaaaaaaaaaaaaaaa

SEQ ID NO: 3305 - protein, 263 aa, Rattus norvegicus (Norway rat)
MFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHVFQTCPSANYFDCRAMSIGARSQSARTYLERHMSEFMQCNLDELVKHGLRALRETLPAEQDLTTKNVSIGIVGKDLEFTIYDDDDVSPFLDGLEERPQRKAQPSQAADEPAEKADEPMEH

SEQ ID NO: 3306 - DNA, 1108 bp, Oryza sativa (rice)
  CDS (81)..(866)
gaaattctctctgattctctctcgcgggcggcggaagcaatcgtatttagcaaaggccggcaagcgaccccccaccggcgatgggcgacagccagtactccttctccctcaccaccttcagcccgtcggggaagctggtgcaaatcaaccacgccctgacggcggtcgggtccggccaaacctccctcgggatcaaagctgctaatggagtgtttgttgccaccgagaagaagttgccttctattttagtggatgaaacatctgtgcaaaaaattcagtcgttgactccaaatgttggtgtcgtctacagtggcatggggccagacttccgtgttttagtgaggaaaagtccaaagcaagcacaacagtgttgtcgtctgtacaaggaaactatgcctgttacacagctagtccgagaaactgctgctgtcatgcaggaatttacacaatctggtggtgtaagaccatttggtgtatctttgttgattgctgggtatgatgacaatggtccccaattgtaccaggttgatccatccgggtcatacttctcctggaaagcatcggctatggggaaaaatgtgtctaatgcaaaaacatttcttgagaaaagacacacagaagatatggagctcgacgatgccattcatactggtattttaattctgaaagaaggatatgaaggacaaatctccgccaacaacatcgaaattgggataatccgatccgaccgtgaattcaaggttctgagccccgcagagatcaaggtttcttggaagaggtggaataatttgtctcaacaatctcatgtttcaaaccagtggacacccgagcagctgcctcgaagttatatcccctttcattcatgaactgatcggcaccagtgacacgagacaaatgtttattcagattctcatgaacgaaaatgtgtttttaggaacgtatttgatttggcacggtgttttctgcatcctcttgtgcccatcctagtttcttgggccagtgcaacaactattcggcgtctcctaacttttgtagtctgtttcacttcttgccaaacgaagcacatgccatcttttgctcttgcaacggcaaaaaaaaaaaaaaaaaa

SEQ ID NO: 3307 - protein, 261 aa, Oryza sativa (rice)
MGDSQYSFSLTTFSPSGKLVQINHALTAVGSGQTSLGIKAANGVFVATEKKLPSILVDETSVQKIQSLTPNVGVVYSGMGPDFRVLVRKSPKQAQQCCRLYKETMPVTQLVRETAAVMQEFTQSGGVRPFGVSLLIAGYDDNGPQLYQVDPSGSYFSWKASAMGKNVSNAKTFLEKRHTEDMELDDAIHTGILILKEGYEGQISANNIEIGIIRSDREFKVLSPAEIKVSWKRWNNLSQQSHVSNQWTPEQLPRSYIPFHS

SEQ ID NO: 3308 - DNA, 1080 bp, Oryza sativa (rice)
  CDS (78)..(890)
atcttcgaatccccaccgaatcgcgcgagagagaaatccaaggcgaggacgaggaggaggagaaggaagcttcgagaatgttccggaaccagtacgacaccgacgtgacgacgtggagcccggcggggcggctgttccaggtggagtacgccatggaggccgtgaagcagggctccgcctgcgtcggcctccgctcccgcacccacgccgtcctcgccgccgcgaacaaggccgcctccgagctctcctcccaccagcggaaggtcttccgcgtcgcagaccacgccggggtcgcgctcgccggcctcaccgccgacggccgcgtcctctcccgattcctccgctccgagtgcatcaaccacgccttcgtctacgacgcgcccctccccgtctccaggctcgcgctccgccttgccgacaaggcgcaggtttgcacacagcgatcatggaagaggccatatggtgttggcctccttgttgctggattagatgagtctggagcccatctatactataactgccccagcggcaactattttgagtaccaggcatttgctattggctctcgctctcaagccgccaagactttccttgagcgcagattcgagggctacaacgactacaccccagagcaacttatcaaagatgccctctccgccataaaggagacgctgcaaggtgagaagctaaccagctccaactgcaccgttgctattgttggcagaaaggacgatggcaccgttgagccatttgagatgatcgacgtgaagaggatccaagaaataatcgattccatggaggctgccgaggaggcaccagcggcagaggctgagtcgagctcgatgcaggaggaggacaagggcacggacgccgcgcccatggacatctaggcccaagatacatcttatctcctcccttacaccgtgtctgagtttccaaaagactactgttttagaaagctgtgactgttgtgtaccctttcttcagtactacaactttgcgacggtctctttgatcaacatcgattgtgttttggaccgattatttacatgtgatgcggacagaaaatctctttggttt

SEQ ID NO: 3309 - protein, 270 aa, Oryza sativa (rice)
MFRNQYDTDVTTWSPAGRLFQVEYAMEAVKQGSACVGLRSRTHAVLAAANKAASELSSHQRKVFRVADHAGVALAGLTADGRVLSRFLRSECINHAFVYDAPLPVSRLALRLADKAQVCTQRSWKRPYGVGLLVAGLDESGAHLYYNCPSGNYFEYQAFAIGSRSQAAKTFLERRFEGYNDYTPEQLIKDALSAIKETLQGEKLTSSNCTVAIVGRKDDGTVEPFEMIDVKRIQEIIDSMEAAEEAPAAEAESSSMQEEDKGTDAAPMDI

SEQ ID NO: 3310 - DNA, 1024 bp, Oryza sativa (rice)
  CDS (112)..(861)
gaggagcagcaacgagaaaaggcggaggcggcggcgcaaccgacaaggaaaagcaaagcgagagcaggaaaacctcgccggcggcgacaccaccaccaccagcaggcagggatggcccggtacgaccgcgcgatcaccgtcttctcccccgacggccacctcttccaggtggagtacgccctcgaggccgtccgcaagggcaacgccgccgtcggcgtccgcggcaccgacaccgtcgtcctcggcgtcgagaagaaatccacccccaagctccaggactccaggtccatgcgcaagatcgccagcctcgacacccacatcgcgcttgcctgcgcggggctcaaggcggacgcccgcgtgctcatcaaccgggcgcgcgtcgagtgccagagccaccgcctcaccgtcgaggaccccgtcaccgtcgagtacatcacgcgctacatcgccggactgcagcagaagtacacccagagcggcggggtgcgccccttcggcctctccaccctcatcgtcggcttcgacccctacaccgagaagcccgccctctaccagaccgacccatccggcaccttctccgcctggaaggccaacgccaccggccgcaactccaactccatgcgcgagttcctcgagaagaattacaaggacacctccggcaaggagaccatcaagcttgccatccgagccctccttgaggttgtcgagagcggtggcaagaacatcgagattgcggtgatgacacacaaggatggcctccgcgagctggaggaggctgagatcgacgagtacgtggctgagattgaagcagagaaggctgccgccgaggccgcgaagaagggcgccccgaaagaaacctgacctgatcatcatgattcagcaaagcataatctctcttagcatgtgttgtttcttttctgttcttgtttgagaggaacgcagaactgtttggttcaactgaagtggatatggctatttgctgatcagcctacctggagtaaatcctcatgctatatgctttgcg

SEQ ID NO: 3311 - protein, 249 aa, Oryza sativa (rice)
MARYDRAITVFSPDGHLFQVEYALEAVRKGNAAVGVRGTDTVVLGVEKKSTPKLQDSRSMRKIASLDTHIALACAGLKADARVLINRARVECQSHRLTVEDPVTVEYITRYIAGLQQKYTQSGGVRPFGLSTLIVGFDPYTEKPALYQTDPSGTFSAWKANATGRNSNSMREFLEKNYKDTSGKETIKLAIRALLEVVESGGKNIEIAVMTHKDGLRELEEAEIDEYVAEIEAEKAAAEAAKKGAPKET

SEQ ID NO: 3312 - DNA, 994 bp, Glycine max (soybean)
  CDS (115)..(855)
tgatatctaattcgcggccgctcaaaaccaattgcatcactctcgtccgttaccgccgctgccctagaccaccgcaagcgacgtcgcacaccgccgtcatccgttagggcaaaaatgagtcgaggaagtggaggtggatacaatcgtcacatcactattttctcccctgaaggacgtctctttcaagtggagtatgctttcaaggctgtgaaggctgcaggaatcacctcgattggtgtccgaggaaaggattcaatttgtgtcgttactcacaagaaggttccggataagcttttggacaacacaagtgttacacacctctttcccatcaccaagtaccttggattattggctactggcatgacagctgatgctaggacactggtccaacaagcaagaaatgaagcagctgagtttcgctttacatatggatatgagatgcctgtagatgtattagctaaatggattgcagataaatcacaagtctatactcaacatgcttatatgagaccactcggagtagttgctatggttttgggtattgatgatgaatatggacctcagctatacaaatgtgatccagctggtcattactttggtcacaaggcaacaagtgctggattgaaggaccaagaggcaattaatttcttggaaaagaagatgaagaatgacccttcatttacatatgaggagacggttcagactgccatttctgccctgcaatcagttcttcaggaggattttaaggccactgagattgaggttggagtggtgcgaaaggataatcccgaattcagagttttaaccaccgacgaaattgatgagcacttgactgcaataagtgagcgtgactgagttcttgataaggatgtagttgttcaaactttctgatggtagagattatattatgtacttgtttctagaatcatcgaattcatttccttgtgatatttgagtagtgagttacccaagaatgatgttgaagattggtatt

SEQ ID NO: 3313 - protein, 246 aa, Glycine max (soybean)
MSRGSGGGYNRHITIFSPEGRLFQVEYAFKAVKAAGITSIGVRGKDSICVVTHKKVPDKLLDNTSVTHLFPITKYLGLLATGMTADARTLVQQARNEAAEFRFTYGYEMPVDVLAKWIADKSQVYTQHAYMRPLGVVAMVLGIDDEYGPQLYKCDPAGHYFGHKATSAGLKDQEAINFLEKKMKNDPSFTYEETVQTAISALQSVLQEDFKATEIEVGVVRKDNPEFRVLTTDEIDEHLTAISERD

SEQ ID NO: 3314 - DNA, 780 bp, Lycopersicon esculentum (tomato)
  CDS (1)..(780)
atggctagatacgacagagcgatcaccgttttctcgccggacggccacttattccaagtggagtacgccatggaagccgtacgcaaaggaaacgccgccgtcggtgtacgtggaactgacactgttgtcctcggcgtcgagaagaagtccactcccaagcttcaagactccaggtcagtaagaaagatagtgaatctagatgatcacattgcgttggcgtgtgctgggctgaaagcagatgcacgagttcttgtgaataaagcacgcattgagtgtcagagtcataggcttacagttgaagatcctgttactgttgagtacataactcgttacattgctggtcttcagcaaaagtacacccaaagtggtggggtgaggccatttggtctatccaccttgatcattggttttgacccacacacaggtgtcccctcactttaccaaacagatccatcaggtacattctcagcttggaaagccaatgcgactggtagaaactccaactctactcgggaattcttggagaagaattacaaagaaacatctggccaggaaactgtgaaactagcaatacgtgcattgcttgaagttgttgaaagtggtggaaaaaacatagaagttgctgtgatgacaaaagagcatgggcttaagcaacttgaggaagctgaaattgatgccattgttgctgagatcgaagcagagaaagctgctgcagaagcagccaaaaggccccaccgaagaaacctagttgagctgaaatttgttcttaactatccctga

SEQ ID NO: 3315 - protein, 259 aa, Lycopersicon esculentum (tomato)
MARYDRAITVFSPDGHLFQVEYAMEAVRKGNAAVGVRGTDTVVLGVEKKSTPKLQDSRSVRKIVNLDDHIALACAGLKADARVLVNKARIECQSHRLTVEDPVTVEYITRYIAGLQQKYTQSGGVRPFGLSTLIIGFDPHTGVPSLYQTDPSGTFSAWKANATGRNSNSTREFLEKNYKETSGQETVKLAIRALLEVVESGGKNIEVAVMTKEHGLKQLEEAEIDAIVAEIEAEKAAAEAAKRPHRRNLVELKFVLNYP

SEQ ID NO: 3316 - DNA, 1099 bp, Spinacia oleracea (spinach)
  CDS (43)..(792)
ggcacgaggaatcggagagagaaagagcggaaaagaagcagaatgagcagcatcggaacaggctacgacctttcggtcactactttctcaccagacggtcgagtttttcagatcgagtacgccgccaaggccgttgacaacagcgggactgctgtaggcatcaaatgcaaggatggaattgttctgggtgtggagaagcttattcaatcgaagatgatgttgccgggctcgaatcgacgaatccactccgttcatcgtcactctggcatggcagttgcaggattagcagctgatggaaggcaaatagttgctcgtgccaaatcagaagctacaaactatgagagtgtctatggtgaagctgtcccagtgaaggaacttgctgatcgtgttgctagttatgtccatttatgcaccctctattggtggctcagaccttttggatgtggagtcattcttggaggttatgaccgagatggaccacagttatatatggttgagccttctggaatttcatatagatattttggcgctgctattggaaagggaaaacaggctgctaaaacggaaattgaaaagctgaagctctcagaaatgacctgtagagaagggatcattgaagtagccaagatcatatacaaggttcatgatgaagcaaaagataaagcttttgaattggagatgagctggatttgtgatgagtcaaaacgcgagcatcagaaggttcctgacaatcttctacaagaagccaaagccgccgcaactgctgcactggaagagatggacgctgactaatatgcttatatggggttataactagagagccatgtatcaagtgaaactttatgcaggttaggattggcagtaatatgatgtatcactccttgagaactgtccctttatatcaaaattgtgagctctgtagaaacatctttttagttaacggtcaaattgttcacccctttcggtaaatttagtttggaggagggataatatttctaatgttaatgagaggtagaacccaattcgctgtgtattcagctatttataaatggcatttcctgtcgatgattttacttttatttgaaaaaaaactcgtgcc

SEQ ID NO: 3317 - protein, 249 aa, Spinacia oleracea (spinach)
MSSIGTGYDLSVTTFSPDGRVFQIEYAAKAVDNSGTAVGIKCKDGIVLGVEKLIQSKMMLPGSNRRIHSVHRHSGMAVAGLAADGRQIVARAKSEATNYESVYGEAVPVKELADRVASYVHLCTLYWWLRPFGCGVILGGYDRDGPQLYMVEPSGISYRYFGAAIGKGKQAAKTEIEKLKLSEMTCREGIIEVAKIIYKVHDEAKDKAFELEMSWICDESKREHQKVPDNLLQEAKAAATAALEEMDAD

SEQ ID NO: 3318 - DNA, 1046 bp, Spinacia oleracea (spinach)
  CDS (76)..(828)
gcggcacactttactctcatctatttctctctcctctttcgatcgatctttctgcatttctcaaggtagtgaatcatgtctcggaggtatgatagccgtacaacaatcttctcccctgaaggtcgactttaccaggtggagtatgcaatggaggcgattgggaatgctgggagtgccatagggattttggcaaaagatggtgttgttttgattggtgagaaaaaggtgacttctaagcttcttcagacctccacctcaaccgaaaagatgtacaagatcgacgatcatgtagcttgtgctgtggctggtataatgtctgatgcaaacattcttatcaatacagctcgtgtccaagctcagcgttacacattttcttaccaagaaccgatgcctgttgagcagcttgttcagtctctttgtgataccaagcagggttacactcagtttggtgggctacgaccatttggtgtttcatttctgtttgctgggtgggataagaactatgggttccaactttacatgagtgacccaagtgggaattatggtgggtggaaagctactgctatcggagcaaacaaccaagctgcacagtcaatgcttaagcaggactacaaggatgatgttactcgggaagatgctgttaagcttgctttgaaggctctcagcaagacaatggacagcacaagtctcacttctgagaagctagaattggctgaggtttaccttctgccttctggaaaagtcaagtaccaggtacactctccagaatccttgaacaggttgttgaccgagtctgggctgactcaacctgctgctgaaacctcttgagctctggcaatacttagtgttacccatgtccctagatcccatttcttgctgcgtattctgtaatgtactctattagatatgacttgcgtcttgcatcttgcatcttgcttaaatcgtttccttgactttgcgaactgtggaaagaaaaaaggcgcacttcctaccagtggttttttttatttattgctatatgctgttcatgctgtggtgaaaaaaaa

SEQ ID NO: 3319 - protein, 250 aa, Spinacia oleracea (spinach)
MSRRYDSRTTIFSPEGRLYQVEYAMEAIGNAGSAIGILAKDGVVLIGEKKVTSKLLQTSTSTEKMYKIDDHVACAVAGIMSDANILINTARVQAQRYTFSYQEPMPVEQLVQSLCDTKQGYTQFGGLRPFGVSFLFAGWDKNYGFQLYMSDPSGNYGGWKATAIGANNQAAQSMLKQDYKDDVTREDAVKLALKALSKTMDSTSLTSEKLELAEVYLLPSGKVKYQVHSPESLNRLLTESGLTQPAAETS

SEQ ID NO: 3320 - DNA, 759 bp, Plasmodium falciparum
  CDS (1)..(759)
atggctggacttagtgctgggtatgatttatccgtgtcaactttttctccagacggtcgtttgtatcaggttgaatatatttataaatcaataaataataacaacacagctttatgtttagaatgtaaggatggaataatatgttgttgtataaattcaaatatggataagaataagatgattaaaaaaaatagttataatagaatatatcatgtcaataataatattataataacatattcaggatttgatggagatgcaagaaatataatagatagagcaagaagtgaagcaaatacttattattataatttccatacaaacataccattacatattttagtaaacagaatttctttatatatccatgcgtatacattatattggcacatgagaccttttgcagcttcaataattataagttcttttaacgaaaaggataaaggagatatttattgtattgaaccaaacggagcgtgctataaatactcaggcatagttattggtaagaacaaagaaatgtttaaaacagaaattgaaaagaaggattataaagacattaatgtaagagatgctatcgaagatatttataaatttatattaactagtgatgatcatatgaataaaaataacctacaaaatttagttaatttttcatggatatgtaaagaatcttcatatgaatttcaaaacatccatgaagaaattttaacacctgctcttaataaagcagttgaatatatagaaaaattaaactag

SEQ ID NO: 3321 - protein, 252 aa, Plasmodium falciparum
MAGLSAGYDLSVSTFSPDGRLYQVEYIYKSINNNNTALCLECKDGIICCCINSNMDKNKMIKKNSYNRIYHVNNNIIITYSGFDGDARNIIDRARSEANTYYYNFHTNIPLHILVNRISLYIHAYTLYWHMRPFAASIIISSFNEKDKGDIYCIEPNGACYKYSGIVIGKNKEMFKTEIEKKDYKDINVRDAIEDIYKFILTSDDHMNKNNLQNLVNFSWICKESSYEFQNIHEEILTPALNKAVEYIEKLN

SEQ ID NO: 3322 - DNA, 741 bp, Caenorhabditis elegans
  CDS (1)..(741)
atgtctcgtggaagcagcgccggattcgatcgtcatattaccatcttctctccagaaggacgtgtttatcaggtcgagtatgccttcaaagcaatcaactctaccaatctgacggctgtcgcagtcaagggagctgatgcagctgtcattgccgttcaaaagcgtgttccagacagtctcatcgtcgctgataccgtcacttcggtttatcaaatctctcagtctgttggatgctgcgccattggaatgatcccggatgctaaattccaaatcaagcgtgcacagggagaagctgctagctggaagtacaagaacggctacgatatgccatgcgagcttctcgccaaaaagatggctgatctcaaccagtattacacacaaaatgcggagatgcgtagtttgggatgtgctcttttgttcatttcctacgatgacgagaaaggaccagaagtttatcgtgttgaccccgctggatactaccgtggtatgaaaggagtatctgttggagtgaaacaacttccagcgacctcattcttggaaaagaaaattaagaagaagtccgaattgacatccacagaagctattgaactcgccattgaggctcttcagacttcattgggaatcgacgttcgttccaaggatcttgaggttgtcgttgtcaccaaggataactccaaattcaccaagctaaccagcgatcaggtcgaacatcatctcaatcaaatcgccaaccgagattaa

SEQ ID NO: 3323 - protein, 246 aa, Caenorhabditis elegans
MSRGSSAGFDRHITIFSPEGRVYQVEYAFKAINSTNLTAVAVKGADAAVIAVQKRVPDSLIVADTVTSVYQISQSVGCCAIGMIPDAKFQIKRAQGEAASWKYKNGYDMPCELLAKKMADLNQYYTQNAEMRSLGCALLFISYDDEKGPEVYRVDPAGYYRGMKGVSVGVKQLPATSFLEKKIKKKSELTSTEAIELAIEALQTSLGIDVRSKDLEVVVVTKDNSKFTKLTSDQVEHHLNQIANRD

SEQ ID NO: 3324 - DNA, 762 bp, Caenorhabditis elegans
  CDS (1)..(762)
atgaacagatacgatcgtgctatcactatcttctcccctgatggacacttgttccaagtggaatatgcccaggaagctgtcaagaagggttcgactgcggtcggtgttcgcggaaaggattgcattgttatcggtgttgagaagaagtcaattccagctcttcaagatgaccgcacaatccgtaaaattcatatgatcgacgaccatgtgatgctcgcttttgctggattgtccgcagatgctcgtgttcttgttgatcgtgctcgtatcgagtgccagtcgtacaagttgactcttgaagatccagttaccgttgcctatatctccagatatattgcaaacacgaagcagcgcttcacacaatctccaggacgtcgcccattcggaatttcaatgctcattggaggattcgatcatgacggaactccacgtcttttcaaaaccgagccatctggagcttactacgagtacgttgccaacgcgactggaagaggagagaaaccagtgcgtgaataccttgaggagcaatacagcgaggaaaatactgtcgacgaagctaccactcttaaattggttgtaaagtcgctggctcaggtcgtaccaccaggatcacaaaatatcgagattgcagtcatgaaaaaagttaatgatgagctgcagcaacgtgtattgtcaactgaagaaatcgaggctctcctgaaggttgttgagacagaacgtgtggctgctgaggctgaagaggctgcatccaagaagaagtag

SEQ ID NO: 3325 - protein, 253 aa, Caenorhabditis elegans
MNRYDRAITIFSPDGHLFQVEYAQEAVKKGSTAVGVRGKDCIVIGVEKKSIPALQDDRTIRKIHMIDDHVMLAFAGLSADARVLVDRARIECQSYKLTLEDPVTVAYISRYIANTKQRFTQSPGRRPFGISMLIGGFDHDGTPRLFKTEPSGAYYEYVANATGRGEKPVREYLEEQYSEENTVDEATTLKLVVKSLAQVVPPGSQNIEIAVMKKVNDELQQRVLSTEEIEALLKVVETERVAAEAEEAASKKK

SEQ ID NO: 3326 - DNA, 696 bp, Caenorhabditis elegans
  CDS (1)..(696)
atgggagatcactatggattctcactcaccaccttcagcccatcgggaaaattgatgcaaatcgaatatgcattgaatgctgtcaagaatgggcaaccatcggttggactgagagctaaagacggagtcgttcttgcgaccgagaatgtcggatctgttctcaccgatgaccagccaaaggtagaacaaatcagcaagcatattggatgcgtctacagtggaatgggaccagacttccgtattttggtgaagaaagctcgcaagattgctatggaatacgaaatgatgtacggcgaggaaatgccaaccattcaacttgtcactgacatcgcggccgtaatgcaggaatatactcaatctggtggtgttcgtccgtttggagcatcgcttcttatcgcaggttgggacaaaaatccaggacggccattgctcttccaatgtgatccatctggagcttacttcgcatggaaagcaacagcactcgggaaaaacgacgtcaatgcgaaaacattcctcgagaagcgcttcagcgaggccctcgagctcgatgatggaattcacactgctcttctgacactgagagaatcgttcgatgttggcatgaacgagaacaacgttgaggtggctgtttgtaactcgaccggattccatcggctcaccaagcaacaagtccatgatcaccttggaactctttaa

SEQ ID NO: 3327 - protein, 231 aa, Caenorhabditis elegans
MGDHYGFSLTTFSPSGKLMQIEYALNAVKNGQPSVGLRAKDGVVLATENVGSVLTDDQPKVEQISKHIGCVYSGMGPDFRILVKKARKIAMEYEMMYGEEMPTIQLVTDIAAVMQEYTQSGGVRPFGASLLIAGWDKNPGRPLLFQCDPSGAYFAWKATALGKNDVNAKTFLEKRFSEALELDDGIHTALLTLRESFDVGMNENNVEVAVCNSTGFHRLTKQQVHDHLGTL

SEQ ID NO: 3328 - DNA, 747 bp, Caenorhabditis elegans
  CDS (1)..(747)
atgttcctcactcgcagcgagtacgatcgtggagtcaacactttttctccagaagggcgtttgttccaagtggaatacgctattgaggccgtcaaactcggatctacaagcattggaatcaagacgagcgaaggtgttcttctcgctgctgagaaaagatcgacatcgaagctgatggtcaatgacgcgatcgagaaaatcagcaaggtcgaccaacatattggcgtcacattcgcaggtttgattgccgactcgcgcactctggtcgaacgggcacagatcgaggctcaaaatttctggttcacttataaccgcaaaattcgcgtggaagacgtcactcagtcggtcgccaatctagctcttcagtttggagacgacgacgtcaaagcatcaatgtctcgtccatttggtgtagcaatgctgttcgctggtgtagaccaagaaggagccaaactgttccatctcgatccatctggaactttcatcgattgtaaggctaaatcgatcggtgcagctagcgatggagctgagcagaatctcaaggagcaatatcatgatgctctgactatcaaggaaggactcaagatggcattggccattctcaagcaggtgatggaagagaaactgaactccgccaatgtcgaagtcgttgttatcaaaccaacagttgacgcgaaggggcgtccaatcggagaattcacaagagtgtcgaacgaagagctcgatcaagttatcacatcgctttga

SEQ ID NO: 3329 - protein, 248 aa, Caenorhabditis elegans
MFLTRSEYDRGVNTFSPEGRLFQVEYAIEAVKLGSTSIGIKTSEGVLLAAEKRSTSKLMVNDAIEKISKVDQHIGVTFAGLIADSRTLVERAQIEAQNFWFTYNRKIRVEDVTQSVANLALQFGDDDVKASMSRPFGVAMLFAGVDQEGAKLFHLDPSGTFIDCKAKSIGAASDGAEQNLKEQYHDALTIKEGLKMALAILKQVMEEKLNSANVEVVVIKPTVDAKGRPIGEFTRVSNEELDQVITSL

SEQ ID NO: 3330 - DNA, 783 bp, Caenorhabditis elegans
  CDS (1)..(783)
atgttccgcaaccaatacgacggcgatgtaacagtctggagcccacagggacgtcttcaccaagtcgaatatgccgttgaggcgatgaagcaaggttcggcaactgttggaatcaagagtgaaacccacgctgtcatcgtcgccctgaagagagcgcaaaacgatttgtcgtctcatcagaagaaagtgtacgaaattgacactcacgctggagtttccatcgctggtctcctctccgatggtcgcatcttggctcgctacctccaaaccgagtgctcgagttggcgttgggattacaagcaagcggttccaatcaagaagctcgctgaatctatgcaattgaaacttcaagccaatacacaatattatggccgtcgtccattcggagttggaattctgattgccggatatgacaaagatggagcacacatcattcaaactgacccatctgctgaagtcgtcagcatgcatggaacttcaatcggagcaagatctcagtctgcgcgcacttacctcgagagaaatgttgataacttcgagaaatcaactccggaacaattgattgtccatgctctccttgctcttcgcgacacacttccagccgaagaaaacctcaacgctcagaatacgtctattggaattgtcgggaaagattctccattcagtcttctcgaagatgctcaagtcgccgttcatctcaaccaagtttccacacatccacgcacaactggcggagcagcagcagcagcagctccaggtggcgccgaaccaatgcaaatgtag

SEQ ID NO: 3331 - protein, 260 aa, Caenorhabditis elegans
MFRNQYDGDVTVWSPQGRLHQVEYAVEAMKQGSATVGIKSETHAVIVALKRAQNDLSSHQKKVYEIDTHAGVSIAGLLSDGRILARYLQTECSSWRWDYKQAVPIKKLAESMQLKLQANTQYYGRRPFGVGILIAGYDKDGAHIIQTDPSAEVVSMHGTSIGARSQSARTYLERNVDNFEKSTPEQLIVHALLALRDTLPAEENLNAQNTSIGIVGKDSPFSLLEDAQVAVHLNQVSTHPRTTGGAAAAAAPGGAEPMQM

SEQ ID NO: 3332 - DNA, 735 bp, Schizosaccharomyces pombe
  CDS (1)..(735)
atgtctcaagcacgcggatttgataggacaattaccgtcttctcccctgaaggacgtctttatcaagttgaatatgcattcaaagcgtttaataacgcagggattacatctgttggtgtaacaggtaaaaattgtgcatgtgtaatctcccaaaaaaaagtacctgacaaacttattgatgcctctaccgttaaacatgtttttcctattactaaaggaatcggctgtgttatgacaggctctatcgcggacgctcgcgcgcaagttagccgggctcgaagtgaggctgctgaatttgaatacaaaaatggataccctatgccctgcgatgttctagccaaaagaatggctaatattgctcaagtttctacccaacgtgctgctatgaggcctttgggagttgcaatgacccttgtagctgtggatgatgagattggaccttccctatttaagctcgaccctgctggtttctatattggttataaagctaccagtgctggaccaaagcaaacggaaactataaactggctagaaaaacgattcaaaaaggacggaataccttcaaaccttactgataccgttgaaaccggaattcaggctttaatgagtagtttaagtactgattttaagtctactgagcttcagattggtgttgttgaagacgacaaaccatttcgagttttatcagtagaagaaatagaagcccatttacaaagtattgccgaaaaggattga

SEQ ID NO: 3333 - protein, 244 aa, Schizosaccharomyces pombe
MSQARGFDRTITVFSPEGRLYQVEYAFKAFNNAGITSVGVTGKNCACVISQKKVPDKLIDASTVKHVFPITKGIGCVMTGSIADARAQVSRARSEAAEFEYKNGYPMPCDVLAKRMANIAQVSTQRAAMRPLGVAMTLVAVDDEIGPSLFKLDPAGFYIGYKATSAGPKQTETINWLEKRFKKDGIPSNLTDTVETGIQALMSSLSTDFKSTELQIGVVEDDKPFRVLSVEEIEAHLQSIAEKD

SEQ ID NO: 3334 - DNA, 1357 bp, Thermococcus sp
  CDS (78)..(860)
ttgcatgcctgcaggtcagcttaatagatggcccgtagagtaagctaaaggagtaaagggaatagaggtgatgtgaaatggcgtttgtaccaccgcaggccggttacgaccgggcgattacggtattcagccctgatggaaggctcttccaggtcaactatgccagggaggcagtgaagaggggagcaaccgctgtcggtgttaagtggaaggacggtgttgtcctcgctgttgagaagaggatcaccagcaagctcatcgaaccgagcagctatgagaagatattccttattgatgaccacatagcggccgctccgagcggcattattgccgatgccagggttttggttgacagggccaggcttgaggcccagatttaccgcctcacctacggcgaacccgtcccgctcaccgttctggtgaagaagatatgcgaccttaagcaggcccacacccagtacggtggtgtgaggcccttcggcgccgccctgcttatggcgggcgtaaacgagaagcccgagctttttgagaccgatccgagcggcgcctacttcgagtggaaagcagttgccataggaagtggcaggaacaccgccatggccattttcgaggagcactacagggacgacatcgggaaggacgacgccataaagctcgcaatccttgcccttgcgaagaccctcgaagagccaactgctgagggtatagaggttgcctacataaccatggacgagaagcgctggaagaagctcccgagggaggagcttgagaagtacctcaacgagatcctccaggaagttaaggaggaagaggttgaggagaaacaggaagactactccgaactcgatcagaactactgaggtgacgggcgatgccgataagtgttgataaggccgtcatcgcccgtctgaagacccatggtgagactttcgagatactggtcgatccttacctggctagggacttcaaggagggcaaggacgttccgatagaggagatcctcgccactccctacgtttttaaggacgcccacaagggtgacaaggcgagcgagcacgagatggagaaaatattcggcaccagcgacccgtacgaagtcgccaagataatcctccgaaagggtgaggttcagctgacagctgagcagaggaggcagatgcttgaggacaaaaagcgctacatagccactgtgatccacaggcacgcagttgatccgaggacgggctatccccacccggttgacagaattctcagggccatggaagaggcaggagtgcacattgacatattcaaggatgccgaggctcaagttccacaggtcatcaaggctataaggccgatactgcccctaaagctt

SEQ ID NO: 3335 - protein, 260 aa, Thermococcus sp
MAFVPPQAGYDRAITVFSPDGRLFQVNYAREAVKRGATAVGVKWKDGVVLAVEKRITSKLIEPSSYEKIFLIDDHIAAAPSGIIADARVLVDRARLEAQIYRLTYGEPVPLTVLVKKICDLKQAHTQYGGVRPFGAALLMAGVNEKPELFETDPSGAYFEWKAVAIGSGRNTAMAIFEEHYRDDIGKDDAIKLAILALAKTLEEPTAEGIEVAYITMDEKRWKKLPREELEKYLNEILQEVKEEEVEEKQEDYSELDQNY

SEQ ID NO: 3336 - DNA, 759 bp, Haloferax volcanii
  CDS (1)..(759)
atgcagggacaagcgcaacaacaggcgtacgaccgcgggattacgatcttctcgccggatggtcgactctatcaggtcgaatacgctcgtgaggccgtcaagcgcggcaccgcgagcatcggcgtgcgaacgcccgagggcgtcgtcctcgcggcggacaagcgctctcgctcgccgctgatggaaccgacgagcgtcgagaagattcacaaggcggacgaccacatcggcatcgcgagcgccggccacgtcgccgacgcccgtcagctcatcgacttcgcccgccaccagtcacaggtcaaccgcctccgctacggcgaacccatcggcatcgagacgctgaccaaggaagtcaccgaccacatccagcagtacacgcaggtcggcggcgcgcgcccgttcggcgtcgcgctcctcatcggcggcgtcgaaaacggtaccccccgcctctacgagaccgacccctcggggaccccctacgagtggaaggccgtctccatcggggccgaccgcggcgaccaccaagagcacctcgaagagaacttccgcgacgacctgaccctcgacgagggtatcgaactcgcgctggaggccatcgcctcgaccagcgacgagggcaccgcgcccgacggcgtcgacgtggcgaccgtctccgcggagacggagcgcttcgtcgagctgtctaacgacgaaatcgagagctacctcgaagccaacgacctgttggcgaccgaggacgacgaacagaccgaagagtaa

SEQ ID NO: 3337 - protein, 252 aa, Haloferax volcanii
MQGQAQQQAYDRGITIFSPDGRLYQVEYAREAVKRGTASIGVRTPEGVVLAADKRSRSPLMEPTSVEKIHKADDHIGIASAGHVADARQLIDFARHQSQVNRLRYGEPIGIETLTKEVTDHIQQYTQVGGARPFGVALLIGGVENGTPRLYETDPSGTPYEWKAVSIGADRGDHQEHLEENFRDDLTLDEGIELALEAIASTSDEGTAPDGVDVATVSAETERFVELSNDEIESYLEANDLLATEDDEQTEE

SEQ ID NO: 3338 - DNA, 750 bp, Haloferax volcanii
  CDS (1)..(750)
atgaaccgaaacgacaagcaggcctacgaccgcggaacgtcgcttttctcccccgacggacgcatctatcaggtcgagtacgcccgggaggccgtcaagcgcggcgcgccggttctcggcgtccgcaccgccgacggcgtcgtgctggcggcgctccggtcgaccccgtcggaactcatggaagccgaaagcatcgagaaactgcacaagctcgacgacgcgctcggcgcggccacggccggccacgtcgccgacgcgcggaagctcgtggacttcgcgcggacgaccgcccagcgcgagcacctgcgctacggcgagccaatcggcgtcgagacgctcacgaaaaccatcaccgacaacatccaagagagcacgcagtccggcggcacccgcccgtacggcgcgtcgctcctcatcggcggcgtcgaaaacggctcgggtcgcctgtttgcgaccgacccctcggggacgccccaagagtggaaggcggtcgccatcggcggccaccgcgaggacgtccaggccgccctcgaagacggctacgccgaggacctgtcgctcgaagacggcctcgcgctcgccgtcgaggcgctcgtcgcggccgacgaggaaatcgagagcgacgaactgaatctcgtcaccgtctccgaggcgggctacgaaatcgtcgacgaggagaccatcgccgagctgttcgccgacgcgaccgcggacgacgagtccgacgagacggacgaacgcgaggagtag

SEQ ID NO: 3339 - protein, 249 aa, Haloferax volcanii
MNRNDKQAYDRGTSLFSPDGRIYQVEYAREAVKRGAPVLGVRTADGVVLAALRSTPSELMEAESIEKLHKLDDALGAATAGHVADARKLVDFARTTAQREHLRYGEPIGVETLTKTITDNIQESTQSGGTRPYGASLLIGGVENGSGRLFATDPSGTPQEWKAVAIGGHREDVQAALEDGYAEDLSLEDGLALAVEALVAADEEIESDELNLVTVSEAGYEIVDEETIAELFADATADDESDETDEREE

SEQ ID NO: 3340 - DNA, 992 bp, Methanosarcina thermophila
  CDS (175)..(918)
gatatccgcacaggttaaatagcgtttactgaccaaagccttttttgggcatgcggtgatttagttgacgattctgcggatttgaaatcccttaggaaaaatgaccggtttctcaccgggaaaattgaaacaatatagaacataaattaaggcaaggagatacggaatatgcagatggcaccacagatgggttatgacagggcaattacggttttcagccctgacggaagacttttccaggtagagtatgcccgcgaagcggtcaaaaggggaacaacagccgtaggaatcaaggcagctgatggggtagtgctgctggttgacaagcgaataaccagcagacttgtggaagccgaatcaatcgaaaaaatattccagattgatgaccacataggagccgcaacctcagggcttgtggcagacgcccgcgcccttgttgacagggctcgcgtagaagcccaggtaaacagggtttcttatgacgaactcataggtgtggaggtaatctctaagaaaatttgtgaccacaagcagacctacacccagtacggtggagttcgcccatacggaactgcactcctgattgccggcgtggatgacaaaaggccaaggctctttgagaccgaccctagcggggctctcctcgagtacaaggcaacagccataggcgcaggtagaaatgcagttgttgaggtttttgaggcagattacaaggaagatatgaatattgaagctgctatcctcctcgggatggatgcactctataaagcagctgaaggcaaattcgatgccggaacccttgaagtgggtgtcgtgtctcttcaggacaagaaattcagaaaactggagcctgaagaagttgggaactacgttcagcagatccttgagaaacacaaggaaactgaaaacaaagaataaaacctataactatttaaagaatgagtaatcagagaaattctgaatctcaaacttacatcttagagaaggtattc

SEQ ID NO: 3341 - protein, 247 aa, Methanosarcina thermophila
MAPQMGYDRAITVFSPDGRLFQVEYAREAVKRGTTAVGIKAADGVVLLVDKRITSRLVEAESIEKIFQIDDHIGAATSGLVADARALVDRARVEAQVNRVSYDELIGVEVISKKICDHKQTYTQYGGVRPYGTALLIAGVDDKRPRLFETDPSGALLEYKATAIGAGRNAVVEVFEADYKEDMNIEAAILLGMDALYKAAEGKFDAGTLEVGVVSLQDKKFRKLEPEEVGNYVQQILEKHKETENKE

SEQ ID NO: 3342 - DNA, 1113 bp, Arabidopsis thaliana (mouse-ear cress)
  CDS (117)..(857)
cttgaagacaaagaaagctttcttctataatacatctttctctacagatcacacagaagcaaaaattccatctccgatttcggaagagagttgttctcttctctgagaagaagaagatgagcagaggaagcggcgctggttacgatcgtcacatcactattttctcaccggaaggtcgtctcttccaagtcgagtatgctttcaaagccgtgaaagcagctggaatcacatcgatcggtgtccgagggaaagattcagtatgcgtcgttacgcagaagaaagttccggacaagcttttggatcagtctagtgtatctcaccttttccctgttaccaagtaccttggattgttagccactggcatgacagctgattcaaggtcattggtacaacaagctaggaatgaggctgctgagtttaggttccaatatggttatgagatgcctgcagatattcttgctaaatggattgcagataagtctcaggtttacacacaacatgcttacatgagaccccttggagtagttgccatggttctaggtattgatgaagagagaggacctctactttacaagtgtgacccagctggacatttttacggtcacaaggcaactagtgctggtatgaaagaacaagaagcagtcaatttcttggagaagaaaatgaaagaaaaccctgccttcacatatgatgaaacagtacagactgctatatccgctctccaatctgttcttcaagaagacttcaaagcaactgaaattgaggtgggagttgtgagagctgatgaccctctcttccgttccctgagaacagaggagatcgacgagcacttgacggccattagtgaacgtgactgatcactttcactggaacattcagtcgggactttgcatctctttcttttgctttaaatctatctaagatgattcacgtttcagagaaacgtgtttccattagtcatgagtcgtgtagttttcatttgaatcatctgcttcctcctaataggagttacatgtaagggtgtcaaattaaggtcgaatgagatggtttaaggttttgaattttaaaaggcaaaacaaagaaagttatttacaaaaaaaaaaaaaaaaaaaa

SEQ ID NO: 3343 - protein, 246 aa, Arabidopsis thaliana (mouse-ear cress)
MSRGSGAGYDRHITIFSPEGRLFQVEYAFKAVKAAGITSIGVRGKDSVCVVTQKKVPDKLLDQSSVSHLFPVTKYLGLLATGMTADSRSLVQQARNEAAEFRFQYGYEMPADILAKWIADKSQVYTQHAYMRPLGVVAMVLGIDEERGPLLYKCDPAGHFYGHKATSAGMKEQEAVNFLEKKMKENPAFTYDETVQTAISALQSVLQEDFKATEIEVGVVRADDPLFRSLRTEEIDEHLTAISERD

SEQ ID NO: 3344 - DNA, 1045 bp, Arabidopsis thaliana (mouse-ear cress)
  CDS (134)..(841)
acttcaaccttctcttctctgcaagaaacctaaaagcctatttatttcacctctctctctctctctctgcaactaatcacttgttcgatctcgaagctgaagctaaagctttcgctaatttgcttaaggagctatgggagatagtcagtactcgttttctctcaccactttcagcccatctggtaagctggtgcagatagaacatgcccttacagctgttggatctggccaaacatctttagggattaaagcttctaatggagttgtcattgcaactgaaaagaagttgccttctattctggttgatgaagcatctgttcaaaaaattcagcatttgactcctaatattggagttgtttacagtggcatgggtcctgattttcgagttcttgttaggaagagtaggaaacaggctgagcaatatcttcgtctgtacaaagaacccatccctgttacccaacttgtaagggaaaccgctactgttatgcaagagtttactcaatcgggaggtgttaggcctttcggggtttccttgctggtggctggatatgatgacaagggtccacaattgtatcaggtggatccatctggctcttatttctcctggaaagcttcagccatggggaagaacgtttctaatgcaaaaaccttccttgagaaaaggtacacagaagacatggaacttgacgatgccattcacacagcgatactgacattgaaagaaggctttgagggagagatctcaagcaaaaatattgaaattggcaaaatcggtgctgacaaagttttcagggtactaacaccagcagagatcgatgattaccttgctgaagtcgagtaactcccagcatagtctagcaacaaagtttaagaccggaatttcgtggcatttacagtcttaaagagttgttttttctgtaaaactttggatctttaaatagtttgttgctgaacacaagctgagtgtctctcaataactaatgaaatctgtttctttttttctcactcagtgaaggtttcagagaaatcttatagtagtctcgtc

SEQ ID NO: 3345 - protein, 235 aa, Arabidopsis thaliana (mouse-ear cress)
MGDSQYSFSLTTFSPSGKLVQIEHALTAVGSGQTSLGIKASNGVVIATEKKLPSILVDEASVQKIQHLTPNIGVVYSGMGPDFRVLVRKSRKQAEQYLRLYKEPIPVTQLVRETATVMQEFTQSGGVRPFGVSLLVAGYDDKGPQLYQVDPSGSYFSWKASAMGKNVSNAKTFLEKRYTEDMELDDAIHTAILTLKEGFEGEISSKNIEIGKIGADKVFRVLTPAEIDDYLAEVE

SEQ ID NO: 3346 - DNA, 753 bp, Arabidopsis thaliana (mouse-ear cress)
  CDS (1)..(753)
atgtctcggagatatgatagccgtaccacaatcttctcgccagaaggtcgtctttaccaggtagagtatgctatggaggccattggaaacgccggttctgcgattggaatcttatccaaagacggtgttgtgttgatcggtgagaagaaagtcacctcaaagcttcttcaaacctcaacctctgctgagaaaatgtacaagattgatgaccatgttgcctgtgctgttgctggtataatgtctgatgctaacatacttatcaacacggctcgagttcaagctcaacgttacaccttcatgtaccaagagcccatgccggttgagcagctggttcaatctctttgtgacacaaaacaaggatacacacagtttggtggtcttcgcccgtttggtgtctcctttctctttgcaggatgggacaagcaccatggtttccagctttatatgagtgacccgagtgggaactatggtggttggaaagctgcagctgttggagcaaacaatcaggcggctcagtctatcctgaaacaagactacaaggacgatgcaaccagggaagaagcagtcgagcttgccttgaaggttctgaccaagacaatggacagcactagcttaacatctgagaagctagagcttgctgaagtgtatctgactccatccaagactgttaagtaccatgttcactcacctgagtcgctcaccaaactgttggtcaagcacggtgtgactcaacccgctgctgaaacatcttaa

SEQ ID NO: 3347 - protein, 250 aa, Arabidopsis thaliana (mouse-ear cress)
MSRRYDSRTTIFSPEGRLYQVEYAMEAIGNAGSAIGILSKDGVVLIGEKKVTSKLLQTSTSAEKMYKIDDHVACAVAGIMSDANILINTARVQAQRYTFMYQEPMPVEQLVQSLCDTKQGYTQFGGLRPFGVSFLFAGWDKHHGFQLYMSDPSGNYGGWKAAAVGANNQAAQSILKQDYKDDATREEAVELALKVLTKTMDSTSLTSEKLELAEVYLTPSKTVKYHVHSPESLTKLLVKHGVTQPAAETS

SEQ ID NO: 3348 - DNA, 1104 bp, Arabidopsis thaliana (mouse-ear cress)
  CDS (78)..(830)
cttgtcgcagaagttgggattcgtctttttataatttgccctgaaaacgaaaacgaaaataaaaagcggagagagagatggctagatacgatcgagcaattactgtcttctcccccgacggtcacctctttcaagtcgaatacgcccttgaagccgtccgcaagggtaacgccgccgtcggtgtccgcggtaccgacaccgttgtcctcgccgtcgagaagaagtccacccccaagcttcaggattctagatcagccagaaaaattgtgagccttgacaatcacattgccttggcatgcgcggggctcaaggctgatgcccgagtcttgattaacaaagcaaggatcgagtgtcaaagccacaggcttacacttgaggaccctgtcactgttgagtacatcactcgctacattgctggccttcaacagaagtatacccaaagtggtggtgtcagacccttcggtctttctactcttatcgttggctttgacccttactctcgcctcccttccctatatcagactgatccttctgggactttctctgcttggaaagctaatgctaccggcagaaactccaactctattagggaattcctcgagaagaactacaaagaatcctctggccaagaaactattaaactcgctatccgtgctctgcttgaggtagttgagagtggcggaaagaacattgaggttgccgtaatgacacgggaggaaactgggctgcgccagctagaagaagctgaaattgatgcaatcgtggccaagatcgaagctgaaaaggcggccgcagaagcagccaagaaaggccctccaaaggaaacttgataaaacaataactgtttctgtttctcaatctgaacttaccttcttcgctgcttctgtttctcaatcttgttttgactcgagccaactctttggcaaaagaagaacctgaccccatcgttttgttaacttgaaaatgctccaaaaaaaaactgaagaaagggtttaaaattcgcttgatcttgatcaaaccaaggataaatttgctgttgctcattgttagatagagaagtgactctccattttctatttataagtaagcagaacaattagtgtt

SEQ ID NO: 3349 - protein, 250 aa, Arabidopsis thaliana (mouse-ear cress)
MARYDRAITVFSPDGHLFQVEYALEAVRKGNAAVGVRGTDTVVLAVEKKSTPKLQDSRSARKIVSLDNHIALACAGLKADARVLINKARIECQSHRLTLEDPVTVEYITRYIAGLQQKYTQSGGVRPFGLSTLIVGFDPYSRLPSLYQTDPSGTFSAWKANATGRNSNSIREFLEKNYKESSGQETIKLAIRALLEVVESGGKNIEVAVMTREETGLRQLEEAEIDAIVAKIEAEKAAAEAAKKGPPKET

SEQ ID NO: 3350 - DNA, 1006 bp, Arabidopsis thaliana (mouse-ear cress)
  CDS (116)..(829)
agagcaaaagcttctgtttcttctccgattcgcagatcaattagctgggttttgattccgttgtgcgaaggactttaagaggttttgcagatcgaaatcggaagagaagaagaagatgtttctcactagaactgagtatgacagaggagtgaacactttttctccagaaggaaggctatttcaagtggaatatgccattgaagctatcaagcttggttctactgcaattggagtaaagacaaaagaaggagttgtgcttgctgtcgagaagcgtatcacgtcgccattgctggaaccgagcagtgtggagaagattatggaaattgatgaccatattggttgtgctatgagcggtttaattgctgacgcgcgcacacttgttgagcatgctagagttgaaactcaaaaccatagattctcgtatggtgagccgatgactgtagagtccacaacacaagcactgtgtgatctggctttacggtttggtgaaggagaggaagaatcaatgtctcggccgtttggagtatctcttctcattgctggccatgatgaaaatggaccaagcttgtactacactgatccttcaggaacattctggcagtgcaatgcaaaggcaattggttcaggttctgaaggagctgatagctctcttcaagagcaattcaacaaagatttgtctctacaagaagctgagactatcgctgtatctatcctaaagcaagttatggaagaaaaggtgactccaaataacgtggatattgccaaggtagcaccagcttatcatctctacactccacaagaagtcgaagcagtcatcgctcgtctttgattgaaaaaactcaatttgggtaatttacctatcagcttgtgtcacaaaacttgttacttttgtctgttagattgaggatcatgtcacattttagtcggttgtgtaagagaatcttttggctcccatgtcattcaataacctttcggatttgtgacttataaaatttcctttcctacc

SEQ ID NO: 3351 - protein, 237 aa, Arabidopsis thaliana (mouse-ear cress)
MFLTRTEYDRGVNTFSPEGRLFQVEYAIEAIKLGSTAIGVKTKEGVVLAVEKRITSPLLEPSSVEKIMEIDDHIGCAMSGLIADARTLVEHARVETQNHRFSYGEPMTVESTTQALCDLALRFGEGEEESMSRPFGVSLLIAGHDENGPSLYYTDPSGTFWQCNAKAIGSGSEGADSSLQEQFNKDLSLQEAETIAVSILKQVMEEKVTPNNVDIAKVAPAYHLYTPQEVEAVIARL

SEQ ID NO: 3352 - DNA, 1023 bp, Arabidopsis thaliana (mouse-ear cress)
  CDS (105)..(818)
gtctacgggagctaaaaaggaactgggaagagtttgtttcttcgattcgtagatcaattctcagctgacattgaggtttatctcagatcgaaatcgagaagaagatgtttctcactaggactgagtatgacagaggagtcaatacattttctcctgaaggtcgtctctttcaggttgagtatgccattgaagctatcaagcttggttctactgctattggtgtaaagacgaaagagggagttgttcttgcagtcgagaagcgtattacttcgcctttactggagccgagtagtgttgagaagattatggaaattgatgaccatataggttgtgctatgagtggtctgattgctgacgcgcgaacacttgttgagcatgcacgagtagagacccagaaccacaggttctcgtatggtgagccaatgactgtagaatctacaacacaagctttgtgtgatcttgctttacggtttggtgaaggagaggaagagtcaatgtctcgtccatttggagtatcccttctcattgctgggcatgatgaaaatggaccgagcctgtactacacagatccatcgggaacattctggcaatgcaatgcaaaggcaattgggtctggctcagaaggagctgatagttctctccaagagcaattcaacaaggatataactcttcaagaagctgaaacaatagctgtatctatcctaaagcaagtaatggaagaaaaggtgactccaaacaatgtcgacattgccaaagtcgcaccagcttatcacctctacactcctcaggaggttgaagccgtcatcagtcgtctatgaagaaataaaccgccattctcttcctgttatcttaccttgtctgttcggtaatttatcaggcttctgtctgcttccggttctctaaaccaaaaattagtttcgtttaatcagataatggattttatcgagttgagttttattgagctttctatctacatttttttgtcgttttcaacaagaagttaaaactaataaatatctgtcc

SEQ ID NO: 3353 - protein, 237 aa, Arabidopsis thaliana (mouse-ear cress)
MFLTRTEYDRGVNTFSPEGRLFQVEYAIEAIKLGSTAIGVKTKEGVVLAVEKRITSPLLEPSSVEKIMEIDDHIGCAMSGLIADARTLVEHARVETQNHRFSYGEPMTVESTTQALCDLALRFGEGEEESMSRPFGVSLLIAGHDENGPSLYYTDPSGTFWQCNAKAIGSGSEGADSSLQEQFNKDITLQEAETIAVSILKQVMEEKVTPNNVDIAKVAPAYHLYTPQEVEAVISRL

SEQ ID NO: 3354 - DNA, 1637 bp, Arabidopsis thaliana (mouse-ear cress)
  CDS (44)..(877)
aaacgaaaagcttttgaagaacagaggaacaagaagaagaaagatgttcaggaaccagtacgacacagatgtgacaacatggagtcccacaggtcgactattccaagtcgaatacgccatggaagctgtgaaacaaggctccgcagcaataggactcagatctcgctctcatgtcgtcctcgcttgtgtcaacaaagcacaatcagagctctcttctcatcaaaggaagatctttaaagtcgatgatcatattggtgttgctattgctggtctcactgctgatggtcgtgttctctctcgatatatgagatctgagtctattaatcactcttttacttatgagtctcctcttcctgttggtcgtcttgttgttcatcttgctgataaagctcaggtatgtacccaacgatcatggaaacggccttatggtgtgggtttgctggtaggtggattggacgagtcaggagctcacctctactacaactgccctagcggaaactactttgaatatcaagcattcgctatcgggtctcgttcacaagctgcgaaaacctatctggagcgcaaattcgagagcttccaagaatcatcaaaagaagatctgataaaagatgctattatggccataagggaaactttgcaaggggaaacactgaagagctcgctctgcactgtttctgttctaggagtcgatgaaccattccatttcttggaccaggaaagcattcaaaaggtgattgatacgtttgagaaggttcctgaggaagaggaagatgctggtgagggtgaggccgaacccgaagctgctcctggtgctgctggaactggtgaacaaggtggttcaggtgatcaagatgttgcaccaatggaaatttgagcaagagggaatgagttcaaagttggattttctaaccaattttcttgtgtgtagctctttgatatgttccaacttccaagtacaattgtggtttttattcggctttgtttatttaacagcttggaacaaggagttattgagtgccactagcttatgtttagtcctacttaagtcaaatctgtcacatgataataataatcggcgaatcgccaacctagagagtgtatcaaacagacaccattttgaatgagagaaacagcgagagaaagaatgaaagattaatccaactttgtttctctttctgcaaattgttcctcgaagaaatgacttcataatgcaaccatacattattgagcaaggatgataaatctcctgcttgctcggaagaaaagttaaaaccaaaataatatctctcttgaccttccagagaatcaatcctgtcttgaaatgatttcaacacacaaaaacaacctgagattggaattagaagtactgagtagacggaaccttggcgacgggtttaccacctggtaagacattgtcgggaagaatcaactccggtggagtttcacgggtaatcccaagcattgaatcgtaatcctcgtccttgcgtgcatacttcttcctaagcgctctctcaacctcgatctgctcaaatgactttgaattctctgaggcgtgaatctgtgcgagattgatgtaattctttgctgactgtgagatgtatactatctcttcatctgttaactttctcatgaac

SEQ ID NO: 3355 - protein, 277 aa, Arabidopsis thaliana (mouse-ear cress)
MFRNQYDTDVTTWSPTGRLFQVEYAMEAVKQGSAAIGLRSRSHVVLACVNKAQSELSSHQRKIFKVDDHIGVAIAGLTADGRVLSRYMRSESINHSFTYESPLPVGRLVVHLADKAQVCTQRSWKRPYGVGLLVGGLDESGAHLYYNCPSGNYFEYQAFAIGSRSQAAKTYLERKFESFQESSKEDLIKDAIMAIRETLQGETLKSSLCTVSVLGVDEPFHFLDQESIQKVIDTFEKVPEEEEDAGEGEAEPEAAPGAAGTGEQGGSGDQDVAPMEI

SEQ ID NO: 3356 - DNA, 1373 bp, Cryptosporidium parvum
  CDS (337)..(1116)
gtgcattctcaagattaattcacacaatatttcaaaatgaatcaaattagttaattttgtgttttattctacgtttctaattaactaatgtcctggtgttcaaaaaggtagtttaatgtttaggcaccagtctatacttattttaattagactttttattcattaattattaacccgcgaatattgccgccacccccctaagttttctaaaaatagaattgtactagaataggtttctagagtatttgatactttttctgttcactcttacaacaatttagtagttgtgaatacatcctttttattactttagtttttttaataagtatttcaataatgtatagaaaccaatatgatacggacgttgttacttggtctccacaaggaagagttttccagattgaatacgcaatggaagcagttaaacaaggcactgcagtagttggagcaagaaacgatgagatagttgttcttgcttgcataaaaagaagtacaagcaggctcgctgggtaccaaaagaaactatacaaaattgacaaccatattggcgtagcagtttcagggattactgcagacgctaaagtaatttgtaactaccttagatcagaatgtctaaactactcattcacatatgattcaccaataccattgaacactttggttaacaggcttgtattgaaatcccaggtaaatacacaagaatacggcagaaggccatttggcgtaggattgctcttggcaggatttgatgaaagcggcccgcatttatttgaaacatgcccttccgggaattgctttgaatattactcgattgcaatagggtcaagatctcaagctagcaaaacttatttggaaaaacattttaaagaatttgctaattgtagcaaggatcaattgattttacatactttaagagcattaagatcaagcttgtcatctgaacaagaaatgaatcaagaaaatgtggatgtggcaattttaggaagaaatgacatttataatgaattattagaagaagaaaaaataaaatatcttcaaattattaaccaagagcaaccgccaactatagaacaaattaatgaatctcaagaaacttcctctatgcaaatagactaatgattgattgctcgcttttacgttttttttgtagatttcaataattattgcctctgtataaagtatggtttctgtagttaacttttaagtacattaccaattaaataaatgcttttcttctatattaaaattttttctgcaaagatataatttaatattttaatttatcgctggatcattccgcacggaatgagttcttcaaattgttgtgccgggtaaatttttttttaaattggggcttacatgaaaaatttttg

SEQ ID NO: 3357 - protein, 259 aa, Cryptosporidium parvum
MYRNQYDTDVVTWSPQGRVFQIEYAMEAVKQGTAVVGARNDEIVVLACIKRSTSRLAGYQKKLYKIDNHIGVAVSGITADAKVICNYLRSECLNYSFTYDSPIPLNTLVNRLVLKSQVNTQEYGRRPFGVGLLLAGFDESGPHLFETCPSGNCFEYYSIAIGSRSQASKTYLEKHFKEFANCSKDQLILHTLRALRSSLSSEQEMNQENVDVAILGRNDIYNELLEEEKIKYLQIINQEQPPTIEQINESQETSSMQID

SEQ ID NO: 3358 - DNA, 1040 bp, Anopheles gambiae str
  CDS (93)..(821)
gttgagttcgccgccgccgtttgattactctggcaaatattgtagaaagttgttgcatttcagagagaattagcccaaatttgtctgcaaggatgttcctgacccgctccgagtacgatcgtggagtgaacaccttctcgcccgagggtcgtctgttccaggttgagtatgccatcgaggcgatcaaatttggctccaccgccatcggcatcagcactccggacggtgttgtgatggcggtcgagaaacgtatcacctcatcgctcattgaaccgtcgaagatggaaaagattgtggaagtggaccggcacatcggttgcgccacctccggactgatggccgattcgcgaacgctgctcgatcgggcacgtatcgagtgccagaaccattggtttgtgtataatgagcgaatgtcggtggaatcgtgcgcccaggcagtgtcgaacgtggccatccagttcggtgatggggatgatacggattcggccatgagccgaccgttcggtgtggcgatactgttcgccggcattgagaatggggagccgcagctctggcatatggatccgtccgggacgtacattcggttcgacgcgaaagcgattggatctggtagcgaaggtgcacagcaaaacttgcaggaatattatctgcccacaatgaccataaaggaagcgatcaatctggccctcagcacgctaaagcaggtgatggaagagaagctgaactcgacgaacgtggaagtcatgacgatgactccgaaggaactgttccgaatgttcagcaaggaggaggtggaggagtacattaacaacatgagctaaattaggggcggggtatcgttttgcagctcccttctctgcggcttctcttttcacgcaaccacattctaagtgatcatcatctcgtgtttttaaagcgtgaatgcctgggagttgtggcggagatggtgagttacagccggagagcatagcttgggtgtatcggttaacgtacgtttcacatcgcggttaaggggaagaacgaggacagccgttctcgtt

SEQ ID NO: 3359 - protein, 242 aa, Anopheles gambiae str
MFLTRSEYDRGVNTFSPEGRLFQVEYAIEAIKFGSTAIGISTPDGVVMAVEKRITSSLIEPSKMEKIVEVDRHIGCATSGLMADSRTLLDRARIECQNHWFVYNERMSVESCAQAVSNVAIQFGDGDDTDSAMSRPFGVAILFAGIENGEPQLWHMDPSGTYIRFDAKAIGSGSEGAQQNLQEYYLPTMTIKEAINLALSTLKQVMEEKLNSTNVEVMTMTPKELFRMFSKEEVEEYINNMS

SEQ ID NO: 3360 - DNA, 810 bp, Neurospora crassa
  CDS (1)..(810)
atggcgtccggatacgacagagctctttcagtcttcagtcccgatggacacgttttccaagtcgagtatgccggtgaagctgtcaagagaggtacctgcgcggtgggcgtaaagggcaaggatgtcgtcgtccttggttgcgaaaagaggtcggccatgaagctccaagacacaagaatcaccccctccaagattggcctggtcgacaagcacgtttgcctcgcctttgccgggctgaacgccgatgccagaatcttggtggacaaggctcgcctagaagcccagtcgcaccgtctcaaccttgaggaccccgtcacgattgagtacattacaaagtatgttgccggcgtgcagcagcggtatacacagagcggtggtgttcgtccttttggtattagcaccttgatcgtcggcttcgacaacggcagcgatgttcccagactctaccagaccgagccctcgggcatttactctgcatggaaagccaacgccatcggccggtcaagcaagacggttcgcgaattcctcgagcgcaactacaaggacgacatggaccgggaggctacgatccgcctgaccatcaagtccctactcgaagttgtgcaaacgggcgccaagaacattgagatcgccatcatggctcctggcaaggagctcgagatgctccctgtggaggacattgagaactacgtcaagaacattgagcaggagaagcaggaggaggcggacaagaagaagaagggccggactcctggtacgggcactgctgccatactgaccaggagccaggatgagccaggtgaccactaa

SEQ ID NO: 3361 - protein, 269 aa, Neurospora crassa
MASGYDRALSVFSPDGHVFQVEYAGEAVKRGTCAVGVKGKDVVVLGCEKRSAMKLQDTRITPSKIGLVDKHVCLAFAGLNADARILVDKARLEAQSHRLNLEDPVTIEYITKYVAGVQQRYTQSGGVRPFGISTLIVGFDNGSDVPRLYQTEPSGIYSAWKANAIGRSSKTVREFLERNYKDDMDREATIRLTIKSLLEVVQTGAKNIEIAIMAPGKELEMLPVEDIENYVKNIEQEKQEEADKKKKGRTPGTGTAAILTRSQDEPGDH

SEQ ID NO: 3362 - DNA, 765 bp, Neurospora crassa
  CDS (1)..(765)
atgtcgggcagcgctggctacgacaggcacattacaatcttctccgagcagggaagactgtaccaagttgaatatgccttcaaggccatcacagctgccaacatcatgtcgctcggcgtcagggggaaggactgcgccgtagttctgtcccagaagaaggttcccgataagctcatcgacccctcctccgtctcccacatcttccagatctcgccctcggttggctgcgtcatcaccggatccatcgccgatgcgcgcgccttcgcacaacgcgcccaaggagaggctgccgagttccgatacaagtttggctacgagatgccatgcgacgccttggcgaagcgcatcgccaacatcagccaggtctacactcagcgcgccttcatgcgcccatatggcgtcgccgtcaccctcatatcggtcgattcggagtttggcccccagctgttcaagtgcgatccggcaggctactacacaggctacaagggcaccgcggcgggtcccaagcagcaggaggccctcaaccacctggagaagaagctcaagaacaaggatcacgcgcccggtgattggaaggaggtggtggagttggccatcaccacgctcagcacggtgctaagcatggacttcaagaagaccgagatcgagattggtatcgtcggtggacccaggccggacggaaaggagggcacatatcccggcttcaggacgttgactgaagatgagattgacgagaggctacaagctattgccgaaaaggactaa

SEQ ID NO: 3363 - protein, 254 aa, Neurospora crassa
MSGSAGYDRHITIFSEQGRLYQVEYAFKAITAANIMSLGVRGKDCAVVLSQKKVPDKLIDPSSVSHIFQISPSVGCVITGSIADARAFAQRAQGEAAEFRYKFGYEMPCDALAKRIANISQVYTQRAFMRPYGVAVTLISVDSEFGPQLFKCDPAGYYTGYKGTAAGPKQQEALNHLEKKLKNKDHAPGDWKEVVELAITTLSTVLSMDFKKTEIEIGIVGGPRPDGKEGTYPGFRTLTEDEIDERLQAIAEKD

SEQ ID NO: 3364 - DNA, 756 bp, Neurospora crassa
  CDS (1)..(756)
atggcgagaagatacgattcccgaacaaccatcttctcccccgaaggtcgtctgtaccaggtcgaatatgctcttgaagccatttcccatgccggtaccgccatcggtatcctcgccaaggatggcatcgtcctagctgctgagcgcaaggtcacctccaagctcctcgagcaagacacatcggccgagaagctctacattctcaacgacaacatgatctgcgccgtcgccggcatgacagccgatgccaacatcctcatcaactacgcccgacaagccgcccaacgctatcttttgacctacaacgaggacatcccctgcgaacagctagtgcgccgtctctgcgatctcaagcaaggctacacacaacacggtggtctccgtccctttggtgtttccttcatctacgccggctgggatccccagcgccagttccagctctacctcagcaacccctcgggtaactacggcggctggaaggcgaccagtgcgggcgccaacaatgcgagcgcccagagcctgctgaagcaggattacaaggaggactgcacgctcaaggaggcatgcgccatggccgtcaaggtgttgagcaagaccatggactcgaccaagctgagcccggagaagatcgagtttgcgacggttggccagaccaaggacggcaagatctaccacaggctatggagcgcggacgagatcacggcgctattgaaggaacacgacttggcgaaggacgacaacacggaagacaagtaa

SEQ ID NO: 3365 - protein, 251 aa, Neurospora crassa
MARRYDSRTTIFSPEGRLYQVEYALEAISHAGTAIGILAKDGIVLAAERKVTSKLLEQDTSAEKLYILNDNMICAVAGMTADANILINYARQAAQRYLLTYNEDIPCEQLVRRLCDLKQGYTQHGGLRPFGVSFIYAGWDPQRQFQLYLSNPSGNYGGWKATSAGANNASAQSLLKQDYKEDCTLKEACAMAVKVLSKTMDSTKLSPEKIEFATVGQTKDGKIYHRLWSADEITALLKEHDLAKDDNTEDK

SEQ ID NO: 3366 - DNA, 738 bp, Neurospora crassa
  CDS (1)..(738)
atgtttatggcaagatctgaatacgatcggggcatcaacaccttctcccccgaaggccgcctcttccaagtcgagtactccctcgaggccatcaagctcggctccaccgccatcggcgtcgccacctcggagggcgtcattctcggcgtcgagaagcgcgtgacctcgaccctgctcgagacctcgtcggtcgagaagattgtcgagatcgaccgccacatcgggaccgccatgtccgggctgcaggccgatgcgcgctccatgatcgagcacgcccgcgtcgagtgccagagccacgccttcaactacaacgagaagctgcgcgtcgagagctgcacgcaggccatctgcgacctggccctgcgcttcggcgagagcgccgacggcgaggagagcatcatgtcccgcccctttggcgtggcgctgctgattgccggctacgatgaggacggcccgagtctgtaccatgccgagccgtcgggaacgttttatcgctatgatgcaaaggcaattggaagcggtagcgagggcgcgcaggccgagttgcagaatgagtaccacaagtccctcaccctcgaagacgccgagacgctcgtcctcaagacgctcaagcaggtcatggaggagaagctcgatgccaagaacgtgcagctggcgagcgtcaccaaggacaagggcttcaggatatacacagacgaggaaatggccgctgttgttgcgcggttgcccgccaactaa

SEQ ID NO: 3367 - protein, 245 aa, Neurospora crassa
MFMARSEYDRGINTFSPEGRLFQVEYSLEAIKLGSTAIGVATSEGVILGVEKRVTSTLLETSSVEKIVEIDRHIGTAMSGLQADARSMIEHARVECQSHAFNYNEKLRVESCTQAICDLALRFGESADGEESIMSRPFGVALLIAGYDEDGPSLYHAEPSGTFYRYDAKAIGSGSEGAQAELQNEYHKSLTLEDAETLVLKTLKQVMEEKLDAKNVQLASVTKDKGFRIYTDEEMAAVVARLPAN

SEQ ID NO: 3368 - DNA, 825 bp, Neurospora crassa
  CDS (1)..(825)
atggcggacagatactccttctcccttactacgttctcgcccagcggcaagctggtccagatcgctctcggcatcaaggccaccaacggtatcgtcctcgccaccgaaaagaagtcctcctcacccctcgccgacccctcctccctctccaagatcagcctcatcacgcccaacattggcatggtctacagcggcatgggccccgactaccgcgtgcttgtcgaccgcgcgcgcaaggtttcgcacacgggttacaagcgcatctacaacgagtacccgccgacgcggatattggtgcaagacgttgcgcgcgtcatgcaagaggccacgcagtccggaggtgtccgcccctatggtgtctcgctgctgatcgccggctgggacgagggtattttgcccgaggacgagctggaggagcaaaagagcaaggacgagatggtggctgacgatggcgagaccaagaagaaggcgacgggcaagacgggcggcatcctgaagggcggccccatgctgtaccaggtcgacccctcgggcagttatttcccttggaaggcgacggccattggcaagaacgccacgacggccaagacctttttggagaagaggtataccgagggcttggagctcgaggatgcggtgcacattgcgctgttgacgctgaaggagacgattgagggagagatgaacggtgacaccattgaaattggcatcgtcggaccaccggcggaccacctccttggcgtcgagggtgtcgagggagcaaagggcccccgcttcaggaaactctctcctcaggagatcgaggattacctgacgaacctatga

SEQ ID NO: 3369 - protein, 274 aa, Neurospora crassa
MADRYSFSLTTFSPSGKLVQIALGIKATNGIVLATEKKSSSPLADPSSLSKISLITPNIGMVYSGMGPDYRVLVDRARKVSHTGYKRIYNEYPPTRILVQDVARVMQEATQSGGVRPYGVSLLIAGWDEGILPEDELEEQKSKDEMVADDGETKKKATGKTGGILKGGPMLYQVDPSGSYFPWKATAIGKNATTAKTFLEKRYTEGLELEDAVHIALLTLKETIEGEMNGDTIEIGIVGPPADHLLGVEGVEGAKGPRFRKLSPQEIEDYLTNL

SEQ ID NO: 3370 - DNA, 894 bp, Neurospora crassa
  CDS (1)..(894)
atgacttccataggaacaggctacgatcttgccaactccattttctcccccgatggtcgcaactttcaagtcgaatatgccatgaaggcagttgagaatggcagcacctcgatcggcatccgctgcaaggacggcatcgtgttggcggcggagaaggttatcacatccaagctgctcaagcaaggcgccaacaagcgcattgcgacagtcgacaggcatttgggcattgtatactccggcatgatccccgacggtaggcacttcgtggaccgcgcccgcgacgaggcgcgcggctggcgcgacaactacaagacgcccatctcgacaaaagacctagccggccgcatgggcggttacatgcaagcctacacgctctaccaatctgtgcgacctttcggcatcacggccatcatcggcggctacgacagcgaactcgatacgcccgtggaaggcgaggtcggcagcggccccagcgtcggcgccggcggcaaggtggagggcaagaagcacggtggtccgttcctgtacatggtggagccctcgggcctctactggggatactacggcgccgcgacgggcaagggcaggcaagcggccaaggcggagctcgagaagctggacctcagtagcgacggcgagtcgagtctgacgctggagcaggccgtcaaggaggcagcgcgcatcatctacgttgcccacgacgacaacaaggacaaggagttcgagctcgagatgacctggatcagcggggcggacggtcccacgaagggccgtcaccaagaggtgcccgaggctttgcggaaggaggcggagaagtatgcggagcgcatgactgcgaaggacatcgaggaggaagaggaaacgaaagagggcggggacaagatggaggagtaa

SEQ ID NO: 3371 - protein, 297 aa, Neurospora crassa
MTSIGTGYDLANSIFSPDGRNFQVEYAMKAVENGSTSIGIRCKDGIVLAAEKVITSKLLKQGANKRIATVDRHLGIVYSGMIPDGRHFVDRARDEARGWRDNYKTPISTKDLAGRMGGYMQAYTLYQSVRPFGITAIIGGYDSELDTPVEGEVGSGPSVGAGGKVEGKKHGGPFLYMVEPSGLYWGYYGAATGKGRQAAKAELEKLDLSSDGESSLTLEQAVKEAARIIYVAHDDNKDKEFELEMTWISGADGPTKGRHQEVPEALRKEAEKYAERMTAKDIEEEEETKEGGDKMEE

SEQ ID NO: 3372 - DNA, 998 bp, Brachydanio rerio
  CDS (67)..(807)
ccggtgtacgttagagcgcagtgtttagatctgtttacaaacttttagcattaaatctctgttataatgtcccggggctcgagcgcggggtttgaccgacacatcaccatcttttctccggaggggagactctatcaagtcgaatatgctttcaaggccattaatcagggaggtctgacgtcagtagctgttcgagggaaagactgtgcagttgttattacccaaaggaaagttcctgataagcttctggattcgtccactgtcactcatttattcagaataacagagaacattggctgcgtgatgtctggcatgacagctgacagcaggtcgcaggtgcagagagcgcgatatgaagccgctaactggaagtacaaatatggttatgagatcccggtggacatgctgtgcaagcgcatcgcagacatctctcaggtgtacacgcagaatgcagagatgaggccgcttggatgctgtatgatcgtggttggtgtggacgaggagctcgggccgcaggtctacaaatgcgatcctgccggttattactgcggttttaaagccactgctgcgggagtcaaacaaacagaggccaccagctttctggagaagaagatcaagaagaaactggactggacctttgaccaaacagtggagactgccatcagctgcttgtctacagttctggccatcgacttcaagccatccgagctggagatcggcgtcgtgaccacagaagagcccaagttcagaattttgtccgagtctgagatcgacactcatctgatggctctgactgaacgagattgagaactgcatgagtgtttatcctgtgacagagaaaaacatctgagaactacagtctgtcaacattcaggtcatctgatcatttattgctgtttatgtagcttttttcttgcaacagtacaataaaattaacgttttggaaaaaaaaaaaaaaaaaaaaaaaaaaaaaaaaaaaaaaaaaaaaaaaaaaaaaa

SEQ ID NO: 3373 - protein, 246 aa, Brachydanio rerio
MSRGSSAGFDRHITIFSPEGRLYQVEYAFKAINQGGLTSVAVRGKDCAVVITQRKVPDKLLDSSTVTHLFRITENIGCVMSGMTADSRSQVQRARYEAANWKYKYGYEIPVDMLCKRIADISQVYTQNAEMRPLGCCMIVVGVDEELGPQVYKCDPAGYYCGFKATAAGVKQTEATSFLEKKIKKKLDWTFDQTVETAISCLSTVLAIDFKPSELEIGVVTTEEPKFRILSESEIDTHLMALTERD

SEQ ID NO: 3374 - DNA, 998 bp, Brachydanio rerio
  CDS (87)..(872)
agtgagtttcttcagcggagtcggagccgcaacagtgaacaggcattgctatcccaggctttaggatttattttatttagggcactatgtctcggagatatgattcaagaacaaccatcttttccccagaggggcgtctgtatcaggtagaatatgccatggaggccatcgggcacgctggcacctgtctgggcatcttggccaatgacggtgtgctgctggctgctgagcgaaggaacatccacaaactgctggacgaagttttcttctccgagaagatttacaaactcaacgaagacatggcctgcagtgtcgcaggaatcacatcagatgcaaacgtcctcacgaacgagctgagactaatcgcacagaggtacctgctgcagtatcaggagcccattccctgtgagcagctggtgacggctctgtgtgacattaaacaggcctacacgcagtttggaggtaagaggcctttcggtgtgtctctgctgtatatgggatgggacaaacactacggtttccagctctatcagagtgaccccagcggaaactacggaggctggaaagccacgtgcatcggcaacaacagcgcagctgctgtgtcaatgctgaagcaggactataaagagggagagatgactctgtctgcggccctcgctctcgccgtcaaagtgctaaacaagactatggacgtcagcaagctctcggcagagaaagttgagatcgctacactgacacgagagaacggcaagaccaaaatcaaagtcctcaagcagaaagaagtggaagagctcatcaagaaacacgaagcggaagaagccaaagctgagaaggacaagaaagagaaagaacagaaggagaaagacaaataaaacgcctgcacttgttttctactgaaatgcaaacgcccgctgggattcgtaaaaaagttcatattgctctgtctgtccatctgtcgatttctttattaaacacaaaatgaaaaaaaaaaaaaaaaa

SEQ ID NO: 3375 - protein, 261 aa, Brachydanio rerio
MSRRYDSRTTIFSPEGRLYQVEYAMEAIGHAGTCLGILANDGVLLAAERRNIHKLLDEVFFSEKIYKLNEDMACSVAGITSDANVLTNELRLIAQRYLLQYQEPIPCEQLVTALCDIKQAYTQFGGKRPFGVSLLYMGWDKHYGFQLYQSDPSGNYGGWKATCIGNNSAAAVSMLKQDYKEGEMTLSAALALAVKVLNKTMDVSKLSAEKVEIATLTRENGKTKIKVLKQKEVEELIKKHEAEEAKAEKDKKEKEQKEKDK

SEQ ID NO: 3376 - DNA, 858 bp, Dictyostelium discoideum
  CDS (32)..(784)
aataatataatatatatataaatacataataatgtcaagtgcaagatacgatagagcaattacagttttctcaccagatggtcatctttttcaagtagaatatgccatggaagcagtaagaaaaggtactgttgcagttggtgtacgtggtaaagatgttattgttttaggtgttgaaaagaaagcaaccgctaaacttcaagatgcaagatcaattagaaaaatcgttaaattagatgaccacatttgtttaacctttgctggtttaactgccgattcacgtgtattaattagtaaagcattaatggaatgtcaatcctatagattaactgttgaagattcaccatcagttgaatatatttctaaatttattgctggtattcaacaacgttatactcaaagtggtggtgttagaccatttggtatttcaacattaattgttggttttgatacagatggtacaccaaatctttatcaaactgatccatctggatcctatagttcatggaaagccgctgcaattggtcgtagttcaaagagtgttggtgaatttttagaaaagaattatacagacgttagtgaagaggaatcaattaaattagcagttagagctttattagagattgttgaaagtggaaataaaaatattgaaattgcagtcattagaaataaacaaccaatcgttttattagatgaacaagaaattgataaattagttgctgtcgttgaagctgaaaaagaaattcaaaaagaacaagaaaaatctgaaaaacaacaaaaataaattacatcaaattcctttttttccccacctttttttttaattatcttcaagtttttttaaaaaaaaaaaaaaaa

SEQ ID NO: 3377 - protein, 250 aa, Dictyostelium discoideum
MSSARYDRAITVFSPDGHLFQVEYAMEAVRKGTVAVGVRGKDVIVLGVEKKATAKLQDARSIRKIVKLDDHICLTFAGLTADSRVLISKALMECQSYRLTVEDSPSVEYISKFIAGIQQRYTQSGGVRPFGISTLIVGFDTDGTPNLYQTDPSGSYSSWKAAAIGRSSKSVGEFLEKNYTDVSEEESIKLAVRALLEIVESGNKNIEIAVIRNKQPIVLLDEQEIDKLVAVVEAEKEIQKEQEKSEKQQK

SEQ ID NO: 3378 - DNA, 798 bp, Neurospora crassa
  CDS (1)..(798)
atgttcaggaacaactacgacaacgactcggtcacattctctccgcaagggcgaattttccaggtcgaatatgcggcggaagcagtaaagcagggttcggtggtggtgggaattgctagcaagacacacgccgtcctggtagcgatcaagcgtaacgccgaagaactctcatcgtaccaaaagaagctctttcccatcgacgaacatgtcggcatcgccatcgccggcctcacctcggacgcgcgcgtcctctccaacttcatgaagcagcagtccctcggccaccgcctcacgtacggccgcaacatgcccgtgcggacccttgtcgacatgatcggatccaaggcgcagatcaacacgcaacactacggtaagcggccctacggtgtcggtctcctggtcgccggcgttgacgaccacggcccgcaccttttcgagttccagcccagcggcatgaccgaggagatggtggcctttgccattggcgcccgcagccagatggcgcgcacatatttggagaagaacctagaggcctttgccgactgcggccgcgaggagctgattcgtcatggtctcaaggcgctcaaggagagcctggtgcaagaccgcgagttgaccatcgacaataccagcgtcgccattgtgggtgtcgagaagcaggaggacggcacgaccaagccgcagccattcatggtgtacgatggacaagacgtcagcgcatggatagagagtgtggcggataaccaagaggctgccccggcagctgccgagggcgagggtatggatgtcgatagctaa

SEQ ID NO: 3379 - protein, 265 aa, Neurospora crassa
MFRNNYDNDSVTFSPQGRIFQVEYAAEAVKQGSVVVGIASKTHAVLVAIKRNAEELSSYQKKLFPIDEHVGIAIAGLTSDARVLSNFMKQQSLGHRLTYGRNMPVRTLVDMIGSKAQINTQHYGKRPYGVGLLVAGVDDHGPHLFEFQPSGMTEEMVAFAIGARSQMARTYLEKNLEAFADCGREELIRHGLKALKESLVQDRELTIDNTSVAIVGVEKQEDGTTKPQPFMVYDGQDVSAWIESVADNQEAAPAAAEGEGMDVDS

SEQ ID NO: 3380 - DNA, 1165 bp, Mus musculus
  CDS (84)..(872)
ggtttctttgacgatcaccgaaccgtatttggggccgtgttcctgtgtccgctgctgggtcaggttgtcgctgcgccggagctatgtttcgaaaccagtatgacaatgatgtcactgtttggagccctcagggcaggattcatcaaattgaatatgcaatggaagctgttaagcaaggttcagcaacagttggtcaaaatcaaaacgcacgcagtgtggttgcactgaagagagcacagtcagagcttgccgctcaccagaagaaaattctccatgttgacaaccatattggtatctcaattgcgggtctaactgctgatgccagactgttatgcaactttatgcgccaggagtgtttggattccagatttgtgtttgacagaccacttcctgtgtctcgtcttgtgtctctaattggaagcaaaacccagatcccaacacagcgatatggccggaggccgtatggtgttgggctgctcattgctggttatgatgatatgggccctcatattttccaaacctgtccatctgctaactattttgactgcagagctatgtctattggagcccgttctcaatcagctcgtacttacctggagagacatatgtctgaatttatggagtgcaatttggatgaactggttaaacatggtctgcgtgccttaagagaaacactccctgcagagcaggacctgaccacaaagaatgtttccattggaatcgttggtaaagacttggaatttacaatctacgatgatgatgatgtatctccattcctggatggtcttgaagaaagaccacagagaaaagcacagccttcacaggctgctgaggaacctgcagaaaaagccgatgaaccaatggaacattaagtgataaaggttacaaggacataagaatgcagggacatacactggcgacaataatctgtattttaaaccaacagctgcagtgtattgggtggtatgttttagaaatcagtccagatgtaagttttctctaagcaacttcacagaaaccatataatggggtgcattttctttgaaagggtatacataatcattttctaggaagtataggtatctataccaatgtttttatactgaagaaaataagtgtctttgcagttttaaagacaactgtgaaataaaattgtttcaccacc

SEQ ID NO: 3381 - protein, 262 aa, Mus musculus
MFRNQYDNDVTVWSPQGRIHQIEYAMEAVKQGSATVGQNQNARSVVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLDELVKHGLRALRETLPAEQDLTTKNVSIGIVGKDLEFTIYDDDDVSPFLDGLEERPQRKAQPSQAAEEPAEKADEPMEH

SEQ ID NO: 3382 - DNA, 1097 bp, Nicotiana benthamiana
  CDS (64)..(888)
agtgtgtgattccaaactccaaaaacgacatcgttttataatccctaacatttgacaaacagaatgttcagaaaccagtacgataccgacgtgacgacatggtcaccggcggggaggctatttcaagtagagtacgcaatggaggcagtgaagcaaggttcagcggcaataggtttgagatcgaagacgcacgtgattctcgcgtgcgttaataaggcgaattctgagttatcctctcaccagaagaagatcttcaaagttgatgaccacatcggagttgcaatcgccggacttactgccgacggccgtgtactttctcgttatatgcgtaatgagtgcattaattatagttacgcttatgagtcgccgttgcctgtaggccgccttgttgttcagctcgctgataaagctcaggtctgcactcaacgatcctggaaacggccttatggtgttggcctgcttgttggtgggctggatgagtctggtgctcacctttattacaattgccctagtggtaactacttcgagtatcaagcttttgccattggatctcggtcacaagctgccaaaacctacttggaacgtaggtttgagactttcatggattcttcacgggaaaccctgcttaaggacgcactctttgcactgagagaaactttgcaaggagaaaaactaacaagcaccaattgcacggtcgcagtggtaggagtaggagaggctttccatatgttggacaaggaaactatacaagcattgatcaatgaatttgagatagctggtgaagaagctcctgctgcagccccagatgaagctggtagtgatgaaccagcagcagcacctgaagagggtgcacctgctgatcagggagctgccccgatggatatttgatgatgttatgtcctcctttaggcctcacttctttcatattcagagatttcttcttgatattgcgattttgtgtggcacattgggtaatattttctgcttggatgttttattacgcaatcttgctttactttggtccaatcatgcttctgaagttgaactataaacagtttaaatgactttgttgggttaaaaaaaaaaaaaaaaaaaaa

SEQ ID NO: 3383 - protein, 274 aa, Nicotiana benthamiana
MFRNQYDTDVTTWSPAGRLFQVEYAMEAVKQGSAAIGLRSKTHVILACVNKANSELSSHQKKIFKVDDHIGVAIAGLTADGRVLSRYMRNECINYSYAYESPLPVGRLVVQLADKAQVCTQRSWKRPYGVGLLVGGLDESGAHLYYNCPSGNYFEYQAFAIGSRSQAAKTYLERRFETFMDSSRETLLKDALFALRETLQGEKLTSTNCTVAVVGVGEAFHMLDKETIQALINEFEIAGEEAPAAAPDEAGSDEPAAAPEEGAPADQGAAPMDI

SEQ ID NO: 3384 - DNA, 911 bp, Phytophthora infestans
  CDS (29)..(781)
gatacggcaaagatcactaagaagcacaatgtcgagacgctacgacggccgcacgaccaccttctccccggaaggccgactcttccaggtggaatacgccatggaggccatcaacaacgccggatcggccgtcggaatccttgccaaggacggcatcgtgattgcagctgagaagaagacggtgtcaaagctattaacccccagcaagacaagcgagaagaccatcaagctggacgaccacctcatttgcgccgtggccggtctgacggctgatgctaatatcttggtcaactacgcgcgtttgtcggcgcagcgctatgaacttgcgtaccaagagaaggagccgtgcgagcagctcgtgcagacgctttgtaactacaagcaggcgtacacacagttcggtggtcagcgtcccttcggcgtgtccttcctgtacgctggctgggaccgtcaccacggcttccagctataccacagtgacccgagcggaaactacggcggctggaaggccaccgccatcggtgccaacaaccgtgcagctaagagcatgctcaagagcgactacgaggagggcatgacggtggaagaggctctggctttctcggtcaaggttatgaacaagaccatggactccacctcccccagtgcagagaagcttgagttcacgacggtcacgcggaacgcggacggcaagattgtgcaccgccaactcaccgagagcgagacggatgagctgttgaagaaggcggctgcagacacggcctcatcgggcgacatgtaatccaaatgagcggtgataaatgtgcacggtgtcgtagcttttgatcagcagacaagtctacagcattcgtgcttttaccaactaatggaaaaaggatcaaaaaaaaaaaaaaaaaaaaaaaaaaaaaaaa

SEQ ID NO: 3385 - protein, 250 aa, Phytophthora infestans
MSRRYDGRTTTFSPEGRLFQVEYAMEAINNAGSAVGILAKDGIVIAAEKKTVSKLLTPSKTSEKTIKLDDHLICAVAGLTADANILVNYARLSAQRYELAYQEKEPCEQLVQTLCNYKQAYTQFGGQRPFGVSFLYAGWDRHHGFQLYHSDPSGNYGGWKATAIGANNRAAKSMLKSDYEEGMTVEEALAFSVKVMNKTMDSTSPSAEKLEFTTVTRNADGKIVHRQLTESETDELLKKAAADTASSGDM

SEQ ID NO: 3386 - DNA, 708 bp, Plasmodium falciparum
  CDS (1)..(708)
atggcagatggtgaatatagtttttctttaacaacttttagtccaacaggaaaattagtacaaattgaatatgctcttaatagagtatctagcagttcgccagctttaggtattagagccaagaatggtgtgataattgctaccgaaaagaaaagtccaaatgaattaatagaagaaaatagcatattcaaaatacaacaaataagtgaacatataggtattgtatatgcaggaatgcctggagatttccgtgtattattaaaaagggcaagaaaagaagccataagatattctttacaatatggaagtgaaatattagtaaaagaattagtaaaaataattgcatcaatagttcaagaatttacacaaacaggtggggtaagaccatttggtttatctttattaatatgtggggttgatgtatatggataccatttatatcaaatcgatccatctggatgttattttaattggatggctacatgtgtaggaaaagattatcaaaacaatatgtcctttttagaaaaaagatataataaagacatcgaaatagaagatgcaattcatacagctattttaactttaaaagaaagttatgaaggagtattgaatgaaaaaaatattgaaattggtgtagcctatgataataaaccattcaagattttaacacaaaatgaaattaaagattatttaatagaaatagaataa

SEQ ID NO: 3387 - protein, 235 aa, Plasmodium falciparum
MADGEYSFSLTTFSPTGKLVQIEYALNRVSSSSPALGIRAKNGVIIATEKKSPNELIEENSIFKIQQISEHIGIVYAGMPGDFRVLLKRARKEAIRYSLQYGSEILVKELVKIIASIVQEFTQTGGVRPFGLSLLICGVDVYGYHLYQIDPSGCYFNWMATCVGKDYQNNMSFLEKRYNKDIEIEDAIHTAILTLKESYEGVLNEKNIEIGVAYDNKPFKILTQNEIKDYLIEIE

SEQ ID NO: 3388 - DNA, 741 bp, Plasmodium falciparum
  CDS (1)..(741)
atggcaagaagatatgatagtagaacaactaccttttctccagaaggaaggttatatcaagtagaatatgctttggaagccataaataatgcaagtataacaattggtttaataacaaaggatggagtaatattaggagcggataaagtttttatttcaaaattaattgataaagctaataattatgaaaaaatatataaaattgataaacacatattttgtggtgtagcaggattgaatgctgacgcaaatattttaataaaccaatctagattatatgcacaaagatatttatataattataatgaagtacaaccagtatcacaattagtagttcaaatatgtgatatcaagcaaagttacacacaatatggtggattaagaccatatggtgttagctttttaattggtggttatgatacaaaagatggataccaactttatcatactgatccaagtggaaattattcaggatggtttgcaacagctattggtaccaataacttaacagctagttctgtacttaaacaggaatggaaaaatgacatgactttggaagaaggtttgttattagctttaaaaacactagcaaaaagtactgatacggaaattcccaaaagtgaaaaaatcgaattagcatatttaacaaataaagatggggaagtatatcaaaagtatttaacggaaaaggaaatagaagagttaattaaattgtatacacagaagtatattaaagaataa

SEQ ID NO: 3389 - protein, 246 aa, Plasmodium falciparum
MARRYDSRTTTFSPEGRLYQVEYALEAINNASITIGLITKDGVILGADKVFISKLIDKANNYEKIYKIDKHIFCGVAGLNADANILINQSRLYAQRYLYNYNEVQPVSQLVVQICDIKQSYTQYGGLRPYGVSFLIGGYDTKDGYQLYHTDPSGNYSGWFATAIGTNNLTASSVLKQEWKNDMTLEEGLLLALKTLAKSTDTEIPKSEKIELAYLTNKDGEVYQKYLTEKEIEELIKLYTQKYIKE

SEQ ID NO: 3390 - DNA, 1314 bp, Homo sapiens
  CDS (115)..(867)
gaggcgcgtgtggaagcgcttccgggcggtagcacgctgtgttggcggcggctccccgcttgcctcagctgcagcagcgggaagctcggtggcaagcccttgtagtcctgtgcgatggcgtctcgatatgacagggcgatcactgtcttctccccagacggacacctttttcaagttgaatatgcccaggaagcggtgaagaaaggatccaccgcggtcggaattcgaggtaccaatatagttgttcttggggtagaaaaaaaatctgttgccaagcttcaagatgaaagaactgtgaggaaaatttgtgcccttgatgaccatgtctgcatggcttttgcaggacttactgctgatgctagagtagtaataaacagagcccgtgtggagtgccagagccataagcttacggttgaggacccagtcactgtagaatacataactcgcttcatagcaactttaaagcagaaatatacccaaagcaatggacgaagaccttttggtatttctgccttaattgtaggttttgatgatgatggtatctcaagattgtatcagacagatccttctggtacttatcatgcttggaaggcaaatgcaataggccgaagtgctaaaactgttcgagaatttctagaaaagaattacacagaagatgccatagcaagtgacagtgaagctatcaagttagcaataaaagctttgctagaagttgtccagtctggtggaaaaaacattgaacttgctataataagaagaaatcaacctttgaagatgtttagtgcaaaagaagttgaattatatgtaactgaaatagaaaaggaaaaggaagaagcagagaagaaaaaatcaaagaaatctgtctaattcttaggatgaccactgggaggtcttaatgttttgttttattgtactgcctgaggttgtttagtgaaattttagaggaaaacagttattttgcagcattacatgcagtacttgtgtgatgttttgagaatgccagatctgtggctgtcttcattctattacatagtcaaacataggtttatgtgaagattttctttgaaaggggatttcagtaattgttgagagcagtcataattccacataagcctgagactctataatttgtccagtgtcttacttaccttcatatatgcaaatataattttaaaaaattttttaattaaaaaaatttaataatttggtgatgtttgaatattgactgtcagttaaggacatagctattccaaataaactaaatataatattgagctgcaaaaaaaaaaaaaaaaaaaagaaaaaaaaaaaaaa

SEQ ID NO: 3391 - protein, 250 aa, Homo sapiens
MASRYDRAITVFSPDGHLFQVEYAQEAVKKGSTAVGIRGTNIVVLGVEKKSVAKLQDERTVRKICALDDHVCMAFAGLTADARVVINRARVECQSHKLTVEDPVTVEYITRFIATLKQKYTQSNGRRPFGISALIVGFDDDGISRLYQTDPSGTYHAWKANAIGRSAKTVREFLEKNYTEDAIASDSEAIKLAIKALLEVVQSGGKNIELAIIRRNQPLKMFSAKEVELYVTEIEKEKEEAEKKKSKKSV

SEQ ID NO: 3392 - DNA, 1070 bp, Arabidopsis thaliana
  CDS (82)..(918)
gaaaagttttgtttctgaactttcgtctctataaaccctttcgacgacgagtgaagaagaaagcgagacgaagaagcaaagatgttcagaaaccaatacgacacagatgttacgacatggagtccaacaggtcgtttattccaagtggaatacgccatggaagcagtgaagcaaggatctgcagcaattggactcagatctcgttctcatgtcgttctcgcttgtgttaacaaagctcaatcggagctttcttcgcatcagaggaagatctttaaagtcgatgaccatatcggtgttgcaatcgctggtctcacagccgacggtcgtgtattgtctcggtatatgagatcggaatcgattaatcactcttttacttatgagtctcctcttcctgttggtcgtctcgttgttcatcttgctgataaagctcaggtctgtacccaacgatcatggaaacgaccctatggtgttggtttgctggtaggtggattggatgagtctggagcccacctttactacaactgtcccagcggaaactactttgagtaccaagcttttgctattggatcccgttcccaagcagcaaagacctatctggaacgcaggtttgagagctttggggattcttctagagaagatctgatcaaagatgctattttggctgttagggagacattgcaaggggaaacactgaagagttctctctgcacagttgctattctaggagtcgatgaaccgttccacttcctggaccaggaagcaatacagaaagtgatcgacacatttgagaaagtgccagaggaagaggaagcagaaggcgaggctggtgagggtgaggccgaagctgccggggctgcaccagcagaacaaggtggtggtggtgcaggtgaccaagacgtggctccaatggaaatgtaaggcttgtgtgtgtaacgctggatggaactattttatttcgatgttagttggatttttactttgcaaaatggctgcgggtttagattatatgcttgagaagttgaaaccatttcgtcattttaactcaatagctgccatcaagactttctctc

SEQ ID NO: 3393 - protein, 278 aa, Arabidopsis thaliana
MFRNQYDTDVTTWSPTGRLFQVEYAMEAVKQGSAAIGLRSRSHVVLACVNKAQSELSSHQRKIFKVDDHIGVAIAGLTADGRVLSRYMRSESINHSFTYESPLPVGRLVVHLADKAQVCTQRSWKRPYGVGLLVGGLDESGAHLYYNCPSGNYFEYQAFAIGSRSQAAKTYLERRFESFGDSSREDLIKDAILAVRETLQGETLKSSLCTVAILGVDEPFHFLDQEAIQKVIDTFEKVPEEEEAEGEAGEGEAEAAGAAPAEQGGGGAGDQDVAPMEM

SEQ ID NO: 3394 - DNA, 929 bp, Drosophila melanogaster
  CDS (118)..(825)
cctttgttttgtccaccactagccaagtaaaagccgtcaaatcatcgtcgcattcgacccaaggaattaaactaatttttgcgtttgaattgtttaaattttcacaaagtcttcgctatgagtactattggcactggatacgacttgtcggcctcgcagttttcgcctgatggccgcgttttccagatcgactacgcctcaaaggcggtggagaagagcggcaccgtaatcgggattcggggcaaggacgccgtggtgctggccgtggagaagatcatcaccagtaaactgtacgaaccagacgccggcggacgcatcttcaccatcgaaaagaacatcggaatggcggtggccggcttggtggccgatggaaactttgtggctgacattgcgcgtcaggaggcagccaactacagacagcaatttgagcaggctatcccgcttaaacacctgtgccaccgagtcgccggctacgttcacgcctacactctgtacagtgccgtccgccccttcggactttccatcattctcgcctccttcggttacttcgcctgcgccagcggcaaggccaagcagctggccaagactgagatggagaagctcaagatggatatgaggaccgacgaattggtggagagcgctggtgaaatcatctacaaagtccatgacgagttgaaggacaaggacttccgcttcgaaatgggtttggtgggcagggtaaccggtggcctacatctcataaatccctcagaactgacggagaaggcgaggaaagccggcgatgcggccaacaaggacgaagacagcgacaatgagacgcactagttcgtttgtgtgccagtgaatctaattctgggcctcatacataatgttaattttatatttccctaaagcgcaaaatgaataaacaaaatcgggtgaaatttaag

SEQ ID NO: 3395 - protein, 235 aa, Drosophila melanogaster
MSTIGTGYDLSASQFSPDGRVFQIDYASKAVEKSGTVIGIRGKDAVVLAVEKIITSKLYEPDAGGRIFTIEKNIGMAVAGLVADGNFVADIARQEAANYRQQFEQAIPLKHLCHRVAGYVHAYTLYSAVRPFGLSIILASFGYFACASGKAKQLAKTEMEKLKMDMRTDELVESAGEIIYKVHDELKDKDFRFEMGLVGRVTGGLHLINPSELTEKARKAGDAANKDEDSDNETH

SEQ ID NO: 3396 - DNA, 1008 bp, Arabidopsis thaliana
  CDS (50)..(790)
atatacacatctctgattcaactccaccgaattcagaagatcgaagaagatgagtagaggaagcggcgctggttatgatcgtcacatcactatcttctcaccggaaggtcgtctctttcaagttgaatatgccttcaaggccgtgaaaacagctggtattacttcaatcggagttcgtgggaaagattcggtttgcgtcgttacccagaaggaagttcctgacaagcttttggatcagtctagtgttacacatctgttccctatcaccaagtacattggattggtagctactggcattacagctgatgcaaggtctttggttcaacaagcaaggaatcaagcagctgaatttcggttcacttatggatatgagatgcctgttgacattcttgctaaatggatagcggacaagtcacaggtctacactcaacatgcttacatgagaccccttggagttgtcgctatggtaatgggtgttgatgaagagaatggtcccttactttacaaatgtgacccagctggacatttttacggtcacaaggcaactagtgctggtatgaaggaacaagaagcagtcaatttcttggagaagaaaatgaaagaaaacccatctttcacatttgatgaaaccgtgcagactgccatatcggctttgcaatctgttcttcaagaagacttcaaggctactgagattgaggtaggtgtggtgagagcagagaacccggaattccgtgcattgacaacggaggagattgaggagcatttgacagccattagtgaacgagactgatcaacttagtgaaacaagtgtgagttacgttgcttcgcttctatcagacattcctctaaagtggccactctccatcgatcttttgtttggtcttccttccataatttaatttacttagtcaacccagcaaacttgaaaaacaaaaatgcactgtaatgcttaaggctgtgagagtttccgagtcttttgactcttcagaaatgacaccaactttactt

SEQ ID NO: 3397 - protein, 246 aa, Arabidopsis thaliana
MSRGSGAGYDRHITIFSPEGRLFQVEYAFKAVKTAGITSIGVRGKDSVCVVTQKEVPDKLLDQSSVTHLFPITKYIGLVATGITADARSLVQQARNQAAEFRFTYGYEMPVDILAKWIADKSQVYTQHAYMRPLGVVAMVMGVDEENGPLLYKCDPAGHFYGHKATSAGMKEQEAVNFLEKKMKENPSFTFDETVQTAISALQSVLQEDFKATEIEVGVVRAENPEFRALTTEEIEEHLTAISERD

SEQ ID NO: 3398 - DNA, 699 bp, Encephalitozoon cuniculi
  CDS (1)..(699)
atggaggactttaagcaaagtgtaaacacatacagctctgagggaagaatccatcagattgaatatgccatgaaggcaatgaatctgggaacaacaacaataggagtaagaaccaaggagtttgtgatactatgttctgagaagaagatattgtctaccttgcagaatcccaagagtgtggtaaagcattacaagatctacgatcatattgtgcttgggttttccgggataagcggcgacacaaagaccattgtgaagcggtcgcgagacttctgcatttctcacacccacatgtatggagaaaacatcagcgtggaaaggctcttgaaatacctgtccagcctgagcctgaggtttggcgaggaggatgaggccaaaatgatatttcgaaggccctttggcgtttcgttgattatagcaggattcgacaccgaacccaggctgtattcactggatccgtctgggtcgtatatcagttacaaggcaaaggccataggatctggacacgaggtggttgaaggcatacttgaaaacgagtacgaggaatacagtggacttgatcagtctctgagaaaagtgctttgcaccctatctaaggtgatgaaggacaagattagcaaggataatgtggaggtcgttgttgttactcaagaagagtccaagtttctgacccccgaggaagtgtcggtatatctatga

SEQ ID NO: 3399 - protein, 232 aa, Encephalitozoon cuniculi
MEDFKQSVNTYSSEGRIHQIEYAMKAMNLGTTTIGVRTKEFVILCSEKKILSTLQNPKSVVKHYKIYDHIVLGFSGISGDTKTIVKRSRDFCISHTHMYGENISVERLLKYLSSLSLRFGEEDEAKMIFRRPFGVSLIIAGFDTEPRLYSLDPSGSYISYKAKAIGSGHEVVEGILENEYEEYSGLDQSLRKVLCTLSKVMKDKISKDNVEVVVVTQEESKFLTPEEVSVYL

SEQ ID NO: 3400 - DNA, 699 bp, Encephalitozoon cuniculi
  CDS (1)..(699)
atggatgacaacaaaccaaagtccaacacctttacagatgaaggtagactaccacaggtggaatttgccatcaagaacgtctccagggcaggcacaataattggatacgtgtgttcagacggcgttgttctcatgggggtaaacaaggagccgacgaatgggccgatggagaagatctaccaactgagcgatagtatttattgtgtgctatgtggactgtttggagatgcaatggagctcaagagatatgcgcggataaaggcccaggaagttctagaaagattcggggtggagtgccctcttacaaccctatgcaaatttgttggacagaggaagcaggcgtttacccaatatgcaggaacgcggccctttggagtgtcctttctgtatgccggggttatagacggaaaatatgccctgatgtccacggatccaagcgggacatcgaatcggtggaagggaatgtgctacggggagaacgaagaggccataaacaggggacttaagaacgactttcccgaggatgaaatggacatgaagacggccaccgtcgagatattaaggcttctaggcaaggctcgggagctaggccccaaggaggcagacaggttggaaattctgcacttctctaaggactgcaagaaataccttccgtgtgatgaggttttaaagcttcttgaggaaatacatgccaagtag

SEQ ID NO: 3401 - protein, 232 aa, Encephalitozoon cuniculi
MDDNKPKSNTFTDEGRLPQVEFAIKNVSRAGTIIGYVCSDGVVLMGVNKEPTNGPMEKIYQLSDSIYCVLCGLFGDAMELKRYARIKAQEVLERFGVECPLTTLCKFVGQRKQAFTQYAGTRPFGVSFLYAGVIDGKYALMSTDPSGTSNRWKGMCYGENEEAINRGLKNDFPEDEMDMKTATVEILRLLGKARELGPKEADRLEILHFSKDCKKYLPCDEVLKLLEEIHAK

SEQ ID NO: 3402 - DNA, 1020 bp, Anopheles gambiae
  CDS (142)..(846)
ggccacgcgtcgactagtacggggggggggggggactgccggtgagaaagctgttttgccagatttgtttccctccgcactgaaaccattttatgaaaaacatcttgtccgtacgctgcattttgagctgaatcttttgtgatggcttcggaacggtatagcttttcgctgaccacctttagcccgtcgggtaagctggtccagatcgagtatgccctcgcggcggtagcggccggagcaccgtcggtcggcatcaaggcggtaaacggtgtcgtgatcgcgacggaaaacaagcagaaatcgatcctgtacgatgagcacagcgtgcacaaggtcgagatggtgacgaaccatatcgggatgatctactccgggatggggcccgactatcggctgctggtgaagcaggcccgcaagctggcccaaaactactacctcacgtaccgcgaaccgataccgacgtcgcagctggtgcagaaggtggccaccgtcatgcaggagtacacgcagtcgggcggtgtccgaccgtttggagtttcgctgctgatctgcggctgggacgatggccgtccgtacctgttccagtgcgatccgtccggcgcttacttcgcgtggaaggcgacggcgatgggcaagaacgccaacaatggcaaaacgttcctcgagaagcggtacagcgaggatctcgagttggatgatgccgttcacaccgcgattctgacgctcaaggaaggcttcgagggacagatgaacgcggacaacatcgaggtgggcatctgcgatgcgaacggtttccgccgactggacccatccgacgttcaggattatctggccaatattccataagctagctagggcaaggggggagaagcaaatcgagagagagaggagggagctttttcgtcgtaagagtgcgtcctagcgagggacattttttgcgttaaagtagagttactctggatgggtggatgatttggaataaacacttacatttcttcaagcggaaaaaaaaaaaaaaaa

SEQ ID NO: 3403 - protein, 234 aa, Anopheles gambiae
MASERYSFSLTTFSPSGKLVQIEYALAAVAAGAPSVGIKAVNGVVIATENKQKSILYDEHSVHKVEMVTNHIGMIYSGMGPDYRLLVKQARKLAQNYYLTYREPIPTSQLVQKVATVMQEYTQSGGVRPFGVSLLICGWDDGRPYLFQCDPSGAYFAWKATAMGKNANNGKTFLEKRYSEDLELDDAVHTAILTLKEGFEGQMNADNIEVGICDANGFRRLDPSDVQDYLANIP

SEQ ID NO: 3404 - DNA, 1144 bp, Drosophila melanogaster
  CDS (48)..(806)
tacacaaagtacactccatagtatttcaaataagtagccccacttcaatggctcagcgatacgatcgcgcggtgaccatttactcacccgacggtcacctgctgcaggttgagtacgcccaggaggccgtccgaaggggttccactgtgatgggtctgcgcaccaacaacgccattgtaatcggcgtggagaagcgctccgtgggcgacttgcaggaggagcgcatggtgcgcaagatttgcatgctcgacgaccacgtggtgatgactttttcgggtctcaccgcggacgcacggatcctggtaagccgcgcccaaatggaggcccagagccatcgtctgaatttcgagaagcccacgaccgtggagtacataacccgatacatagcccagctgaaacagaactacacgcagagcaatgggaggcgtccatttggattgtcctgtctggttgggggcttcgacgaggatggcactccgcacctgttccaaacggatccctcgggcatcttctacgagtggagggccaacaccaccggccgctcaagccagccggtccgcgattacatggagaagcacgcggacgagattctgaccatcgccgacgaggcagcggccatcaagcacatagtccgcaccctggtcagcgtatcctcgctcaaccacactcaaatggaggtggctgtgctcaattaccgccagccactgcgtatgattgatcaccaggtcctggccgatctggagcgaaccgttcgcagggaaattgaagacgaggccgaggtcagtcggcggccccgtgctccctagttttggctggccaccctgatccattctgtccaccatggcccctggccattttcatgaccaatcaaaagttgataaccggtcgtgctctctttttctgggcaattcaatttcggccggggagttggagaaaagtaatcagcaggaaaaatgtgtaaagcgggcaaatcacttaatttgtctccagggcgtatttgtttactttatatccctctccggtggagacgcgtacgctcctttcaggccaaccaagttaaaaagttttaagtgaaaatgcgaattgaatttgtagagaaaaaataagaaagtgcgcgcacacatgcaaaaaaaaaaaaaaaaaa

SEQ ID NO: 3405 - protein, 252 aa, Drosophila melanogaster
MAQRYDRAVTIYSPDGHLLQVEYAQEAVRRGSTVMGLRTNNAIVIGVEKRSVGDLQEERMVRKICMLDDHVVMTFSGLTADARILVSRAQMEAQSHRLNFEKPTTVEYITRYIAQLKQNYTQSNGRRPFGLSCLVGGFDEDGTPHLFQTDPSGIFYEWRANTTGRSSQPVRDYMEKHADEILTIADEAAAIKHIVRTLVSVSSLNHTQMEVAVLNYRQPLRMIDHQVLADLERTVRREIEDEAEVSRRPRAP

SEQ ID NO: 3406 - DNA, 911 bp, Drosophila melanogaster
  CDS (57)..(806)
aataacttgtcacaagcaaattgttgttttgttttgcctgctaactaacccaaaggatgtcctcacgctacggtcgagctctaaccatattctcgccggatggccacctgttgcaggtggagtacgcccaggaagctgttcgaaagggctccacagcggttggcgttcgtggagccaattgtgtggtgctgggtgtggagaagagctcggtgtccgagatgcaggaggatcggacggtgcgcaagatcagcatgctcgatcgccacgtggcgttggcatttgccggtctcacggccgatgcacggatccttataaatcgagggcaggtcgagtgccagagccatcgactcaacttcgaaaaccaggtgacccccgagtacatcaccagataccttgcccagctcaagcagaagtacacgcagtgcaatggacgtcgtcctttcggtatatcgtgtctaataggaggcattgacgccgatggctctgcacgtctctttcataccgaaccatccgggatattccacgagtacaaggcgaccgccactgggcgttgggcaaatactgtgagggagttttttgagaaggcctatggcgatcatgaagtgacaaccaaatgtgatgccatcaaactagccatgcgtgcccttctcgaagtaacccagatgagccagatgcgcctggaggtggccgtattggagaatggcaagccaatgaaaatgctggacagtgtagtaatttcggaaatagtcaagatcgttcagaacgaaaaggagctccaagcgaaggcacataaaatgaagagatgaattgctacacccgcagatcgttgattttttatgttcatcaaattgttattagatattcatgttatattgttttggagctttgtttaaaaaaaaaaaaaaaaaaaa

SEQ ID NO: 3407 - protein, 249 aa, Drosophila melanogaster
MSSRYGRALTIFSPDGHLLQVEYAQEAVRKGSTAVGVRGANCVVLGVEKSSVSEMQEDRTVRKISMLDRHVALAFAGLTADARILINRGQVECQSHRLNFENQVTPEYITRYLAQLKQKYTQCNGRRPFGISCLIGGIDADGSARLFHTEPSGIFHEYKATATGRWANTVREFFEKAYGDHEVTTKCDAIKLAMRALLEVTQMSQMRLEVAVLENGKPMKMLDSVVISEIVKIVQNEKELQAKAHKMKR

SEQ ID NO: 3408 - DNA, 910 bp, Trypanosoma cruzi
  CDS (27)..(764)
ttctgtactatattgcaagatcgccaatgttttcttccaaaactgagtatgacagaggtgtaaacaccttcagccccgagggacgaattttccagattgagtacgcgattgaggcgattaagctgggaagcacaagtcttggaatccaaacccccgatgcggttgtaattgccgctgaaaagcgggttccttccgtgctggtggacccttccagcatgaataagattttagagatcgattatcacatgggaaccgtattgagtggcatggtggcggatgcacggattctcgtcgagcatgctcgtgtggaggcgcagaatcaccgtttcacctacgatgagccaatgcgcgttgagtcgtgtgcgttggccacctgcgatttatctgttcgattcggtgaaagtgggggacgcaagaagctgatgtccagaccatttggcgtttcacttcttattgccggtgtcgatgaaaacggtccacagctctggcaaacagaccctagcggcacctacacacgttacgacgctcaagcgattggtgctggtgccgaagctgctcagaccgtgtttaatgaaatttatcatcgcaacatgactgttgaggaggcagaaacgcttgcagtgcgaatcctgaagcaggtgatggaagaagaactgaccaaaagcaacattgagattgccattgttcctgcatgtacaggcaagctggaagtatatgatcagacaaaaatacaaagaatcattgatcgactgacggaagagtaacggcatcggatgcattttatggttctgtctttttcccccccccctttttttttcttttaatttattttactttactgcacggtaccttgtaggaaatgagatgtgttttttgttgttgttgttgaaaaaaaaaaaaaaaaaaaaaa

SEQ ID NO: 3409 - protein, 245 aa, Trypanosoma cruzi
MFSSKTEYDRGVNTFSPEGRIFQIEYAIEAIKLGSTSLGIQTPDAVVIAAEKRVPSVLVDPSSMNKILEIDYHMGTVLSGMVADARILVEHARVEAQNHRFTYDEPMRVESCALATCDLSVRFGESGGRKKLMSRPFGVSLLIAGVDENGPQLWQTDPSGTYTRYDAQAIGAGAEAAQTVFNEIYHRNMTVEEAETLAVRILKQVMEEELTKSNIEIAIVPACTGKLEVYDQTKIQRIIDRLTEE

SEQ ID NO: 3410 - DNA, 1191 bp, Brachydanio rerio
  CDS (304)..(1062)
gcacgaggcgcaacccggaagagagacgcaacagaaacgcaacgagacgaacaaacacaaacacaaacggacacacagcgcaatctcccgtgtgcacccgatcgatcggctggtggagtgaaggtgtgtgtttgagagagtgcgcgcgcgcgtgttcttcttcctcgtcgagtgtaatgacgcgcaggactgaaagagaaagtgaaagagtgaattcgcttattcactgcggactcgacgagcttcaccttcagctgcagcttttcttctgtcaatcagtcatcgataaagcgtgttttcaggatgtctcggggctcgaacgcgggatttgaccgacacatcaccatcttctcccccgagggacgcttatatcaagtcgaatatgcgtttaaggccatcagtcagagcggattgaccacggtgggcatcagaggagtggactgtgcagttctggtcacgcagaagaaagtgtcggacacactcctggacgcctctacaatgacaaacatgtttcgcatcactccacacatcggctgcgtcatgactggacattacgctgacagtcgctctcaggttcatcgtgcgcgtatcgaggctggcgagtggaagtataagttcggctatgatatgccggtggacgctctgtgccggcgtctggctgatctgtctcaggtctacacacagaacgcagagatgaggccgctgggctgctgcatgatgctgatctccatggacccccagaagggccccatgctgtataagtgtgaccctgcgggatacttctgcggcttcagggcctccagtgtgggagtcaagcacaccgaggccaacagctacctggagaagaagatcaagaagatgcagaagaagaaggaggaggtggagctggactttgacagcagcgtgcagatggcgatcccctgcttgtcttctgttctctgcatggactttaagtgcactgagctggaggtggccgtggtcactaaagaaaaccctaaattcaggactctgtcagaagtggagatcgagcgtcatctggttgcaatcgcagagagagagtgatcagtgtgtgtgtgtgtgtgtgtgtgtgttttctacttttacactgctctgttactccacaccctcagtccagacaccagcagactctcaaataaaccaatattactgtcgaaaaaaaaaaaaaaaaaa

SEQ ID NO: 3411 - protein, 252 aa, Brachydanio rerio
MSRGSNAGFDRHITIFSPEGRLYQVEYAFKAISQSGLTTVGIRGVDCAVLVTQKKVSDTLLDASTMTNMFRITPHIGCVMTGHYADSRSQVHRARIEAGEWKYKFGYDMPVDALCRRLADLSQVYTQNAEMRPLGCCMMLISMDPQKGPMLYKCDPAGYFCGFRASSVGVKHTEANSYLEKKIKKMQKKKEEVELDFDSSVQMAIPCLSSVLCMDFKCTELEVAVVTKENPKFRTLSEVEIERHLVAIAERE

SEQ ID NO: 3412 - DNA, 896 bp, Brachydanio rerio
  CDS (1)..(702)
atgtctcggggctcgagcgcggggtttgaccgacacatcaccatcttttctccggaggggagactctatcaagtcgaatatgctttcaaggccattaatcagggaggtctgacgtcagtagctgttcgagggaaagactgtgcagttgttattacccaaaggaaagttcctgataagcttctggattcgtccactgtcactcatttattcagaataacagagaacattggctgcgtgatgtctggcatgacagctgacagcaggtcgcaggtgcagagagcgcgatatgaagccgctaactggaagtacaaatatggttatgagatcccggtgggcatgctgtgcaagcgcatcgcagacatctctcaggtgtacactcagaatgcagagatgaggccgctcggatgctgtatgatcgtggttggtgtggacgaggagctcgggccgcaggtctacaaatgcgatcctgccggttattactgcggttttaaagccactgctgcgggagtcaaacaaacagaggccaccagctttctggagaagaagatcaagaagaaactggactggacctttgaccaaacagtggagactgccatcagctgcttgtctacagttctggccatcgacttcaagccatccgagctggagatcggcgtcggtgaccacagaagagcccaagttcagaattttgtccgagtctgagatcgacactcatctgatggctctgactgaacgagattgagaactgcatgagtgtttatcctgtgacagagaaaaacatctgagaactacagtctgtcaacattcaggtcatctgatcatttattgctgtttatgtagcttttttcttgcaacagtacaataaaattaacgttttaaaaaaaaaaaaaaaaaaa

SEQ ID NO: 3413 - protein, 233 aa, Brachydanio rerio
MSRGSSAGFDRHITIFSPEGRLYQVEYAFKAINQGGLTSVAVRGKDCAVVITQRKVPDKLLDSSTVTHLFRITENIGCVMSGMTADSRSQVQRARYEAANWKYKYGYEIPVGMLCKRIADISQVYTQNAEMRPLGCCMIVVGVDEELGPQVYKCDPAGYYCGFKATAAGVKQTEATSFLEKKIKKKLDWTFDQTVETAISCLSTVLAIDFKPSELEIGVGDHRRAQVQNFVRV

SEQ ID NO: 3414 - DNA, 1047 bp, Nicotiana tabacum
  CDS (91)..(840): n means a or g or c or t/u
cttttcctcttcctctgtatgttccgtcgttcatagttccagaacaaaagatcttcgaactcaaaactgaataagtaaaatcagttaaaaatgagcagcataggaacaggttatgacttatccgtgacgacattctcgccggacggcagagtatttcagatcgaatatgccggcaaagccgtcgataacagtggtactgttgtcggaattaaatgcaaggacggaatcgttttgggagttgagaagctgattgcgtctaaaatgatgttaccgggatctaatcgtcggattcactccgttcatcgccattctggcatggctgttgcagggctggctgcagatgggaggcaaattgttgcccgcacgaagtctgaagcaaccaactatgaaagtacatatggngaaccaattctggtaaaagagcttgcagaacgtgttgctagttatgttcatttatgcacactttattggtggctcaggcctttcggatgtggggtgatcctcggaggctatgatagagatggacctcaactatacatggttgagccgtctggtgtctcctataggtactttggtgctgctattgggaagggcagacaagctgctaagacagaaattgaaaagttgaagctctctgaaatgacgtgtcggcaaggggtaattgaggtagccaaaataatatacggagtacatgatgaggcaaaggacaaggcgtttgaactggaaacgagttgggtgtgtgatgagtctaatcgacagcatcagaaggttcctgccgatttgttagaggaagccaaggctgcggctaaagctgcacttgaagagatggatgcagattagtggcacaaagacactttgttccttgtttattcatgcacctatcttttatcagctgagtcaaatagtcttgctctgccatgtttgaaatttggcacctgtatgatgattactttcagtgatgaaagtgattgttattcccttaaactgtaatcgttacacataattttctaagatcaagaggataggttgcattctcaaaaaaaaaaa

SEQ ID NO: 3415 - protein, 249 aa, Nicotiana tabacum
MSSIGTGYDLSVTTFSPDGRVFQIEYAGKAVDNSGTVVGIKCKDGIVLGVEKLIASKMMLPGSNRRIHSVHRHSGMAVAGLAADGRQIVARTKSEATNYESTYGEPILVKELAERVASYVHLCTLYWWLRPFGCGVILGGYDRDGPQLYMVEPSGVSYRYFGAAIGKGRQAAKTEIEKLKLSEMTCRQGVIEVAKIIYGVHDEAKDKAFELETSWVCDESNRQHQKVPADLLEEAKAAAKAALEEMDAD

SEQ ID NO: 3416 - DNA, 952 bp, Physcomitrella patens
  CDS (81)..(794)
gggaggcacagattgctgcgacatagagagcgagagagagagtttcttcttcttcatttcccaaaccttctatcttatacatgttcctcaccaggagtgagtatgatagaggtttcaatacgttttctcccgaggggcgcctctttcaagtggagtacgccattgaagctattaagcttggttccacggcagtgggattgaagaccaaggagggagttgttttggccgtcgagaagcgaataacctcagttttgttggaacccaccagtgtcgagaagatcatggaaatcgatgaacatattgggtgtgccatgagtggtctcactgcggatgctcgcacacttgttgaacatggccgtgtggaaactcagaatcataggttctcgtataatgagcctatgagtgtggagtctactacacaagccctgtgtgatctggctttacgttttggggaattcgacgaagaatcaatgtcacgtcctttcggagtttctctgctcattgctggccatgatgagagtggaccatgcttgtaccacacagatccatctggaacattttggcaatgtgatgctaaggcaattggttcaggatcagaaggtgccgatacttcccttcaggaacatttcaacaagaacatgacgctggaggaagccgagacattggcgttgtctaccttgaagcacgtcatggaagaaaaggtaacttcctgtaatgtggatattgctaaggtggctcccaagtatcatttgtacacacccgaagaagttgaggttgttatacaacgattgtaattatcttatctgggtagttgaatactcgagaatgccgttttcgattcatgagctatccattcaaatattggtttaatttagtagcgaatgtgttcatttctatggtataacttgaaccttctgcactttttttaattaaaaaaaaaaaaaaaaaaaaa

SEQ ID NO: 3417 - protein, 237 aa, Physcomitrella patens
MFLTRSEYDRGFNTFSPEGRLFQVEYAIEAIKLGSTAVGLKTKEGVVLAVEKRITSVLLEPTSVEKIMEIDEHIGCAMSGLTADARTLVEHGRVETQNHRFSYNEPMSVESTTQALCDLALRFGEFDEESMSRPFGVSLLIAGHDESGPCLYHTDPSGTFWQCDAKAIGSGSEGADTSLQEHFNKNMTLEEAETLALSTLKHVMEEKVTSCNVDIAKVAPKYHLYTPEEVEVVIQRL

SEQ ID NO: 3418 - DNA, 1349 bp, Mus musculus
  CDS (56)..(823)
ggtaggagcggcgcttgaggcctggaagcgttccgcggcctgccgggtcagcaccatgagctccatcggcactgggtatgacttgtcagcctctacgttctctcctgatggaagagttttccaagttgaatatgccatgaaggctgtggaaaacagtagtacagcgattgggatcagatgtaaagatggtgttgtgtttggggtagaaaaactagtcctttctaaactttatgaagaaggctccaataaacgtctttttaatgttgatcgacatgttggaatggcagttgcaggtttgctggcagatgctcgttcattagcagacatagcgagagaagaagcatccaactttaggtccaacttcggctataacattcctctaaaacatcttgcagacagagtggccatgtatgtacacgcctatacactctacagcgctgttagaccttttggctgcagtttcatgttggggtcttacagtgcgaatgatggtgcacagctctatatgatcgacccatcaggtgtttcatatggttactggggctgtgcgattggcaaacgcaggcaggctgcaaagacagagatagaaaagcttcagatgaaggaaatgacttgccgtgatgtagttaaagaagttgcaaaaataatttacatagtacacgatgaagttaaggataaagcttttgaactggagctcagctgggttggtgaattaactaaaggaagacatgaaattgttcccaaagacataagagaggaagcagagaaatatgccaaggaatctttgaaggaagaagatgaatcagatgatgacaatatgtaatattttcttccccatccgctggtttacatttctgtaacagttgcatatggctagcaccatggactatatatacccactgaccgattttcattaaattttgtcttataaacattgttgggtaattgaagctatctgtgtaatattaaaatatagattgatgtttgattaaaaattcttagaactgggcctggagagatggctcagcagttaagagctgctcttccaggggacataggttcaattcccagcacctacaatggcagctcacacctgtctgtaactccagttccaggcttctgacacctacaaactgaggtacatgcaggcaaaacaccaatgaatataaaataaaaataaatgatatctacttacacatataataaatgcaaaaatacaaatatgtatatatacagacacacatgtgtatatacatttaaattcttggtgctattctcgtgtggtagtacatgcctttaatcctagtactcagaggcaggtggacctcttgagttcaaggctagtattc

SEQ ID NO: 3419 - protein, 255 aa, Mus musculus
MSSIGTGYDLSASTFSPDGRVFQVEYAMKAVENSSTAIGIRCKDGVVFGVEKLVLSKLYEEGSNKRLFNVDRHVGMAVAGLLADARSLADIAREEASNFRSNFGYNIPLKHLADRVAMYVHAYTLYSAVRPFGCSFMLGSYSANDGAQLYMIDPSGVSYGYWGCAIGKRRQAAKTEIEKLQMKEMTCRDVVKEVAKIIYIVHDEVKDKAFELELSWVGELTKGRHEIVPKDIREEAEKYAKESLKEEDESDDDNM

SEQ ID NO: 3420 - DNA, 1040 bp, Zea mays
  CDS (82)..(822)
ggcacgaggttccccaaacacgcacagcacacgaacacacaccgcgcccagctccgaggtgatcttccggcggccggcgagatgagccgtggcacaggcgcgggctatgaccgccacatcaccatcttctccccggagggacgcctgtaccaagtcgagtacgcgttcaaggcggtgaagtcggcgggtgtcacgtcgatcggcgtccgcggcgcggactccgtctgcgttgttacgcagaagaaagtcccggataagttgctggatcagacgagcgtgacacacctgttcccgatcaccaagtacgtcggattgcttgccactggccttacagctgatggtaggtcattggtttcccaagcaaggaacgaagcagctgagtttcgtttcaaatggggctacgagatgccagttgatgtgttagcaaaatggattgctgacaaagctcaagtttacacgcagcatgcatacatgagaccccttggagtagttgctatggtcttgggctacgatgaagagaaaaatgcccaactattcaagtgcgaccctgctggtcacttctttggacataaggcaactagtgccgggctcaaggagcaggaagcaataaattttctggagaagaaaatgaaggatgacccgaaattcacctatgacgaaactgtgcagattgcaatatctgcgttgcaatcagttctccaggaagatttcaaggccactgagatcgaagttggtgttgtgagaaaagatgaccgcgttttcagagctctcacgacagaggagatcgatcagcacctgacggcaattagtgaacgtgactgagatgtcatatgctgcacatttcagcgctgcacacactgcgccgtgccattgtgcttcggcagtcattaagtttcatagtcatcaaaggaactgagtgtaccatttcacgtttaagaccgaaaacaagccccctctcgatgtactcgtttcatatcgttctgtggttgattgaaattggcacggtttggttttgggttgctaaaaaaaaaaaaaaaaaa

SEQ ID NO: 3421 - protein, 246 aa, Zea mays
MSRGTGAGYDRHITIFSPEGRLYQVEYAFKAVKSAGVTSIGVRGADSVCVVTQKKVPDKLLDQTSVTHLFPITKYVGLLATGLTADGRSLVSQARNEAAEFRFKWGYEMPVDVLAKWIADKAQVYTQHAYMRPLGVVAMVLGYDEEKNAQLFKCDPAGHFFGHKATSAGLKEQEAINFLEKKMKDDPKFTYDETVQIAISALQSVLQEDFKATEIEVGVVRKDDRVFRALTTEEIDQHLTAISERD

SEQ ID NO: 3422 - DNA, 1010 bp, Leishmania infantum
  CDS (198)..(893)
aactaacgctatataagtatcagtttctgtactttattgctggattctttttctgcgccgcagaagccattctttcacttcccgtgcactcgcttctctagcatacacagcttgtgaggtaagctgtactttttcgctacacaaagacgaatacatcgatatttggaaaaaaaaagaaagcagcatcataactgaaaatgtctgaggcattttatggtctgacgacgtttagcccttcaggaaagctggtccagattgagtatgcgacgacagctgccggcaaagggacgactgcgctgggggtgaaggccaccgatggggtcgtcattgctgcaaagaagaaggctccatctaccctagtggatgcctcatcgatccagaaggtcttcgtcttggatgagcacgttggctgcacctacagcgggatgggcccggactgccgtgttcttatcgactcagctcggaagaattgccagcagtacaggctgatgtacaacgagagcattccgatcagccagctggtgcggaagattagcgctctctatcaggaatttacacagtctggcggtgttcgtcccttcggatgctctctcctggtcgctggggtggacgctaacggctaccatttgtatcaggtggaccctagcggcacgttctgggcgtggaaggcgacggcgattggcaccggaagtccggacgcgaaggcatttctagaaaagcgttacactgtggacatggagctggaggatgctgtacacaccgcattgttgacgctaaaggagggctttgatggccagatgacgtcagaaaacactgaggtcggtcgtgttgtaggaaaccgtttcgaagtcctgagcgtcgatcagctgcgcgattacctggaccagatttagtgtggtcatgcatatagtgctgcgtagcggaaagtatatagacttcggcggcgtgcaacaaagagctgtgctgtggaaaatgtcttctatttcaggtattgtttctcgtcaaaaaaa

SEQ ID NO: 3423 - protein, 231 aa, Leishmania infantum
MSEAFYGLTTFSPSGKLVQIEYATTAAGKGTTALGVKATDGVVIAAKKKAPSTLVDASSIQKVFVLDEHVGCTYSGMGPDCRVLIDSARKNCQQYRLMYNESIPISQLVRKISALYQEFTQSGGVRPFGCSLLVAGVDANGYHLYQVDPSGTFWAWKATAIGTGSPDAKAFLEKRYTVDMELEDAVHTALLTLKEGFDGQMTSENTEVGRVVGNRFEVLSVDQLRDYLDQI

SEQ ID NO: 3424 - DNA, 1284 bp, Trypanosoma brucei
  CDS (9)..(869)
gattagaaatgtcctcgcgttacgactcccgcaccaccaccttctcgcctgagggacgtctttatcaagtggaatatgcggaagaggcaatatcgcaggcgggcactatcatcggaattctcactactggtggcgtcgtgcttgacgctgagcgggggcagcaacatgggttgttcgatacagagaacatggaggatataaatataagtggagaaaaagtgtataagatttcaaatcatctcggctgcagcgtcgccggcgtaacttctgatgcctacgcactaatcaactacgctcgactgagtgcagcccgccacttttacagctttcaggagccgatagccgcggaagacctttgccgcatggtgtgtgacgagaaacagctgtacacccagtatggtggtgtgcgtcccttcggtgtgtcatttctctttgcagggtgggatcgccactatggctaccaactttaccacacagatgcaagtggtaactatagcgcatggcgggcgtatgccgttggacaaaatgaccaggttgcacagtcacttctcaagcgtgactggaaaccggaacttacactggaggagggcattgtgctttgcctacgggtcctcggtaagacgatggacgctgtgaagcttacgccagagcgcttggaggtggcggtgctccatcgcgttcaggcaccactgacccaaaaattactggacccgtacggtgtaaacccaaagatggttccgagctttaaaatcttgactgatgaagagctgaaaccacatgttgatgaagcaaacagacaacgtgaggctgaggaggcggaagaagcggaaaaggagaaaaagaacgagaagcgcttggcctcgccgtaattggcgtgcaacgtgatggcgaatgggatgaagaatagggggaaaaaggaggttttttttatgacctaatagtgtgctagtaggagttgaaaggcgcttgcgcttctggaaagaggacgataaagcgttatgcatagcaaagtgccattatgccgatagtgggtagggtgaaagcaggaaggcaggtggtaaggtagtggagctaaccgagtgggagggaaaaaatcacttatttcgcctacttttttatttgtcacatactttaccctttcattctttccactctttcgtatgcatgtgttactttgttttcatcagtttccgtccactcatgccgaagtgagggggcgcctgcgcacctcaaccctatacccggttggatatttgtgacatgtgcggtaaatgccgaaattcc

SEQ ID NO: 3425 - protein, 286 aa, Trypanosoma brucei
MSSRYDSRTTTFSPEGRLYQVEYAEEAISQAGTIIGILTTGGVVLDAERGQQHGLFDTENMEDINISGEKVYKISNHLGCSVAGVTSDAYALINYARLSAARHFYSFQEPIAAEDLCRMVCDEKQLYTQYGGVRPFGVSFLFAGWDRHYGYQLYHTDASGNYSAWRAYAVGQNDQVAQSLLKRDWKPELTLEEGIVLCLRVLGKTMDAVKLTPERLEVAVLHRVQAPLTQKLLDPYGVNPKMVPSFKILTDEELKPHVDEANRQREAEEAEEAEKEKKNEKRLASP

SEQ ID NO: 3426 - DNA, 1224 bp, Leishmania major
  CDS (1)..(1224)
atgctttccgtcgccgccttcatccgtgcgactcccctccacgcacacccttcctctctttccgcctcttgctcccaccccctctgcccctcatctgcacgcgcctgtgcacacacacacacacatacacacacgtgcgataacgggcggatccctgaatggcatctccagcattgcatcgctgtgcagactcactgcatcctctccctctctctctctctgtttacttctgttcgcccgtctttccttgccttcgtgactctccgtggtgcctatcacccccgcctctgcgcagacacgcacgcattgaaacaagcagctgctctgtgccgcagcttaccatcaccaccactgcgcatcgccaccatgtctcaccggtacgactcccgcaccaccaccttctcccctgagggtcgcctctaccaggtggagtacgccgtggaggcgattcagcaggccggcaccgtcatcggcgtatgcacgaaagacggcgtcgtgctggcgggtgagaagatggtgccgcacccgctctttgatagcgaaaacatgcaagacaagaacatcagcggggaaaagatgtacaagatcgctgagcacatcggctgcagcgtggcgggtgtgacgtctgatgcgtacgccttgctgaactacgctaggctttcggcactgcgccaccagtacaccttccaggagccgatagcgatcgaggatctctgccgcatcctgtgtgacgagaagcagctctacacgcagtacggcggtgtgcgcccctacggtgtctccttcctgcttgttggatgggaccgctattatggttatcagctctactccaccgagccgagtggcgactacagcgcctggagcgcgtacgcgatcggacagaacgaccaagtggcgcactcactcttgaagaaggactggcacgagaacatgacgctagaggacggcatgctgctggcgctgcgggtgctgggcaagacgatggacacggcaaagatcgacctcggccgggtggaggtggcggtgatgcgcaaagtgcccgcttcgaacgttgatcagctgctcgagccgttcaaacaccaccccaagacggcgcctcagtttcagattctcgcccctagtgaactgaagccgcacgccgaacgcgccgaccaggccagggaggcggaggagcaggccgaggcggagcgccagcgccagcaggagcaggctctggagtcgtaa

SEQ ID NO: 3427 - protein, 407 aa, Leishmania major
MLSVAAFIRATPLHAHPSSLSASCSHPLCPSSARACAHTHTHTHTCDNGRIPEWHLQHCIAVQTHCILSLSLSLFTSVRPSFLAFVTLRGAYHPRLCADTHALKQAAALCRSLPSPPLRIATMSHRYDSRTTTFSPEGRLYQVEYAVEAIQQAGTVIGVCTKDGVVLAGEKMVPHPLFDSENMQDKNISGEKMYKIAEHIGCSVAGVTSDAYALLNYARLSALRHQYTFQEPIAIEDLCRILCDEKQLYTQYGGVRPYGVSFLLVGWDRYYGYQLYSTEPSGDYSAWSAYAIGQNDQVAHSLLKKDWHENMTLEDGMLLALRVLGKTMDTAKIDLGRVEVAVMRKVPASNVDQLLEPFKHHPKTAPQFQILAPSELKPHAERADQAREAEEQAEAERQRQQEQALES

SEQ ID NO: 3428 - DNA, 735 bp, Giardia lamblia
  CDS (1)..(735)
atgtctcgttttgactctcgcacgactcttttttcgcaggacggccgtctcctgcaggttgagtacgcgataaaggcagtaacgattgccgcgccgtgcctcgcaatcctggcccaagacgggattgtctttgtcgcccagaagaagctgccatcgaaactcagcgatcagcagacaagcgaaaagatttacaagatcgattcccacattgtgtgcgctgtttctgggctaacctccgatgccaatatccttatcgacgaggccagaacctacagtcaaaaatggctagcagtctatgacgaacctattcccgtcgaagttctagttcaatatatttcggatgtcaaacagaactacacgcaccacggaggactgcgtccatatggcgtctccttcctttttgggggctgggatgcccaccttgggttccaattgtaccagacagatcccagtgggaattattctgcgtgggttgcaacaagcataggagggtccgctccggaaatagcatcagctctgaagcagaacattgcagatagcagtcaaaagattctactaaaggaggcccagcaatacgctgtttctgcgttaattaagactacagacataaccaaggtatcatctgacaaaatggagatccttacggtggtgaagggcgagagtggagacattcttgcaaagtacgtctctaatgcagaggtcgacgccatctgtcgacaactgcaggataagtga

SEQ ID NO: 3429 - protein, 244 aa, Giardia lamblia
MSRFDSRTTLFSQDGRLLQVEYAIKAVTIAAPCLAILAQDGIVFVAQKKLPSKLSDQQTSEKIYKIDSHIVCAVSGLTSDANILIDEARTYSQKWLAVYDEPIPVEVLVQYISDVKQNYTHHGGLRPYGVSFLFGGWDAHLGFQLYQTDPSGNYSAWVATSIGGSAPEIASALKQNIADSSQKILLKEAQQYAVSALIKTTDITKVSSDKMEILTVVKGESGDILAKYVSNAEVDAICRQLQDK

SEQ ID NO: 3430 - DNA, 1053 bp, Trypanosoma brucei
  CDS (124)..(837): n means a or g or c or t/u
tttagaacagtttctgtactatattgaagaaaaatactgaaggaaaggacgatatnggtatcgaggtcatccacaagaaaaggagaaagtaaatcaaggcaagaggagatataagggaggacaatgtctggctctggtcatgaccagtcaacagatatattttctgctgacgggcgtgtgtttcaggtagagtacgcctgcaaggctgtcgacaatggcagcaccgccgttgctgcctgttgcaaggacggtgttgtcgttgctgtggagaaaatcctcacaagccgcatgctggaggaagggtccaataaccgtattcatgcggtagatcggcaggccggaatttgtgtttgtggagtgctccccgatggtcttgctgttgtttcacgcgctcgtggtgaagcagagaacagtcgagatattttttccacaccgatactaggctccttgcttgcgtctcgaatcggcgagtttatgcacgtttacacgactcactacgcctatcgccccttcggctgttcggtcatcattgcctcttatgctgacgatggcccgcagctttatgtggccgacccgagcggggcagttgcggggtactatggaatagcgttggggaagggcaaaacggtggccaaaaccgagttggagaagctggactttgcgactctgacatgcagtgaggcggtggaaaagctaaccaacatcctccatgaggtgcatgacaagtcgaaagataaaatttatgaggtggaggtggcatgggtgtgcgacaagtccgatcgcaccttcgtgcatgtgccgaaggaaatggtaccgcatccaacccccgcatcatagtgtggaaaggtgagaaatgcaactgtgaaatggtaaaggaaatcgcgtgcagagggttgtgaatgactccatgctcttgcacggaatttagtcaggacattgctcgtttttcttctttccgcccattcgcgttttgtgtgtttatgtttgtgttaagggaggtatatttttcttactattttttgttacctgcacgtcatgcagttgacatacgtg

SEQ ID NO: 3431 - protein, 237 aa, Trypanosoma brucei
MSGSGHDQSTDIFSADGRVFQVEYACKAVDNGSTAVAACCKDGVVVAVEKILTSRMLEEGSNNRIHAVDRQAGICVCGVLPDGLAVVSRARGEAENSRDIFSTPILGSLLASRIGEFMHVYTTHYAYRPFGCSVIIASYADDGPQLYVADPSGAVAGYYGIALGKGKTVAKTELEKLDFATLTCSEAVEKLTNILHEVHDKSKDKIYEVEVAWVCDKSDRTFVHVPKEMVPHPTPAS

SEQ ID NO: 3432 - DNA, 735 bp, Leishmania major
  CDS (1)..(735)
atgttcacctccaagtctgagtacgaccgcggcgtgaacaccttcagcccggaaggtcgcattttccagatcgagtatgctgtggaggccatcaaactgggtagtaccagcctcggaatccgcacgcctaagggcgtcgttcttgccgcggagaaacgcgtgccatcgaccttggtcgttccgtccagcatgagtaagattatggagatcgacagccacattgcggctgtcatgagcggcatggttgcagatgcgcgcatccttgtcgagcacgcccgcgtggagtcgcagaaccaccgcttcacctacaacgagcccatgtctgtggagtcctgcacgctagcgacgtgcgacctgtcgatccagtttggtgagagcggtggaaagcgcaagctcatgtcgcgcccgttcggcgtttcgttgctcatcgccggcgtagatgaaaagggcccgcagctgtggcagacagaccccagcggcacgcacacgcgctacgacgcccaagccattggtggcggtgccgaggcggcgcagagtgtcttcacggagcgctaccaccgaaacatgacactggaagagggcgagacgctcgcggtggacattctgaagcaggtgatggaggaccagctgtcgccggagaacatagaggtggccgtagtgcgggccgacgacggcaagctgcacatgtacacacccacagaaatcaaagcaatcatgagtcgcatgccggagtaa

SEQ ID NO: 3433 - protein, 244 aa, Leishmania major
MFTSKSEYDRGVNTFSPEGRIFQIEYAVEAIKLGSTSLGIRTPKGVVLAAEKRVPSTLVVPSSMSKIMEIDSHIAAVMSGMVADARILVEHARVESQNHRFTYNEPMSVESCTLATCDLSIQFGESGGKRKLMSRPFGVSLLIAGVDEKGPQLWQTDPSGTHTRYDAQAIGGGAEAAQSVFTERYHRNMTLEEGETLAVDILKQVMEDQLSPENIEVAVVRADDGKLHMYTPTEIKAIMSRMPE

SEQ ID NO: 3434 - DNA, 696 bp, Leishmania major
  CDS (1)..(696)
atgtctgaggcattttatggtctgacaacgtttagcccttcaggaaagctggtccagattgagtatgcgacgacagctgccggaaaagggacgactgcgctgggggtgaaggccaccgatggggtcgtcattgctgcgaagaagaaggctccatctaccctcgtggatgcctcatcaatccagaaggtcttcatcttggatgagcacgttggctgcacctacagcggcatgggcccagactgccgtgttcttatcgactcagctcggaagaactgccagcagtacaggctgatgtacaacgagcccattccgatcagccagctggtgcggaagatcagcgctctctatcaggaattcacgcagtctggtggcgtccgtccctttggatgttctcttctggtcgctggggtggatgctaacggctaccatttgtatcaggtggaccctagcggcacgttctgggcgtggaaggcgacggcgatcggcaccggaagtccggacgcgaaggcatttctagaaaagcgttacactgtggacatggagctggaggatgctgtgcacaccgcattgttgacgctaaaggagggctttgatggccagatgacgtcagaaaacactcaggtcggccgtgttgtaggaaaccgtttcgaagtcctgagcgtcgatcagctgcgggattacctggaccagatttag

SEQ ID NO: 3435 - protein, 231 aa, Leishmania major
MSEAFYGLTTFSPSGKLVQIEYATTAAGKGTTALGVKATDGVVIAAKKKAPSTLVDASSIQKVFILDEHVGCTYSGMGPDCRVLIDSARKNCQQYRLMYNEPIPISQLVRKISALYQEFTQSGGVRPFGCSLLVAGVDANGYHLYQVDPSGTFWAWKATAIGTGSPDAKAFLEKRYTVDMELEDAVHTALLTLKEGFDGQMTSENTQVGRVVGNRFEVLSVDQLRDYLDQI

SEQ ID NO: 3436 - DNA, 753 bp, Leishmania donovani
  CDS (1)..(753)
atgaaccgcgcaggcttcgacaagtacattaccgtcttcagccctgagggctcgctgtaccaggtggagtacgcattcaaagccgtcacctaccctggcttgctcaccattgccattcgctgcaaggatgccgttctggtcgcaacgcagcacgtgattcccgaccgcctcatgcgccctgactcggtgacggcgctctacgaggtcactccgagcatcggctgctgcatgaccggtcgcgcccccgacgggcgcgcgctagtgcagcgcgcgcgagaggaagcgtcggattaccactaccgctacggtgtgcagattccaatcgctgtgctggcgaagcgcatgggcgacaaggcccaggtgcgcacgcaacaggccggcctgcggccgatgggtgtggtgagcaccttcatcggcatggatcagagtgaccaggatggctcgctgaagccgcagatttacaccgtcgacccggccggctggaccggtgggcacattgcatgcgctgttggcaagaagcaggtggaggcgatggcattcttggagaagcgccagaagagcaccaagtttgacgagctgacgcagaaggaggccgcgatgatcgcgctggcggcgctgcagagcgcgatcggcacggctgtcaaagcgaaagaggtggaggtgggccgctgcacagccgccaacccggcctttcagcgtgtgccgaatagcgaggttgaggagtggctgaccgccgtggccgaggcggattaa

SEQ ID NO: 3437 - protein, 250 aa, Leishmania donovani
MNRAGFDKYITVFSPEGSLYQVEYAFKAVTYPGLLTIAIRCKDAVLVATQHVIPDRLMRPDSVTALYEVTPSIGCCMTGRAPDGRALVQRAREEASDYHYRYGVQIPIAVLAKRMGDKAQVRTQQAGLRPMGVVSTFIGMDQSDQDGSLKPQIYTVDPAGWTGGHIACAVGKKQVEAMAFLEKRQKSTKFDELTQKEAAMIALAALQSAIGTAVKAKEVEVGRCTAANPAFQRVPNSEVEEWLTAVAEAD

SEQ ID NO: 3438 - DNA, 870 bp, Drosophila melanogaster
  CDS (1)..(870)
atgttccggaatcagtatgacaacgacacaaccacttggagtccgcagggtcgtctcttccaggtggagtacgcaatggaggcggtgaaacagggagcagccaccgtgggactcaagggcaccgactatgccgtgctggccgccctgtgccgcacctcaaaggacacgaacacgctccagcggaagatcatgccggtggatgaccacgtgggtatgtctatcgcaggactaacggcagatgcccgcgtggtgtgccagtacatgaggacggagtgcatggcatatcggcactcctataacgcagaatttccggttcgccgtttggtttccaatctgggtaacaagctgcagaccaccacccagcgctatgatcgtcgtccctacggtgtgggcttgctggtggctggatacgatgagcagggaccacatatctaccaggtgatgcccacggccaatgtgctcaactgcaaggcaatggccattggatctcgttcgcagagtgctcgcacatatctggagcgaaatatggagagtttcgaggactgcgacatggatgaactgatatgtcatgccattcaggccattcgaggatcgttgggttccgatgatgtcgagaatctcaccataaatgtggccattgtgggcaaggatgtgccgtttaaaatgtttacggaagccgagaaccagaagtatgtgaaattggtcaaggctatggatccacctctggaggcggaccacgatcctctatccgaggagggaatgagcgatgatgacatgacggaccacggaccgagtagcagtggagttccacccaatgatacatctgacatggaaaccactgcatccaccggcggcagtgacgcacattga

SEQ ID NO: 3439 - protein, 289 aa, Drosophila melanogaster
MFRNQYDNDTTTWSPQGRLFQVEYAMEAVKQGAATVGLKGTDYAVLAALCRTSKDTNTLQRKIMPVDDHVGMSIAGLTADARVVCQYMRTECMAYRHSYNAEFPVRRLVSNLGNKLQTTTQRYDRRPYGVGLLVAGYDEQGPHIYQVMPTANVLNCKAMAIGSRSQSARTYLERNMESFEDCDMDELICHAIQAIRGSLGSDDVENLTINVAIVGKDVPFKMFTEAENQKYVKLVKAMDPPLEADHDPLSEEGMSDDDMTDHGPSSSGVPPNDTSDMETTASTGGSDAH

SEQ ID NO: 3440 - DNA, 756 bp, Drosophila melanogaster
  CDS (1)..(756)
atggcccgtttcttcgattcccgcaccacgatcttttcaccggagggccgcctctatcaggtggagtatgcgatggaggccgcttcgcagtcgggcacatgcgtgggactcctggctaagaacggagtcctgttggccactgaacgaagcgttgacaagctcatggacaccagtattcctgtgccaagaatctcgtggttgaacgagaacattgcctgttgcgccacgggcaacacggcggatggtaacgtgctggttaaccaactgcgaatgatcgcccaacaatatcagttcaacttcggtgagatgattccttgcgagcagttggtcacgaacctttgcgatatcaaacaggcgtatacgcaatatggtggcaaacgacccttcggggtatcgtttctttacatgggctgggattgccgcttcgggtttcagttgtatcagtccgatcccagtggaaactacagtggctggaaggccacctgcattggccgcaagtcaggggcagccatggaaatgcttcagaaggaactatttagcaagggctacgtaagtccttcggtcgaggaggccaaggatgtagccatcaaggtcatgggcatgaccttgggcagagatagcttgacccccgaaaaactggaaattgctttcgtacagcgttacggtaacaccaccgtctttcatattttagaaaaaaacgagatccaccggctaatcgaaaggaataacaatttgaagaggcgcgtcgggtcgtaa

SEQ ID NO: 3441 - protein, 251 aa, Drosophila melanogaster
MARFFDSRTTIFSPEGRLYQVEYAMEAASQSGTCVGLLAKNGVLLATERSVDKLMDTSIPVPRISWLNENIACCATGNTADGNVLVNQLRMIAQQYQFNFGEMIPCEQLVTNLCDIKQAYTQYGGKRPFGVSFLYMGWDCRFGFQLYQSDPSGNYSGWKATCIGRKSGAAMEMLQKELFSKGYVSPSVEEAKDVAIKVMGMTLGRDSLTPEKLEIAFVQRYGNTTVFHILEKNEIHRLIERNNNLKRRVGS

SEQ ID NO: 3442 - DNA, 744 bp, Xenopus laevis
  CDS (1)..(744)
atgagctatgatagagcgatcactgtcttctccccggacggccacctcttccaggtggaatatgcacaggaggccgtcaagaaaggatccacggcggttggtgttcgtggcaaggaaattgtggttctaggagtggaaaagaaatctgtagcaaaactccaggatgagagaaccgtgcggaaaatttgtgccttggatgaaaacgtctttatggcttttgctggtctcacggctgatgctcgcattgttataaaccgcgctcgcgttgaatgccagagccacagactgacggtggaagatccggtaacggtggagtacattacacggtacattgccagcctgaagcagcgctatacgcagagtaacggacgccgtccttttgggatctcggctctgatcgtgggatttgactttgatggcactcctcgtctctaccagacagatccctctgggacgtaccacgcatggaaggctaatgccattggcagaggtgccaaatctgtgcgagaatttttggaaaaacactacactgatgaagccattgagacagacgacctgaccattaaattagtaatcaaggctttgcttgaggttgttcagtctggaggtaaaaacatagaactggcagttatgagacgagaccagccgctgaagatcctgaaccccgaggagattgagcggtacgttgccgaaatagagaaagaaaaagaggagaatgagaagaagaagcagaagaagacataa

SEQ ID NO: 3443 - protein, 247 aa, Xenopus laevis
MSYDRAITVFSPDGHLFQVEYAQEAVKKGSTAVGVRGKEIVVLGVEKKSVAKLQDERTVRKICALDENVFMAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKHYTDEAIETDDLTIKLVIKALLEVVQSGGKNIELAVMRRDQPLKILNPEEIERYVAEIEKEKEENEKKKQKKT

SEQ ID NO: 3444 - DNA, 753 bp, Mus musculus
  CDS (1)..(753)
atggcttctcggtatgacagggcaatcaccgtcttctccccagatggacaccttttccaagtggagtatgcccaggaagcagtgaagaaaggctccaccgcggttggaattcgaggaactaatatagttgtgcttggggtagaaaaaaagtcagtggccaagcttcaagatgaaaggactgtgaggaaaatctgcgctctcgatgaccatgtctgcatggcttttgcaggtctgacagcggatgctagagtggtgatcagcagagcgcgggtggagtgccagagccacaagctcacagtggaggatcccgtcactgtagagtatataactcgcttcatagcgacgctaaagcagaaatatacccagagcaatggacgaaggccttttggtatttcagccttaattgtaggctttgatgatgatggcatcccaagattgtatcagacagatccctccgggacttaccacgcttggaaagcaaatgcaataggccgaagtgctaaaactgtccgggaatttctggaaaaaaattacacagaagatgcaatttcaaatgacaaggaagctatcaaattagcaataaaagctttgctcgaagttgtccagtctggcggaaagaacattgaactggctataataagaagagatcaacctttgaagatgtttagtgccaaagaaattgaactggaggtgagtgaaatagaaagggaaaaggacgaagcagagaagacaaagtcaaagaagtcaacctaa

SEQ ID NO: 3445 - protein, 250 aa, Mus musculus
MASRYDRAITVFSPDGHLFQVEYAQEAVKKGSTAVGIRGTNIVVLGVEKKSVAKLQDERTVRKICALDDHVCMAFAGLTADARVVISRARVECQSHKLTVEDPVTVEYITRFIATLKQKYTQSNGRRPFGISALIVGFDDDGIPRLYQTDPSGTYHAWKANAIGRSAKTVREFLEKNYTEDAISNDKEAIKLAIKALLEVVQSGGKNIELAIIRRDQPLKMFSAKEIELEVSEIEREKDEAEKTKSKKST

SEQ ID NO: 3446 - DNA, 970 bp, Gallus gallus
  CDS (14)..(796)
cgtggttgcgaacatgcttcctgtggccggcagcgacgtgacggtgtggagcccccagggcaggattcatcaaatagaatatgccatggaagctgtgaagcaaggctcagccactgtggggctgaagtcgaaaacacacgctgttctggttgctctaaagcgagcacagtctgagctggcagctcatcagaaaaagatcctgtacgttgacaaccatatcggtatctcaattgctggacttacagctgatgcaagactcttgtgcaatttcatgcgtcaggagtgcctggattctagatttgtgtttgatagacctcttccagtatctcgtttggtgtcactaatcggaagcaaaacccagataccaacgcagcgctatggcagaagaccatatggtgtaggactgctcattgcaggttatgatgatatgggccctcacatcttccaaacttgtccctcagcaaactattttgactgtaaagcaatgtccattggtgctcgttcgcaatcagcacgaaattacctggaaagacacatgactgaatttactgattgtaatctaaacgagctagttaaacatggactgcgtgccctgagagagactcttcctgctgaacaggatctgaccaccaagaatgtttccatcgggattgttggcaaagacatggagttcacaatctatgacgacgatgacgtagcaccgttcctagaaggccttgaggagagaccgcagagaaagcctgctctgcctgctgatgagcctgcagagaaggcagaagagcccatggagcactaattggtggacgggttcctctctgctaccatacgtgttgcctggtaccgggagcttttatcagccagtggtaactttatcctcacctgtatgcctcttatgctgatacgttctgaggattgcttttaaaaatgaaataaaccgactcacctatccttaaaaaaaaaaaaaaaaaaa

SEQ ID NO: 3447 - protein, 260 aa, Gallus gallus
MLPVAGSDVTVWSPQGRIHQIEYAMEAVKQGSATVGLKSKTHAVLVALKRAQSELAAHQKKILYVDNHIGISIAGLTADARLLCNFMRQECLDSRFVFDRPLPVSRLVSLIGSKTQIPTQRYGRRPYGVGLLIAGYDDMGPHIFQTCPSANYFDCKAMSIGARSQSARNYLERHMTEFTDCNLNELVKHGLRALRETLPAEQDLTTKNVSIGIVGKDMEFTIYDDDDVAPFLEGLEERPQRKPALPADEPAEKAEEPMEH

SEQ ID NO: 3448 - DNA, 801 bp, Trypanosoma brucei rhodesiense
  CDS (1)..(801)
atgtttaaaaaccagtacgacacggataccaccacgtggagcccaaccgggaggttgtttcaagtggaatacgcaaatgaggcggtgaacaatggctccgctgcggttggagttaagggcgccgattatgtcgtactcacggccttgaaacgcaatcccgtgtcagggctatcatcctatcaagagaaggcattcaaattggatgagcacgttggcatggcaatcagtggcctcgtggcagacggccgtgcgctctctcgttttctacgtacagaatgtatgaattatcgctacatgcacgatagcgacgctccacttgttatgcttgctgacatagtgggcgcgaagcaccagcgccacattcaatttgcgggtaagcgtccctttggtgtcggtctcttaattgccggttatgatcgccaggggccacgcctttaccaaacggtgccctcaggtgatgtgtttgattttaaggcaaccgcgatggggttgcgttctcaggcagcacgtacctacttggagaggcactttagagggtttcccgcgtgtgatttggacgagttggttatgcatgcgttgagggctcttggcgcggcgacctctggtggtgtagaactgaacattaaaaacaccaccattgccattgtaggaaagggcaccccctttactattctcacggaagaagaggcgcgcaagtatctggatgggtttaagacgcgcccagaagacatccccgccgttgcagacaacgaagaggatgatgatgaattacacgagcaaccccctgacgttgaggagtga

SEQ ID NO: 3449 - protein, 266 aa, Trypanosoma brucei rhodesiense
MFKNQYDTDTTTWSPTGRLFQVEYANEAVNNGSAAVGVKGADYVVLTALKRNPVSGLSSYQEKAFKLDEHVGMAISGLVADGRALSRFLRTECMNYRYMHDSDAPLVMLADIVGAKHQRHIQFAGKRPFGVGLLIAGYDRQGPRLYQTVPSGDVFDFKATAMGLRSQAARTYLERHFRGFPACDLDELVMHALRALGAATSGGVELNIKNTTIAIVGKGTPFTILTEEEARKYLDGFKTRPEDIPAVADNEEDDDELHEQPPDVEE

SEQ ID NO: 3450 - DNA, 1199 bp, Trypanosoma cruzi
  CDS (47)..(844)
agagagagaaaaaaaaagaaaaagaagggaaaaagggaagtgtggtatgttcaaaaatcagtacgacaccaatacaactacgtggagccccacgggccggctgttccaggtagagtacgccaatgaggcggtgaacaacggctcggctgcggttggtgcgaagaataaagattttgttgtcttgactgccctgaagcgcagcccagtggcgcagttttcgtcctaccaggagaaggtgttcaagttggatgatcacgtcggtatggcaatagcgggtcttgtcgcggacggccgcatgttagcccgcttcgtgcgcacagaatgtatgaactatcgctatatgcacgacagcgataatcctttgccgctcatagcggaaattgttggagagaagtatcagcgccacattcagtttgcagggaagcggccctttggtgtgggtcttttaattgctggatatgacagcacagggcctcatttgtatcatacagtcccatctggagacgtatttgactttaaggcaacggccatgggtttgcgctcacaggctgctcgtacatatttggaaaagcactttgaatctttcccagactgtggccttgatgagcttattatgcatgcattgaaggcacttgcggcggcaacctcgggaggcgcggagctaaatataaagaatacaacgattgccatagtaggaaagggcacacctttcatggttctcacggaggaggcagcgcggaagtacttggatggttttaagatgcgtccagaggacattccccccgctccggaagctgaagaggaggaaactctgcaagaacgctccttggatgtggaggagtgagagagatcagcgccaacggatgtcaatgaaggcttttatgattactattattattatgattattatattttccccttgtttctttcattctccctatttttatttactttctcaccggagcgtgcacagagtgattcatccaaacggcatcttctccaaaaaaaacccaacaaaaaagaaaaagagggtatccaaaagtataaattatatatatacatatatatatatactgaacgttgggggattttgcacacaataaagatgagaattatgaaatattgaacgatttagaggggataaaaacgaatctgcagctcggaaggagtaaaatagcaacaaaaaaaaaaaaaaaaaa

SEQ ID NO: 3451 - protein, 265 aa, Trypanosoma cruzi
MFKNQYDTNTTTWSPTGRLFQVEYANEAVNNGSAAVGAKNKDFVVLTALKRSPVAQFSSYQEKVFKLDDHVGMAIAGLVADGRMLARFVRTECMNYRYMHDSDNPLPLIAEIVGEKYQRHIQFAGKRPFGVGLLIAGYDSTGPHLYHTVPSGDVFDFKATAMGLRSQAARTYLEKHFESFPDCGLDELIMHALKALAAATSGGAELNIKNTTIAIVGKGTPFMVLTEEAARKYLDGFKMRPEDIPPAPEAEEEETLQERSLDVEE

SEQ ID NO: 3452 - DNA, 1133 bp, Oryza sativa
  CDS (132)..(839)
aacgaacgacacgcgagtcggcggcgacaacaaatcgaaaatcgaacgggagaaattctctctgattctctctcgcgggcggcggaagcaatcgtagttagcagaggccggcgagcgagccgccaccggcgatgggcgacagccagtactccttctccctcaccaccttcagcccgtcggggaagctggtgcagatcgagcacgcgctgacggcggtcgggtccggccagacctccctcgggatcaaagctgctaatggagtagttattgccaccgagaagaagttgccttctattttagtggatgaaacatctgtgcaaaagattcagtcgttgactccaaatattggtgttgtctacagtggcatggggccagacttccgtgttttagtgaggaaaagtcgaaagcaagcacaacagtattatcgtctgtacaaggaaactatacctgttacacagctagtccgagaaactgctgctgtcatgcaggagtttacacaatctggtggtgtaagaccatttggtgtatctttgttgattgctgggtatgatgacaatggtccccaattgtaccaggttgatccatcagggtcatacttctcctggaaagcatcagctatggggaaaaatgtgtcaaatgcaaagacatttcttgagaaaagatacacagaagatatggagcttgacgatgccattcatactgctattttaactctgaaagaaggatatgaaggacaaatctccgccaacaacattgaaattgggataatccgatctgaccgtgaattcaaggttctgagccctgcagagatcaaggatttcttggaagaggtggaataatttgtctcaacaatctcatgtttcaaaccagtggacacctgagcagctgcctcgaagttatatcccctttcattcatgaactgattggcaccagtgacacgagacaaatgtttattcagattctcatgaatgaaaatgtgtttttaggaacgtatttgatttggcacggtgtcttctgtatcctcttgtgcccatcctagtctcctcggccagtgctacaactatttggcgtctccttacttttgtagtctgttttacttcttgccaaatgaagcacatgccatcttttgctct

SEQ ID NO: 3453 - protein, 235 aa, Oryza sativa
MGDSQYSFSLTTFSPSGKLVQIEHALTAVGSGQTSLGIKAANGVVIATEKKLPSILVDETSVQKIQSLTPNIGVVYSGMGPDFRVLVRKSRKQAQQYYRLYKETIPVTQLVRETAAVMQEFTQSGGVRPFGVSLLIAGYDDNGPQLYQVDPSGSYFSWKASAMGKNVSNAKTFLEKRYTEDMELDDAIHTAILTLKEGYEGQISANNIEIGIIRSDREFKVLSPAEIKDFLEEVE

SEQ ID NO: 3454 - DNA, 696 bp, Trypanosoma brucei brucei
  CDS (1)..(696)
atgtctgagtcttcgtacggtcttacaacattcagtccttccggaagacttgtgcagattgagtatgcaacgacggccgcctccaaagggacaacagccttaggtgtcaaggcaactgatggtgttgtcattgcagcagaaaagaaaacaacatcacccctcgctgactccttaacacttcataaagtgtttgctttggatgatcatgttggctgtacgtatagtgggattggtcctgattgccgcgtgcttgttgatgctgcccgacgcgcatgccagcgctaccgcctgacatatcatgagccaatgcctattagtcaactggttcgtcaaatcagtttcttatttcaagaattcacgcaatccggcggtgtccgtccgtttgggtgttctcttctcgttgccggggcggattctcgtggaaatcacctttatcaactggaccccagtggaaccttctggacgtggaaggcgacatctatcggcaaaggcagccccgatgcgagaacattcctcgagaaacggtacaccaatgaaatggaaattgaggacgccgtacacactgcgcttttgacactgaaggaggggtttgatgggagaatgacagctgaaaacacgcaagtgggtcgggtggttgaaggtcgctttgaactgcttacggtagagcagttgaaggattacctggaccaaatctaa

SEQ ID NO: 3455 - protein, 231 aa, Trypanosoma brucei brucei
MSESSYGLTTFSPSGRLVQIEYATTAASKGTTALGVKATDGVVIAAEKKTTSPLADSLTLHKVFALDDHVGCTYSGIGPDCRVLVDAARRACQRYRLTYHEPMPISQLVRQISFLFQEFTQSGGVRPFGCSLLVAGADSRGNHLYQLDPSGTFWTWKATSIGKGSPDARTFLEKRYTNEMEIEDAVHTALLTLKEGFDGRMTAENTQVGRVVEGRFELLTVEQLKDYLDQI

SEQ ID NO: 3456 - DNA, 858 bp, Dictyostelium discoideum
  CDS (52)..(798)
tttttttatttttttttttttttcataaatatttatatataacaatataaaatgtctagtgtaggatcaggttatgatttatatgtatcaacatattcaccagatggtaaattatttcaagtagattatgcaaataaagccgttgaaaatagtggtacactcgtcgcaattaaagcaaaagatggtgttgttttaggtgttgaaaaattagtcccatcaaaaatgttatgttcaggttcaaatcgtagagttcatcatattgacactcatgttggtgttgcaattgcaggatttttagcagatgcaagacaattgattacacgtgctagaagtgaagcaaaaaattataaatcaacctatggtcaaccaattccaattaaagtattatcacaaagaattgcatcatacaatcatatgcatacattatatggtagtgttagaccatttggttgttcaattgcaatcactggtattgatcaatatggtccacaactctttttagttgaaccatctggttcttgtgttggttatttcggtgcttcacttggtaaaggtaaacaagctgcaaagaatgaattagaagagattagattttcagaaatgacttgtcgtgaagcaattaaagaagtttcaagaattatttactctgttcatgatgaagttaaagataaagattttgaattagaattaggttggatttcaacagaaacagacaatgttcaccaaatcgttccaaaagaattacacgatgaaggtgaggcttatgctaaacaatctttagaagatgccaatatgtaaatttttccaataaataaataaaaaaataaataaaaaaaaaaaaaaaattgaaatactata

SEQ ID NO: 3457 - protein, 248 aa, Dictyostelium discoideum
MSSVGSGYDLYVSTYSPDGKLFQVDYANKAVENSGTLVAIKAKDGVVLGVEKLVPSKMLCSGSNRRVHHIDTHVGVAIAGFLADARQLITRARSEAKNYKSTYGQPIPIKVLSQRIASYNHMHTLYGSVRPFGCSIAITGIDQYGPQLFLVEPSGSCVGYFGASLGKGKQAAKNELEEIRFSEMTCREAIKEVSRIIYSVHDEVKDKDFELELGWISTETDNVHQIVPKELHDEGEAYAKQSLEDANM

SEQ ID NO: 3458 - DNA, 997 bp, Drosophila melanogaster
  CDS (96)..(857)
ccaagtaaaagccgtcaaatcatcgtcgcattcgacccaaggaattaaactaatttttgcgtttgaattgtttaaattttcacaaagtcttcgctatgagtactattggcactggatacgacttgtcggcctcgcagttttcgcctgatggccgcgttttccagatcgactacgcctcaaaggcggtggagaagagcggcaccgtaatcgggattcggggcaaggacgccgtggtgctggccgtggagaagatcatcaccagtaaactgtacgaaccagacgccggcggacgcatcttcaccatcgaaaagaacatcggaatggcggtggccggcttggtggccgatggaaactttgtggctgacattgcgcgtcaggaggcagccaactacagacagcaatttgagcaggctatcccgcttaaacacctgtgccaccgagtcgccggctacgttcacgcctacactctgtacagtgccgtccgccccttcggactttccatcattctcgcctcctgggacgaagtagaggggccacagctctacaagatcgagccgtccggctcctccttcggttacttcgcctgcgccagcggcaaggccaagcagctggccaagactgagatggagaagctcaagatggatatgaggaccgacgaattggtggagagcgctggtgaaatcatctacaaagtccatgacgagttgaaggacaaggacttccgcttcgaaatgggtttggtgggcagggtaaccggtggcctacatctcataaatccctcagaactgacggagaaggcgaggaaagccggcgatgcggccaacaaggacgaagacagcgacaatgagacgcactagttcgtttgtgtgccagtgaatctaattctgggcctcatacataatgttaattttatatttccctaaagcgcaaaatgaataaacaaaatcgggtgaaaaaaaaaaaaaaaaaaaaaaaaaaaaaaaaaaaaaaaaaaaaa

SEQ ID NO: 3459 - protein, 253 aa, Drosophila melanogaster
MSTIGTGYDLSASQFSPDGRVFQIDYASKAVEKSGTVIGIRGKDAVVLAVEKIITSKLYEPDAGGRIFTIEKNIGMAVAGLVADGNFVADIARQEAANYRQQFEQAIPLKHLCHRVAGYVHAYTLYSAVRPFGLSIILASWDEVEGPQLYKIEPSGSSFGYFACASGKAKQLAKTEMEKLKMDMRTDELVESAGEIIYKVHDELKDKDFRFEMGLVGRVTGGLHLINPSELTEKARKAGDAANKDEDSDNETH

SEQ ID NO: 3460 - DNA, 1188 bp, Oryza sativa
  CDS (255)..(1004)
ggagtgaaaaaaaaaaaccccaaaagaaagaaatctccttctctctctcgatcccgtctcgtctcgtcagtctgcacccggttgcctccccgccgctctcctctccggtctactcctccgccgtcgccgtcggcaccgccgccggagctcctccctgctccctctactgggttggcggggagtggatcggggatctgcacgcaggggccgatttcttctcttcgtaaggagtagataacacagaatagttgaagatgagcagcataggcacaggatacgatctgtccgttaccaccttctctccggatggtcgcgtcttccaggttgagtatgccacgaaggctgtcgacaacagcgggactgttgttggaatcaaatgcaaagatggaatcgtcctgggtgtggagaagctagtaacttcgaagatgatgctggagggatctaataggaggatccattcagtgcactggcactctggcttggctgttgctggtttagctgcagatggcaggcaaattgtttcaagagcaaaatcggaagcggccagttatgagaaggtctatggtgaacccatttctgtaaaagaattggctgatcgtgtggctagctacgttcatctttgtacactctactggtggctcaggccttttggttgtggagttattcttggaggttatgatagggatgggccacagctctacatgatcgaaccctcaggagtctcatacaaatactttggtgctgctctgggtaaaggaagacaggctgcaaaaactgaaatagagaagttgaagctttccgagcttacctgccgggaaggcattgtggaggttgcaaagatcatttatggagtacatgatgaagctaaggacaaagcttttgagttggaattaagctggatatgtgatgaatcaaatcgccagcatcagaaggttcctgctgatcttttggagcaggccaaggttgcagctcaggcagcgcttgaggagatggatgctgattaagaggagacccgactatgttctacgtttggccactgatgaaatctttgatgtcattactggcacacagggacatggccattctgtcggattttaaaacttcgcatgtacttatggtactaaattcatggaaagtttgatgctggacagtgaatggatatctgacttttgactgaacttgtccctt

SEQ ID NO: 3461 - protein, 249 aa, Oryza sativa
MSSIGTGYDLSVTTFSPDGRVFQVEYATKAVDNSGTVVGIKCKDGIVLGVEKLVTSKMMLEGSNRRIHSVHWHSGLAVAGLAADGRQIVSRAKSEAASYEKVYGEPISVKELADRVASYVHLCTLYWWLRPFGCGVILGGYDRDGPQLYMIEPSGVSYKYFGAALGKGRQAAKTEIEKLKLSELTCREGIVEVAKIIYGVHDEAKDKAFELELSWICDESNRQHQKVPADLLEQAKVAAQAALEEMDAD

SEQ ID NO: 3462 - DNA, 753 bp, Caenorhabditis elegans
  CDS (1)..(753)
atggcccgtcgttacgatagtagaacgaccatcttctctccggagggaagactgtatcaagtcgaatatgctatggaggctatcagccatgctggaacttgcctcggcattctctcatcggaaggaatcgtcgttgctgctgagagaaagaacgttcacaagttgctggatgattctgtcatgactgaaaaggtctaccgtctttcggacaacatctcgtgcactgtcgctggtatcaccgccgacgcgaacatcctcatcaaccacttgagatggtgggctgccagctatcgtaacagttacggagaggaaatgccagttgagcagctcgtccagaatctttgcaatgaaaagcagagatacacgcagattggaggaaagagaccgttcggagtgtcacttctctatatcggatgggataagcactacggatatcaactttaccaatctgatccttccggaaactacactggatggaaggcaacctgcatcggaagcaaccaccaggctgccgtaaccttgttgaaacaggagtacaaatccccaaatcttgaagaagcaaagcagttggctatcaaggttctctggaagactttggatgtgaagctcgcttccgagaaagttgagatggctgttttgactcgtcgtgatggaaagactgtgctcgaagagctcaccaccaaggaagtcgatgctctgattgctgagcacgagaagaaagaaaaggaagctgagactgctgagaagaagtaa

SEQ ID NO: 3463 - protein, 250 aa, Caenorhabditis elegans
MARRYDSRTTIFSPEGRLYQVEYAMEAISHAGTCLGILSSEGIVVAAERKNVHKLLDDSVMTEKVYRLSDNISCTVAGITADANILINHLRWWAASYRNSYGEEMPVEQLVQNLCNEKQRYTQIGGKRPFGVSLLYIGWDKHYGYQLYQSDPSGNYTGWKATCIGSNHQAAVTLLKQEYKSPNLEEAKQLAIKVLWKTLDVKLASEKVEMAVLTRRDGKTVLEELTTKEVDALIAEHEKKEKEAETAEKK

SEQ ID NO: 3464 - DNA, 826 bp, Dictyostelium discoideum
  CDS (43)..(795)
tttttttttttttttttcacttaatatatatataatcacaaaatggcaagaagatatgatcaaagaacaacaattttttcaccagaaggtcgtgtttatcaagtagaatatgcaatgacagcaattagacatgcaggtgcaacagttggtattttagcaaaagatggtattgttttagcagcagagaaaaagaccacagcaaaacttttagattcatcaacatcaatctctgaaaagatgtttaagattgatgaacatgttgtttgtgcagtcgctggtatcacatccgatgccaacattttaatcaattatgcaagattatcatcacaacgtttcttttatcaatatcaagaaccaatgccagtcgaacaattggtctctcaaatttgtgatacaaaacaaggttacactcaatatggtggtttacgtccatttggtgtctcattcctttatgctggttgggatcgtcattatggtttccaattatatcaatctgatccttctggtaattttgctggttggaaagctacctcaattggtggtgaaaatagtcaagttgcacaatcagttttaagatcaaattataaaccagatatttcattaaaagaagcccttcaattggctctcaaagttttaacaaaaactatggatcgttcaaatatcaacagtgaaaaattagaattctcttatttcactaaacaaggtgacaatgttgtttatcatatttttactgcagcagaattagatgctttcattaaagaaactgatctcgaacaagaaactgaagataattaaaaaaataaaataaaaaaaaaaaaaaaaaaac

SEQ ID NO: 3465 - protein, 250 aa, Dictyostelium discoideum
MARRYDQRTTIFSPEGRVYQVEYAMTAIRHAGATVGILAKDGIVLAAEKKTTAKLLDSSTSISEKMFKIDEHVVCAVAGITSDANILINYARLSSQRFFYQYQEPMPVEQLVSQICDTKQGYTQYGGLRPFGVSFLYAGWDRHYGFQLYQSDPSGNFAGWKATSIGGENSQVAQSVLRSNYKPDISLKEALQLALKVLTKTMDRSNINSEKLEFSYFTKQGDNVVYHIFTAAELDAFIKETDLEQETEDN

SEQ ID NO: 3466 - DNA, 753 bp, Oryza sativa
  CDS (1)..(753)
atgtctcgccggtacgacagccgcacgacgatcttctcgccggaggggcggctctaccaggtggagtacgcgatggaggcgatcgggaacgcagggtcggccctgggcgtcctggcggccgacggcgtggtcctcgtcggcgagaagaaggtcacctccaagctcctccagacctcgcgctccgccgagaagatgtacaagatcgactcccacctcgcctgcgccgtcgccgggatcatgtcggacgccaacatcctcctcaacacggcgcgcctccacgcccagcgctacgccctctcctaccaggagcccatccccgtcgagcagctcgtccaatccctctgcgacaccaagcaggggtacacccagttcggcggcctccgccccttcggcgtctccttcctcttcgccggctgggacaagcaccatggcttccagctctacatgagcgacccctccggcaactacagcggctggaaggccgccgccgtcggggccaacagccaggcggcgcagtccatgctcaagcaggactaccgcgacgggatgacacgggaggaggccgtcgccctcgccctcaaggtgcttagcaagaccatggattcgaccagcttgaccgccgagaagctggagctcgccgaggtgttcttgcagcccggcaccggggaggtgcagtaccaggtgtgctcgcctgaggcgatggggaagctgctcgccaaggccggcctctcgcagccggcgcctgaggcttga

SEQ ID NO: 3467 - protein, 250 aa, Oryza sativa
MSRRYDSRTTIFSPEGRLYQVEYAMEAIGNAGSALGVLAADGVVLVGEKKVTSKLLQTSRSAEKMYKIDSHLACAVAGIMSDANILLNTARLHAQRYALSYQEPIPVEQLVQSLCDTKQGYTQFGGLRPFGVSFLFAGWDKHHGFQLYMSDPSGNYSGWKAAAVGANSQAAQSMLKQDYRDGMTREEAVALALKVLSKTMDSTSLTAEKLELAEVFLQPGTGEVQYQVCSPEAMGKLLAKAGLSQPAPEA

SEQ ID NO: 3468 - DNA, 890 bp, Petunia hybrida
  CDS (52)..(801)
ttgcacttctcttagatctcacttttcaggtgtacttcagttgagaacaaaatgtcacgaaggtatgatagccgtacaacaatcttctcccctgaaggtcgtctctatcaggttgagtatgcgatggaggctattggaaatgcaggcagtgctataggcatctcgtctaaggatggggtggtactggtaggcgaaaagaaagtaacatctaagctgcttcagacctcaacatcaagtgagaagatgtacaagatcgatgatcatgtggcatgtgccgtagctggaattatgtctgatgccaacattctaatcaacactgccagggtccaggctcagcgctatacattctcgtatcaagaacccatgccagtcgaacaacttgttcagtcactatgtgacaccaagcaaggttacacacagtatggtggactccccccttttggtgtttcatttctctttgcaggttgggataaaaattttggcttccagcttttcatgagcgacccaagtggaaattatgctggttggaaagcggcagcaattggagcaaacaaccaggcagctcaatcaatgcttaagcaggattacaaggatgatattacaagggaagaggctgttcaacttgctcttaaagtgcttagtaagacaatggacagcactagtctcacttcagagaaacttgaacttgctgaggtatttctctctaacgggaaagtcaagtatcaggcatgctcacctgagaaactgaatagcatgttggtgaagtctggactgacccaaccttcagcagaagaatcatagaaagtatctttcatcaggatttgatatccatgagactctttacaccatctgttgcatgttgtactaatttaagtgaaaaaaaaaaaaaa

SEQ ID NO: 3469 - protein, 249 aa, Petunia hybrida
MSRRYDSRTTIFSPEGRLYQVEYAMEAIGNAGSAIGISSKDGVVLVGEKKVTSKLLQTSTSSEKMYKIDDHVACAVAGIMSDANILINTARVQAQRYTFSYQEPMPVEQLVQSLCDTKQGYTQYGGLPPFGVSFLFAGWDKNFGFQLFMSDPSGNYAGWKAAAIGANNQAAQSMLKQDYKDDITREEAVQLALKVLSKTMDSTSLTSEKLELAEVFLSNGKVKYQACSPEKLNSMLVKSGLTQPSAEES

SEQ ID NO: 3470 - DNA, 888 bp, Drosophila melanogaster
  CDS (68)..(802)
tcatttcagcgtcaagtcatccggcatttgtttgcgattttgttaaggaaattatagaaaacccaccatgtttctcacgcgttccgagtacgacagaggcgtgaacaccttctcgccggagggccgcctcttccaagtggaatatgccattgaggccatcaaattgggctccacagcaattggaatttgcacgccagaaggagtggttttggcggtggagaagcgcatcacttcgccgctaatggtacccagtactgtggagaagattgtggaggtggacaagcacattggttgcgccacctccggcttgatggccgatgccaggactctgatcgagagggcacgcgtggagtgccagaaccactggttcgtctacaacgagcgcatgtccatcgagtcctgcgcccaggctgtgtccactttggccatccagttcggtgatagtggcgacagcgatggtgccgccgccatgagtcgtccctttggtgtggccattctatttgccggcatcgaggcgggacaaccccagttgtggcacatggatccctccggcacattcgtgcgccacggagccaaggccattggctcgggcagcgaaggtgctcagcagaatctgcaggacttatttagacccgatttgactctcgatgaggctatcgacatttcgctcaacacacttaaacaggttatggaggagaaactaaactccaccaatgtggaggtgatgaccatgacgaaagaaagagagttctacatgttcaccaaggaggaggtggagcagcacattaagaacattgcgtaagcggcagtggttttaaattgatctaatttcaaatgtaatgtgaataaagaaagggattctaaatcgaaaaaaaaaaaaaaaaaaaa

SEQ ID NO: 3471 - protein, 244 aa, Drosophila melanogaster
MFLTRSEYDRGVNTFSPEGRLFQVEYAIEAIKLGSTAIGICTPEGVVLAVEKRITSPLMVPSTVEKIVEVDKHIGCATSGLMADARTLIERARVECQNHWFVYNERMSIESCAQAVSTLAIQFGDSGDSDGAAAMSRPFGVAILFAGIEAGQPQLWHMDPSGTFVRHGAKAIGSGSEGAQQNLQDLFRPDLTLDEAIDISLNTLKQVMEEKLNSTNVEVMTMTKEREFYMFTKEEVEQHIKNIA

SEQ ID NO: 3472 - DNA, 744 bp, Entamoeba histolytica
  CDS (1)..(744)
atgtttatgactaaaaatgaaaacgatcatggtgttaataccttttcatctgaaggaagattgttccaagttgagtatgctacagaagcaatgaaattaggatcaaccgttattggtattcaaacaaaagaaggtgttgtccttgctgtagaaaaacgaatttcatcaccattaatgcttggaagtagtattgaaaaaattattgaaattgatgatcatattggagcagctgttagtggactaactgctgatgcacgtacattaattgacaatgctagacttgaagcacaaaatcatagatttatgtatgatgaaccaataaatgtagaagttgttgctcaagccatttcagatctttctttaagatttggagaaggatcaagaaagaaaaaagtcatgagtagaccatttggtgttgcattattaattgcaggtgttgatgaaactggtccaagacttttccaaactgatccaagtggaatgtttattgaattttatgccaaagccacaggagcaggaacagaagctgcacaatcaattttacatgaaaaatataataaatcgatgacattaagagaagcagaaatacttgcattatcaacattaaaacaagtaatggaagaaaaattaaattctaagaatgtagaagtagcgttagttacagtagaaaagaagaaatttgaaattatggatactgcatttattgaaaatttaattggagaaatcaaagaagaattaatttaa

SEQ ID NO: 3473 - protein, 247 aa, Entamoeba histolytica
MFMTKNENDHGVNTFSSEGRLFQVEYATEAMKLGSTVIGIQTKEGVVLAVEKRISSPLMLGSSIEKIIEIDDHIGAAVSGLTADARTLIDNARLEAQNHRFMYDEPINVEVVAQAISDLSLRFGEGSRKKKVMSRPFGVALLIAGVDETGPRLFQTDPSGMFIEFYAKATGAGTEAAQSILHEKYNKSMTLREAEILALSTLKQVMEEKLNSKNVEVALVTVEKKKFEIMDTAFIENLIGEIKEELI

SEQ ID NO: 3474 - DNA, 1188 bp, Oryza sativa
  CDS (194)..(907)
ggcatgtaagtggcacgccgcatcgtccctctcgtctcggcttggtccgcaagaagaacaacaccgcgagagtaaaagcaccccctcctcttcgtctcggctttcggagctctcgatactttagccgcgattcggagggaaaccctagctagctcccgctctcgatcccgcgcccgccaccgcactcggcaagatgttcctcacgaggacggagtacgaccgcggggtgaacaccttctccccggaggggcggttgttccaggtcgagtacgccattgaggccatcaagttggggtcaactgcgatcgggttgaagaccaaggatggtgttgtccttgctgtagagaaacgtgtgacctcgccactgctggaaccaagcagtgtggagaaaatcatggaaattgacgagcacataggctgtgccatgagtggccttattgctgatgctagaacattggttgagcatgctcgtgttgaaacccagaatcataggttctcatatggggagccaatgacagtagaatctactacacaagctatctgtgacttagctctgcgttttggtgaaggtgatgaagagtcgatgtcacgaccatttggtgtctctctccttattgctggtcatgatgagaatggacccagcttgtactacactgacccatcaggaaccttttggcagtgcaatgccaaggcaattggatcaggttctgaaggagctgatagctcattacaggagcagtacaataaggagttgacccttcaggaggctgagaccatagccctgtctatcttgaagcaggttatggaagaaaaggttactccaaacaacgtcgatatcgcaaaggtttctcccaactaccacctctacacccctgcagaggttgaagctgtcattgcacggttgtgagaagattgccatcgcgtgttattttaatcagccctaagacagcctctgtatgaacttcctaaatggattatcagtccattgtttgctatggctgtcatgttatgttaacaagatagtggctgctagagtttattactggctctaatagtctggtgtgcagcccagtcatttgcttgttttcagcagtgttgagaccatgtactatcaaaaagagaacgacaatcctttccaagatttggttgcaacatttcgacagtcatcttgatcttcggtttcttccc

SEQ ID NO: 3475 - protein, 237 aa, Oryza sativa
MFLTRTEYDRGVNTFSPEGRLFQVEYAIEAIKLGSTAIGLKTKDGVVLAVEKRVTSPLLEPSSVEKIMEIDEHIGCAMSGLIADARTLVEHARVETQNHRFSYGEPMTVESTTQAICDLALRFGEGDEESMSRPFGVSLLIAGHDENGPSLYYTDPSGTFWQCNAKAIGSGSEGADSSLQEQYNKELTLQEAETIALSILKQVMEEKVTPNNVDIAKVSPNYHLYTPAEVEAVIARL

SEQ ID NO: 3476 - DNA, 966 bp, Glycine max
  CDS (14)..(727)
ggcacgagggaagatgtttctcacaaggactgagtatgaccgaggagtcaacaccttttctcccgaaggccgtttgtttcaggttgagtatgcaatcgaagccatcaagctgggatcaactgcgattgggttgaagaccaaagaaggagttgtccttgcagttgaaaagcgcatcacatcgccgctcctggagcctagtagtgttgagaaaattatggaaattgatgagcacatcggttgtgcaatgagtgggttgattgcagatgctcgaacacttgttgagcatgcacgggtggaaactcagaatcacaggttctcctatggtgagcctatgactgttgagtccaccacccaagctctttgtgatctagccttgcgttttggtgaaggtgatgaagagtccatgtcccgaccatttggagtatctctcctcattgctggtcatgatgagaatggacctagcttatactacactgatccatctggcacattttggcaatgcaatggcaaagctattggttcagggtcagaaggtgcagacagttctctacaagaacaattcaacaaggacctaacccttcaagaagccgagactattgctttatccattttgaagcaagttatggaagaaaaggtcactcccaacaacgttgacattgccaaggtggctccaacgtatcatctttatacaccgtctgaggtggaagctgtgataagtcgtttatgattatctctattcagcattgtttcctatccttcctgccgtacgtctaattatttagtatcatggggaacttcttgtggatgatgctacacttgtggcaaagttgtatactgtacgagattctggtgttatatttgcatttagtctagttgaaattgaggactaaaaaggcttcaatggttgggaaaatttagaactattacccgattgggggaggcaatgaagggaaaaaagatttacac

SEQ ID NO: 3477 - protein, 237 aa, Glycine max
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNGKAIGSGSEGADSSLQEQFNKDLTLQEAETIALSILKQVMEEKVTPNNVDIAKVAPTYHLYTPSEVEAVISRL

SEQ ID NO: 3478 - DNA, 741 bp, Trypanosoma brucei brucei
  CDS (1)..(741)
atgttctcctccaaaaccgagtatgaccgtggcgttaacacctttagcccagagggtcgcattttccaaattgaatacgccatcgaggcaatcaagttgggaagcacaagcttgggaattcaaacccccgatgctgttatcattgctgccgagaagcgggtgccatcaacactggttgatccgtcaagtgtaaataagatcctggaaatcgatcatcatatcgggaccgttcttagtggcatggtggcggatgcgagaatacttgtggaccatgcgcgtgtggaggcacaaaatcaccgtttcacctatgatgagccgatgagcgttgaatcgtgtgccttggcgacgtgcgacctgtcagttcagtttggtgaaagcgggggacggaagaaactcatgtcgaggcccttcggtgtctcattattgattgccggtgttgacgaaaacggaccccagctttggcaaacagaccccagcggcacttatacacgttacgatgctcaagcaatcggtggtggtgccgaggctgctcaaaccgttttcagtgagcgttatcatcggaacatgacagttgaggaggcagaaaatctcaccgtgcagattttacggcaggtgatggaagagaagctaacgaagaccagcgttgaaattgcaattgttccggtttccactgggcggcttcaaatatatgaccaggaacagatacagcggatcattgatcggcaggccgaggaaaattaa

SEQ ID NO: 3479 - protein, 246 aa, Trypanosoma brucei brucei
MFSSKTEYDRGVNTFSPEGRIFQIEYAIEAIKLGSTSLGIQTPDAVIIAAEKRVPSTLVDPSSVNKILEIDHHIGTVLSGMVADARILVDHARVEAQNHRFTYDEPMSVESCALATCDLSVQFGESGGRKKLMSRPFGVSLLIAGVDENGPQLWQTDPSGTYTRYDAQAIGGGAEAAQTVFSERYHRNMTVEEAENLTVQILRQVMEEKLTKTSVEIAIVPVSTGRLQIYDQEQIQRIIDRQAEEN

SEQ ID NO: 3480 - DNA, 735 bp, Drosophila melanogaster
  CDS (1)..(735)
atgtctcgcggaagttcagccggctttgacagacacatcacgatcttctctccggagggacgcctctaccaagtggagtacgccttcaaggctattgcccaggagaacatcaccacggtggcgctgaagagtggcgactgtgccgtggtggccacccaaaaaaaagtgaccgagaagaacatcgtgcctgaaacggtgacccacctgttccgcatcaccaaggacattggatgcgcaatgaccggacgcatagctgattcccgctcacaggtgcagaaggccagatacgaggccgccaacttccgctacaagtacggctacgaaatgcccgtggatgtgctgtgtcgtcgaattgcggatatcaaccaggtgtacacgcagaatgccgagatgcgtccgctcggctgcagcatggtgctgatcgcttacgacaatgaaatcggccccagcgtttacaagacggacccggctggctacttcagcgggttcaaggcctgcagcgtgggtgccaagactctggaggccaacagctatctggaaaagaagtacaagcccaacttgtcggaggagaaagcgatccagctggccatctcctgtctgtccagtgtgctcgctatagacttcaagccgaacggcattgagatcggcgtggtcagcaagtctgatcccactttccgtattttggatgagcgggagatcgaggaacacctcaccaagatcgccgagaaggactaa

SEQ ID NO: 3481 - protein, 244 aa, Drosophila melanogaster
MSRGSSAGFDRHITIFSPEGRLYQVEYAFKAIAQENITTVALKSGDCAVVATQKKVTEKNIVPETVTHLFRITKDIGCAMTGRIADSRSQVQKARYEAANFRYKYGYEMPVDVLCRRIADINQVYTQNAEMRPLGCSMVLIAYDNEIGPSVYKTDPAGYFSGFKACSVGAKTLEANSYLEKKYKPNLSEEKAIQLAISCLSSVLAIDFKPNGIEIGVVSKSDPTFRILDEREIEEHLTKIAEKD

SEQ ID NO: 3482 - DNA, 1048 bp, Oryza sativa
  CDS (114)..(854)
gatttttggtttattttgcctccccaaccaagcacaaacacaagcctcgccgtattctctcggagcaaagcgaacgcgaaaccccacccgcggcggcgagaaatccggcgacgatgagccgcggcacgggcgccggctacgaccgccacatcaccatcttctccccggagggccgcctctaccaagtcgagtacgcgttcaaggcggtgaagtcggcgggggtgacgtcgatcggcgtccgcggcaaggactccgtctgcgtcgtcacacagaagaaagtgccggacaagttgctggaccatacgagcgtcacgcacttgttcccgatcaccaagtacatcggtctgctcgccactggcctcacagctgatgcaaggtccttagtctaccaagcaaggaatgaggcagctgaattccgtttcaaatggggctacgagatgcccgtagacgtattagcaaaatggatagcagacaaagcacaagtctacacgcagcatgcctacatgaggccccttggagtagttgctatggtcttgggctatgacgaagagaaaaacgctcaactattcaaatgtgacccggcaggtcacttctttggacataaggcaactagcgccggtcttaaggagcaggaagcaataaattttctggagaagaaaatgaaggatgacccacagttctcctacgaggaaactgtccagattgcaatttctgcattgcaatcagttcttcaggaagatttcaaggccaccgagattgaggtcggtgttgtgaggaaagatgatcgtgttttcagagcactcacgacagaggagatcgatcagcacctaacagccataagtgagcgcgactgagctacaatgaagttggacatgttactgcttcacactgcactctagtctttcagcagtgtcattttatttcatgttcagccaagaaacattcagtgaaccatttcatgtaactccaaaaaacagtcatcagctttacttgttggatcatcctctatcgttgtggttgaatttactacgatttacttgtatgctgc

SEQ ID NO: 3483 - protein, 246 aa, Oryza sativa
MSRGTGAGYDRHITIFSPEGRLYQVEYAFKAVKSAGVTSIGVRGKDSVCVVTQKKVPDKLLDHTSVTHLFPITKYIGLLATGLTADARSLVYQARNEAAEFRFKWGYEMPVDVLAKWIADKAQVYTQHAYMRPLGVVAMVLGYDEEKNAQLFKCDPAGHFFGHKATSAGLKEQEAINFLEKKMKDDPQFSYEETVQIAISALQSVLQEDFKATEIEVGVVRKDDRVFRALTTEEIDQHLTAISERD

SEQ ID NO: 3484 - DNA, 1035 bp, Nicotiana tabacum
  CDS (69)..(809)
cggcacgagtctggatcaagcaatcagatcgaactgaaaaacaaaaaagtaaatctagcaatctaaaaatgagtagagggagtggaggcggctacgatcgtcacattacgatcttctctcccgaaggtcgtctctttcaagtcgaatatgcgtttaaggctgtgaaggcggccggaattacctctattggcgtccgtggaaaggactccgtttgtgttgttactcagaagaaagtccctgacaagctattggatcagaccagtgtatcccacttgttcccgattaccaagtatcttggactattggctactggcatgacagcggatgcgagaaccttggttcaacaagctcgaaatgaagctgctgagtttcgttttaaatatggatatgaaatgccagtggatgtactgtctaaatggattgcagacaagtctcaggtttacacacagcatgcctatatgagaccccttggagtagttgctatgattttgggcattgatgaggagaaaggaccccagctcttcaagtgtgaccctgctggtcatttttttggtcataaggctacaagtgctggatctaaagaacaagaggcaattaattttttggagaagaaaatgaaaaatgaccctgctttctcctatgaggaaactgttcagactgcaatttctgctcttcaatctgtcctgcaagaggattttaaggccagtgaaattgaggttggtgttgtgaagaaagaagatcccatcttcagagtgttaactaccgaggaaattgacgagcacttaacggccatcagtgagcgtgactaattagccacaggatagtctgtttcagttagaaatgtatgttcgctatctggacttgtaagatcccatatgattgtccttctgcatatgctgataatgagtttcaaattattgaatgtaacatttctcgggatcatcctattttcacaaaaatgttgaatgcaactgcgcgggattatatttatatttcatgctgaatttcacgtgcttcaaaaaaaaaaaaaaaaaa

SEQ ID NO: 3485 - protein, 246 aa, Nicotiana tabacum
MSRGSGGGYDRHITIFSPEGRLFQVEYAFKAVKAAGITSIGVRGKDSVCVVTQKKVPDKLLDQTSVSHLFPITKYLGLLATGMTADARTLVQQARNEAAEFRFKYGYEMPVDVLSKWIADKSQVYTQHAYMRPLGVVAMILGIDEEKGPQLFKCDPAGHFFGHKATSAGSKEQEAINFLEKKMKNDPAFSYEETVQTAISALQSVLQEDFKASEIEVGVVKKEDPIFRVLTTEEIDEHLTAISERD

SEQ ID NO: 3486 - DNA, 778 bp, Cicer arietinum
  CDS (29)..(778)
gaaaaagaagcacaacaaaaatatcaatatggcgaggtacgatagagctatcacagttttttctcccgatggtcatcttttccaagtcgagtacgccctcgaagccgttcgtaaaggtaacgctgccgttggtgtacgtggtaccgataatgtcgttctcggcgtcgagaagaaatccaccgccaaactccaggacactagatcagtaaggaagattgttaatctggatgatcacattgcccttgcttgtgctggactaaaagccgatgcccgtgtccttattaaccgggcacgagttgaatgtcaaagtcacaggcttactgttgaggatcctgtcactgtcgagtatataacccgttacattgcaggtcttcagcagaagtacacacaaagtggcggtgttcgaccctttggcctatcaaccttgattgttggatttgatccatacactgggtcaccatccctgtaccaaacagacccttctggtaccttttcagcttggaaagctaatgcaactggaagaaactcaaattcaatccgtgagtttctagagaaaaactttaaagaaacttctggtcaagaaactgtcaaattggcaatccgggcattgcttgaagttgttgagagtggaggcaagaacattgaagttgctgtgatgaccaaggagaatggtcttcgtcaattagaggaagctgaaattgatgccattgttgctgagattgaagcagagaaagcagctgctgaggctgcaaagaaagctcctcctaaggatacatga

SEQ ID NO: 3487 - protein, 249 aa, Cicer arietinum
MARYDRAITVFSPDGHLFQVEYALEAVRKGNAAVGVRGTDNVVLGVEKKSTAKLQDTRSVRKIVNLDDHIALACAGLKADARVLINRARVECQSHRLTVEDPVTVEYITRYIAGLQQKYTQSGGVRPFGLSTLIVGFDPYTGSPSLYQTDPSGTFSAWKANATGRNSNSIREFLEKNFKETSGQETVKLAIRALLEVVESGGKNIEVAVMTKENGLRQLEEAEIDAIVAEIEAEKAAAEAAKKAPPKDT

SEQ ID NO: 3488 - DNA, 1145 bp, Homo sapiens
  CDS (191)..(937): n means a or g or c or t/u
gcggacgcgtgggcggacgcagtgggcggacgcgtgggccgnctgacgccgcccgtcgccggcagctgcaggacacggcgccgagggtggggcgcgggcgtagtggcgccgggagtcgcgggtgcgcgcaggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggccggggtgccaagtcagtgcgygagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaaaaaaaaaaaaaaaaaaaaaaaaaaaaaaaaaaaaaaaaaaaaaaaaaaaaaaaaaaaaaaaaaaaaaaaaaaaaaangggggn

SEQ ID NO: 3489 - protein, 248 aa, Homo sapiens
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEVVQSGGKNIELAVMRRDQSLKILNPEEIEKYVAEIEKEKEENEKKKQKKAS

SEQ ID NO: 3490 - DNA, 892 bp, Mus musculus
  CDS (25)..(771)
gcccgagctagtgcgtccgcagtgatgagctacgaccgcgccatcaccgtcttctcgcccgacggccacctcttccaagtggagtacgcgcaggaggcggtcaaaaagggctccaccgcggttggtgttcgaggaaaggacattgttgttcttggtgtggaaaaaaaatcagtggccaagctacaagatgaaagaacagtacgaaaaatctgcgccttggacgataacgtctgtatggcctttgcaggtctcaccgctgatgcaaggatagtcatcaacagagcccgggtagagtgccagagccaccggctgacagtggaggacccagtgactgtggagtacatcacccgctacattgcgagtctgaagcagcgttatacacagagcaatgggcgcaggccatttggtatctcggccctaattgtgggttttgactttgatggcactcccagactctatcagactgacccctcgggcacataccatgcttggaaggccaatgccataggccggggcgccaagtcagtgcgtgaatttctggagaagaactacacagatgatgccattgaaacagatgatctgaccatcaaacttgtgatcaaggcactgttagaggtggtccagtcaggtggcaaaaacatcgaacttgccgtcatgaggcgggatcagcccctcaagattctaaatcctgaagaaattgagaagtatgttgctgaaattgagaaggagaaagaagaaaatgaaaagaagaagcaaaagaaagcatcttgatgaagaggcactggtcagagcagctttgagcctctatccgggcaagcctcggtgctgtgggccttgtggccatttgtccgagttcaataaactactacattttttaaaaaaaaaaaaaaaa

SEQ ID NO: 3491 - protein, 248 aa, Mus musculus
MSYDRAITVFSPDGHLFQVEYAQEAVKKGSTAVGVRGKDIVVLGVEKKSVAKLQDERTVRKICALDDNVCMAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDDAIETDDLTIKLVIKALLEVVQSGGKNIELAVMRRDQPLKILNPEEIEKYVAEIEKEKEENEKKKQKKAS

SEQ ID NO: 3492 - DNA, 1007 bp, Oryza sativa
  CDS (43)..(789)
ccaccaagctccgccaccgccggaaccctagacccgccggcgatggcccgctacgaccgcgccatcaccgtcttctcccccgacggccacctcttccaggtcgagtacgccctcgaggccgtccgcaagggcaacgccgccgtcggcgtccgcggctccgacaccgtcgtcctcggcgtcgagaagaagtccacccccaagctccaggactccaggtcggtgcgcaagatcgctagcctggacacccacatcgcgctggcgtgcgcggggctcaaggcggacgcccgcgtgctcaaccgcgcgcgggtcgagtgccagagccaccgcctcaccgtcgaggacgccgtcaccgtcgagtacatcacgcgctacatcgccggcctgcagcagaagtacacccagagcggcggggtccgccccttcggactctccaccctcatcgtcggattcgacccttacaccgacaagcccgcgctgtaccagaccgatccctccggcaccttctccgcgtggaaggccaacgccacggggaggaactccaactccatgagggagttcttggagaagaattacaaggagacctctggcaaagagaccatcaagctcgcaatccgtgctctccttgaggttgttgagagtggcggaaagaacatcgagattgcagtgatgacacagaaggatggtcttcgccaactcgaggaggctgaaatcgacgaatatgttgctgagatcgaggcagagaaagctgcagctgaggctgcaaagaagggtgcccctaaggagacctaattcttcgctgtaccaaattttcattccatcaacacatttagcgcattacttgtgttccacagcactgtttttaactgttctagaggaacgctagattgtttggagagtgaatgattctattcttattgcacatcaagatcccttagacccaaatgccttgtgatgtacttgttttctatatacatggcttcttttgaacaaaaaaaaaaaaaaaaaaa

SEQ ID NO: 3493 - protein, 248 aa, Oryza sativa
MARYDRAITVFSPDGHLFQVEYALEAVRKGNAAVGVRGSDTVVLGVEKKSTPKLQDSRSVRKIASLDTHIALACAGLKADARVLNRARVECQSHRLTVEDAVTVEYITRYIAGLQQKYTQSGGVRPFGLSTLIVGFDPYTDKPALYQTDPSGTFSAWKANATGRNSNSMREFLEKNYKETSGKETIKLAIRALLEVVESGGKNIEIAVMTQKDGLRQLEEAEIDEYVAEIEAEKAAAEAAKKGAPKET

SEQ ID NO: 3494 - DNA, 978 bp, Trypanosoma brucei brucei
  CDS (176)..(919)
ttagaacagtttctgtactatattggaagttggaggaaacattaactaaggcttaccggttgtaacaaaaggaagttctcaaggaaaggaaaggaaaggaaggaaggcggctgcaggcctatttgttaattacttgcacgtacgtacatacgtatacacacttatccgaaatagtatgagctacgatcgcgcaattactgtgtttagtcccgatggacatttgttccaggttgagtatgcgcaagaggccgttcgcaagggtctctgtgcagttggtgtgaaagggaaggacagcattatctttgctgtggagaaaaaatcagtgcaaaagctgcaggacagtcgtacgacccgcaaaatatacaaacttgacgagcatatttatctcgcttccgcaggtctctctgccgacgcccgtgtggttgtgaatcacgcacaactggaatgtcaacgcttccgcttgagctacgaagacgccattgacgttgacctgctcgtgcggtacgtggcaagggtacagcaacgttctacgcaatcaagcggcagcagaccgtacggtgtttcaaccatcattggtggctttaatgagaatgggcagccgcagttgtggaagacggagccgtctggaacgagttcagcgtggaatgcagcagcaatcggccgaaatgacaaggttgtgctcgaatttatggaaaaaaactatcaggatggcatgacgcgggatcgttgcgtgcactttgcaattaaggcgcttcttgaggctgttgaaagtgggtcgaaaaacattgaactcctggtgctggagcgcggtaaggcggcttacatgagcgacaccgaattgcacaggttcgtcgttgaggtagaaaaagagcgcgaggaggaggccgcaaggagaaggcgccttgccgaagaggattgaggcgcgtgcacctgtgggaaaaagaatgtggacagaatttggtgaggaggaaaacaaac

SEQ ID NO: 3495 - protein, 247 aa, Trypanosoma brucei brucei
MSYDRAITVFSPDGHLFQVEYAQEAVRKGLCAVGVKGKDSIIFAVEKKSVQKLQDSRTTRKIYKLDEHIYLASAGLSADARVVVNHAQLECQRFRLSYEDAIDVDLLVRYVARVQQRSTQSSGSRPYGVSTIIGGFNENGQPQLWKTEPSGTSSAWNAAAIGRNDKVVLEFMEKNYQDGMTRDRCVHFAIKALLEAVESGSKNIELLVLERGKAAYMSDTELHRFVVEVEKEREEEAARRRRLAEED

SEQ ID NO: 3496 - DNA, 744 bp, Methanosarcina acetivorans
  CDS (1)..(744)
atggcaccacagatgggttatgacagggcaattacggttttcagccctgacggaagacttttccaggtagagtatgcccgcgaagcggtcaaaaggggaacaacagccgtgggaatcaaggcagccgacggggtagtgctgctggttgacaagcggattacaagcaggcttgttgaagccgaatcaatcgaaaaaatattccagattgatgaacatatcggagccgcaacctcagggctcgtggccgacgcccgttcccttgttgacagggcccgcgtagaagcccaggtaaacagggtttcttatgacgaacccataggtgtggaggtaatctccaagaaaatttgcgaccacaagcagacctacacccagtacggaggagttcgcccatacggaactgccctcctgatcgcaggcgttgacgacaacaaaccaaggctctttgagaccgacccgagcggtgctctcctcgagtacaaggcaaccgccataggcgcaggcagaaatgcagttgttgaggtctttgaggcggactacagggaagatatgaatatggacgctgctatcctcctcggaatggatgcactttataaagcagctgaaggcaagttcgatgccggaacccttgaggtaggcgttgtatcccttgaggacaagaaattcagaaaactggggcctgaggaagttgagaactacgttcagcagatccttgagaaacacaagggaactgaaagcagcgaataa

SEQ ID NO: 3497 - protein, 247 aa, Methanosarcina acetivorans
MAPQMGYDRAITVFSPDGRLFQVEYAREAVKRGTTAVGIKAADGVVLLVDKRITSRLVEAESIEKIFQIDEHIGAATSGLVADARSLVDRARVEAQVNRVSYDEPIGVEVISKKICDHKQTYTQYGGVRPYGTALLIAGVDDNKPRLFETDPSGALLEYKATAIGAGRNAVVEVFEADYREDMNMDAAILLGMDALYKAAEGKFDAGTLEVGVVSLEDKKFRKLGPEEVENYVQQILEKHKGTESSE

SEQ ID NO: 3498 - DNA, 741 bp, Methanopyrus kandleri
  CDS (1)..(741)
atggccgtgcaacccgctcagacggcgtatgaccgggccatcaccgtcttcagcccggacggtcgactgttccaggtcgagtacgcgcgcgaggccgtcaagcgtggcactacggctctggggattaaagtggaagagggtgtcgtcctcggggtcgataagcgcgtcacctccaagctgatcgagcccgagtccatagagaaagtctaccagatcgacactcacattggagcggctacggcggggctcgtcgcggacgctcgtgtgttagtcgagcgcgccaggatcgaggcacagacgtatcggtacacttacggtgagccgatcgatgtggacgtgctcgtgaaggctatctgcgacctcaagcaggtgtacacgcagcatggaggagttcgacccttcggaaccgcgcttttgatcgccggggtggacacgaagggatgtcgcctgttcgagaccgatcccagcggtgctctgaccgaacacaaagccacggcgatcggtgagggtcgacaggaagcgttggacgtgttcgaagaggaataccgggaggacatgacccttcaagaggccatcgagctcgcggtgcgggcgctgtacgaagcctcacgggaagagactaccgctgacaacctcgagatcgccgtcgtcgataaacaagggttccggaagttggagcggaagaagatcgaggagatgtttgaacgtgtagtcggttcggaggaagacgagggtgaatga

SEQ ID NO: 3499 - protein, 246 aa, Methanopyrus kandleri
MAVQPAQTAYDRAITVFSPDGRLFQVEYAREAVKRGTTALGIKVEEGVVLGVDKRVTSKLIEPESIEKVYQIDTHIGAATAGLVADARVLVERARIEAQTYRYTYGEPIDVDVLVKAICDLKQVYTQHGGVRPFGTALLIAGVDTKGCRLFETDPSGALTEHKATAIGEGRQEALDVFEEEYREDMTLQEAIELAVRALYEASREETTADNLEIAVVDKQGFRKLERKKIEEMFERVVGSEEDEGE

SEQ ID NO: 3500 - DNA, 750 bp, Methanosarcina mazei
  CDS (1)..(750)
atgcagatggcaccacagatgggttatgacagggcaattacggttttcagccctgacggaagacttttccaggtagaatatgcccgcgaagcggtcaaaaggggaacaacagccgtaggaatcaaggcagccgatggggtagtgctgctggttgacaagcgaataacaagcaggcttgtggaagccgaatcaatcgaaaaaatattccagattgacgaccacataggagccgcaacctcagggcttgtggcagatgcccgctctcttgttgacagggcccgtgtagaagcccaggtaaacagggtttcatatgacgaactcattggtgtggaggttatctccaagaaaatctgtgaccacaagcagacatacacccagtacggaggggttcgcccttacggaaccgcactcctgattgcaggcgtggacgacaacaagccaaggctttttgagactgacccgagcggcgctctccttgagtacaaggcaacagccataggcgcaggcagaaatgcagtcgtcgaggtctttgaggcagactacagggaagatatgaacattgatgctgctatccttctcgggatggatgctctttataaagctgctgaaggcaagttcgatgccggaactcttgaagtgggtgttgtgtcccttgaggataagaaattcaggaaattaggtcctgaagaagttgagaactatgttcatcagatccttgagaaacacaaaggaaatgagaacaaagaataa

SEQ ID NO: 3501 - protein, 249 aa, Methanosarcina mazei
MQMAPQMGYDRAITVFSPDGRLFQVEYAREAVKRGTTAVGIKAADGVVLLVDKRITSRLVEAESIEKIFQIDDHIGAATSGLVADARSLVDRARVEAQVNRVSYDELIGVEVISKKICDHKQTYTQYGGVRPYGTALLIAGVDDNKPRLFETDPSGALLEYKATAIGAGRNAVVEVFEADYREDMNIDAAILLGMDALYKAAEGKFDAGTLEVGVVSLEDKKFRKLGPEEVENYVHQILEKHKGNENKE

SEQ ID NO: 3502 - DNA, 732 bp, Pyrobaculum aerophilum
  CDS (1)..(732)
atgttcccaccggcaatggcaggttacgatcgcgcaataacaatcttctcgcctgagggcaaaatatatcaagttgagtacgccggcgaggcggtaaagagggggtggccgaccgtcggcgttaagtgtaaagcaggcgtcgtgctcacggcagagaagaggaagatctcagcgctgtttgattcatcttctctagaaaaaatttatttaattgatgagcacgtcgcggcatctccctcaggcctcctcgcagatgctagaatccttatagactacgccagagacgtggctttaagccacaggtttatttacgacgagccaatagacgtggaattcttaacaaaagcagtatgtaatttaaaacaacagtacacccagtttggaggcgccaggcccttcggagtagcccttcttatagccggcgttgatagacacggcgctaggctgtaccagactgatccctcaggggtctacataggatacttcgccactgccataggcgctgagtctggcacaattacagaattcttagagaagaactacaaattcgacatggaaatgggggagtgtatagaattggcattaaaagcgttggcgtctgcggtggagataacagatagcgcaaacgtcgaagtggcatatgcgacaatagaggagaagaaaatgaggaaaatgagccaagacgaagtggcctcgctacttactaaactagggctacttaaaaagagctaa

SEQ ID NO: 3503 - protein, 243 aa, Pyrobaculum aerophilum
MFPPAMAGYDRAITIFSPEGKIYQVEYAGEAVKRGWPTVGVKCKAGVVLTAEKRKISALFDSSSLEKIYLIDEHVAASPSGLLADARILIDYARDVALSHRFIYDEPIDVEFLTKAVCNLKQQYTQFGGARPFGVALLIAGVDRHGARLYQTDPSGVYIGYFATAIGAESGTITEFLEKNYKFDMEMGECIELALKALASAVEITDSANVEVAYATIEEKKMRKMSQDEVASLLTKLGLLKKS

SEQ ID NO: 3504 - DNA, 783 bp, Pyrococcus furiosus
  CDS (1)..(783)
atggcatttgttccacctcaggctgggtacgacagagcaattacagtttttagtccagatggaagattattccaagtaaattatgcaagggaagcagtaaaaagaggagctacagctgtgggagttaagtgtggcgagggtgttgtcttagctgttgagaaaaggataacgagcaggttaattgaacctgacagttatgagaagatctttcaaattgatgatcacatcgctgcagcttcaagtggtattatagccgatgcgagagttctagttaacagagcaagattagaagctcaaatttatagactaacatatggtgaaccagcaccagtttcagttatagtcaaaaaaatctgtgaccttaagcagatgcatactcagtatggaggcgtaaggccatttggagcagcgcttttaatggcgggtataaatgacagaccagagctttatgagacagatccaagtggtgcatattttgcttggaaagctgtagctataggaagtggaaggaacacagcaatggcaattttcgaagaaaaatatagagatgacatgaatttagaagatgcaataaagctggctttgatggcactggcaaagacaatggaaaatcctagtgcagataatatagaagtggctgtaataactgtaaaggacaaaaagtttagaaaacttactagggatgaaatagaaaagtacctgtcggaagtgctaaaagaagttgaagaggaagaagtcaaggaaaaggaagaggattattcggagctggatagcaactactga

SEQ ID NO: 3505 - protein, 260 aa, Pyrococcus furiosus
MAFVPPQAGYDRAITVFSPDGRLFQVNYAREAVKRGATAVGVKCGEGVVLAVEKRITSRLIEPDSYEKIFQIDDHIAAASSGIIADARVLVNRARLEAQIYRLTYGEPAPVSVIVKKICDLKQMHTQYGGVRPFGAALLMAGINDRPELYETDPSGAYFAWKAVAIGSGRNTAMAIFEEKYRDDMNLEDAIKLALMALAKTMENPSADNIEVAVITVKDKKFRKLTRDEIEKYLSEVLKEVEEEEVKEKEEDYSELDSNY

SEQ ID NO: 3506 - DNA, 729 bp, Sulfolobus tokodaii
  CDS (1)..(729)
atggcatttggaccagcagcaatgggatatgatagagctataacaatattttctccagatggatcattatatcaagtagattatgcctttgaggcagtaaagaaaggttggactactttaggggtaaaaacaaaagctggagttgttctcattggagaaaaaagaaaagccacccaacttcttgatgttgatagcatagaaaaagtctttatccttgatgaccatgtaggatgtagctttgctggattagcctcagacggaagaatattaattgattatgctagatctcaagcacttcagcataggttaatatatgatgaacctatcaatattgactatcttacaaaattagtttcagatgtaaaacaaatgtatacccaacacggtggagtaagaccctttggtgttgctttaattataggtggtattgatagaggaaaaactccaaaattattaatgacagagccaagcggtcagtttatgccttactatgctgtagctattggacaaggtgggtataccgcaacagaatactttgagaaaaactatagagaagatctcaatatgcaagatacaatattactaggaattagagccttagcatctactcttaaacccggagaaaaacttgcaccttctaatattgaagttggatttgcagatgtagattccggaatgtttagaaagatgagtttcgaagaaagagcatcaatattacaaaaattataa

SEQ ID NO: 3507 - protein, 242 aa, Sulfolobus tokodaii
MAFGPAAMGYDRAITIFSPDGSLYQVDYAFEAVKKGWTTLGVKTKAGVVLIGEKRKATQLLDVDSIEKVFILDDHVGCSFAGLASDGRILIDYARSQALQHRLIYDEPINIDYLTKLVSDVKQMYTQHGGVRPFGVALIIGGIDRGKTPKLLMTEPSGQFMPYYAVAIGQGGYTATEYFEKNYREDLNMQDTILLGIRALASTLKPGEKLAPSNIEVGFADVDSGMFRKMSFEERASILQKL

SEQ ID NO: 3508 - DNA, 702 bp, Thermoplasma volcanium
  CDS (1)..(702)
atgcaacagggtcagatggcttatgatagagcgataacggtattctctcccgacgggagattatttcaagttgaatatgcaagagaggctgtaaaaaagggatcgactgcccttggattaaaattttcaaacggcgtccttctgatatctgacaaaaagataaggagcaaactaatagaacagaattcccttgaaaagatacagcttattgatgattatgttgccgctgtgacttcaggtcttgttgctgatgcaagggttcttatcgacttcgctaggatcagtgcacagcaggaaaaagttacatacggttcccttgtaaatatcgagaatctagtaaagagagttgccgatcaaatgcaacaatatacgcaatatggtggcgtaaggccttacggtgtatcccttatatttgcaggaatagatcagattgggccgaggttgtttgactgtgatccagcaggaacgataaacgagtataaagcgacagctataggatcaggaaaggacgcagtggtaagctttctagagaaggaatacaaagaagggctttcggaaaaagaggcagtaacactcggcataaaggcgcttaaggcctccttagaagaaggggaagagctaaaggcccctgaaatagcttccattacagtgggatctaaatacagaatatatggtgcagaagaagtaaaaaaattcctgtaa

SEQ ID NO: 3509 - protein, 233 aa, Thermoplasma volcanium
MQQGQMAYDRAITVFSPDGRLFQVEYAREAVKKGSTALGLKFSNGVLLISDKKIRSKLIEQNSLEKIQLIDDYVAAVTSGLVADARVLIDFARISAQQEKVTYGSLVNIENLVKRVADQMQQYTQYGGVRPYGVSLIFAGIDQIGPRLFDCDPAGTINEYKATAIGSGKDAVVSFLEKEYKEGLSEKEAVTLGIKALKASLEEGEELKAPEIASITVGSKYRIYGAEEVKKFL

SEQ ID NO: 3510 - DNA, 971 bp, Xenopus laevis
  CDS (66)..(833)
gtgtggaggaacagaagaagtgaaagtgcagtctcaccgcctgttagtgacgagttcgctccaccatgagttctattggtaccgggtatgatctttctgcctccacgttttcgccagatggtcgggtatttcaggtggaatatgcagccaaagcagtcgagaacagcagcacagctattgccatcagatgtaaagatggagtcgtgtttggcgtagagaaactcgtgttgtccaaattatatgaagaaggatctaacaagcgcatctttaatgtggatcgtcatgtcggtatggcagtagcaggtcttctggcagatgcacggtccttagctgatattgcacgagaagaagcctcaaatttccgggcaaactatggttatgacattcctttaaagcatctttcagacagagtggccatgtatgcgcatgcatacacactgtacagcgctgtccgaccgttcggatgcagttttatgctgggatcttataatgaagacgatgatgctcagttatacatggtggatccatcaggcatttcctatggctactggggttgtgcaattgggaaggccaaacaggctgctaagacagagattgaaaagcttcagatgaaagaaatgacctgccgtgatgcagtcaaagaggtagcaaaaataatctacattgtccatgatgaagtgaaagacaagtcctttgaactggaattaagctgggttggcaaaataaccaaaggaaagcatgaaatagtcccaaaagaaattcgagaagaagcagaaaaatatgcaaaggaatctttagaagaggaggaggattctgatgatgacaatatgtaacatccagtcgtaacgcggtctgttcactaagaatactgtttttttttatgtataaatatatgtatatgaaaaggaacctgcaacctcaatgtgtgacaaattgtcagtaaaatagttcttttcaaaaaaaaaaaaaaa

SEQ ID NO: 3511 - protein, 255 aa, Xenopus laevis
MSSIGTGYDLSASTFSPDGRVFQVEYAAKAVENSSTAIAIRCKDGVVFGVEKLVLSKLYEEGSNKRIFNVDRHVGMAVAGLLADARSLADIAREEASNFRANYGYDIPLKHLSDRVAMYAHAYTLYSAVRPFGCSFMLGSYNEDDDAQLYMVDPSGISYGYWGCAIGKAKQAAKTEIEKLQMKEMTCRDAVKEVAKIIYIVHDEVKDKSFELELSWVGKITKGKHEIVPKEIREEAEKYAKESLEEEEDSDDDNM

SEQ ID NO: 3512 - DNA, 929 bp, Xenopus tropicalis
  CDS (21)..(761)
gccgcatctttgtcttagtcatgtctcggggatccagcgcggggtttgacaggcacattaccatcttctcacccgaagggcgtctctatcaagtcgaatatgcattcaaggcgatcaaccaggggggtcttacatcagtggctgtcagaggaaaagactgtgctgttgttgttacccaaagaaaagtcccagacaagctgttggacagcaacacagtaacccatttattccggattactgaatccattggctgtgtaatgaccggaatgacagctgacagcaggtcgcaggtccagcgggcacgttatgaggctgcaaattggaagtacaaatacggctatgaaatcccagtagatatgctttgtaaaaggattgcggatatttctcaagtatacacacagaatgctgaaatgaggcccttaggatgttgcatgatcctaattggagtggatgaggagaatggaccacaagtctttaaatgtgatcctgcaggctactattgtggctttaaggctaccacagctggagtgaagcaaactgaggccaccagcttcctagaaaagaaagtaaagaagaaattggactggacttatgagcagactcttgagacagccatttcttgtctctccacggtactgtctattgatttcaaaccttcagaactggaggtgggagtcgtcacagtcgaggatccaaaattcagagttcttacagaagcagagattgatgtccaccttgttgcactagctgagcgtgactagtcatcctactttcacctctgcccagaaagctcttgcctggtaaaatcacctgtcttcataacactttttgttttgttctctacataaataaaacagatttttttctttttggaaaaaaaaaaaaaaaaaaaaaaaaaaaaaaaaaaaaaaaaaaaaaaaaaaaaaaaa

SEQ ID NO: 3513 - protein, 246 aa, Xenopus tropicalis
MSRGSSAGFDRHITIFSPEGRLYQVEYAFKAINQGGLTSVAVRGKDCAVVVTQRKVPDKLLDSNTVTHLFRITESIGCVMTGMTADSRSQVQRARYEAANWKYKYGYEIPVDMLCKRIADISQVYTQNAEMRPLGCCMILIGVDEENGPQVFKCDPAGYYCGFKATTAGVKQTEATSFLEKKVKKKLDWTYEQTLETAISCLSTVLSIDFKPSELEVGVVTVEDPKFRVLTEAEIDVHLVALAERD

SEQ ID NO: 3514 - DNA, 1173 bp, Rattus norvegicus
  CDS (117)..(902)
ggggatattcgccgccgatgcttggccatccgggttggttcttctccagctgagtaaagcggcgctgatctgcaccctcactgtcttcctccggatccacataaaattcagaagccatgtctcgaagatatgactccaggaccacaatattttctccagaaggtcgcttataccaagtggaatatgccatggaagccattggacacgcaggcacttgtttgggaattttagccaatgatggcgttctgcttgcagcagagaggcgcaacatccacaagcttcttgatgaagtctttttttctgagaaaatttataaacttaacgaggacatggcttgcagtgtggcaggcataacatctgatgccaacgttctgactaatgaactcaggctcattgctcaaaggtacttattacagtatcaggagccaattccctgtgagcagttggttacagcactgtgtgatatcaaacaggcgtacacacagtttggaggcaaacgtccctttggtgtttctttgctgtatattggctgggataagcactatggctttcagctctatcagagtgacccaagtggaaactacgggggatgggaagccacatgcattggaaacaacagtgctgcagcggtatcaatgctgaaacaagactacaaagaaggagaaatgactctgaagtcagcgctggctctggctgtcaaggtgctaaacaagacaatggatgttagtaaactgtcagctgaaaaagtggaaatcgccacactaacaagagagaatggaaagaccgtgatcagagtcctcaagcaaaaggaagtggaacagttgatcaaaaaacatgaagaggaagaagcgaaagctgaacgggagaagaaagaaaaagaacagagagaaaaggataaatagacagaatcatggattttataactccttagaggcgccagttcacttaggagctgtcctggccttcccctggaagtgttttcttgtattttcttccttaccttggccatcggggaaatgggacattgcatactgaattgggtccatgtctgtccagctggatgctttattgtaatgatggacatctttataaacatcttaatctcgacacataatttttggaataaaacctggaaagattggcaaaaaaaaaaaaaaaaaaaaaaaaaaaaaa

SEQ ID NO: 3515 - protein, 261 aa, Rattus norvegicus
MSRRYDSRTTIFSPEGRLYQVEYAMEAIGHAGTCLGILANDGVLLAAERRNIHKLLDEVFFSEKIYKLNEDMACSVAGITSDANVLTNELRLIAQRYLLQYQEPIPCEQLVTALCDIKQAYTQFGGKRPFGVSLLYIGWDKHYGFQLYQSDPSGNYGGWEATCIGNNSAAAVSMLKQDYKEGEMTLKSALALAVKVLNKTMDVSKLSAEKVEIATLTRENGKTVIRVLKQKEVEQLIKKHEEEEAKAEREKKEKEQREKDK

SEQ ID NO: 3516 - DNA, 1290 bp, Brachydanio rerio
  CDS (99)..(854)
cgcagatcaatttcgaaacctcctgtgctgtgctgctagtcgaaagtcagaggcaactatttcacagcaattcgcgcttttgtgtctagtgtgcagaaatggcagctagatacgacagagctataacagttttctctccagacggtcacttgtttcaggtggaatatgcgcaggaagcagtaaagaagggctccacagctgttggaatcaggggaaaagatattgttgtgctgggtgttgagaagaagtcagtggcgaagcttcaggaggagaggacggtcaggaagatctgtgctttggatgaacatgtgtgcatggccttcgcaggtctgacagcagatgccaggattgtgatcaacagagcacgagtagagtgtcagagccacagactcacagtggaagaccccgtaactgtagagtacatcacccgctacatcgccacactcaaacagcgctacactcaaagcaatggacgtcgtccgttcggcatctcggccctgattgttggtttcgactatgatgggaccccacgtctctatcagacagacccttctggaacataccacgcgtggaaggcaaacgccatcggccgcagtgcgaagacggtgagggagtttctggagaagaactacacagatgaagccatcgccagtgataatgatgccatcaagctggccatcaaagctttactggaggttgtgcaatccgggggcaagaacatagagctggcagtgatccgaagaaaccagccccttaagattctggagtccaaagagattgagacgctggtcgccgaaatagagaaggagaaagaggaggaggcagagaagaagaagcagaagaagtcttcgtaaatcagattctctcttggttttgtttatatgggcagatgcacttggctcaggctctcactgtacaccttcctcctcctcttcatctgttaagagcacagactcttggtcttctgctgaaccacggcatcaatgaatatgtttgttttttttccccaggaaatatttttaagatcctcgtaatcatagcatgttcagggatgagagctgccagttgttcatttgttgagcatgtactgtggtcagcctcttgattttggtcagttttcttgctcaactttcgaccactgctcagaattctgggagaatgtgctctgactgatgtttcctaataaactgttttggtttgtactaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3517 - protein, 251 aa, Brachydanio rerio
MAARYDRAITVFSPDGHLFQVEYAQEAVKKGSTAVGIRGKDIVVLGVEKKSVAKLQEERTVRKICALDEHVCMAFAGLTADARIVINRARVECQSHRLTVEDPVTVEYITRYIATLKQRYTQSNGRRPFGISALIVGFDYDGTPRLYQTDPSGTYHAWKANAIGRSAKTVREFLEKNYTDEAIASDNDAIKLAIKALLEVVQSGGKNIELAVIRRNQPLKILESKEIETLVAEIEKEKEEEAEKKKQKKSS

SEQ ID NO: 3518 - DNA, 1185 bp, Branchiostoma belcheri tsingtaunese
  CDS (25)..(813)
ggtagtgcatcctgggatatcaacatgtcacgacgttacgatacaagaacgaccatcttctctccagaaggccgcctgtaccaggtggaatatgccatggaggccataggtcacgctggcacccgtctgggtatcctggcgaatgacggtatcgtgctggccgctgagcgtaggaacacgcacaagctactggacgaggtcttcttctctgagaagatttacaaactccatgatgacatggcgtgcagtgtagcagggatcacatctgatgccaacgtcctcactaacgagctccgtctcatagcacagaggtacattctacagtatcaggaaccgattccctgtgaacagcttgtcagcagtctgtgtgacatcaagcaggcctacacacagtggggaggcaagcgtccgtttggcgtgtccatcctgtacatcggctgggacaagcactacggcttccagctgtaccagtctgaccccagtggcaactacggaggctggaaggccacgtgcataggcaacaacagcgcagctgctgtttccatgctgaagcaggaatacaagattgatgagatgaccatgcaggacgcccttcaactggccatcaaggtcgtcagcaagacactagacgtctccaaactcacacctgaggaagtggagttagcgacgttgaccagagagaacaacaagaccaaagtgcaggtgctgccgagcaaacaggtggaggaactcatcaagaagcacgaggaggaggtggctgcggccgagcaggagaagaaggaaaaggagaagcaagaaaaagggtcatcatagttacccgttgtcatagttgcgtccttatcacaaaaaaagaccctgtcagctacttgtgttttcactctgttagtagcgtttcttgagaacatccttataaatttatgttagtctaaaggccaggcccatatttctcttattttgtcagactttgtaagacatgaactagagaattgtccaggaaacctcttctccaaggtgaatgtatgtactgtatctttaaatgtacacaattcctcttagcttccaacacaaattttttccaagggacagacttgttggtcatagtttgacgagtgacaacaaattggattatttcattaaacatcaatttcatacatataaaaaaaaaaaaaaaaaaaaaaaaaaaaa

SEQ ID NO: 3519 - protein, 262 aa, Branchiostoma belcheri tsingtaunese
MSRRYDTRTTIFSPEGRLYQVEYAMEAIGHAGTRLGILANDGIVLAAERRNTHKLLDEVFFSEKIYKLHDDMACSVAGITSDANVLTNELRLIAQRYILQYQEPIPCEQLVSSLCDIKQAYTQWGGKRPFGVSILYIGWDKHYGFQLYQSDPSGNYGGWKATCIGNNSAAAVSMLKQEYKIDEMTMQDALQLAIKVVSKTLDVSKLTPEEVELATLTRENNKTKVQVLPSKQVEELIKKHEEEVAAAEQEKKEKEKQEKGSS

SEQ ID NO: 3520 - DNA, 1104 bp, Brachydanio rerio
  CDS (73)..(798)
gatgaatgaacacttcctgtactgttgaaactagcaaactcaccctccactgcagaagatttgcgtttcaacatgttcctgacaagatcagaatatgacagaggagtaaacactttctcaccagaaggaaggctttttcaggttgaatatgccattgaagccatcaagttggggtccacagccattggcattcagacatcagaaggagtttgtcttgctgtggagaagagaataacctctcctctgatggagcccagcagcattgaaaagattgtagagatcgactctcacattggctgtgccatgagtggcttgatagctgatgccaaaactcttattgacaaagcaagagtagaaacacagaaccattggtttacctacaatgagacgatgactgtggagagcgtaacacaagccgtttctaatcttgctctgcagtttggagaggaggatgctgaccccggcgctatgagccgtccttttggtgtcgcattgctattcggaggtgtggatgagaaaggacctcagctataccacatggatccttcaggcacttttgtccagtgtgacgcgagagcaatcggctcagcatctgaaggcgctcagagctctcttcaagaggtttaccacaagtctatgacgttaaaggatgccattaagtcttctctcactatcctgaaacaagtgatggaggagaaactcaatgccaccaatattgagcttgccacagtagagccgggcaaaacctttcacatgtacacaaaagaagagctggaggatgtcatcaaggatatctaaacgtgctaagcataacagatgttcaatatgaaaagtccagtgtaatttttgtgtgaatcatcacacagcagaatggatacataatactctgactgcattgtagggtttgcctgttcagacgggaatcgaatctttatacttttctttttccttctgtcagtcccaaaatttctatagttctgtacaagcacaggacagcagatcttgtcattgaattaaatggggggttctttttgttaccaatcactgcgttaataaactgttgttgaaaaaaaaaaaaaaaaaaaaaaaaaaaaaaaaaaaaaa

SEQ ID NO: 3521 - protein, 241 aa, Brachydanio rerio
MFLTRSEYDRGVNTFSPEGRLFQVEYAIEAIKLGSTAIGIQTSEGVCLAVEKRITSPLMEPSSIEKIVEIDSHIGCAMSGLIADAKTLIDKARVETQNHWFTYNETMTVESVTQAVSNLALQFGEEDADPGAMSRPFGVALLFGGVDEKGPQLYHMDPSGTFVQCDARAIGSASEGAQSSLQEVYHKSMTLKDAIKSSLTILKQVMEEKLNATNIELATVEPGKTFHMYTKEELEDVIKDI

SEQ ID NO: 3522 - DNA, 753 bp, Nanoarchaeum equitans
  CDS (1)..(753)
atggattttatgcaattaccacaagtaatgggctatgatagagctagcactctatttagccccgatgggaggttgttacaagtagaatatgcgagaacaacagtaaaacaatcccctaccgctattggtatgctttataaaacaggtgtcctcgttattggagataagaaaattgttgagaaattcgtaataccttcatccatagaaaaggtatacatagttgacgaccatgtaatcgctgctcctgctggtataattggagatggtagagttttaatagagagagcaagagttatagcacaaacttacaaatatttttatggccaccccatcgatattagagggttagtaaaagagatagccgatataaaacaggaatatacccaaattggaggagtaaggccatttggggtctctataatttttgcaggcatagatgatacaggcaaacacatatttgttactgaacctggaggaatgttttgggaatacaaattagctgttataggggaaggagaacagaaggttttggattatttaggaaaagaatataacgaaaacctctcccttaaaaaagcgatagaactaggattaaaggcattgtataatttctacaaagagaataataatgaattaactgctgaaaagttggacatcgcttatgttgatgaaaaaaccaaaaaagcaaaatatgttgatgtaaatgagatagaaaaaatattggaaaaaataaaaagtggaggaaatagttaa

SEQ ID NO: 3523 - protein, 250 aa, Nanoarchaeum equitans
MDFMQLPQVMGYDRASTLFSPDGRLLQVEYARTTVKQSPTAIGMLYKTGVLVIGDKKIVEKFVIPSSIEKVYIVDDHVIAAPAGIIGDGRVLIERARVIAQTYKYFYGHPIDIRGLVKEIADIKQEYTQIGGVRPFGVSIIFAGIDDTGKHIFVTEPGGMFWEYKLAVIGEGEQKVLDYLGKEYNENLSLKKAIELGLKALYNFYKENNNELTAEKLDIAYVDEKTKKAKYVDVNEIEKILEKIKSGGNS

SEQ ID NO: 3524 - DNA, 862 bp, Ornithodoros moubata
  CDS (58)..(783)
acgtacactggtgccgggagagttttggtcgagctatccgaatttgtagcgtctaagatgtttatgacaaggtccgagtacgacaggggtgtcaacaccttctctcccgagggacgcctatttcaggttgaatatgctattgaggctattaagctcggatcaacagccatcggcatccagacttcagaaggtgttgtccttgctgtggaaaagcgagtcacatctccactaatggagccgacgaccattgaaaagatcgtcgagatcgacacccacattgcatgtgctgtcagtggcttgatggccgactcgaggacgatggttgataaagcaagagtcgaagcccagaatcaccgctttgtctacaacgaagacatgcaagtggaaagcgtagcccaggcggtttccaacctggccatccagtttggcgacagcgatgacgatggcaatgccatgagccgtccctttggtgtggccatcttgttcgctggccacgatgcaaagggaccccagctgtaccatatggatccatcaggaacctacgttcagtataacgcaaaagccataggatctgggtgtgagggagctcagcaggctcttcaagagaaatatcacaggtctatatttttagcagaggcaacaaaagaagcgctcatcattttgaagcaggtgatggaggaaaaactcaactccacaaatgtggaggtggcaaccgtgactaaagaaaaaggcttccacatgtttgcaaaggaggaagttgaagaggtgatgaagaacatttaaaaatattacacgtcaggttcattgttggaattaaacctttttttttttacaaaaaaaaaaaaaaaaaaaaaaaaaaaaa

SEQ ID NO: 3525 - protein, 241 aa, Ornithodoros moubata
MFMTRSEYDRGVNTFSPEGRLFQVEYAIEAIKLGSTAIGIQTSEGVVLAVEKRVTSPLMEPTTIEKIVEIDTHIACAVSGLMADSRTMVDKARVEAQNHRFVYNEDMQVESVAQAVSNLAIQFGDSDDDGNAMSRPFGVAILFAGHDAKGPQLYHMDPSGTYVQYNAKAIGSGCEGAQQALQEKYHRSIFLAEATKEALIILKQVMEEKLNSTNVEVATVTKEKGFHMFAKEEVEEVMKNI

SEQ ID NO: 3526 - DNA, 783 bp, Ashbya gossypii
  CDS (1)..(783)
atgtttctgacgagaagtgagtatgatagaggtgtaagcaccttttcgcctgaaggccggctgttccaggttgaatattctctagaggcgatcaaactggggtcgaccgcgatcggtatcgcgacgaatgaaggagtggtgttgggcgttgagaaacgggtgacgtctcctctgcttgagagtgattcgattgagaagatcgtggaggtggatcggcacattgggtgtgccatgagcgggcttaccgcggacgcgcggtcgatgatagaacatgcgaggatatcgtctgtgacgcataacctctattacgacgaggagattggcgttgagtcgctcacacagtcggtgtgcgatctggcgctgcggtttggcgagggcgcgtctggcgaagagcgtctgatgtctcggccgttcggcgtggcgttgttgatagcaggctacgacaaggaggatgggtaccagttgtaccatgcggagccctcggggactttctaccggtacaacgcgaaggcaattggctcagggtcagaaggtgcgcaatccgagctacagaacgagtggtactcctcgctaacgctgaaggaggctgagttgcttgtgttgaagatcctgaagcaggtgatggaggagaagctagacgagaacaacgcgcaactgagtagcgtcacgaaggagcagggtttccgcatttacccggagtcagaaaccgcggagatcatcaaggagctaaaagagcgcgaggtacaggccagcgcagagcaggacgttgacatgtccggttaa

SEQ ID NO: 3527 - protein, 260 aa, Ashbya gossypii
MFLTRSEYDRGVSTFSPEGRLFQVEYSLEAIKLGSTAIGIATNEGVVLGVEKRVTSPLLESDSIEKIVEVDRHIGCAMSGLTADARSMIEHARISSVTHNLYYDEEIGVESLTQSVCDLALRFGEGASGEERLMSRPFGVALLIAGYDKEDGYQLYHAEPSGTFYRYNAKAIGSGSEGAQSELQNEWYSSLTLKEAELLVLKILKQVMEEKLDENNAQLSSVTKEQGFRIYPESETAEIIKELKEREVQASAEQDVDMSG

SEQ ID NO: 3528 - DNA, 756 bp, Ashbya gossypii
  CDS (1)..(756)
atggggtcgagacgttatgactccaggacaactattttctccccagaggggagactgtatcaagtcgaatacgcgttggagtccatatctcacgccggcactgcgattgggatcatggccaaagacgggattgtgctcgcggccgaacgcaaagtaaccagcaagctgctggaacaggacacgtcgagcgagaaactttatcggctaaacgacaacatcacagtggcggtggcgggcctgacggcggacgcggagatcttggtgaacacggcacggctgcacgcacagaactacctgaagatgtacaacgaggagatcccggtggaggtgctggtgcggcggctgtcggacatcaagcagggctatacgcagcacggtgggttgcggccgtttggtgtgtcgttcatctacgcaggctacgacgcgcggtacgggtaccagctgtacacatcgaacccgtcgggcaattactcgggctggaaggcgatcagcgtgggcgccaacacccaggcggtgcagacgctgctgcagatggactacaaggacgacctcacgttcgacgatgcgatcaagctggcgctcaagacgctgtccaagaccacggacagcagctcgctttctcacgagcgtctggagtttgccaccatccagcgcaacgccgacggcaaggttgtgcagaagatctacaagttgggagaaatcaaggacttgctggagaagacgggcataaacaagcaggaggaaaaggaggactaa

SEQ ID NO: 3529 - protein, 251 aa, Ashbya gossypii
MGSRRYDSRTTIFSPEGRLYQVEYALESISHAGTAIGIMAKDGIVLAAERKVTSKLLEQDTSSEKLYRLNDNITVAVAGLTADAEILVNTARLHAQNYLKMYNEEIPVEVLVRRLSDIKQGYTQHGGLRPFGVSFIYAGYDARYGYQLYTSNPSGNYSGWKAISVGANTQAVQTLLQMDYKDDLTFDDAIKLALKTLSKTTDSSSLSHERLEFATIQRNADGKVVQKIYKLGEIKDLLEKTGINKQEEKED

SEQ ID NO: 3530 - DNA, 921 bp, Ashbya gossypii
  CDS (1)..(921)
atgcgacacctcggacgactccagtatgcgaccgagcctccaatcaatcgcggagacggaatcatctatatacctttccacgaatatcaaatctccgtatcaaatgacaataccagagctacttcccgcggccgggtggcaaacacagctcctgtccagttaactagcaccagtaaagagggcggtgtgcacgagcaattggggcactgtgagttagtgatgttcagaaataactacgacggtgatactgtgacgttttccccgactgggagactgttccaggtggagtacgcgctagaggccatcaagcaggggagcgccacagtcgggctgcggtcgaacaagtacgtggtgctggtggcgttaaagcggaacgcggacgagctgtcgtcgtaccagaagaaaataatcaagtgcgacgatcacatggggctgtcgctcgccgggcttgcgccggacgcgcgcgtgctgtcgaactttctccggcagcagtgcaactactcgcagctggtgtacgcgcgtgacctgtctgtggtcaaggccgggcagttgctgagcgacaaggcgcagaagaacacgcagtcgtacggggggcggccgtacggtgtggggctgctgctggcgggttacgacaacagcggcgcgcatctgctggaattccagccctccggcaacacgctggagctgtacggcgcggcgatcggcgcgcggtcgcagggcgcaaagacttacctggagcgggtcatggaggagtacctggagatcgaggatgccgacgcactgatcaagcacggcgtggaggcgctgaaacattcgttgaaggacgagacactcagcaccaagaatctctcgatcgctattgtcggtaaggacatgccattcactctctatgacggagaagccgttgcggcctacctatag

SEQ ID NO: 3531 - protein, 306 aa, Ashbya gossypii
MRHLGRLQYATEPPINRGDGIIYIPFHEYQISVSNDNTRATSRGRVANTAPVQLTSTSKEGGVHEQLGHCELVMFRNNYDGDTVTFSPTGRLFQVEYALEAIKQGSATVGLRSNKYVVLVALKRNADELSSYQKKIIKCDDHMGLSLAGLAPDARVLSNFLRQQCNYSQLVYARDLSVVKAGQLLSDKAQKNTQSYGGRPYGVGLLLAGYDNSGAHLLEFQPSGNTLELYGAAIGARSQGAKTYLERVMEEYLEIEDADALIKHGVEALKHSLKDETLSTKNLSIAIVGKDMPFTLYDGEAVAAYL

SEQ ID NO: 3532 - DNA, 741 bp, Ashbya gossypii
  CDS (1)..(741)
atgagtgctgcagggtatgataggcatattacgatcttctcgcccgaggggcggctgtaccaggtcgagtatgcattcaaggcaacgaatcagaccaacatcaattccgtggcgatccgcgggaagtcatgcacggtcctagtgaaccaaaagaaggtgccagacaagctactggagccatcgacagtgacttatttgttcccgattgcgaaacatattgggatgtgcgcgacgggcccgattgccgacgcacgcaatgtggctgtccggtgcagagccatggcggccgaattccggtacgagtatggctatgacatgccggtgcatgtgcttgccaagcgctttgccaacctatcgcagacgtacacgcaacgagcatacatgcggccgctgggagtggtgcttacgttcatttccgtggacgaggaggaggggccatccatcttcaaatgcgaccctgcaggctactacaccggctacaaggccactgccacgggacccaagcagcaggagctaatcacagcgctagagaagcattttaaaaaattgcagaaggaccgcctggacgaggacagctgggagaaggttgtcgagttcgccattggccagatgatcaactcgctagggaccgacttctccagcaaggatctggaaataggagtggcggtggcagggaagtttttcgtgctgagccaggaccaggtcgaggagcggctggtcgcaattgctgagcaggactag

SEQ ID NO: 3533 - protein, 246 aa, Ashbya gossypii
MSAAGYDRHITIFSPEGRLYQVEYAFKATNQTNINSVAIRGKSCTVLVNQKKVPDKLLEPSTVTYLFPIAKHIGMCATGPIADARNVAVRCRAMAAEFRYEYGYDMPVHVLAKRFANLSQTYTQRAYMRPLGVVLTFISVDEEEGPSIFKCDPAGYYTGYKATATGPKQQELITALEKHFKKLQKDRLDEDSWEKVVEFAIGQMINSLGTDFSSKDLEIGVAVAGKFFVLSQDQVEERLVAIAEQD

SEQ ID NO: 3534 - DNA, 1190 bp, Drosophila sechellia
  CDS (147)..(896)
aatttagtaattttcatcgaacccatgctgcggtcacactgcggcatttcctcaaaaaagcatcatcattgcctggcgaattcgagaaggaaaaagctataagttaatattctgcaagtacctcagctattgaataaagcaacaagatgtcctcacgctacgatcgtgctgtaaccatattctctcccgacggtcacctcctgcaggtggagtatgcccaggaggccgttcgcaagggatcgactgcggtcggagttcgcggcgccaactgcgttgtgcttggcgtggagaagaagtcggtggcccaactgcaggaggatcgaaaggtgcgcaagatttgcatgctcgacaaccacgttgtaatggcttttgccggtctcacggccgacgctcgcatcatgatcaatcgtgcccaggtggagtgccagagccatcgtctcaatgtcgaggatcccgtgaccctcgagtacataaccagattcattgcccagctgaaacaaaaatacacgcagagcaatggccgccgtcccttcggtatttcctgccttattggcggcttcgatgccgatggctctgcgcatctgttccagactgagccgtcgggcattttctacgagtataaggctaacgccaccgggcgatcggcaaaggttgtgcgcgagttcttcgagaagtcctaccgcgaggaggaggtggccaacgagcacggagccgtcaaactggccatccgtgcgctgctcgaggtggcgcagtcaggccagaacaatctggaggtggccatcatggagaacggcaagccactgaaaatgctggacaccgatgtcattaccgattatgttaagatcatcgagaaggagaaggaggaggagctcgagaagaagaaacagaaaaagtaacacccagcagctgggacacttcttcgatggaaggccgttgcattgaatcgctttccatgcattcggcgacactatctggtgtcgccgcccacattctgtctgctcattgtagccaacctgatttgacttggaaaacgattcaaattgaattcggtgaaccgaatgcatactttttttaattaccactttctattcttcggaaccctgtaaaacggtatgaaaatatttgatctgtataaaatacatgcgtcatcatacattaggcggagctcctgttgaaaaaaaaaaaaaaaa

SEQ ID NO: 3535 - protein, 249 aa, Drosophila sechellia; identical to SEQ ID NO: 3273

SEQ ID NO: 3536 - DNA, 1132 bp, Drosophila simulans
  CDS (48)..(806)
tacacaaagtacactccatagtatttcaaataagtagccccacttcaatggctcagcgatacgatcgcgcggtgaccatttactcacccgacggtcacctgctgcaggtggagtacgcccaggaggccgtccgaaggggttccactgtgatgggtctgcgcaccaacaacgccattgtaatcggcgtggagaagcgctccgtgggcgacttgcaggaggagcgcatggtgcgcaagatttgcatgctcgacgaccacgtggtgatgactttttcgggtctcaccgcggacgcacggatcctggtaagccgcgcccaaatggaggcccagagccatcgtctgaatttcgagaagcccacgaccgtggagtacataacccgatacatagcccagctgaaacagaactacacgcagagcaatgggaggcgtccatttggattgtcctgtctggttgggggcttcgacgaggatggcactccgcacctgttccaaacggatccctcgggcatcttctacgagtggagggccaacaccaccggccgctcaagccagccggtccgcgattacatggagaagcacgcggacgagattctgaccatcgccgacgaggcagcggccatcaagcacatagtccgcaccctggtcagcgtgtcctcgctcaaccacacccaaatggaggtggctgtgctcaagtaccgccagccactgcgtatgattgatcaccaggtcctggccgatctggagcgaaccgttcgcagggaaattgaagacgaggccgaggccagtcggcggccccgtgctccctagttttggccggccaccctgatccattctgttcgccatggcccctggccattttcatgaccaatcaaaagttgataaccggtcgtgctctctttttctgggcaattcaatttcggccggggagttggagaaaagtaatcagcaggaaaaatgtgtaaagcgggcaaatcacttaatttgtctccagggcgtatttgtttactttatatccctctccggcgtagacgcgtacgctcctttcaggccaaccaagttaaaaagttttaagtgaaaatgcgaattgaatttgtagaggaaaaataagaaagtgcgcgcacacatgcagaaaa

SEQ ID NO: 3537 - protein, 252 aa, Drosophila simulans
MAQRYDRAVTIYSPDGHLLQVEYAQEAVRRGSTVMGLRTNNAIVIGVEKRSVGDLQEERMVRKICMLDDHVVMTFSGLTADARILVSRAQMEAQSHRLNFEKPTTVEYITRYIAQLKQNYTQSNGRRPFGLSCLVGGFDEDGTPHLFQTDPSGIFYEWRANTTGRSSQPVRDYMEKHADEILTIADEAAAIKHIVRTLVSVSSLNHTQMEVAVLKYRQPLRMIDHQVLADLERTVRREIEDEAEASRRPRAP

SEQ ID NO: 3538 - DNA, 1132 bp, Drosophila sechellia; identical to SEQ ID NO: 3536
  CDS (48)..(806)

SEQ ID NO: 3539 - protein, 252 aa, Drosophila sechellia; identical to SEQ ID NO: 3537

SEQ ID NO: 3540 - DNA, 756 bp, Drosophila simulans
  CDS (1)..(756)
atgtcctcacgctacgatcgagctataaccatattctcgccggatggccacctgttgcaggtggagtacgcccaggaagctgttcgaaagggttccacagcggttggcgttcgtggagccaattgcgtggtgctgggcgtggagaagagctcggtgtccccgatgcaggaggatcgaacggtgcaaaaaatcagcatgctcgacaagcacgttgcgttggcatttgccggtctcacggccgatgcacggatcctaataaatcgagggcagatggagtgccagagccatcgactcaacttcgacaaaccggtgacccccgagtacatcaccagatacattgcccagtttaagcacaagtacactcagtgcactggacgtcgtcctttcggaatatcctgtctagtcggaggcattgacgccgatggctctgcacgtctcttccacacggaaccatccgggatattctacgagtacaaggcgatcgccactgggcgttcggcaaatactgtgagggagttctttgaaaaggcctatcgcgaccatgaagtgacaaccaaatgtgaagccatcaaactagccacgcgtgcccttctcgaggtaacccagttgggccagagccgcctggaggtggccgttttggagcatggcaagccaatgaaaatgctggacagctgtgtaatttcggaaatagttaaaatccttcagaaggaaaaggagcaggagctccaagcgaaggcacataaaatgaagagatga

SEQ ID NO: 3541 - protein, 251 aa, Drosophila simulans
MSSRYDRAITIFSPDGHLLQVEYAQEAVRKGSTAVGVRGANCVVLGVEKSSVSPMQEDRTVQKISMLDKHVALAFAGLTADARILINRGQMECQSHRLNFDKPVTPEYITRYIAQFKHKYTQCTGRRPFGISCLVGGIDADGSARLFHTEPSGIFYEYKAIATGRSANTVREFFEKAYRDHEVTTKCEAIKLATRALLEVTQLGQSRLEVAVLEHGKPMKMLDSCVISEIVKILQKEKEQELQAKAHKMKR

SEQ ID NO: 3542 - DNA, 756 bp, Drosophila sechellia
  CDS (1)..(756)
atgtcctcacgctacgatcgagctataaccatattctcgccggatggccacctgttgcaggtggagtacgcccaggaagctgttcgaaagggttccacagcggttggcgttcgtggagccaattgcgtggtgctgggcgtggagaagagctcggtgtccccgatgcaggaggatcgaacggtgcaaaagatcagcatgctcgacaagcacgttgcgttggcatttgccggtctcacggccgatgcacggatcctaataaatcgagggcagatggagtgccagagccatcgactcaacttcgacaacccggtgacccccgagtacatcaccagatacattgcccagcataagcagaagtacactcagtgcactggacgtcgtcctttcggaatatcctgtctagtcggaggcattgacgccgatggctctgcacgtctcttccacacggaaccatccggaatattctacgagtacaaggcgatctccactgggcgttcggcaaatactgtgagggagttctttgaaaaggcctatcgcgaccatgaagtgacaaccaaatgtgaagccatcaagctagccacacgagcccttctcgaggtaactcagttgggccagagccgcctggaggtggccgttttggagaatggcaagccaatgaagatgctggacagctgtgttatttcggaaatagttaagatctttcaaaaggaaaaggagcaggagctccaagcgaaggcacataaaatgaagagatga

SEQ ID NO: 3543 - protein, 251 aa, Drosophila sechellia
MSSRYDRAITIFSPDGHLLQVEYAQEAVRKGSTAVGVRGANCVVLGVEKSSVSPMQEDRTVQKISMLDKHVALAFAGLTADARILINRGQMECQSHRLNFDNPVTPEYITRYIAQHKQKYTQCTGRRPFGISCLVGGIDADGSARLFHTEPSGIFYEYKAISTGRSANTVREFFEKAYRDHEVTTKCEAIKLATRALLEVTQLGQSRLEVAVLENGKPMKMLDSCVISEIVKIFQKEKEQELQAKAHKMKR

SEQ ID NO: 3544 - DNA, 783 bp, Caenorhabditis elegans
  CDS (1)..(783)
atgagttcaatcggtaccggctacgatctcgccgcctctactttttctcctgatggcagaattttccaagtcgagtacgctcaaaaggctgtcgacaatgcaggaacaatgattgcaattcgtggcaagaacggagttgtggtcgttgctgacaagctgatctcttccaaactttacactgataacgctaatccaagaatgtttaacgtgaacgacaatgttggtgtcgcagttgctggaaactatccagatggtttcgctctgaagaactatgcttacggagaagcaatgaagtggctcaaagactaccgtgagccaatgccgattcagaatattgctaactcagttgctgagtacattcacattcacactctcggcattagtcgtccgtttggagcaggagccttcttcatgtcatggaacaaacaaactggaggacgtcttttccttgtggagccatcaggtctaaactatgaatacaaggcatgggctgtcggaaaacatcgccaagccgcaaaagctgagattgagaagctgaagatcgaggagctggatgtgaatcaactcgtgaaggaagctgctcgaatcattatggtggtgcgtgacgagaacaaggataaaaacgttcaaatcgaaatgggatgggtcggtgagcagacgaacggaaagtacgaagaagttccaagcgaggttgtcactgctgccgaggaatgggctattgcaagcttgacgaggacgacatggacgattgaatcattctcgtgtatttattcacatttttaa

SEQ ID NO: 3545 - protein, 260 aa, Caenorhabditis elegans
MSSIGTGYDLAASTFSPDGRIFQVEYAQKAVDNAGTMIAIRGKNGVVVVADKLISSKLYTDNANPRMFNVNDNVGVAVAGNYPDGFALKNYAYGEAMKWLKDYREPMPIQNIANSVAEYIHIHTLGISRPFGAGAFFMSWNKQTGGRLFLVEPSGLNYEYKAWAVGKHRQAAKAEIEKLKIEELDVNQLVKEAARIIMVVRDENKDKNVQIEMGWVGEQTNGKYEEVPSEVVTAAEEWAIASLTRTTWTIESFSCIYSHF

SEQ ID NO: 3546 - DNA, 738 bp, uncultured archaeon
  CDS (1)..(738)
atgatgccacaaatgggttatgatcgggcgataacagtattcagccctgatggaagattgtttcaagtagaatacgcaagggaagcggtgaaaagaggaactaccgccgtggggataaaggcacaggatggtgttgcgctgttggtggacaagagattgacttcccgactattggaaggtggctccgtagagaaaatattccggttagacacgcatataggcgcagcaacttctggattggtagcagatgcgaggatgctgatagatcgaggtcgaatagaatcacaaataaataaagtcgtatatgacgagccaatagctgtggaaacattagcgaaaaagatatgcgattataagcaagcatttacacaatatggcgggcttagaccttttggtaccgcgttgttgataggtggtgtatacaatggcgatacgtacctctttgaaactgaccccagtggggcgttactggaatataaagcaactgctataggttccgggagaagcatagtaacagagctacttgagcagcagtataaagaaggcatcaaacttgaagatgccatcttgctcggtttggaagcgttgtataaagtaacagaaggaaagatagacataacaaccgtggatgtaggtctcgctgagtcaaagacgaaaactttcaggattttagaggcaaaggagctggaaccgtacataaagaaggtgcaagagaggggaaagaaggcagaagagtaa

SEQ ID NO: 3547 - protein, 245 aa, uncultured archaeon
MMPQMGYDRAITVFSPDGRLFQVEYAREAVKRGTTAVGIKAQDGVALLVDKRLTSRLLEGGSVEKIFRLDTHIGAATSGLVADARMLIDRGRIESQINKVVYDEPIAVETLAKKICDYKQAFTQYGGLRPFGTALLIGGVYNGDTYLFETDPSGALLEYKATAIGSGRSIVTELLEQQYKEGIKLEDAILLGLEALYKVTEGKIDITTVDVGLAESKTKTFRILEAKELEPYIKKVQERGKKAEE

SEQ ID NO: 3548 - DNA, 780 bp, Methanococcus maripaludis
  CDS (1)..(780)
atgcaacaaatggttccagcatcaggatacgatagagcaataacgatattcagccctgaaggaagactttaccaggttgaatatgctagagaagcagttagacgaggaactactgccgtaggaattaagtgtaaagatggagtggttctcgcagtcgataggagaattactagcaaattaattgacgtttcatcaattgaaaaaatatttcaaatcgacgaccatattgtagctgctacatcaggtttagttgctgatgcaagagttttaattgatagagcaagaatcgaggctcagatgaacagggtttcttatggtgaagcaatcactgttgaagcacttgcaaaaaaaatctgtgacattaaacaggcatacactcaacacggcggtgcaagaccatttggtttggcacttttaattactggaatcgacagacacagtgcaagactgttcgaaactgatccaagtggtgccttaatagaatacaaagcaacagcaattggttctggaaggcctatcgcaatggaagttcttgaatcaaaatacgacgaaaatatgactgttagcgaaggaatggaattagcactttacgctttaagtaaaactactgaagaattaaagcctgaaaatattgatatggccataataaaagattctggaaaattagttgaaaaaataagtgttgatgaaattgaaaaaatcgtaaaagcagtttacgaaaaagttaaggctgaagaagaggaagctgaaaaaaataaaggcgaagaagatagtgaataa

SEQ ID NO: 3549 - protein, 259 aa, Methanococcus maripaludis
MQQMVPASGYDRAITIFSPEGRLYQVEYAREAVRRGTTAVGIKCKDGVVLAVDRRITSKLIDVSSIEKIFQIDDHIVAATSGLVADARVLIDRARIEAQMNRVSYGEAITVEALAKKICDIKQAYTQHGGARPFGLALLITGIDRHSARLFETDPSGALIEYKATAIGSGRPIAMEVLESKYDENMTVSEGMELALYALSKTTEELKPENIDMAIIKDSGKLVEKISVDEIEKIVKAVYEKVKAEEEEAEKNKGEEDSE

SEQ ID NO: 3550 - DNA, 24 bp, Primer
atgggttccagaagatacgattcc

SEQ ID NO: 3551 - DNA, 27 bp, Primer
ttatttcatatcttcatcagcttcttc

SEQ ID NO: 3552 - DNA, 336 bp, Saccharomyces cerevisiae
  CDS (1)..(336)
atgactaaaagtatatatattatcatcggatatatgctacatgatgaggagtttttctatttcttttttatttcattctatacactttggatcgtgttttttcttttgcacttgagtttcttttcaacattatcattcggtatatttcacgattttgacaccgatgtttacataaaagtgggtaattatattttgcattttctcgaattgagtaaaaatagtaaccttttaaagaattcttcagaaatgttaaagcatttccgattggcatcattgatgtatatgtacgtatatactcagatgatttgcccctcgttacttggcatcaggaattag

SEQ ID NO: 3553 - protein, 111 aa, Saccharomyces cerevisiae
MTKSIYIIIGYMLHDEEFFYFFFISFYTLWIVFFLLHLSFFSTLSFGIFHDFDTDVYIKVGNYILHFLELSKNSNLLKNSSEMLKHFRLASLMYMYVYTQMICPSLLGIRN

SEQ ID NO: 3554 - DNA, 28 bp, Primer
atgactaaaagtatatatattatcatcg

SEQ ID NO: 3555 - DNA, 24 bp, Primer
ctaattcctgatgccaagtaacga

SEQ ID NO: 3556 - DNA, 1716 bp, Saccharomyces cerevisiae; identical to SEQ ID NO: 230
  CDS (1)..(1716)

SEQ ID NO: 3557 - protein, 571 aa, Saccharomyces cerevisiae; identical to SEQ ID NO: 231

SEQ ID NO: 3558 - DNA, 2817 bp, Neurospora crassa; identical to SEQ ID NO: 1285
  CDS (1)..(2817)

SEQ ID NO: 3559 - protein, 938 aa, Neurospora crassa; identical to SEQ ID NO: 239

SEQ ID NO: 3560 - DNA, 2658 bp, Mus musculus; identical to SEQ ID NO: 1287
  CDS (1)..(2658)

SEQ ID NO: 3561 - protein, 885 aa, Mus musculus; identical to SEQ ID NO: 245

SEQ ID NO: 3562 - DNA, 2583 bp, Xenopus laevis; identical to SEQ ID NO: 246
  CDS (1)..(2583)

SEQ ID NO: 3563 - protein, 860 aa, Xenopus laevis; identical to SEQ ID NO: 247

SEQ ID NO: 3564 - DNA, 2568 bp, Homo sapiens; identical to SEQ ID NO: 1291
  CDS (1)..(2568)

SEQ ID NO: 3565 - protein, 855 aa, Homo sapiens; identical to SEQ ID NO: 241

SEQ ID NO: 3566 - DNA, 2625 bp, Homo sapiens; identical to SEQ ID NO: 242
  CDS (1)..(2625)

SEQ ID NO: 3567 - protein, 874 aa, Homo sapiens; identical to SEQ ID NO: 243

SEQ ID NO: 3568 - DNA, 2076 bp, Caenorhabditis elegans; identical to SEQ ID NO: 1295
  CDS (1)..(2076)

SEQ ID NO: 3569 - protein, 691 aa, Caenorhabditis elegans; identical to SEQ ID NO: 235

SEQ ID NO: 3570 - DNA, 1782 bp, Schizosaccharomyces pombe; identical to SEQ ID NO: 1297
  CDS (1)..(1782)

SEQ ID NO: 3571 - protein, 593 aa, Schizosaccharomyces pombe; identical to SEQ ID NO: 237

SEQ ID NO: 3572 - DNA, 26 bp, Primer
atgaatgatcctcgtgaaattttagc

SEQ ID NO: 3573 - DNA, 25 bp, Primer
ttatattatctcaagatcgctggca

SEQ ID NO: 3574 - DNA, 2244 bp, Saccharomyces cerevisiae
  CDS (1)..(2244)
atgaacgtttcaaaaatacttgtgtcgcccacggtcacgacaaatgttttacgcatatttgctcccaggctacctcaaatcggtgcttctttgttagttcaaaaaaaatgggccttaagatcaaagaagttctaccgtttttattctgaaaagaatagcggtgaaatgcctcctaagaaggaagctgatagctctggaaaggcatccaataaatccacgatatcttcaatcgacaattcgcaaccaccacctccatcgaacactaatgataaaaccaaacaagcgaacgtagctgtgtcacatgctatgctagcaactagagaacaagaggccaataaagacttaacgagtcctgatgcacaagcagccttttacaaacttctcttacaatcaaactacccgcaatacgtggtctctaggtttgagacccccggtattgcgtcatcgcctgaatgcatggaactgtacatggaggccctgcagaggataggcagacactcggaggctgatgccgttagacaaaacctactgacagccagctctgctggcgcagttaacccatcattggcgtcatcttcatcaaaccagtcaggttatcatggtaactttccatcgatgtattctccgctttatggatctcgcaaagagccactacatgttgtcgtatctgaatcaacttttactgttgtatcgagatgggtaaagtggctgcttgttttcggtatcttaacctactctttttctgaaggttttaaatacatcacagaaaatacaacgctactaaagtcgtcagaagtagccgacaaatcagttgatgtagctaagacaaatgttaaatttgatgatgtctgcggttgtgatgaggcccgtgcggaattggaagaaattgttgatttcctgaaagatccaactaagtacgagtccttgggtggtaaactaccaaagggtgtactgttgactggacctcctggtacaggtaaaactttgttggctagggccactgccggagaggctggtgtagattttttctttatgtcaggttctgaatttgatgaagtttacgtcggtgttggtgctaaacgtatccgtgatttgtttgctcaagcgcgttctcgtgcaccagctattatttttattgatgaattagatgccatcggtggtaagcgtaatccaaaggaccaagcttacgccaaacaaacgttgaatcagttattggtcgaattagatggtttctcacaaacaagtggaattattattattggtgccacaaatttccctgaggctttagataaggcgttaactagaccaggtagatttgataaggttgtgaatgtggatttgccagatgttcgtggtcgtgctgatattttaaagcatcacatgaagaagattacattggcagacaatgtggatccaactattattgcgcgtggtacccccggtttatcaggcgctgagctggcaaatttagtcaaccaagcagcagtttacgcgtgtcaaaaaaatgctgtttccgttgatatgtcccacttcgagtgggctaaggataagatattgatgggtgctgagagaaagactatggtcttaacagatgcagccagaaaggccactgctttccacgaggctggacatgccattatggccaaatacaccaatggtgctaccccgctatacaaggccacgatattgcctagaggtagggcattgggtattacttttcaattgccagaaatggataaggtcgacatcaccaaaagggagtgtcaagccagactggacgtgtgcatggggggcaaaattgcagaagaattaatttatggtaaagataacaccacaagtggttgtgggtctgacttgcaaagcgccaccggcacagcaagggctatggttactcaatatggtatgagtgatgatgtaggtcccgttaacttgtcagaaaattgggaatcttggtctaataagattcgcgatattgctgataatgaagtgattgaacttttgaaggactccgaggaaagagcaagaagactattaactaagaaaaatgttgagctacatagacttgcgcaaggtcttattgaatatgaaactctagatgcccacgaaatcgaacaagtttgtaaaggtgaaaaactggacaaactgaaaacttccaccaatacagtcgtagaaggaccagacagtgatgaacgtaaagatataggcgatgataaacccaaaattcctacaatgttaaatgcatga

SEQ ID NO: 3575 - protein, 747 aa, Saccharomyces cerevisiae
MNVSKILVSPTVTTNVLRIFAPRLPQIGASLLVQKKWALRSKKFYRFYSEKNSGEMPPKKEADSSGKASNKSTISSIDNSQPPPPSNTNDKTKQANVAVSHAMLATREQEANKDLTSPDAQAAFYKLLLQSNYPQYVVSRFETPGIASSPECMELYMEALQRIGRHSEADAVRQNLLTASSAGAVNPSLASSSSNQSGYHGNFPSMYSPLYGSRKEPLHVVVSESTFTVVSRWVKWLLVFGILTYSFSEGFKYITENTTLLKSSEVADKSVDVAKTNVKFDDVCGCDEARAELEEIVDFLKDPTKYESLGGKLPKGVLLTGPPGTGKTLLARATAGEAGVDFFFMSGSEFDEVYVGVGAKRIRDLFAQARSRAPAIIFIDELDAIGGKRNPKDQAYAKQTLNQLLVELDGFSQTSGIIIIGATNFPEALDKALTRPGRFDKVVNVDLPDVRGRADILKHHMKKITLADNVDPTIIARGTPGLSGAELANLVNQAAVYACQKNAVSVDMSHFEWAKDKILMGAERKTMVLTDAARKATAFHEAGHAIMAKYTNGATPLYKATILPRGRALGITFQLPEMDKVDITKRECQARLDVCMGGKIAEELIYGKDNTTSGCGSDLQSATGTARAMVTQYGMSDDVGPVNLSENWESWSNKIRDIADNEVIELLKDSEERARRLLTKKNVELHRLAQGLIEYETLDAHEIEQVCKGEKLDKLKTSTNTVVEGPDSDERKDIGDDKPKIPTMLNA

SEQ ID NO: 3576 - DNA, 1866 bp, Clostridium acetobutylicum
  CDS (1)..(1866)
atgtttgataataaagatttcaaagataacaagtataagtatgctattttttatacactaggggcaataatttttgtcctattggttaattatgcagcatcctcaataagaactgaagaaataacatataataaatttctcgatttattaaatgcaaaaaaagtttcacaggttaatatttcagatgaaaagataatgatagtgccaaaagagaatgctggctttcataaaaagattctatatacaggtagaatagaagatccggatttaaaaactgagcttaagaaatcaggagcagaaataaagccagagataaaaaatgatgatccaataaagaattttttaatcacatggattttgccgataatacttcttgctttctttggtaagattttatttggaaaactggataaaaagtttggtaatggagttatgtcttttggtaagaataatgctaaattatatgcagaaagtgaaacaggaaaaacctttgaagatgttgctggacaggaagaagcaaaagagtctcttgtggaaattgtagattttctacataatcctaataaatatgcagaaataggagctaaacttcctaagggagcacttttagttggtccgccaggtacaggaaaaactcttttagcaaaggctgtagctggagaggccaaagtaccatttttttcaatgtcaggttctgattttgttgaaatgtttgttggaatgggagctgcaagggttagagatttatttgagcaagctcaagaaaaggcaccttgtataatatttatagatgaaatagacgccataggtaagagtagagaaaatacacttggaggctctaatgatgagagagagcaaactttaaatcagcttttagcagaaatggatggttttgattcgtcaaagggagttgttattttagctgcaactaatagaccagagattttagataaggcacttttaaggcctggaagatttgatagaagagttatagtagatagacctgatttaaaaggtagggaggctatacttaaagttcatgctaaagatgttaagatgtcagaggatatatctcttgaagaaatagcaaaagcaacctcaggtgctgttggagctgatcttgcaaatatagtaaatgaagctgcacttttagctgtaaagaatggaaggaataaggtttatcaggaagatctagataaggcagttgaatttataattgcaggaaaagaaaagaaagataagatattgtcagataaagacaagaagacagttgcatatcatgaagttggtcatgcgttagtagcggctcttttaaaacatactaatccggtacataaaataactattgtgcctacaactatgggagcattgggatatactatgcagcttccagaagaagaaaaatatcttgtaactaaagatgaaatgatggatgagatatctgttctacttggaggaaggtcctcagaggaagttgtttttggaactatttcaacgggagcatcaaatgatatagaaaaagccacacaaactgctagaaatatggttacaatatatggaatgactgataagtttgatatgatggcacttcagtctcaaggaagtagatatttagatggaactcctgctaaaaattgtagcaatgaagttgagtatgaagcagataaagaggtattaagaattataaaagaagcacataataaagcaaaggatattttaaaggcgaatagagagcttcttgatagtattgcagaaattcttcttgtgaaagaaacattaactggcagcgaatttatgaaaattgtaaaggagagctcagcatggaaagagatgaacgaaatacagatggagaagttaacagattaa

SEQ ID NO: 3577 - protein, 621 aa, Clostridium acetobutylicum
MFDNKDFKDNKYKYAIFYTLGAIIFVLLVNYAASSIRTEEITYNKFLDLLNAKKVSQVNISDEKIMIVPKENAGFHKKILYTGRIEDPDLKTELKKSGAEIKPEIKNDDPIKNFLITWILPIILLAFFGKILFGKLDKKFGNGVMSFGKNNAKLYAESETGKTFEDVAGQEEAKESLVEIVDFLHNPNKYAEIGAKLPKGALLVGPPGTGKTLLAKAVAGEAKVPFFSMSGSDFVEMFVGMGAARVRDLFEQAQEKAPCIIFIDEIDAIGKSRENTLGGSNDEREQTLNQLLAEMDGFDSSKGVVILAATNRPEILDKALLRPGRFDRRVIVDRPDLKGREAILKVHAKDVKMSEDISLEEIAKATSGAVGADLANIVNEAALLAVKNGRNKVYQEDLDKAVEFIIAGKEKKDKILSDKDKKTVAYHEVGHALVAALLKHTNPVHKITIVPTTMGALGYTMQLPEEEKYLVTKDEMMDEISVLLGGRSSEEVVFGTISTGASNDIEKATQTARNMVTIYGMTDKFDMMALQSQGSRYLDGTPAKNCSNEVEYEADKEVLRIIKEAHNKAKDILKANRELLDSIAEILLVKETLTGSEFMKIVKESSAWKEMNEIQMEKLTD

SEQ ID NO: 3578 - DNA, 1842 bp, Nostoc sp. PCC 7120
  CDS (1)..(1842)
atgaataaaagatggagaaatgcggggctgtacgcgctgctatttattgttgtaattgcgcttggcacagctttttttgaaaaacaaccccaaagtcgggaatcatggcgctatagccagtttattcaagaagttgaaaaaggcagagtagaaagagttagtttgagtgcagaccgttctacggcactggttacacccaaatatgaccctagtaaaaaacttgttactttagtcaacgatccagaattaattaatactctgactgcaagaggcgttgatattactgttttgccacaaaccgatgaaggattttggttcaaggctttaagcagcttatttttccctgtattgcttttggtgggcttattcttcttactccgtcgcgctcaaagtggccctggtagccaagccatgaactttggcaaatccaaagccagagtgcaaatggagccacaaacccaagttacctttggtgatgttgcggggattgaccaagcaaaattagaactaaacgaagtcgtagactttcttaaaaatgccgatcgctttactgctgtcggtgcgaaaattcctaaaggtgtattgttagtagggcctccaggtacaggtaaaaccctcctagcccgtgcagtagccggggaagctggcgtacctttcttctccatctctggttctgagtttgtggaaatgttcgttggtgtgggtgcgtcccgcgtccgcgatttatttgaacaagctaagtctaatgctccttgtatcgtcttcatcgatgaaatcgacgctgttggtcgtcaacggggtgctggtttaggtggtggtaacgatgaacgagaacaaactctcaaccagttactcaccgaaatggatggttttgaaggtaataccggcatcattattattgctgctactaaccgtcccgatgtacttgatgccgccttgttgcgtcccggtcgttttgaccgtcaagtcgtcgttgaccgtcccgactacgctggacgtagcgaaattctcaaagtccacgcccgtggtaaaaccttggctaaggatgtggacttggataaaatcgctcgtcgtacccccggatttacaggtgcagatttatccaacctgctgaacgaagctgctatcttagccgcacggcgcaacctgaccgaaatttcgatggacgaaatcaacgacgcaattgaccgcgtgttggctgggccagagaagaaagaccgggtaatgagcgaaaaacgcaaagttttggtagcttatcacgaagctggtcacgctttagttggtgcattgatgcccgactatgacccagtacaaaaaatcagcattattcctcgcggacgtgccggtggtttgacttggttcacccccagcgaagaccgcatggatacaggcttgtacagccgtgcttatctggaaaatcagatggccgtagctttgggtggtcgcatcgctgaagaaatcatctttggtgaagaagaagtaaccacaggtgcttccaatgacttacagcaagtagcccgtgtagcgcgtcagatgattacccgatttggcatgagcgataaactcggccctgtcgcccttggtcgtcagcaaggcaatatgttcctcggtcgtgacatcatgtcagagcgcgatttctcggaagaaacagcagctgctattgatgaagaagttcacaaattagtagaaacagcttacacccgtgctaaagaagtgttggtaaataaccgccacatcctcgaccaaatcgcgcaaatgctggttgataaagaaaccgtagatgccgatgagttgcaagaaattttggcaaataacgacgtgaaaaccgccgcgtttgcctaa

SEQ ID NO: 3579 - protein, 613 aa, Nostoc sp. PCC 7120
MNKRWRNAGLYALLFIVVIALGTAFFEKQPQSRESWRYSQFIQEVEKGRVERVSLSADRSTALVTPKYDPSKKLVTLVNDPELINTLTARGVDITVLPQTDEGFWFKALSSLFFPVLLLVGLFFLLRRAQSGPGSQAMNFGKSKARVQMEPQTQVTFGDVAGIDQAKLELNEVVDFLKNADRFTAVGAKIPKGVLLVGPPGTGKTLLARAVAGEAGVPFFSISGSEFVEMFVGVGASRVRDLFEQAKSNAPCIVFIDEIDAVGRQRGAGLGGGNDEREQTLNQLLTEMDGFEGNTGIIIIAATNRPDVLDAALLRPGRFDRQVVVDRPDYAGRSEILKVHARGKTLAKDVDLDKIARRTPGFTGADLSNLLNEAAILAARRNLTEISMDEINDAIDRVLAGPEKKDRVMSEKRKVLVAYHEAGHALVGALMPDYDPVQKISIIPRGRAGGLTWFTPSEDRMDTGLYSRAYLENQMAVALGGRIAEEIIFGEEEVTTGASNDLQQVARVARQMITRFGMSDKLGPVALGRQQGNMFLGRDIMSERDFSEETAAAIDEEVHKLVETAYTRAKEVLVNNRHILDQIAQMLVDKETVDADELQEILANNDVKTAAFA

SEQ ID NO: 3580 - DNA, 1947 bp, Agrobacterium tumefaciens
  CDS (1)..(1947)
atgaacccaaatttcagaaatttcgccttgtgggccgtgatcgccctgttgctgatcgcgctgttcagcatgttccagacgtcgccgacgcaaacgggttcacgggagattccgtattcccagtttattcgtgacgtggattccgggcgagttcgcgacgtgaccgtcaccggtaaccgggttctcggaacctataccgaaaacggcacggcctttcagacctattcccccgtcattgacgacagcctgatggagcgcttgcagagcaagaacgtcaccatcgtggcgcgtccggaaagcgacggctcctcgggtttcctgagctatctcggcacgcttctgcctatgttcctcatcctcggcgtctggctgttcttcatgcggcagatgcagggcggttcgcgtggtgcgatgggctttggcaaatcaaaggccaagcttctgacggaagcccacggccgcgtgacgtttgacgacgtcgcaggcgtggacgaagccaagcaggatctcgaggaaatcgtggaattcctgcgcgatccgcagaagttccagcgtcttggcggtaagattccgcgcggcgtgctgctggtcgggcctccgggcaccggtaagacgcttctcgcccgctccgtcgccggcgaagccaacgtgccgttcttcacgatttccggttcggacttcgttgaaatgttcgtcggcgtcggtgcaagccgcgtgcgtgacatgttcgagcaagccaagaagaacgcaccctgtatcatcttcatcgacgaaatcgacgccgtcggccgccatcgtggcgccggtcttggtggcggtaacgacgaacgcgaacagacgctgaaccagctgttggtcgagatggatggctttgaggcgaatgaaggcatcatcctcatcgccgctaccaaccgtcctgatgttcttgaccccgcgcttctgcgtcccggccgtttcgaccgtcaggtcgtcgtgccgaacccggatattgtcggccgcgagcgcatcctcaaggttcacgttcgcaacgtgccgctggcgccgaatgtcgatctcaagattctggcccgcggtacgcccggcttttcgggtgcggatctgatgaacctcgtcaacgaagccgccctcatggccgcccgccgcaacaagcgcgtggtcaccatgcaggagttcgaagacgccaaggacaagatcatgatgggtgcggaacgccgctcctccgccatgaccgaagccgaaaagaagctgaccgcctatcatgaggccggtcatgcgattactgcgctgaaggttgccgtggccgatccgctgcacaaggcgacgatcattccgcgcggccgtgcactcggcatggtgatgcagctgccggaaggcgaccgctattccatgagctacaagtggatggtatcgcgccttgtgatcatgatgggtggacgcgttgccgaggaattgaccttcggcaaggagaacatcacgtctggcgcgtcttctgacatcgagcaagccaccaagcttgcccgcgccatggttacgcaatggggcttctccgacgctctcggtcaggtggcttatggtgaaaaccagcaggaagtgttccttggtcattccgtctcgcagtcgaagaacgtctccgaggcaacggcccagacgatcgataccgaagtccgccgtctgatcgacgaggcttacaccgaagcacggcgtatcctcacggacaaccacgatggctttgtcgcaattgcagagggtcttctcgaatatgagaccctgacgggtgaagagatcaaggcgttgctgaggggcgaaaagcccgctcgtgatctgggtgacgattcgcccggcagccgtggttcggctgtgccgaaagctggcgccaagaaggacggcccgagtgaagccaagggcgatggcgaggccgaaggcggcatggagccgcagccgcattga

SEQ ID NO: 3581 - protein, 648 aa, Agrobacterium tumefaciens
MNPNFRNFALWAVIALLLIALFSMFQTSPTQTGSREIPYSQFIRDVDSGRVRDVTVTGNRVLGTYTENGTAFQTYSPVIDDSLMERLQSKNVTIVARPESDGSSGFLSYLGTLLPMFLILGVWLFFMRQMQGGSRGAMGFGKSKAKLLTEAHGRVTFDDVAGVDEAKQDLEEIVEFLRDPQKFQRLGGKIPRGVLLVGPPGTGKTLLARSVAGEANVPFFTISGSDFVEMFVGVGASRVRDMFEQAKKNAPCIIFIDEIDAVGRHRGAGLGGGNDEREQTLNQLLVEMDGFEANEGIILIAATNRPDVLDPALLRPGRFDRQVVVPNPDIVGRERILKVHVRNVPLAPNVDLKILARGTPGFSGADLMNLVNEAALMAARRNKRVVTMQEFEDAKDKIMMGAERRSSAMTEAEKKLTAYHEAGHAITALKVAVADPLHKATIIPRGRALGMVMQLPEGDRYSMSYKWMVSRLVIMMGGRVAEELTFGKENITSGASSDIEQATKLARAMVTQWGFSDALGQVAYGENQQEVFLGHSVSQSKNVSEATAQTIDTEVRRLIDEAYTEARRILTDNHDGFVAIAEGLLEYETLTGEEIKALLRGEKPARDLGDDSPGSRGSAVPKAGAKKDGPSEAKGDGEAEGGMEPQPH

SEQ ID NO: 3582 - DNA, 1887 bp, Nostoc sp. PCC 7120
  CDS (1)..(1887)
atgaaattctcttggagagtcctagtactctggacattgccagctttggtaattggttttttcttttggcaagggacgtttgctggcgctcctgcggacatgagcaagaatgcagctaacactcgcatgacttacggtcgctttttggaatatgtagatgctggacgtgttaccagcgttgacttatacgaaggcggcagaacagctattgtggaagcccaggatcaagatatcgaaaaccgtgtccaacgttggcgggtggatttgccagttagcgctcctgagttaatcagcaaacttaaagacaagaaagtaagttttgatgctcatccagcacgtaatgatggcgctatctggggattgttgggcaatctagtgttccccatcttattgattactggattgttctttttgttccgtcgctctaataatcttccgggtggccctggtcaagccatgaactttggcaaatccaaagcgcgtttccaaatggaagccaaaactggggtgaagtttgacgatgtagctggtatcgaagaagcgaaggaagaattgcaagaagttgtgacattcctcaaacagccagaaagatttacggctgtgggtgcgcggattcccaaaggtgttctgttagtagggcctccagggactggtaaaactttactagcaaaagcgatcgctggggaagctggtgtaccattctttagcatttccggttcggaatttgtggaaatgttcgtgggtgtgggtgcttcccgcgtgcgtgacttatttaagaaagctaaagataacgctccctgtatcatcttcatcgatgaaattgacgcagttgggagacaacggggtgcaggtattggcggcggtaacgacgagagagaacaaactctcaaccagttactcaccgagatggatggttttgaaggcaatacaggcatcattattattgctgctaccaaccgtcccgacgtattagatgcagcgttgttacgtcctggtcgttttgacagacaagtaaccgttgatgctccagatattaaaggacgcttggaagttctgcaagtccacgcccggaataagaaattagatccgagtgtatcattagaagcgatcgcccgtcgtactcccggattcactggtgcagatttagcaaacttgcttaacgaagccgctattcttaccgccagaagacgcaaagaaggtattaccctcagcgaaattgatgacgctgttgatagagttgtcgccgggatggaaggcacacccctagtagatagcaagagcaagcgcttaattgcttaccatgaagtcggacacgccttggtcggtactttattaaaagaccatgacccagtgcagaaagttaccctgattcctagaggacaagcccaaggtttgacttggtttactcctaacgaagaacaagggttaatttctcgttcccaactcaaagccagaattactggcgctttgggtggtcgtgcggcggaagaaatcatttttggttctgcggaagtgaccactggtgcaggcggagacttgcaacaggtgtcaggaatggcacggcaaatggtgacaagatttggtatgtctgatttaggccccttgtccttggaaagtcagcaaggagaagtattcttaggtcgtgactggatgaccagatccgattattcagaatcaattgcggcaagaattgactctcaagtccgattgattgttgatgaatgctatcaaaacgctaagaagattatgcgtgaacatcgcaccgtgacagatcgcatagttgatctgctgattgaaaaagaaaccatcgacggcgaagagttccggcaaattgtcgctgagtacactgatgtgcctgataagcagcagtttgtaccacaactgtaa

SEQ ID NO: 3583 - protein, 628 aa, Nostoc sp. PCC 7120
MKFSWRVLVLWTLPALVIGFFFWQGTFAGAPADMSKNAANTRMTYGRFLEYVDAGRVTSVDLYEGGRTAIVEAQDQDIENRVQRWRVDLPVSAPELISKLKDKKVSFDAHPARNDGAIWGLLGNLVFPILLITGLFFLFRRSNNLPGGPGQAMNFGKSKARFQMEAKTGVKFDDVAGIEEAKEELQEVVTFLKQPERFTAVGARIPKGVLLVGPPGTGKTLLAKAIAGEAGVPFFSISGSEFVEMFVGVGASRVRDLFKKAKDNAPCIIFIDEIDAVGRQRGAGIGGGNDEREQTLNQLLTEMDGFEGNTGIIIIAATNRPDVLDAALLRPGRFDRQVTVDAPDIKGRLEVLQVHARNKKLDPSVSLEAIARRTPGFTGADLANLLNEAAILTARRRKEGITLSEIDDAVDRVVAGMEGTPLVDSKSKRLIAYHEVGHALVGTLLKDHDPVQKVTLIPRGQAQGLTWFTPNEEQGLISRSQLKARITGALGGRAAEEIIFGSAEVTTGAGGDLQQVSGMARQMVTRFGMSDLGPLSLESQQGEVFLGRDWMTRSDYSESIAARIDSQVRLIVDECYQNAKKIMREHRTVTDRIVDLLIEKETIDGEEFRQIVAEYTDVPDKQQFVPQL

SEQ ID NO: 3584 - DNA, 2073 bp, Listeria innocua
  CDS (1)..(2073)
atgaacaggttttttagaaatgcgatattttatgtcataatattccttgttattatcgggattgttgcttcatttaattcaaataaagaggcagccaaagatattagctattcagaatttgtgagtaaattagaagatggtaaagttaaatccgtagaaatacagccagaccgcagtgtttatacaatcgaaggagaatttaaatcaagcgataaaagctccgacgacaaaaaaaccggtcttggccaaagtaaaacaagcagcactgctttcacaacatacgctttaaatagcgatacttcacttggcgatttgcaaaaaacgcttgataaagaagacgtgaaaacaacagtagtacctgccaaacaaaacagcggttgggttacattcctaacttctattgtaccttttgtaattatcttcatcctcttcttcttcctaatgagccagtctcaaggtggtggcggcggtaaagttatgagctttggtaaaagtaaagccaaactttacaacgacgacaagaagaaagttcgcttcacagatgtagctggagcagacgaggaaaaacaagagcttgttgaagtagtagaattcctaaaagatccgcgcaaatttgcggaccttggcgctcgtattccgaaaggtgtccttttagtaggtcctccgggtactggtaaaaccttgctagctcgtgcagttgccggtgaagcaggcgtgccattcttctcaatctcaggttcagactttgtagaaatgtttgtcggtgtcggtgcaagccgtgtccgtgatttattcgaaaatgcgaagaaaaatgcaccatgtatcattttcattgatgaaattgatgcagttggtcgtcaacgtggagcaggaatgggcggcggtcacgatgaacgtgaacaaaccctaaaccaattactagttgaaatggatggtttcggcggcaatgaaggtatcatcattattgcagcaactaaccgtgcagacgtacttgacccagcacttcttcgtccaggtcgttttgaccgtcaaattatggttgatcgtccagacgtaaaaggccgtgaagcagtacttcgtgttcatgctcgtaacaaaccacttgctaaaagtgttgatttaaaagcaatcgctcaacgtacaccgggattctctggtgccgatttagaaaacttactgaatgaagctgcacttgttgccgctcgttccgataagaaagaaatagacatgagtgacctcgatgaagctagtgaccgcgtaattgctggaccagctaagaaaaatcgagttatctctgaaaaagaacgtcgcacagttgcatatcatgaaggtggtcacgttatcgtcggaatggtacttgatgaagcggaagttgtgcataaagttaccatcgttcctcgtggacaagctggtggttatgccgtaatgttaccaaaagaagatcgcttcctaatgacgaaagctgagttaatggaccgtattactggtttactaggtggacgcgtagccgaagaagttacttttggtgaagtaacaactggtgcaagtaatgactttgaacgtgcaactgaacttgctcgccgcatggtaactgaatggggtatgagtgataagattggaccacttcaattcacttctggtaatggtcaagtatttatgggccgcgattttggtagcgataaaggatattccgataaaatcgcctacgaaattgatacagaagttcaaagcttaatccgctactgttatgaccgcgctaaaacaatcattacagaacaccaagagcaacataaacttatcgcggaaacattactaaaagtagaaacattagatgctcgccaaattcgttccctatttgatgacggtgtaatgcctccagatatcgatacgattgacgtagaagcggaatatccttccgaaaaagacgaagaagtagcaggtaaatcttttgaagaagaaaaagaagacttgaaagaagaaaaagtcgaagaaacacaagatgaaccaaaagaagtaacttcggaagatgctccaaacattgagcaaactccaaacgataaaaaagacgaataa

SEQ ID NO: 3585 - protein, 690 aa, Listeria innocua
MNRFFRNAIFYVIIFLVIIGIVASFNSNKEAAKDISYSEFVSKLEDGKVKSVEIQPDRSVYTIEGEFKSSDKSSDDKKTGLGQSKTSSTAFTTYALNSDTSLGDLQKTLDKEDVKTTVVPAKQNSGWVTFLTSIVPFVIIFILFFFLMSQSQGGGGGKVMSFGKSKAKLYNDDKKKVRFTDVAGADEEKQELVEVVEFLKDPRKFADLGARIPKGVLLVGPPGTGKTLLARAVAGEAGVPFFSISGSDFVEMFVGVGASRVRDLFENAKKNAPCIIFIDEIDAVGRQRGAGMGGGHDEREQTLNQLLVEMDGFGGNEGIIIIAATNRADVLDPALLRPGRFDRQIMVDRPDVKGREAVLRVHARNKPLAKSVDLKAIAQRTPGFSGADLENLLNEAALVAARSDKKEIDMSDLDEASDRVIAGPAKKNRVISEKERRTVAYHEGGHVIVGMVLDEAEVVHKVTIVPRGQAGGYAVMLPKEDRFLMTKAELMDRITGLLGGRVAEEVTFGEVTTGASNDFERATELARRMVTEWGMSDKIGPLQFTSGNGQVFMGRDFGSDKGYSDKIAYEIDTEVQSLIRYCYDRAKTIITEHQEQHKLIAETLLKVETLDARQIRSLFDDGVMPPDIDTIDVEAEYPSEKDEEVAGKSFEEEKEDLKEEKVEETQDEPKEVTSEDAPNIEQTPNDKKDE

SEQ ID NO: 3586 - DNA, 1971 bp, Nostoc sp. PCC 7120
  CDS (1)..(1971)
atggcaatttttgctagaagaataggcttaaatcagcactcagcctatggcagcagacaaagggtaattgttatgaaaaattttgggaaaaaggcattgataaaacagcaatcaccaaagcgcgttgcttggactggtgctttggcggccagcttgattatgttaccaacgatgtttggcggtaatcctgtcttagcgcagaaagcagagcgtgagtctctgtcatacggagagttgattcaaaaagttaatcaagagcaagtcaaaagagtagaactggacgaaactgaacagatagccaaagtttatttaaaaggtcaaaaaccagacgcaccaccaatacaggtgaggttgttggagcagaacaacgagttaattaatagactcaaagaaaaaaatgttgattttggcgagatttcttctgccaatagtagagcggctgtagggttattaattaacctgatgtggattttgccattggtggctttaatgctgctattcttgcgtcgttctacgaatgcttctagccaagccatgaactttggcaaatctagagcgcgtttccaaatggaagccaagactggggtaaaatttgacgacgtagcgggtattgaagaagcgaaggaagaattacaagaagttgtgacattcctcaagcagccagaaagatttacggctgtgggtgcgcgcatacctaaaggtgtgctgttggtggggcctccaggtactggtaaaactttactagcaaaagcgatcgctggggaagcggctgtgccatttttcagtatctctggttcggaatttgtggaaatgtttgtgggtgtaggtgcttcccgtgtccgtgatttgtttaagaaagctaaagacaatgcaccttgtctgatatttatcgatgaaatagatgcagttggcagacaacgaggtacgggtattggtggcggtaacgacgaaagagaacagaccctcaatcagttactcacggagatggatggttttgaaggtaacacaggcatcattattattgctgccactaaccgtcctgatgtattagattcagccttgttacgtcctggtcgttttgacagacaagtaattgttgatgcaccagacttgaaaggacgcttagagattttgcaagtccattcgcgcaataagaaagttgaccctagtgtatcactggaggcgatcgctcgccgcacacccggattcactggtgcagatttagctaacttactcaacgaagccgctatcctcacagcacgtaggcgcaaagaagcaattacgattctagaaattgatgatgctgttgatagagtcgtcgctggtatggaagggacacccctagtagacagcaaaagcaaacgcttaattgcttaccatgaagtcggacatggtttagtcgggacgctattaaaagaccatgacccagtgcagaaagttaccctcattcccagaggacaagcacagggtttaacttggtttactcccaacgaagaacaagggttaatctcccgttcccaactcaaagccagaattacttctactttggctggtcgtgctgctgaggagattgtctttggtaagccggaagtgaccacaggtgcaggggatgacctgcaaaaagtcacatcaatggcacggcaaatggtgacaaagtttggtatgtctgaattaggccccttgtctctggaaaatcaaagcggcgaggtatttttaggacgcgactggatgaataaatccgactattctgaagaaatcgccgccaagatagattctcaagtccgagaaattatcaacacttgctaccaaacatcaaaagaacttttgcaaactaatcgcgtggttatggaacggctagtagatttgttgacagaacaagaaactattgaaggtgatttgttccgtaaaattgttagcgaaagtcaaaatccagtagttgatgagcaattgtcgatggttaatagtcaatag

SEQ ID NO: 3587 - protein, 656 aa, Nostoc sp. PCC 7120
MAIFARRIGLNQHSAYGSRQRVIVMKNFGKKALIKQQSPKRVAWTGALAASLIMLPTMFGGNPVLAQKAERESLSYGELIQKVNQEQVKRVELDETEQIAKVYLKGQKPDAPPIQVRLLEQNNELINRLKEKNVDFGEISSANSRAAVGLLINLMWILPLVALMLLFLRRSTNASSQAMNFGKSRARFQMEAKTGVKFDDVAGIEEAKEELQEVVTFLKQPERFTAVGARIPKGVLLVGPPGTGKTLLAKAIAGEAAVPFFSISGSEFVEMFVGVGASRVRDLFKKAKDNAPCLIFIDEIDAVGRQRGTGIGGGNDEREQTLNQLLTEMDGFEGNTGIIIIAATNRPDVLDSALLRPGRFDRQVIVDAPDLKGRLEILQVHSRNKKVDPSVSLEAIARRTPGFTGADLANLLNEAAILTARRRKEAITILEIDDAVDRVVAGMEGTPLVDSKSKRLIAYHEVGHGLVGTLLKDHDPVQKVTLIPRGQAQGLTWFTPNEEQGLISRSQLKARITSTLAGRAAEEIVFGKPEVTTGAGDDLQKVTSMARQMVTKFGMSELGPLSLENQSGEVFLGRDWMNKSDYSEEIAAKIDSQVREIINTCYQTSKELLQTNRVVMERLVDLLTEQETIEGDLFRKIVSESQNPVVDEQLSMVNSQ

SEQ ID NO: 3588 - DNA, 1938 bp, Nostoc sp. PCC 7120
  CDS (1)..(1938)
atgcctgttgaaactgataaaaaaaattccattaaaccaccaaggttacggcaatttggcggcagtttcctaattctgctaactttgctgttattgcttaactttattgttcccagtttttctggccctcgcttgccacaggttccttatagtgaatttatcgctcaagtacaagctggtaaagtagacaaggcgattgtggggggcgatcgcattcaatactcgatcaaaactcaaacccccgatggtaaagtcgttgaccaagtatttgctaccacaccagtagctattgatttggacttaccaaagattctccgcaacaataatgtcgagtttgccgcaccaccaccagaccaaaacgcctggattggaaccctactaagttgggtagcaccaccattaattttctttgggatttgggcgtttttaattaatcgtcaaggtgctggcccggctgcattgacagttgggaaaagcaaagcccggatttactcagaaggtagcacaggggtgaaatttctcgatgtggctggggtcgatgaagccaaggcggaattagaagaaattgttgatttcttgaagaatgcgactaagtacacaaatttaggtgcgaaaattcctaaaggtgttttgttagtcggccctccggggactggtaaaacattattagcgaaggcgatcgctggtgaagctggtgtaccattcttcagtatctctggttcagaatttatcgagttgtttgttggtgtcggtgcggcgcgtgtccgtgacttatttgagcaagccaaaaaacaggctccctgcatcgtcttcatcgatgagttagacgcattaggtaaatctcgcggtggtgctggtggctttgttggtggtaacgacgaacgcgaacaaaccctcaaccagttgctcacagaaatggatggctttgatgctaatacaggtgtaattatcatcgccgctaccaaccgtcccgaagttctagaccctgctttgcgccgtcctggtcgctttgaccgtcaagtcgtggttgatcgccctgataaaattggtcgagaagcaattctcaaagtccacgccagaaatgtgaaattagctgatgatgtcgatttaggtaacatcgctatcaaaactcctggttttgccggtgcagatttagctaacctcgtcaatgaagcagcactgttagccgcaaggcaaaatcgccaagctgttgtgatggctgatttcaacgaagctattgaaaggttagtggctggcttagaaaaacgttctcgtgtcttgaatgaaaccgagaagaagactgtcgcctatcacgaagttggtcacgcaattatcggcgcattaatgcccggtgctggtagagttgagaaaatctctgttgttcctcgcggtgttggcgctttgggttatacaattcaaatgcctgaagaagaccgctttttgatgattgaagatgaaattcgcggtcgaattgctactctgttgggtggacgttcggcggaagaaacagtctttggtaaagtctccactggtgcaagtgatgatattcaaaaagccacggacttagcagaacgctacgtcactttatatggaatgagtgacaaattagggccagtagcttttgagaagattcaacaacaattcctcgaaggttacagtaatcctcgccgttccatcagcccaaaagtggctgaggaaatcgaccgcgaagtgaaacagattgtggataatgctcaccacatcgccttgagtatcctgcaaaataaccgtgacttgttggaagaaactgcacaagaacttttgcaaacagaaattctcgaaggtactgcacttagggaacgcctcagccaagctcaagcaccagaagaactgcaagaatggttacggacaggtaagatatcggaagataaacccctaatgcaaacacttctagtctaa

SEQ ID NO: 3589 - protein, 645 aa, Nostoc sp. PCC 7120
MPVETDKKNSIKPPRLRQFGGSFLILLTLLLLLNFIVPSFSGPRLPQVPYSEFIAQVQAGKVDKAIVGGDRIQYSIKTQTPDGKVVDQVFATTPVAIDLDLPKILRNNNVEFAAPPPDQNAWIGTLLSWVAPPLIFFGIWAFLINRQGAGPAALTVGKSKARIYSEGSTGVKFLDVAGVDEAKAELEEIVDFLKNATKYTNLGAKIPKGVLLVGPPGTGKTLLAKAIAGEAGVPFFSISGSEFIELFVGVGAARVRDLFEQAKKQAPCIVFIDELDALGKSRGGAGGFVGGNDEREQTLNQLLTEMDGFDANTGVIIIAATNRPEVLDPALRRPGRFDRQVVVDRPDKIGREAILKVHARNVKLADDVDLGNIAIKTPGFAGADLANLVNEAALLAARQNRQAVVMADFNEAIERLVAGLEKRSRVLNETEKKTVAYHEVGHAIIGALMPGAGRVEKISVVPRGVGALGYTIQMPEEDRFLMIEDEIRGRIATLLGGRSAEETVFGKVSTGASDDIQKATDLAERYVTLYGMSDKLGPVAFEKIQQQFLEGYSNPRRSISPKVAEEIDREVKQIVDNAHHIALSILQNNRDLLEETAQELLQTEILEGTALRERLSQAQAPEELQEWLRTGKISEDKPLMQTLLV

SEQ ID NO: 3590 - DNA, 1905 bp, Aquifex aeolicus
  CDS (1)..(1905)
atgaacgcgttgaaaaacttctttatatgggcaatcattatcggagctgcgatagtagcctttaacctatttgaaggaaaaagagaatttaccacgaaggtttccttaaacgaagtagttaagctcgttgaggaaggtaaggtaagttacgcggaggtaaggggaaacacggcgataattcaaactaaagacggacaaaaactggaggtgactctcccacctaacacgaacttagttgacaaaatggttgagaaaggtgtaagggttgaagttgcaaacccagaaccgcccggagggtggctcgtaaacgtattcctctcatggcttccaatactcttctttatcggtatatggatattcctcctcaggcagatgtcggggggtggaaacgtaaacagggcctttaacttcggaaagagcagggcgaaggtttacatagaggaaaaaccgaaggtaactttcaaggacgttgcaggaatagaagaagtaaaggaagaagtaaaggaaattattgaatacctgaaagaccccgttaagttccagaagctcggcggaagacctcccaagggagttctcctttacggtgagccaggtgtgggtaaaacgctccttgcgaaagctatcgcgggcgaggctcacgttcccttcatctcggtctctggttctgacttcgttgagatgttcgtcggtgtaggagccgcacgggtaagggacctttttgaaaccgcaaagaagcacgctccctgcataatctttatagacgagattgacgcggtaggaagggcaaggggagctattcccgtaggcggtggacacgatgagagagaacaaaccttaaaccagcttctcgttgaaatggacggctttgacacctcagacggtattatcgtaatcgccgcaaccaacagaccagacatcttagacccggctcttttaaggcccggacgttttgacaggcagatatttatacccaaacctgacgtaagaggtaggtacgaaatactcaaagttcatgcgaggaacaagaaactcgctaaggacgttgaccttgagtttgtggcgagggcaaccccgggctttacgggagcggaccttgaaaacctcctaaacgaagcggcattactcgcggcaaggaaaggtaaagaagagataactatggaagaaatagaagaagccctagacaggattactatgggactagaaagaaagggaatgaccatatcgccaaaagaaaaggagaagatagctatacacgaagccggacacgccctcatgggactcgtctccgatgacgatgacaaggttcacaagatatccataatcccgaggggtatggctctgggagtaacgcaacaacttcccatagaagacaagcatatatacgacaaaaaggatctctacaacaagatactggtgcttctgggcggaagggctgcggaagaggtattcttcggaaaagatggaatcactacgggagcagaaaatgaccttcagagagcaacggacctcgcttacagaatggtttccatgtggggtatgagcgataaggtcggtccgatagctataaggagggtggcaaatcccttcctcggaggaatgaccacagcggtagacacaagccctgaccttttaagggaaatagacgaagaggtaaagaggattattacggaacagtatgaaaaggctaaagctatagtggaggaatacaaagaacccttgaaagccgtggtcaagaagctacttgagaaggaaacgataacctgcgaggagttcgtagaagtgttcaagctctacggtatagagcttaaagacaagtgtaagaaagaggaactctttgacaaagacaggaaatctgaggaaaataaagaacttaaatctgaagaagttaaggaggaggtagtctga

SEQ ID NO: 3591 - protein, 634 aa, Aquifex aeolicus
MNALKNFFIWAIIIGAAIVAFNLFEGKREFTTKVSLNEVVKLVEEGKVSYAEVRGNTAIIQTKDGQKLEVTLPPNTNLVDKMVEKGVRVEVANPEPPGGWLVNVFLSWLPILFFIGIWIFLLRQMSGGGNVNRAFNFGKSRAKVYIEEKPKVTFKDVAGIEEVKEEVKEIIEYLKDPVKFQKLGGRPPKGVLLYGEPGVGKTLLAKAIAGEAHVPFISVSGSDFVEMFVGVGAARVRDLFETAKKHAPCIIFIDEIDAVGRARGAIPVGGGHDEREQTLNQLLVEMDGFDTSDGIIVIAATNRPDILDPALLRPGRFDRQIFIPKPDVRGRYEILKVHARNKKLAKDVDLEFVARATPGFTGADLENLLNEAALLAARKGKEEITMEEIEEALDRITMGLERKGMTISPKEKEKIAIHEAGHALMGLVSDDDDKVHKISIIPRGMALGVTQQLPIEDKHIYDKKDLYNKILVLLGGRAAEEVFFGKDGITTGAENDLQRATDLAYRMVSMWGMSDKVGPIAIRRVANPFLGGMTTAVDTSPDLLREIDEEVKRIITEQYEKAKAIVEEYKEPLKAVVKKLLEKETITCEEFVEVFKLYGIELKDKCKKEELFDKDRKSEENKELKSEEVKEEVV

SEQ ID NO: 3592 - DNA, 2283 bp, Mycobacterium tuberculosis
  CDS (1)..(2283)
atgaaccggaaaaacgtgactcgcaccataacagcgatcgccgtcgtggtgctgctcggctggtcgttcttttacttcagcgacgacacccgcggctacaagcccgttgatacctcggtggcgataacacagatcaacggcgacaacgtcaagagcgcacagatcgacgatcgcgagcaacagctgcggctgatcctgaagaagggtaacaacgagaccgacgggtccgagaaggtcatcaccaagtaccccaccgggtacgccgtcgacctgttcaacgcgctcagcgccaaaaacgcgaaggtcagcacggtcgtcaaccagggcagcatcctgggcgagctgctggtctacgtgctgccgctgctgttgctggtggggctgttcgtgatgttctcccgcatgcaaggcggcgcccggatgggcttcgggttcggcaagtcacgcgccaagcaactgagcaaggacatgcccaagaccaccttcgccgacgtcgcaggtgtcgacgaggcggtcgaggagctctacgagatcaaggacttcctgcagaaccccagcaggtaccaagcgctgggcgccaagatccccaaaggcgtgctgctctacgggccgccgggaaccggtaagacgttgctggctcgtgcggtggccggcgaagccggagtgccgttcttcaccatctccggctccgacttcgtcgaaatgttcgtcggcgtcggcgcatcccgtgtcagagacctgttcgagcaggccaagcagaacagcccgtgcatcatcttcgtcgacgagatcgacgccgtcggccgacaaagaggcgccgggctgggcggcggtcacgacgagcgtgagcagaccctcaaccagttgctagtcgaaatggacggttttggcgatcgcgccggcgtcatcctgatcgcggccaccaaccggcccgacatcctggacccggcgctgttgcggccgggccgcttcgaccgccagatcccggtatccaaccccgatctggcgggtcggcgggcggtgctgcgcgtgcactccaagggcaagccgatggccgcggacgccgacctcgacggactggccaagcggaccgtcggcatgaccggagccgacctggccaacgtcatcaacgaggcggcgctgctgaccgcccgggagaacggcaccgtcatcaccggtcccgccctcgaggaagcggtggaccgggtgatcggcggcccgcgccgcaaaggccggatcatcagcgagcaggagaagaagatcaccgcctatcacgagggcgggcacaccctggccgcttgggcgatgcccgatatcgagccgatttataaggtgacgatcctggcgcgcgggcgtaccggcgggcacgcggtggcggtgccggaagaagacaagggcctgcggacccgctcggaaatgatcgcgcaactggtgttcgcgatgggtgggcgcgccgccgaagaactggtgtttcgtgagccgaccaccggcgcggtgtccgacatcgagcaggccaccaagatagcgcgctcaatggtcaccgaatttggaatgagctccaagctgggcgcggtcaaatacggctccgaacacggcgacccgttcctcggacgtaccatgggcacccagccggactactcccacgaggtcgcccgcgagatcgacgaagaggtccgcaagcttatcgaggcggcgcataccgaagcgtgggaaatcctgaccgaataccgcgacgtgctggacactttggccggcgagctgctggaaaaggagaccctgcaccgacccgagctggaaagcatcttcgctgacgtcgaaaagcggccgcggctcaccatgttcgacgacttcggtggccggatcccgtcggacaaaccgcccatcaagacacccggcgagctcgcgatcgaacgcggcgaaccttggccccagccggtccccgagccggcgttcaaggcggcgattgcgcaggctacccaagccgctgaggccgcccggtccgacgccggccaaaccgggcacggcgccaacggttcgcccgccggcacccaccggtccggtgaccgccagtacggctccacccagcctgactacggtgccccggcgggctggcatgcgccgggatggcccccaaggtcatctcatcggcccagctatagcggtgaaccggcaccgacgtatccgggtcagccctacccgaccggtcaagccgatccgggttccgatgagtcctcggcggagcaggatgacgaggtcagtcggaccaagccggcccacggctga

SEQ ID NO: 3593 - protein, 760 aa, Mycobacterium tuberculosis
MNRKNVTRTITAIAVVVLLGWSFFYFSDDTRGYKPVDTSVAITQINGDNVKSAQIDDREQQLRLILKKGNNETDGSEKVITKYPTGYAVDLFNALSAKNAKVSTVVNQGSILGELLVYVLPLLLLVGLFVMFSRMQGGARMGFGFGKSRAKQLSKDMPKTTFADVAGVDEAVEELYEIKDFLQNPSRYQALGAKIPKGVLLYGPPGTGKTLLARAVAGEAGVPFFTISGSDFVEMFVGVGASRVRDLFEQAKQNSPCIIFVDEIDAVGRQRGAGLGGGHDEREQTLNQLLVEMDGFGDRAGVILIAATNRPDILDPALLRPGRFDRQIPVSNPDLAGRRAVLRVHSKGKPMAADADLDGLAKRTVGMTGADLANVINEAALLTARENGTVITGPALEEAVDRVIGGPRRKGRIISEQEKKITAYHEGGHTLAAWAMPDIEPIYKVTILARGRTGGHAVAVPEEDKGLRTRSEMIAQLVFAMGGRAAEELVFREPTTGAVSDIEQATKIARSMVTEFGMSSKLGAVKYGSEHGDPFLGRTMGTQPDYSHEVAREIDEEVRKLIEAAHTEAWEILTEYRDVLDTLAGELLEKETLHRPELESIFADVEKRPRLTMFDDFGGRIPSDKPPIKTPGELAIERGEPWPQPVPEPAFKAAIAQATQAAEAARSDAGQTGHGANGSPAGTHRSGDRQYGSTQPDYGAPAGWHAPGWPPRSSHRPSYSGEPAPTYPGQPYPTGQADPGSDESSAEQDDEVSRTKPAHG

SEQ ID NO: 3594 - DNA, 1914 bp, Rickettsia prowazekii
  CDS (1)..(1914)
atgaataatcaaggtagaagtattttagcttgggcagcactttttatttttgtaatattactttttaatgtttttcaatctgatggtttacttggtgtaagaaataatatcactttctcagattttttgacacgagttgacgaaaagaccattaattcagtaaaaattcaaggtagagtaattgaaggtactgcaaatgacggctctacttttagtacgtattctcctgattatcctgatttagtaaatcgtcttactagcaatgacgttaatattgaagtagtgccgcttgaaacaagaatgaatacctttttaggatttttaatttcttggtttccgatgcttttattaataggtgtttgggttttctttatgcgtcaaatgcacggtggcgggaaagccatggggtttggcaaatctaaagctagattgttatcagataaaggaccaaaaattacctttaaagatgttgcgggtattgatgaagcaaaagaagaattaactgaaatagtcgattttttaagagatccaagtaaatttcaaaagcttggcggtaaaataccgaaaggttgcttacttatcggccctcctggtacaggtaagacacttcttgcgaaagcaattgcaggtgaggctaatgtacctttttttagtatatctggttctgattttgttgaaatgtttgtaggtgttggcgcaagccgcgtgcgcgatatgtttgaacaggggaaacgtaatgccccttgtattatctttattgatgagatcgatgctgtagggcgacatagaggtattggtatgggaggtggcaatgatgagcgtgagcaaaccttaaaccaaatgttagtcgaaatggatgggtttgaggcaaacgagggtgtggtaattattgcagctacaaaccgtccagacgttcttgatcgtgcattactgcgtcctggtagatttgatcgtcaaattgctgttgcaaaccctgatataaatggtcgtgagcaaattctaaaagtacatttaaaaaaaattaaatataatagtacggtactagcacgaattattgctcgtggaactcctggtttctccggtgctgaacttgctaatttagttaatgaagctgcgcttattgctgcgaggcttggtaaaaaagaagtagatatgcacgatatggaagaagcaaaagataaggttttgatgggtgttgtgcgtcgctctattgcaatgtcagagaaggagaaaagattaactgcgtatcatgaaggaggacacgcattagtcgggctttattgtcctgcagcctcgcctattcataaagctacgattataccacgtggtaatgctcttggtatggtacaaagacttcctgaaactgatgaatattctcagaatcgtgaacagatggaatcatctatagcagtttatatggcaggaagagtagcagaagaaattatttttggtagaaataaagtaacatcaggagcttcatcagatataaaaggtgcaactaatattgcaagggcgatggttacaaaagcaggtttaagtgatttaataggaccaatattccacggttcaaacagtgatgatatgtatggtagacaatcaagtaatgaaatttcggaagctactgcagagttaattgatgctgaagtgaaaagaattattacgcaaggttatgaattcgcaaaagatattttaacaaaacatatagatcaacttcatacattagcgaatgctttaattgaatatgaaacattgtctggtcagcaaattaaaaatttacttagtggaagagctttagattcagaagaggaaaacaaatttccttttaatgattcacatactataaaaatagataaagaaaatttgcatgagaaagtaaaatcaactaaagataaaaaagaaaatattatttcatag

SEQ ID NO: 3595 - protein, 637 aa, Rickettsia prowazekii
MNNQGRSILAWAALFIFVILLFNVFQSDGLLGVRNNITFSDFLTRVDEKTINSVKIQGRVIEGTANDGSTFSTYSPDYPDLVNRLTSNDVNIEVVPLETRMNTFLGFLISWFPMLLLIGVWVFFMRQMHGGGKAMGFGKSKARLLSDKGPKITFKDVAGIDEAKEELTEIVDFLRDPSKFQKLGGKIPKGCLLIGPPGTGKTLLAKAIAGEANVPFFSISGSDFVEMFVGVGASRVRDMFEQGKRNAPCIIFIDEIDAVGRHRGIGMGGGNDEREQTLNQMLVEMDGFEANEGVVIIAATNRPDVLDRALLRPGRFDRQIAVANPDINGREQILKVHLKKIKYNSTVLARIIARGTPGFSGAELANLVNEAALIAARLGKKEVDMHDMEEAKDKVLMGVVRRSIAMSEKEKRLTAYHEGGHALVGLYCPAASPIHKATIIPRGNALGMVQRLPETDEYSQNREQMESSIAVYMAGRVAEEIIFGRNKVTSGASSDIKGATNIARAMVTKAGLSDLIGPIFHGSNSDDMYGRQSSNEISEATAELIDAEVKRIITQGYEFAKDILTKHIDQLHTLANALIEYETLSGQQIKNLLSGRALDSEEENKFPFNDSHTIKIDKENLHEKVKSTKDKKENIIS

SEQ ID NO: 3596 - DNA, 2178 bp, Mycoplasma pulmonis
  CDS (1)..(2178)
atggataaaatgaaaaaacctaaaattaattgattattaattgttattgttgggattattgcagctctattaataacagttcttgttttactttttagtccaaaaactcaaccaaaaagttttgactatttattaaaacactttgaagaagctgccaaaagcacaacagatgatatctatttcgaaactattaagatcaactccttagataataccattggcgtaatttttagaaatggagctatgagggaagaatatttcgttgctgcctcggctgctcaagcaaatttcttgacttcaggaaacgttgaagttcgtgaaatattacaattagcaaatgttcaagcatatattcaaagtattaaaactcttaatggcacaatttcatgatttacatttatgaataaattcctagcacagcaccctggctatgatgcatctaaagctgggctttttggacaacacattgttcaagaaaatggatttattacatttataaaagccatttgattccctgcgcttattgcaattattattttccttggttacaaagcacaaagtagagcagcttcaggaggaatttttaatcctggaaaaaaccaagctgttattgttaaaacagataaaaaatttactgatatagctggaaataaagaaccaattgaagaggttcaagagttagttgattatttaaaaaatcctaaaaaatatgcagctgcaggagcgagatttcctaaaggaattctgctaggaggtcctccaggaactggtaaaactcttttagcaaaagctacagctggagaagcaaatgttccattctttttcatatcagcttcatcatttgttgaactttatgttggactgggggccaaaagagttagagaaatgtttaaagaagctagaaaattagctccagcaataatttttattgatgaacttgatgctgttggacgttctagaggaagtggaattggtggaggaaatgatgaaagagaacaaactcttaaccaaatccttgtcgaaatggacggtataaatgaaaatgctggtattttgattatgggggctaccaatagaactgatgttttagaccctgctcttttaagacctggaagattcgatagaatcatcacagttggtcttcctgacattaaagaaagagaagaaattttaaaacttcactcaaaaggaaaaagactttctaaagaaattaaatttgacaaaattgctaaaagaactcctggttattcaggggctcaacttgaaaatgttattaatgaagcttcacttctttctgtaagagaaaaaactgatgtaattatttcaactcaaattgatgaggctatcgatagagttatggcaggacctgctaaaaaatctagagttatctctcaagaagaattaaaagctgttgcctaccacgaggcaggacatgccgttgttggtttaaaagttaaaggtggaaataaagttcaaaaaatcactattattcctagaggtaatgcaggaggatataacttgatgactcctgaagaagaaaaatacaatgcaagtaaaaaagagcttctagcaacaatagcctcatacatgggtggtcgagcagctgagatgattatttatggaaaagaaaatatctcaactggagcaagtgatgatatttcaagggcaacaaaaattgctagaaaaatggttactgagtgaggaatgtcagcgctagggccaattaaatatgaagaagatacagaaaatccatttttaggaagagattattctaagggtacttttggaagtaaaatggctcatgaaattgatcttgaaattagaaaaataattagtgcttctgaagaaattgctattaaagcaattgaacaaaacttagaattattagaattaattaaagattcacttcttgaaaatgaaacaattgttgccgaagaaattgaatacattgaaaaaaatatgaaacttccaccaaataacgagaaaataaaacctgatggtgaaagtaaaaaagttaatattgaagatttaattaatcaagtaaatgaaagtcaagaaaaagataaacaaaaaaacgctcaaattaaagaagatttatccaaaatggataaaaaggacaatttaactaaggcaaaagacaaaggtgaagaagaaactttagctgaaaaagctgaataa

SEQ ID NO: 3597 - protein, 725 aa, Mycoplasma pulmonis
MDKMKKPKINWLLIVIVGIIAALLITVLVLLFSPKTQPKSFDYLLKHFEEAAKSTTDDIYFETIKINSLDNTIGVIFRNGAMREEYFVAASAAQANFLTSGNVEVREILQLANVQAYIQSIKTLNGTISWFTFMNKFLAQHPGYDASKAGLFGQHIVQENGFITFIKAIWFPALIAIIIFLGYKAQSRAASGGIFNPGKNQAVIVKTDKKFTDIAGNKEPIEEVQELVDYLKNPKKYAAAGARFPKGILLGGPPGTGKTLLAKATAGEANVPFFFISASSFVELYVGLGAKRVREMFKEARKLAPAIIFIDELDAVGRSRGSGIGGGNDEREQTLNQILVEMDGINENAGILIMGATNRTDVLDPALLRPGRFDRIITVGLPDIKEREEILKLHSKGKRLSKEIKFDKIAKRTPGYSGAQLENVINEASLLSVREKTDVIISTQIDEAIDRVMAGPAKKSRVISQEELKAVAYHEAGHAVVGLKVKGGNKVQKITIIPRGNAGGYNLMTPEEEKYNASKKELLATIASYMGGRAAEMIIYGKENISTGASDDISRATKIARKMVTEWGMSALGPIKYEEDTENPFLGRDYSKGTFGSKMAHEIDLEIRKIISASEEIAIKAIEQNLELLELIKDSLLENETIVAEEIEYIEKNMKLPPNNEKIKPDGESKKVNIEDLINQVNESQEKDKQKNAQIKEDLSKMDKKDNLTKAKDKGEEETLAEKAE

SEQ ID NO: 3598 - DNA, 1920 bp, Borrelia burgdorferi (Lyme disease spirochete)
  CDS (1)..(1920)
atgaatggcaataataatatgaataacaatggaaaatctaacaacaaaaaaaagaataaaaattggattttaggacttgttgttgtttttctaatttcagcaatatttatgtcatattttataagggggggggaaagctataaaaatgttccttatagcacttttcagagttatttagacaatggtctagttgagtctgtagtaataattgataaaaatttgattcaatttgtcgtcaagggttctaactttgcaaagtcttatttttctaccagcattccctatcttgatataaatttactttcagaactaaaaaataaaaaagttgagcttagctcagggaaaagtcaagcttctctgattggggttttattacaaactttgccatggattttgttttttattttctttttctttatatttcgtcaaactcaaggtggcggtgggaaggtttttacatttgggaaaagtaatgctcaaaagtatgaagctggaaagaataaaatcacctttaaagatgtggctggtcaagaagaggttaagcaagagcttcgagaagttgtcgaatttcttaaaaatccaaaaaaatttgaaaaaataggtgcaaaaatccccaaaggagtgcttttagtgggctctccgggtactggcaagactttgcttgccaaagccgttgccggtgaggctggggttagtttctttcacatgtcaggctcagattttgttgaaatgtttgttggggttggagcaagtcgtgttagagatttatttgataatgctagaaaaaattctccatgtattatttttattgatgagcttgatgctgttggtcgaagtcgtggtgcggggcttggcggtggtcatgatgaaagagagcaaactcttaatcagctgttagttgaaatggatggatttggaacgcataccaatgtaattgttatggccgctacaaatcgtcccgatgttcttgactctgctttgcttaggcctggacgatttgacaggcaagtaacagtttctttgcctgatattaaggaaagagaggcaatattaaatattcattctttaaaaacgaagctttcaaaagatattaatttacaagtaatagcaagagctactcctggagctagtggtgctgatcttgcaaatttaattaatgaaggagccttaatagctgcaaggaataatcaagatgaaattttaatgaaggatatggaagaagccagagataaaatattgatgggagttgcaaaaaaatccatgactattactgataggcaaaagcttgagacggcttatcatgaggcaggccatgctttgcttcactattatcttgaacatgctgatccacttcacaaagttaccattattccaaggggcagggcacttggtgttgcattttctcttccaagggaagatagactttcaataaacaaacaccaaattcttgacaaaataaagatatgctatggtggttatgctagcgagcaaataaatttgggtgttacaacagcgggtgttcaaaatgatttaatgcaagctactagtttggctaaaaaaatggttacggagtggggaatgggtgaagaagttggtccaatatttttagtagacgatgaagcacctattttccttccgaaagagttttcaaaggctaaagcttattctgagaacactgccgataaagttgacagagaggtaaaaagaatacttgaagaatgtttaaaagaggcatcggatattcttttaaagcataaggatcaacttgttaagcttgcaaaagaacttgttttaaaagaaactttgacagacaaagaagtgagagagcttttgggttttgaagctaataaggatgaatacgatttattttcatcagactctactacaaaagaagtaaagggggaggatgtaaaaggttag

SEQ ID NO: 3599 - protein, 639 aa, Borrelia burgdorferi (Lyme disease spirochete)
MNGNNNMNNNGKSNNKKKNKNWILGLVVVFLISAIFMSYFIRGGESYKNVPYSTFQSYLDNGLVESVVIIDKNLIQFVVKGSNFAKSYFSTSIPYLDINLLSELKNKKVELSSGKSQASLIGVLLQTLPWILFFIFFFFIFRQTQGGGGKVFTFGKSNAQKYEAGKNKITFKDVAGQEEVKQELREVVEFLKNPKKFEKIGAKIPKGVLLVGSPGTGKTLLAKAVAGEAGVSFFHMSGSDFVEMFVGVGASRVRDLFDNARKNSPCIIFIDELDAVGRSRGAGLGGGHDEREQTLNQLLVEMDGFGTHTNVIVMAATNRPDVLDSALLRPGRFDRQVTVSLPDIKEREAILNIHSLKTKLSKDINLQVIARATPGASGADLANLINEGALIAARNNQDEILMKDMEEARDKILMGVAKKSMTITDRQKLETAYHEAGHALLHYYLEHADPLHKVTIIPRGRALGVAFSLPREDRLSINKHQILDKIKICYGGYASEQINLGVTTAGVQNDLMQATSLAKKMVTEWGMGEEVGPIFLVDDEAPIFLPKEFSKAKAYSENTADKVDREVKRILEECLKEASDILLKHKDQLVKLAKELVLKETLTDKEVRELLGFEANKDEYDLFSSDSTTKEVKGEDVKG

SEQ ID NO: 3600 - DNA, 1968 bp, Deinococcus radiodurans
  CDS (1)..(1968)
atgacccgccgcgcccccgttcgccgcttctccggacgctggagcagccgaagtggttcctggaaagccggcctgctgaccctgcatctgctgacgctgcctgtactggtgcagggcacggcggcggcgaccacagcgcatgtcacggccagcgccaacgcaccgaccacgcctgccccgcagccgccgacctggaccccgaacaaaggcaacccccggctgatgccggaaaactacaccgtcaaccgctttttcgccgacctgcaagccggcaaggtggagcgggtcaaactcgacggtgcgggcaacacccaggtctttttcaaagaaccggcaggcggccccaacccgcgctggctgctgctcccgcccgacgccgccaccctggcccggctgcgcggcagcggcgtcaccatgcaggtcacgccgggcggctcgcgcttcgcatggctggggcaagcgctcccgctggtgctgaccgcgttgattctggcggtgctgtggcgctcgctcagaggcaacggcggaggcggcgccagctcgtttgccaagtcgaaagcggcgattatcagcgaggggcaaattaagctcaccttcgcggacgtggccggctgcgatgaggccaagcaggacctgcaagaagtcgtggacttcctccgccagccggagaaataccatcaactcggggcacggattccacatggggttcttttggtgggcccgcctgggtcggggaaaactttgctcgcgaaggctgtcgcgggggaagccaaagttccctacttctccatctccggctccgacttcgtggaaatgttcgtcggggtcggtgccgcccgcgtccgtgacctgttcgagcaagcccgcaaatcttctccttgcatcgtcttcattgacgaaattgacgcggtgggccgcaaacgcggtatgaacatacaaggtggcaatgacgagcgcgaacagacgctcaaccaattgcttgtcgaaatggacggcttcgggagcgggcaggatgtcattatccttgcggcgacgaacagacctgatgttctggatgccgccttgctcaggcccggacgatttgaccgacaagtcgtggtggacgcgccggacgtgcgaggacgggagcagattctgcggattcactcgcgcaagaaaccgctcgacgtgtcggtggacctcggggtgattgcccgtcggacggcgggaatggtgggggccgacctcgaaaacctgctgaatgaggcggcattgctggccgcccgtgaaggtcgcaaccgcattacggggcgcgatgtagacgaagcgcgcgaccgggtgctgatgggaccagaacgccgcagcatggtcgtgcgtgaggctgaccgcaaagtcaccgcctaccatgaggttgggcacgcgctcgcggctcagctgctccccaacgcccaccgggtggccaagttgacggtggtgccgcgtggccgggccgccgggtacatgctgcccgatgccgacgaccgactgcacgtcacccgcgccgcgctggaggacatgatcgcggtggcgctcgccgggcgggccgccgaggaagtggtctacggcgaggtgacgacgggcgcccagaacgactttcagcaggcgacaggactcgcacggcgcatggtcaccgagtgggggatgtccgggcgcatcggcaaggtggcgctggcgtcggatgagggcaattacctcggcggcgggccgcagccgttgccgaccagcgagcacacatcacaggtggtggacgaggaagttcgcgccctgatcgacgccgcttatgcccgcgtgctggcgctgctgcgcgagtatctgccgcaggtgcatcagatcgtgacggtcctgatgcagcgtgagacgctgagcggcgaggagtttgccaccctgctcgcaggaggcagcctggaaccgctgcctcctgtaggacaagtcgcgctggctccggcctaa

SEQ ID NO: 3601 - protein, 655 aa, Deinococcus radiodurans
MTRRAPVRRFSGRWSSRSGSWKAGLLTLHLLTLPVLVQGTAAATTAHVTASANAPTTPAPQPPTWTPNKGNPRLMPENYTVNRFFADLQAGKVERVKLDGAGNTQVFFKEPAGGPNPRWLLLPPDAATLARLRGSGVTMQVTPGGSRFAWLGQALPLVLTALILAVLWRSLRGNGGGGASSFAKSKAAIISEGQIKLTFADVAGCDEAKQDLQEVVDFLRQPEKYHQLGARIPHGVLLVGPPGSGKTLLAKAVAGEAKVPYFSISGSDFVEMFVGVGAARVRDLFEQARKSSPCIVFIDEIDAVGRKRGMNIQGGNDEREQTLNQLLVEMDGFGSGQDVIILAATNRPDVLDAALLRPGRFDRQVVVDAPDVRGREQILRIHSRKKPLDVSVDLGVIARRTAGMVGADLENLLNEAALLAAREGRNRITGRDVDEARDRVLMGPERRSMVVREADRKVTAYHEVGHALAAQLLPNAHRVAKLTVVPRGRAAGYMLPDADDRLHVTRAALEDMIAVALAGRAAEEVVYGEVTTGAQNDFQQATGLARRMVTEWGMSGRIGKVALASDEGNYLGGGPQPLPTSEHTSQVVDEEVRALIDAAYARVLALLREYLPQVHQIVTVLMQRETLSGEEFATLLAGGSLEPLPPVGQVALAPA

SEQ ID NO: 3602 - DNA, 1857 bp, Deinococcus radiodurans
  CDS (1)..(1857)
atgaaatggtggggctgggcgctgctggccctgaccggcgggctgctggtgctggtgctgtcggggtcgccccgcagccagagcgaactgaacgtcaacgactttacccaggcggtgcggacgcagcaggtcaaaaccgccgacatttcctttcagaacggcaccgcgctcgtcaccgggcgcctcacgagtggccttccctaccgcgcccgcacgctgcccgctgacccggtgttgaaactcggcacgctggaggggcgcggcgtcaccgtcacctacctgcctccgccgcgcatcagcgtgctcggcgccctgagtgtgctgctcacgctggcgctcatcggcggactgatcgcgctgctcgtccgcagccgcaatgggggcaacaacgacgcggcgagcagcttcggcaagtcgaaggcggcgattatcagcgaggggcagatcaagctcacctttgctgatgtggcgggctgcgatgaggccaagcaagacctgcaagaagtcgtggagttcctccgccagcccgagaaataccaccagctcggcgcccggattccgcgtggcgtgctgctcgtcgggcctcctgggtcggggaaaaccttgctggcgaaagcggtcgcaggcgaagccaaagtcccttacttctccatctctggctcggacttcgtggaaatgttcgtcggggtcggtgccgcacgtgtccgtgacctctttgagcaggcccgcaaagcttccccctgcattgtcttcattgacgagattgacgccgtaggccgcaagcgtggcatgaacattcaagggggcaacgacgaacgggaacagactttgaaccagttgctcgtcgagatggacggtttcgggagtgggcaggatgtgattatcctcgcggcgaccaaccggcccgatgtgctggatgccgcattgctcaggcccggacgatttgaccgtcaggtggtcgtggacgcgccggacgtgcggggccgggaacagattctgcggattcactcgcgcaagaaaccactcgacgtgtcggtggacctcggcgtgattgcccgtcggacagcggggatggtgggggccgacctcgaaaacctgctcaatgaagcggcattgctggcagcaagagaaggcaggaaccgcatcaccgggcgcgatgtagatgaagcgcgggaccgcgtgctgatggggccggagcgccgcagcatggtcgtgcgtgaagcagaccgcaaagtcaccgcctaccacgaggtcgggcacgcgctggtcgcccagttgctcccccactccgacaaggcgcacaagctgaccatcgtacctcggggccgcagcctcggctcggcgctctacacgcctgaagaccggatgcaccacacccgcacggcgctgctcgaccgcatttgcgtggcgctctccgggcacgcggcggaagaggtcatctacggcgaggtcacgaccggcgctcagaacgactttcagcaggcgaccggcctcgcgcggcgcatggtcaccgagtggggcatgagcgaggtcgggcagctcgccctggcgcaggacaacggcaattacctcggcttcgggccgcagccgacgaactacagcgaccacaccgccgagcagatcgacaccgccgtggccgacatcctcaatacccagtacgcccgcgcccacgccctgctcagcgagcatgtccacgtcctgcaccgcctgaccgacgaactggtcgcccgcgaaagcctcagcggcgacgaattgcaaacggtattgaacggcggcaccctgcccgagttgcctgccgccgtccgtcccgagggagcgccgccgcccgagggcacgctgcggccggaaggggcctga

SEQ ID NO: 3603 - protein, 618 aa, Deinococcus radiodurans
MKWWGWALLALTGGLLVLVLSGSPRSQSELNVNDFTQAVRTQQVKTADISFQNGTALVTGRLTSGLPYRARTLPADPVLKLGTLEGRGVTVTYLPPPRISVLGALSVLLTLALIGGLIALLVRSRNGGNNDAASSFGKSKAAIISEGQIKLTFADVAGCDEAKQDLQEVVEFLRQPEKYHQLGARIPRGVLLVGPPGSGKTLLAKAVAGEAKVPYFSISGSDFVEMFVGVGAARVRDLFEQARKASPCIVFIDEIDAVGRKRGMNIQGGNDEREQTLNQLLVEMDGFGSGQDVIILAATNRPDVLDAALLRPGRFDRQVVVDAPDVRGREQILRIHSRKKPLDVSVDLGVIARRTAGMVGADLENLLNEAALLAAREGRNRITGRDVDEARDRVLMGPERRSMVVREADRKVTAYHEVGHALVAQLLPHSDKAHKLTIVPRGRSLGSALYTPEDRMHHTRTALLDRICVALSGHAAEEVIYGEVTTGAQNDFQQATGLARRMVTEWGMSEVGQLALAQDNGNYLGFGPQPTNYSDHTAEQIDTAVADILNTQYARAHALLSEHVHVLHRLTDELVARESLSGDELQTVLNGGTLPELPAAVRPEGAPPPEGTLRPEGA

SEQ ID NO: 3604 - DNA, 1914 bp, Bacillus subtilis
  CDS (1)..(1914)
atgaatcgggtcttccgtaataccattttttatttacttattttattagtagtaatcggggttgtgagctacttccagacctcaaatccgaaaacagaaaatatgtcgtacagtacgttcatcaaaaacctggatgacgggaaagttgatagcgtatcggttcagcctgtcagaggtgtttatgaggtaaaagggcagctgaaaaactacgacaaagatcaatactttttgactcatgttcctgaaggaaagggagcagaccagatatttaacgctttgaaaaagacagacgtaaaggttgagcccgcgcaagaaacaagcggatgggtgacgttcctgacgaccatcatcccatttgtcattatctttattctgtttttcttcctgctcaatcaggctcaaggcggcggcagccgtgtcatgaactttggcaagagtaaagcgaagctgtatacagaggaaaagaaacgcgtcaaatttaaagacgttgcaggggctgacgaagaaaagcaagaacttgttgaagttgttgagtttctgaaagatccccgcaagtttgccgagctcggcgccagaataccgaaaggcgtgcttttagtcggacctccgggtaccggtaaaacattgcttgccaaggcttgtgcaggagaagccggcgtacctttcttcagcatcagcggatctgatttcgttgaaatgtttgtaggggtcggtgcttcccgtgtgcgtgacttgtttgaaaatgcgaaaaagaatgcgccttgtttgatcttcattgatgaaattgacgcagtcggacgccagcgtggcgctggtctcggcggtggacacgatgaacgtgaacagacgctaaaccaattgcttgttgaaatggacggattcagcgctaatgaaggaattatcatcattgctgcgacgaaccgtgcggacatcttggacccagccttacttcgtccgggacgttttgaccgtcaaatcacagtggaccgcccagatgtcattggccgtgaagctgtattgaaagtccatgcgagaaacaaaccgctggatgaaacggttaacctaaaatcaattgccatgagaacaccaggcttctcaggcgctgacttagaaaacctcttgaatgaagctgcgcttgtagcggctcgtcaaaacaagaaaaaaatcgatgcgcgtgatattgacgaagcgacggaccgtgtaattgccggacccgctaagaagagccgcgttatctccaagaaagaacgcaatatcgtggcttatcacgaaggcggacacaccgttatcggtctcgttttagatgaggcagatatggttcataaagtaacgattgttcctcggggccaggctggcggttatgctgttatgctgccaagagaagaccgttatttccaaacaaagccggagctgcttgataaaattgtcggcctcttgggcggacgtgttgctgaagagattatcttcggtgaagtcagcacaggggcgcacaatgacttccagcgtgcgacgaatattgcaagacgaatggttacagaattcggtatgtcagaaaaactgggaccgttgcaatttggacagtctcagggcggtcaggtattcttaggccgtgatttcaacaacgaacagaactacagtgatcaaatcgcttacgaaattgatcaggaaattcagcgcatcatcaaagaatgttatgagcgtgcgaaacaaatcctgactgaaaatcgtgacaagcttgaattgattgcccaaacgcttctgaaagttgaaacgcttgacgctgaacaaatcaaacaccttatcgatcatggaacattacctgagcgtaatttctcagatgatgaaaagaacgatgatgtgaaagtaaacattctgacaaaaacagaagaaaagaaagacgatacgaaagagtga

SEQ ID NO: 3605 - protein, 637 aa, Bacillus subtilis
MNRVFRNTIFYLLILLVVIGVVSYFQTSNPKTENMSYSTFIKNLDDGKVDSVSVQPVRGVYEVKGQLKNYDKDQYFLTHVPEGKGADQIFNALKKTDVKVEPAQETSGWVTFLTTIIPFVIIFILFFFLLNQAQGGGSRVMNFGKSKAKLYTEEKKRVKFKDVAGADEEKQELVEVVEFLKDPRKFAELGARIPKGVLLVGPPGTGKTLLAKACAGEAGVPFFSISGSDFVEMFVGVGASRVRDLFENAKKNAPCLIFIDEIDAVGRQRGAGLGGGHDEREQTLNQLLVEMDGFSANEGIIIIAATNRADILDPALLRPGRFDRQITVDRPDVIGREAVLKVHARNKPLDETVNLKSIAMRTPGFSGADLENLLNEAALVAARQNKKKIDARDIDEATDRVIAGPAKKSRVISKKERNIVAYHEGGHTVIGLVLDEADMVHKVTIVPRGQAGGYAVMLPREDRYFQTKPELLDKIVGLLGGRVAEEIIFGEVSTGAHNDFQRATNIARRMVTEFGMSEKLGPLQFGQSQGGQVFLGRDFNNEQNYSDQIAYEIDQEIQRIIKECYERAKQILTENRDKLELIAQTLLKVETLDAEQIKHLIDHGTLPERNFSDDEKNDDVKVNILTKTEEKKDDTKE

SEQ ID NO: 3606 - DNA, 1833 bp, Thermotoga maritima
  CDS (1)..(1833)
atgaacaggtctaacatctggaatctactgttcacgatactcataatagtcacacttttctggctcgccagatttttctacgtcgaaaactcacctgtgtctaagcttagctacacgagttttgttcagatggtcgaggacgaaagaagcgtggtctcagaagttgtgatcagggacgacggagtactgagagtttacaccaaagacggtagagtttacgaagtggacgctccgtgggccgtgaacgattcgcagctcatagaaaaactggtttcaaagggaataaaagtctcgggagagagaagcggaagcagctccttctggataaacgtcctcggcactctcataccgacgatactcttcattgtcgtgtggctcttcatcatgaggagcctctctggaaggaacaatcaggcgttcacgttcacaaagagcagggcaacaatgtacaaaccctctgggaacaagagggtcaccttcaaggacgttggaggagcggaagaagccatagaggaactcaaagaggtagttgaatttctgaaagatccctctaaattcaacaggatcggcgcaaggatgcccaaggggatcctccttgtagggcctccaggtaccggtaaaacgctccttgcgagggcagttgcgggcgaagcgaacgtgccgttcttccacatcagcggttctgacttcgtggagctctttgtcggagtcggtgccgcgagggtgagagatctgtttgcacaggcgaaggctcacgctccatgtatcgtcttcatcgatgagatcgatgccgttggaagacacaggggagcgggacttggaggaggacacgatgaaagagagcagaccctgaaccagcttctcgtggagatggatggattcgattcgaaagagggcatcatagtcatggcggccacaaacaggcccgatatcctggaccctgcacttttgaggcccggaaggttcgacaagaaaatcgtggtcgatccacctgacatgctcggaagaaagaagatactcgagattcacacgagaaacaaaccgctcgcggaagacgtgaatctggagatcatagcgaagagaacgccgggattcgtcggggcggatctggaaaacctcgtaaacgaggcggcgcttcttgcggcgagggaaggtagagacaaaatcacgatgaaggacttcgaggaagccatagacagggtgatagccggacccgcaagaaagtcgaagctgatcagcccgaaggaaaagcgcatcatagcgtaccacgaggcgggacacgccgtggtatccaccgtggttccaaacggggaacccgttcacagaatttccataatccccaggggatacaaagccctcggatacacgcttcatcttcctgaggaggataagtaccttgtttcaaggaacgaacttctcgacaaactcacagctctactcggaggtagagcagcagaagaggtggtctttggcgatgtgacgagtggggcagccaacgatatagaaagggccacggaaattgcgaggaatatggtgtgtcagctgggaatgagcgaagagctcggacccctcgcctgggggaaggaagagcaggaagtctttcttggaaaagagatcacacggctcagaaactacagtgaagaggtagcgagcaaaatcgacgaagaagtgaaaaagatagtgacgaactgctacgagagggcgaaggagataataaggaaatacaggaagcaactggacaacatcgtggaaatactgctggagaaagaaacgatagagggagacgagctgaggcggatactgtccgaggagtttgaaaaggtggtggaatga

SEQ ID NO: 3607 - protein, 610 aa, Thermotoga maritima
MNRSNIWNLLFTILIIVTLFWLARFFYVENSPVSKLSYTSFVQMVEDERSVVSEVVIRDDGVLRVYTKDGRVYEVDAPWAVNDSQLIEKLVSKGIKVSGERSGSSSFWINVLGTLIPTILFIVVWLFIMRSLSGRNNQAFTFTKSRATMYKPSGNKRVTFKDVGGAEEAIEELKEVVEFLKDPSKFNRIGARMPKGILLVGPPGTGKTLLARAVAGEANVPFFHISGSDFVELFVGVGAARVRDLFAQAKAHAPCIVFIDEIDAVGRHRGAGLGGGHDEREQTLNQLLVEMDGFDSKEGIIVMAATNRPDILDPALLRPGRFDKKIVVDPPDMLGRKKILEIHTRNKPLAEDVNLEIIAKRTPGFVGADLENLVNEAALLAAREGRDKITMKDFEEAIDRVIAGPARKSKLISPKEKRIIAYHEAGHAVVSTVVPNGEPVHRISIIPRGYKALGYTLHLPEEDKYLVSRNELLDKLTALLGGRAAEEVVFGDVTSGAANDIERATEIARNMVCQLGMSEELGPLAWGKEEQEVFLGKEITRLRNYSEEVASKIDEEVKKIVTNCYERAKEIIRKYRKQLDNIVEILLEKETIEGDELRRILSEEFEKVVE

SEQ ID NO: 3608 - DNA, 1968 bp, Neisseria meningitidis
  CDS (1)..(1968)
atggggaacacctttaaatcaatccttgtctgggtcgccttgggtatcggcctgatggctgcgttcaacgctttagacggtaaaaaagaagacaacgggcaaatcgaatactctcagttcatccaacaggtcaacaacggcgaagtatccggcgtcaacatcgaaggatccgtcgtcagcggctacctgattaagggcgagcgcaccgacaaaagcactttcttcaccaacgcgcctttggacgacaacctaattaaaacactgctcgacaaaaacgtccgcgtaaaagtaacgccggaagaaaaaccgagcgcgctggctgccctgttttacagcctgctgcccgtcctgctgctgattggcgcatggttctacttcatgcgtatgcagacgggcggcggcggaaaaggcggcgcattctcattcggtaaaagccgcgcccgcctgctggacaaagatgccaacaaagtgacctttgccgatgtcgccggctgcgacgaagccaaagaagaagtacaggaaatcgtcgattacctcaaagcgccgaaccgctatcaaagcctgggcgggcgcgtgccgcgcggcatcctgctggcgggcagcccgggtacgggtaagacgcttttggcgaaagcgattgcaggcgaagccggcgtgccgttcttcagcatttcaggttccgactttgtcgaaatgttcgtcggtgtcggtgcgagccgcgtccgcgatatgttcgagcaggcgaagaaaaacgccccctgcatcatctttatcgacgagattgacgcagtcggccgccaacgcggcgcaggtttgggcggcggcaatgatgagcgcgagcaaacattaaaccaattgttggttgaaatggacggttttgagagcaatcagactgtaattgtgattgcggcaaccaaccgccccgacgtactcgatcctgcgctgcaacgccccggccgtttcgaccgccaagtggttgtccccctgccggacatccgagggcgcgaacagattttgaacgtccattctaaaaaagtgcctttggacgaatctgtggatttattgtccctcgcgcgcggcacgccgggtttttccggcgcggatttggcgaacttggtcaacgaagccgccctgtttgccggccgccgcaataaagtcaaagtcgatcagagcgattttgaagacgccaaagacaaaatctatatgggtccggaacgccgcagtatggtgatgcacgaagacgaaaaacgtgcgacggcgtatcacgaatccggacacgcgattgttgccgaaagcctgccctttaccgaccccgtccacaaagtaaccattatgccgcgcggacgtgcgctgggtctgacttggcagcttccggagcgcgaccgcatcagtatgtataaagatcagatgttgagccagctctccatcctgttcggcggacggattgccgaagacatcttcgtcggacgcatctccaccggcgcatcaaacgactttgaacgcgcaacccaaatggcgcgcgaaatggtaacgcgctacggcatgagcgacaaaatgggcgtgatggtttatgcggaaaacgaaggcgaagtcttcttgggacgcagcgtaacccgttcgcaaaacatttccgagaaaacccagcaggacatcgacgcggaaatccgccggattttggacgagcaatatcaggttgcctacaaaatcctcgatgaaaaccgcgacaagatggaaacgatgtgcaaagccctgatggaatgggaaaccatcgaccgcgatcaggtactggaaatcatggcgggcaaacaacccagcccgcccaaagattacagccacaacctgcgcgagaatgcggacgcggcggaagataacgcgccgcacgctccgactcgggaagaaaccgaagcacctgccccggcagacaccgcttcgacagagtccgagcagcagcctgaaaacaaggcttaa

SEQ ID NO: 3609 - protein, 655 aa, Neisseria meningitidis
MGNTFKSILVWVALGIGLMAAFNALDGKKEDNGQIEYSQFIQQVNNGEVSGVNIEGSVVSGYLIKGERTDKSTFFTNAPLDDNLIKTLLDKNVRVKVTPEEKPSALAALFYSLLPVLLLIGAWFYFMRMQTGGGGKGGAFSFGKSRARLLDKDANKVTFADVAGCDEAKEEVQEIVDYLKAPNRYQSLGGRVPRGILLAGSPGTGKTLLAKAIAGEAGVPFFSISGSDFVEMFVGVGASRVRDMFEQAKKNAPCIIFIDEIDAVGRQRGAGLGGGNDEREQTLNQLLVEMDGFESNQTVIVIAATNRPDVLDPALQRPGRFDRQVVVPLPDIRGREQILNVHSKKVPLDESVDLLSLARGTPGFSGADLANLVNEAALFAGRRNKVKVDQSDFEDAKDKIYMGPERRSMVMHEDEKRATAYHESGHAIVAESLPFTDPVHKVTIMPRGRALGLTWQLPERDRISMYKDQMLSQLSILFGGRIAEDIFVGRISTGASNDFERATQMAREMVTRYGMSDKMGVMVYAENEGEVFLGRSVTRSQNISEKTQQDIDAEIRRILDEQYQVAYKILDENRDKMETMCKALMEWETIDRDQVLEIMAGKQPSPPKDYSHNLRENADAAEDNAPHAPTREETEAPAPADTASTESEQQPENKA

SEQ ID NO: 3610 - DNA, 1956 bp, Vibrio cholerae
  CDS (1)..(1956)
atgagtgacatggcaaaaaatttaatcctgtggcttgtgattgctgtcgttttgatgtctgtattccagagcttcggccccggtgagaataacggcagagcagtcgactacaccacatttgtaaaggaagttggtcaaggccagattcaggaagctcaattcaacaacggtgaaattactttcatgcgtcgtggaggcggcagccgttatgtaacttacatgccggtttatgatcaaaagctcctcgatgacttgatcaatcaagacgtgaaagtacaaggtacgcctcctgaagagcaaagcttgctgggtaccattttcatctcttggttcccaatgattctattgattggggtttggatcttcttcatgcgtcaaatgcaaggtggcggtggcaaaggtgccatgtcatttggtaagagcaaagcgcgtatgatgagtgaagaccagataaaaaccactttcagcgacgttgcgggctgtgatgaagcaaaagaagatgtgaaagaactggtcgattacctgcgcgatccgagccgcttccaaaagctgggtggtaagatcccaacgggtgtactcatggttggtcctcctggtacaggtaaaaccttgcttgccaaagcgattgctggtgaagctaaagtgccattctttactatctctggttcggatttcgttgaaatgtttgtcggtgtcggtgcatctcgtgtgcgtgacatgttcgaacaagcgaagaaagcctctccatgtattattttcattgatgaaattgatgcagtgggtcgtcagcgtggcgcgggtgttggtggtggtcacgatgaacgtgagcagacactaaaccaaatgctggttgagatggatggttttgaaggcaatgaaggcattattgtcatcgcggcaaccaaccgtcctgacgtgttggacccagcattgctgcgtccgggacgttttgaccgtcaagtcgtggtaggcctgccagatgtgcgtggtcgtgagcaaattcttaaagtgcatatgcgcaaagtgcctctggcgaatgatgtagagccatcattgattgcgcgtggtactcctggattctctggtgcggatttagcgaacttagttaacgaagcggcgctgtttgctgctcgtggcaacaagcgcaacgtctctatggttgagtttgaacttgcaaaagacaaaatcatgatgggtgcagagcgccgttcaatggtgatgtctgaagagataaaagagtctaccgcttatcatgaggctggtcatgcggtagtaggtcgccttgtacctgagcatgatccggtttacaaagtgtcgatcattcctcgcggtcgtgcattgggtgtcaccatgtacttgcctgagcaagatcgcgtgagtatgtctaaacagcatctggaatcaatgatctctagcttgtacggcggtcgtcttgctgaagagttgatttacggcaaagagaaagtttcaacaggcgcatcaaacgatatcgagcgtgcaacagaaattgctcgtaagatggtgacccaatggggcttctctgaaaagctaggccctatgttgtatgcggaagatgaaggtgaagtgttccttgggcgcagtgtgacacagacgaaacacatgtctgatgacaccgcgaagctgattgatgacgaagtgcgtcaaatcattgatcgtaactacgaacgagctcgccaaatcattatggataatatggatatcatgcatgcgatgaaagatgcattgatgaagtatgaaactatcgatgcaggtcagattgatgacttgatggcgcgtaagcctgtgattcgtgaaccagcaggttggggtgaacaatcgaaaactccgtctgcacctgaagtaaaagctgagcctgaagctaaggcggaagaatctacagcagagactgcttcatcggatgtcgcgacagcaagcgagaaaaaagacgctgaataa

SEQ ID NO: 3611 - protein, 651 aa, Vibrio cholerae
MSDMAKNLILWLVIAVVLMSVFQSFGPGENNGRAVDYTTFVKEVGQGQIQEAQFNNGEITFMRRGGGSRYVTYMPVYDQKLLDDLINQDVKVQGTPPEEQSLLGTIFISWFPMILLIGVWIFFMRQMQGGGGKGAMSFGKSKARMMSEDQIKTTFSDVAGCDEAKEDVKELVDYLRDPSRFQKLGGKIPTGVLMVGPPGTGKTLLAKAIAGEAKVPFFTISGSDFVEMFVGVGASRVRDMFEQAKKASPCIIFIDEIDAVGRQRGAGVGGGHDEREQTLNQMLVEMDGFEGNEGIIVIAATNRPDVLDPALLRPGRFDRQVVVGLPDVRGREQILKVHMRKVPLANDVEPSLIARGTPGFSGADLANLVNEAALFAARGNKRNVSMVEFELAKDKIMMGAERRSMVMSEEIKESTAYHEAGHAVVGRLVPEHDPVYKVSIIPRGRALGVTMYLPEQDRVSMSKQHLESMISSLYGGRLAEELIYGKEKVSTGASNDIERATEIARKMVTQWGFSEKLGPMLYAEDEGEVFLGRSVTQTKHMSDDTAKLIDDEVRQIIDRNYERARQIIMDNMDIMHAMKDALMKYETIDAGQIDDLMARKPVIREPAGWGEQSKTPSAPEVKAEPEAKAEESTAETASSDVATASEKKDAE

SEQ ID NO: 3612 - DNA, 1974 bp, Bacillus halodurans
  CDS (1)..(1974)
atgaatcggatattccgaaatacgatattttatttattaatattcctcgtaatcgttgggatcgttagcttttttacaggtgaccaaacgcaaaccaagcagattacgtttgaagaatttacccagcatttagaggcgggtgaaattacaagtctgtcgataaagccagaacgggatgtgtatctcgtacgtggacagcttcgcggggccgatgaagatgagtttttcgaaacttatgtactcccgactgagcagatggcagaaaccatttccgaggccgctggtcttcaggtcattccagccgatgaaacgagcggatgggtgacgttctttacagggatcattccgtttatcattatttttatcctattcttcttcttgttgagccaagcgcagggcggtggaagccgtgtcatgaacttcggtaagagcaaggcgaaaatggtaaatgaggataaaaagaaggcgaagtttaaggatgtagctggtgctgacgaagagaaacaagagcttgtggaagttgtagaatttctgaaagaccctcggaagttctcggcgattggggctcgtattcctaaaggggtacttcttgtcgggccaccaggaacagggaaaacgttgcttgctcgtgcagttgcaggggaagcaggtgtaccgttcttctcgataagtggttcagatttcgttgaaatgtttgtcggggtaggggcatcccgtgtccgcgatttgtttgaaaacgcaaagaaaaacgctccttgcattatttttatcgatgaaattgatgctgtaggtcgtcaacgtggtgctggtttaggcggtggtcacgatgagcgcgagcaaacgttgaaccaattgctcgttgaaatggacggttttagcgctaatgaaggaattattattatcgctgcgacgaaccgtgctgacattcttgacccggcgttgctccgtccaggacgcttcgatcgtcaaattacggtcggacgcccagatgtgaaaggacgggaagaagtattaaaagtgcatgctagcaataagccgcttgctgatgacgtaaatcttaaaacgattgcgactcgtacaccaggattctctggggctgaccttgagaacttattaaatgaagccgcactcgttgcagctagacaagatgaaaagaaaattagcatggttcatattgaagaagccattgaccgtgtcattgctggaccggcgaagaagagccgtgtcatttccgaaaaggaaaagaacattgtggcgtggcatgaagctgggcatacagtcgtaggggtgaagctcgaaaacgccgatatggtgcataaagtaacgatcgtacctcgtggcgttgctggtggctatgctgtaatgcttccgaaagaagaccgctattttatgacaaagccggaactcctcgataaaattgtcggacttcttggcggacgtgtagcagaggaaattcaattcggtgaagcgtctacaggagcccacaatgacttccagcgagccacaagcattgcacgtaaaatggtgaccgaatatggaatgagtgaaaagcttggaccgatgcaatttggatcaggatctggtggtcaagttttcttagggcgggatattcaaaatgagcaaaattacagtgatgcgattgcccatgagattgatctcgaagtgcaacgaattattaaagagtgctatgagcgttgtaagcaaatccttttggacaacaagaaaagcctcgaccttgtagctgaaacgcttttagatctagaaacccttgacgccgaacaaatcaaatcactgatccatgatggaaagcttccagataatcaccacttagcagagaagattgctgaaacgcgtgagaacgggcaagattcagaagttaaggtgaacattcattcgaaaaaaggtgaggaagcagagggcgaagaatcagcgcctaacactgaagatgtaaaagaagatgacgaaaagaaataa

SEQ ID NO: 3613 - protein, 657 aa, Bacillus halodurans
MNRIFRNTIFYLLIFLVIVGIVSFFTGDQTQTKQITFEEFTQHLEAGEITSLSIKPERDVYLVRGQLRGADEDEFFETYVLPTEQMAETISEAAGLQVIPADETSGWVTFFTGIIPFIIIFILFFFLLSQAQGGGSRVMNFGKSKAKMVNEDKKKAKFKDVAGADEEKQELVEVVEFLKDPRKFSAIGARIPKGVLLVGPPGTGKTLLARAVAGEAGVPFFSISGSDFVEMFVGVGASRVRDLFENAKKNAPCIIFIDEIDAVGRQRGAGLGGGHDEREQTLNQLLVEMDGFSANEGIIIIAATNRADILDPALLRPGRFDRQITVGRPDVKGREEVLKVHASNKPLADDVNLKTIATRTPGFSGADLENLLNEAALVAARQDEKKISMVHIEEAIDRVIAGPAKKSRVISEKEKNIVAWHEAGHTVVGVKLENADMVHKVTIVPRGVAGGYAVMLPKEDRYFMTKPELLDKIVGLLGGRVAEEIQFGEASTGAHNDFQRATSIARKMVTEYGMSEKLGPMQFGSGSGGQVFLGRDIQNEQNYSDAIAHEIDLEVQRIIKECYERCKQILLDNKKSLDLVAETLLDLETLDAEQIKSLIHDGKLPDNHHLAEKIAETRENGQDSEVKVNIHSKKGEEAEGEESAPNTEDVKEDDEKK

SEQ ID NO: 3614 - DNA, 1959 bp, Streptococcus pneumoniae
  CDS (1)..(1959)
atgaaaaaacaaaataatggtttaattaaaaatccttttctatggttattatttatctttttccttgtgacaggattccagtatttctattctgggaataactcaggaggaagtcagcaaatcaactatactgagttggtacaagaaattaccgatggtaatgtaaaagaattaacttaccaaccaaatggtagtgttatcgaagtttctggtgtctataaaaatcctaaaacaagtaaagaagaaacaggtattcagtttttcacgccatctgttactaaggtagagaaatttaccagcactattcttcctgcagatactaccgtatcagaattgcaaaaacttgctactgaccataaagcagaagtaactgttaagcatgaaagttcaagtggtatatggattaatctactcgtatccattgtgccatttggaattctattcttcttcctattctctatgatgggaaatatgggaggaggcaatggccgtaatccaatgagttttggacgtagtaaggctaaagcagcaaataaagaagatattaaagtaagattttcagatgttgctggagctgaggaagaaaaacaagaactagttgaagttgttgagttcttaaaagatccaaaacgattcacaaaacttggagcccgtattccagcaggtgttcttttggagggacctccggggacaggtaaaactttgcttgctaaggcagtcgctggagaagcaggtgttccattctttagtatctcaggttctgactttgtagaaatgtttgtcggagttggagctagtcgtgttcgctctctttttgaggatgccaaaaaagcagcaccagctatcatctttatcgatgaaattgatgctgttggacgtcaacgtggagtcggtctcggcggaggtaatgacgaacgtgaacaaaccttgaaccaacttttgattgagatggatggttttgagggaaatgaagggattatcgtcatcgctgcgacaaaccgttcagatgtacttgaccctgcccttttgcgtccaggacgttttgatagaaaagtattggttggtcgtcctgatgttaaaggtcgtgaagcaatcttgaaagttcacgctaagaataagcctttagcagaagatgttgatttgaaattagtggctcaacaaactccaggctttgttggtgctgatttagagaatgtcttgaatgaagcagctttagttgctgctcgtcgcaataaatcgataattgatgcttcagatattgatgaagcagaagatagagttattgctggaccttctaagaaagataagacagtttcacaaaaagaacgagaattggttgcttaccatgaggcaggacataccattgttggtctagtcttgtcgaatgctcgcgttgtccataaggttacaattgtaccacgcggccgtgcaggcggatacatgattgcacttcctaaagaggatcaaatgcttctatctaaagaagatatgaaagagcaattggctggcttaatgggtggacgtgtagctgaagaaattatctttaatgtccaaaccacaggagcttcaaacgactttgaacaagcgacacaaatggcacgtgcaatggttacagagtacggtatgagtgaaaaacttggcccagtacaatatgaaggaaaccatgctatgcttggtgcacagagtcctcaaaaatcaatttcagaacaaacagcttatgaaattgatgaagaggttcgttcattattaaatgaggcacgaaataaagctgctgaaattattcagtcaaatcgtgaaactcacaagttaattgcagaagcattattgaaatacgaaacattggatagtacacaaattaaagctctttacgaaacaggaaagatgcctgaagcagtagaagaggaatctcatgcactatcctatgatgaagtaaagtcaaaaatgaatgacgaaaaataa

SEQ ID NO: 3615 - protein, 652 aa, Streptococcus pneumoniae
MKKQNNGLIKNPFLWLLFIFFLVTGFQYFYSGNNSGGSQQINYTELVQEITDGNVKELTYQPNGSVIEVSGVYKNPKTSKEETGIQFFTPSVTKVEKFTSTILPADTTVSELQKLATDHKAEVTVKHESSSGIWINLLVSIVPFGILFFFLFSMMGNMGGGNGRNPMSFGRSKAKAANKEDIKVRFSDVAGAEEEKQELVEVVEFLKDPKRFTKLGARIPAGVLLEGPPGTGKTLLAKAVAGEAGVPFFSISGSDFVEMFVGVGASRVRSLFEDAKKAAPAIIFIDEIDAVGRQRGVGLGGGNDEREQTLNQLLIEMDGFEGNEGIIVIAATNRSDVLDPALLRPGRFDRKVLVGRPDVKGREAILKVHAKNKPLAEDVDLKLVAQQTPGFVGADLENVLNEAALVAARRNKSIIDASDIDEAEDRVIAGPSKKDKTVSQKERELVAYHEAGHTIVGLVLSNARVVHKVTIVPRGRAGGYMIALPKEDQMLLSKEDMKEQLAGLMGGRVAEEIIFNVQTTGASNDFEQATQMARAMVTEYGMSEKLGPVQYEGNHAMLGAQSPQKSISEQTAYEIDEEVRSLLNEARNKAAEIIQSNRETHKLIAEALLKYETLDSTQIKALYETGKMPEAVEEESHALSYDEVKSKMNDEK

SEQ ID NO: 3616 - DNA, 1920 bp, Pseudomonas aeruginosa
  CDS (1)..(1920)
atggcaaagaatctgattctgtggctgatcatcgcggcggtactggtgaccgtgatgaacaatttctcgagcccgagcgagccacagacgctgaactactcggacttcatccagcaggtcaaggatggcaaggtcgagcgagtgaccgtggatggctatgtcatcaccggcaagcgtagcgacggcgataccttcaagaccatccgcccggcgatccaggacaacggcctgatcggcgacctggtcaacaacaacgtcgtggtcgagggcaagcagcccgaacagcagagcatctggacccagttgctggtcgccagcttcccgatcctggtgatcatcgccgtcttcatgttcttcatgcgccagatgcagggtggcggcggcggtcgcggcggcccgatgagcttcggcaagagcaaggcgcgcctgctgtccgaggaccaggtcaagaccaccttcgctgacgtcgccggctgcgacgaggccaaggaggaggtcagcgagctggtcgagttccttcgcgatccgggcaagttccagcgcctgggcggccgtatcccgcgcggcgtgctgatggtcggcccgcccggcaccggcaagaccctgctggccaaggccatcgccggcgaagccaaggtgccgttcttcaccatttccggttccgacttcgtcgagatgttcgtcggcgtgggcgcctcccgtgtccgcgacatgttcgaccaggccaagaagcacgcgccgtgcatcatcttcatcgacgagatcgacgccgtcggccgccatcgcggcgccggcctgggcggcggtcacgacgagcgcgagcagaccctcaaccagttgctggtggagatggatggcttcgagatgaacgatggcatcatcgtcatcgctgccaccaaccgtccggacgttctggacccggcgctgctgcgtccgggccgcttcgaccgccaggtggtggtcggcttgccggatatccgcgggcgcgaacagatcctcaaggtgcacatgcgcaaggtgccgctgggcgaccatgtcgatcctgccgtcatcgcccgcggtacgcccggtttctccggcgccgacctggccaacctggtcaacgaggcctcgctgttcgccgcgcgctccaacaagcgcatcgtcgacatgcgcgagttcgagctggccaaggacaagatcatgatgggcgccgagcgcaagaccatggtcatgtccgagaaggagaagcgcaacaccgcctaccacgaggccggccacgccatcgtcggtcgcctggtgccggagcatgacccggtctacaaggtgtccatcattccgcgcggacgtgccctgggcgtgaccatgttcctccccgaggaagatcgctacagcctgtccaagcgcgcgctggaaagccagatctgctcgctgttcggcggccgtatcgcggaagagatgaccctcggcttcgaaggcgtcaccactggcgcttccaacgacatcatgcgtgctacccagttggcgcggaacatggtgaccaagtggggtctgtccgagaaactcggcccgctgatgtacgcggaggaggagggcgaggtgttcctcggccgtagcgccggcagccagcacgccaatgtgtcgggcgagaccgccaagatgatcgaccaggaagtccggcgcatcatcgacgactgctacggtaccgccaagcgactgctcgacgagaaccgcgacaagctggagatgatggccgacgcactgatgaagtacgagaccatcgactccgaccagatcgacgacatcatggccggtcgcgtgccgcgcgagccgcgtgactggcagggtggttcgggtaccggcaccccgccggccaacctggaagagtcgggccgccgcgagaacacccctcccatcggtgggccggccggcgagcactga

SEQ ID NO: 3617 - protein, 639 aa, Pseudomonas aeruginosa
MAKNLILWLIIAAVLVTVMNNFSSPSEPQTLNYSDFIQQVKDGKVERVTVDGYVITGKRSDGDTFKTIRPAIQDNGLIGDLVNNNVVVEGKQPEQQSIWTQLLVASFPILVIIAVFMFFMRQMQGGGGGRGGPMSFGKSKARLLSEDQVKTTFADVAGCDEAKEEVSELVEFLRDPGKFQRLGGRIPRGVLMVGPPGTGKTLLAKAIAGEAKVPFFTISGSDFVEMFVGVGASRVRDMFDQAKKHAPCIIFIDEIDAVGRHRGAGLGGGHDEREQTLNQLLVEMDGFEMNDGIIVIAATNRPDVLDPALLRPGRFDRQVVVGLPDIRGREQILKVHMRKVPLGDHVDPAVIARGTPGFSGADLANLVNEASLFAARSNKRIVDMREFELAKDKIMMGAERKTMVMSEKEKRNTAYHEAGHAIVGRLVPEHDPVYKVSIIPRGRALGVTMFLPEEDRYSLSKRALESQICSLFGGRIAEEMTLGFEGVTTGASNDIMRATQLARNMVTKWGLSEKLGPLMYAEEEGEVFLGRSAGSQHANVSGETAKMIDQEVRRIIDDCYGTAKRLLDENRDKLEMMADALMKYETIDSDQIDDIMAGRVPREPRDWQGGSGTGTPPANLEESGRRENTPPIGGPAGEH

SEQ ID NO: 3618 - DNA, 2088 bp, Arabidopsis thaliana (mouse-ear cress)
  CDS (1)..(2088)
atggcagcttcatcagcttgtcttgtgggaaatggtttgtcagtgaacacaacaaccaaacagaggttaagtaaacatttttccggcagacagacaagcttttcttcagtgattaggacatctaaggttaatgtagtgaaggcttctttggatgggaagaagaagcaagaaggaagaagagattttctcaaaatcttgttaggaaatgctggggtcggtttggttgcaagtgggaaagcaaatgctgatgaacaaggtgtttcttcgtcgaggatgtcgtattctaggtttctagagtacttggataaggatagggtgaataaagttgatttgtatgagaatgggactatagctattgtggaagctgtttctcctgaattgggtaaccgggttgagagagtacgtgttcagctaccgggtttaagtcaagagcttctacagaagcttagggctaagaatattgattttgcagcacataatgctcaggaagatcaaggttctgtgttattcaacttgattggtaatcttgctttcccggcgcttttgattggtggtttgttccttctttcgagacggtctggtggtggaatgggtggacctggtggtcctggtaacccacttcagtttggtcagtccaaagcaaagttccaaatggaacctaacactggtgtaacatttgatgatgttgctggagttgatgaagcaaagcaagatttcatggaagtggtggagtttttgaagaaacctgagagattcactgcggttggtgccaagatcccgaaaggtgttcttcttattggtcctcctggtaccgggaaaacccttttggcaaaagccattgctggtgaagctggtgtgcctttcttctccatctctggttctgagtttgttgagatgtttgtcggtgttggtgcctcgagagtccgtgatcttttcaagaaagccaaggagaacgctccttgcattgtctttgtagatgaaatagatgctgttggtaggcaaagaggaaccggaattggtggaggtaatgatgaaagagaacagaccctcaatcagctcctaactgagatggatggttttgaaggtaacactggtgttatcgtagttgctgcaaccaatagagcagacattcttgactctgctttgttgaggccaggacggtttgaccggcaggtaagtgttgacgttcctgacgttaaggggagaacagatattctcaaggttcatgccggcaataagaagttcgacaatgatgtttcacttgaaataatagcaatgagaacacctggatttagcggagcagatctcgctaacctcttgaatgaggctgctatattggccggaaggcgagcacggacatcgatatcatctaaagagattgatgactccattgatagaatcgttgctggcatggaaggaacagtgatgaccgatggcaagagcaaaagcttggtagcttaccatgaagttggtcatgcagtgtgtggaacattgactccaggacatgatgctgtgcaaaaggtaacgttgataccaagaggccaagcaagaggtctgacttggttcattccatcagatgacccgacactcatctccaagcagcaactctttgcaagaattgttggtggactcggtggtagggccgctgaagaaatcatctttggtgattccgaggtgactactggcgcagttggtgacttacaacagatcaccggtttggctagacagatggtaacaacatttggaatgtctgatattggaccatggtctttgatggattcttcggcacaaagcgatgtcatcatgagaatgatggcaagaaactccatgtctgagaagcttgcagaagacattgattctgcggtgaagaaactatcagacagtgcatatgagatagctctaagccacataaagaacaatcgtgaagccatggataagctcgttgaagtgcttctcgagaaagaaactattggcggtgacgaattcagggcaattctttccgagtttactgagatccccccggaaaaccgagttccttcttcaacaacgacaactccagcatcagcaccaacaccagctgctgtctaa

SEQ ID NO: 3619 - protein, 695 aa, Arabidopsis thaliana (mouse-ear cress)
MAASSACLVGNGLSVNTTTKQRLSKHFSGRQTSFSSVIRTSKVNVVKASLDGKKKQEGRRDFLKILLGNAGVGLVASGKANADEQGVSSSRMSYSRFLEYLDKDRVNKVDLYENGTIAIVEAVSPELGNRVERVRVQLPGLSQELLQKLRAKNIDFAAHNAQEDQGSVLFNLIGNLAFPALLIGGLFLLSRRSGGGMGGPGGPGNPLQFGQSKAKFQMEPNTGVTFDDVAGVDEAKQDFMEVVEFLKKPERFTAVGAKIPKGVLLIGPPGTGKTLLAKAIAGEAGVPFFSISGSEFVEMFVGVGASRVRDLFKKAKENAPCIVFVDEIDAVGRQRGTGIGGGNDEREQTLNQLLTEMDGFEGNTGVIVVAATNRADILDSALLRPGRFDRQVSVDVPDVKGRTDILKVHAGNKKFDNDVSLEIIAMRTPGFSGADLANLLNEAAILAGRRARTSISSKEIDDSIDRIVAGMEGTVMTDGKSKSLVAYHEVGHAVCGTLTPGHDAVQKVTLIPRGQARGLTWFIPSDDPTLISKQQLFARIVGGLGGRAAEEIIFGDSEVTTGAVGDLQQITGLARQMVTTFGMSDIGPWSLMDSSAQSDVIMRMMARNSMSEKLAEDIDSAVKKLSDSAYEIALSHIKNNREAMDKLVEVLLEKETIGGDEFRAILSEFTEIPPENRVPSSTTTTPASAPTPAAV

SEQ ID NO: 3620 - DNA, 1968 bp, Deinococcus radiodurans
  CDS (1)..(1968)
atgagtctggtacactcaacttatggcaccgccgtgtgccccaactctgttctctccgctgttttccccttttcgcctctggaggcacccctgttgaagcggctcaatccctggatcatcgtgctcctcgtgctcggcctgttcctgatgttcacgaacctgcccggcagtgggcgctataccgtcaactacaacgaattcaagtcactgctgaaccagggccgcatcgagcgcgtcaccgtgcgcgaggacgtggcgaccgtgctgctcaaggagcgcggccaagtcagcgtcatcaccccgcagggtcaggccaccaaggacggcgtcgagagcctgatcgtgcgcctgcccggcaaccaggccacgcctgactccggcctgattccccagctcgaagccaagggcgtggactaccgctttgaggcgccgagccagtggttcgccatcctcatcaacttcctgccgctcatcttgctgttcgggatgatgtacttcttctttgcccgctcgcagggcggtcagggcggcgtcatgcagttcggccagagcaaggccaagaagtacggcaaggaaaaccgcgtgcccaccaagttcaccgacgtggccgggcacgaggaagccaagcgcgagctgatcgaagtcgtggacttcctgaaaaacccggccaagtaccaccagatcggcgccgagattcccaagggcgtgctgcttgtgggccctcccgggacgggcaaaacgctgctcgcccgcgctgtagccggtgaagccgacgtgcccttcttctcggtgagcgcctcggaattcatggaaatgttcgtgggcgtgggcgccagccgtgtgcgcaccctgttcgaggacgcccgcaagagtgcgccggccatcatcttcatcgacgaaatcgactccatcgggcgcaagcgcggtgcgggtatcggcggcgggcacgacgagcgcgagcagacgctcaaccaaatcctctcggaaatggacggcttcgacaagtcgagcagcgtgatcgtgctcggcgcgaccaaccgccccgacgtgctcgaccccgcgctgctgcgtccgggacgcttcgaccgtcaggtgacgatcgacctgcccaacctcaaggaacgtgaggccatcctcaaggtgcacctgcgcaacaagccgctcggtgagggcgtggacgtgcccgaaatcgccaagagcacgccttacttctcgggcgccgacctcaagaacatcaccaacgaagccgcgctcgaagccgcccgcgtgggcaagaccaagatcgatatgagcgacttttaccgggcgctcgacaagatcaccctgggcctggaaaacagctcgctcaccatcagcgaacccgaaaagcgcgccatcgccttccacgaggccgggcacgccgtgaccgccgccgtgattccgggcagcgacaagctgcaaaaggtcagcatcatcccgcgtggccgggcactcggcgccgccttctatctgcccgaagagcaagtgctgatgagcaaggaacggctggaaaaccagctcgtcgtggcactcgggggccgcgccgccgaagaagtcttcgtgggcaccataacgagcggggccgccgacgacttccgcaaggcgaccaacatcgcccgcaagatggtgctggaatggggcatgggcgagaacttccgcaacatggcgctgcaaaccgacggcggcggtccggtgttcctcggcgaggacatgggcaagcccaagatgttctccgagcacaccgcgcaactcgtagacgaagatgtcaagcgcatcctcgccgccgcttacgagcgctcgcgccagatcgtctccgactacaagcaggcgatgcaggaagtggccgacgccctgctcacccacgaactcatcaccggcgacgtggtgcgcgacgccgtggcgcgggtgggcggccagtcggtggccgtggcgcctgctccgaccgtctaa

SEQ ID NO: 3621 - protein, 655 aa, Deinococcus radiodurans
MSLVHSTYGTAVCPNSVLSAVFPFSPLEAPLLKRLNPWIIVLLVLGLFLMFTNLPGSGRYTVNYNEFKSLLNQGRIERVTVREDVATVLLKERGQVSVITPQGQATKDGVESLIVRLPGNQATPDSGLIPQLEAKGVDYRFEAPSQWFAILINFLPLILLFGMMYFFFARSQGGQGGVMQFGQSKAKKYGKENRVPTKFTDVAGHEEAKRELIEVVDFLKNPAKYHQIGAEIPKGVLLVGPPGTGKTLLARAVAGEADVPFFSVSASEFMEMFVGVGASRVRTLFEDARKSAPAIIFIDEIDSIGRKRGAGIGGGHDEREQTLNQILSEMDGFDKSSSVIVLGATNRPDVLDPALLRPGRFDRQVTIDLPNLKEREAILKVHLRNKPLGEGVDVPEIAKSTPYFSGADLKNITNEAALEAARVGKTKIDMSDFYRALDKITLGLENSSLTISEPEKRAIAFHEAGHAVTAAVIPGSDKLQKVSIIPRGRALGAAFYLPEEQVLMSKERLENQLVVALGGRAAEEVFVGTITSGAADDFRKATNIARKMVLEWGMGENFRNMALQTDGGGPVFLGEDMGKPKMFSEHTAQLVDEDVKRILAAAYERSRQIVSDYKQAMQEVADALLTHELITGDVVRDAVARVGGQSVAVAPAPTV

SEQ ID NO: 3622 - DNA, 2151 bp, Arabidopsis thaliana (mouse-ear cress)
  CDS (1)..(2151)
atggcttctaactcattactacgttcttcttcaaatttcttcttaggatcccatatcataatctcatctcccacccctaaaaccaccagaaaaccctctttccctttctccttcgtctcccgtgctaaataccaaatcactcgatcgtctcaagacgaaaattcgccaaatggtaaacccaattcgccattctcgtcgcaagtagccttagcagctattctactatcttcaatttcatcttcgccgctagctttagctgtagtggacgaaccagcttctccgtctgtcgttatagaatctcaagctgtgaagccatcgacgccatcgccattgttcattcagaacgagatacttaaggctcctagtcctaaatcatcggatctcccagaaggatcacagtggcgatacagcgagtttcttaacgctgtgaagaaagggaaagtcgagagagttagattcagcaaagatggttctgttgttcagcttactgccgtcgacaatcgccgtgcttcagtcatcgtccctaacgaccctgaccttattgatatcttggctatgaacggagttgatatatccgtctctgaaggagaatcctcaggcaatgacttgttcactgtcattggaaacttgattttcccgcttttggcctttggtggactcttcttgcttttcaggcgagctcagggaggccctggtggtggtcctggtggcttgggtggtcctatggatttcggacgttctaaatccaagttccaggaagtgcctgagactggtgtatcatttgcagatgttgctggggctgatcaagctaagttggagttacaggaagttgtggatttcttgaagaatcctgataagtacacagccttgggtgctaagattcctaaagggtgtttgcttgttggaccgcctggtacgggtaagacactcctggctagggcggtggctggggaagctggagtgccgttcttctcttgcgcggcctcggagttcgtagagctttttgtgggtgtgggtgcatcgagagttagggatttgttcgagaaggctaagtctaaagccccttgtattgtattcattgatgagattgacgctgtgggtaggcagagaggagctgggatgggaggaggaaatgatgagagagaacagactattaatcagctgttgacagagatggatggattttctggcaactctggtgtgatagttttggcagctacgaataggccggacgttcttgattcggctttgttgaggcctggaaggtttgatcgacaggtcacggtggataggcctgatgtggctggcagagtcaagattcttcaggttcattctagggggaaggcactcggtaaagatgtggactttgacaaggttgccagaaggacccctggtttcacgggtgctgacttacaaaacctgatgaatgaagcggcgattcttgcggctaggcgtgagcttaaggaaataagcaaggatgaaatctctgatgctcttgagaggatcattgctggacctgagaagaagaatgcagttgtctctgaagagaagaagagacttgttgcataccatgaggctggtcatgctctagtgggtgctcttatgccagaatatgatccggttgcaaagatttctatcattcctcgtggccaagctggtgggctcactttttttgctccaagcgaagaaagacttgagtctggattgtacagtaggagctaccttgagaatcaaatggctgttgcacttggcggaagggttgcagaggaggtgatctttggggatgagaatgtgacgactggagcatcaaatgatttcatgcaggtgtctcgtgtggcacgtcaaatgattgagagatttgggttcagcaaaaagattggacaagttgctgttggtggccctggtggaaatcccttcatgggtcaacaaatgtcatcacagaaagattactcaatggcaactgcggatattgtagatgctgaggtgcgagagttagttgagaaggcatacaagagagcaacggagatcataacaactcatattgatatcctacacaagcttgcacagctcctgatcgagaaagaaactgttgacggtgaagagttcatgagtctctttattgacggccaagctgagttgtatatttcttga

SEQ ID NO: 3623 - protein, 716 aa, Arabidopsis thaliana (mouse-ear cress)
MASNSLLRSSSNFFLGSHIIISSPTPKTTRKPSFPFSFVSRAKYQITRSSQDENSPNGKPNSPFSSQVALAAILLSSISSSPLALAVVDEPASPSVVIESQAVKPSTPSPLFIQNEILKAPSPKSSDLPEGSQWRYSEFLNAVKKGKVERVRFSKDGSVVQLTAVDNRRASVIVPNDPDLIDILAMNGVDISVSEGESSGNDLFTVIGNLIFPLLAFGGLFLLFRRAQGGPGGGPGGLGGPMDFGRSKSKFQEVPETGVSFADVAGADQAKLELQEVVDFLKNPDKYTALGAKIPKGCLLVGPPGTGKTLLARAVAGEAGVPFFSCAASEFVELFVGVGASRVRDLFEKAKSKAPCIVFIDEIDAVGRQRGAGMGGGNDEREQTINQLLTEMDGFSGNSGVIVLAATNRPDVLDSALLRPGRFDRQVTVDRPDVAGRVKILQVHSRGKALGKDVDFDKVARRTPGFTGADLQNLMNEAAILAARRELKEISKDEISDALERIIAGPEKKNAVVSEEKKRLVAYHEAGHALVGALMPEYDPVAKISIIPRGQAGGLTFFAPSEERLESGLYSRSYLENQMAVALGGRVAEEVIFGDENVTTGASNDFMQVSRVARQMIERFGFSKKIGQVAVGGPGGNPFMGQQMSSQKDYSMATADIVDAEVRELVEKAYKRATEIITTHIDILHKLAQLLIEKETVDGEEFMSLFIDGQAELYIS

SEQ ID NO: 3624 - DNA, 1809 bp, Clostridium acetobutylicum
  CDS (1)..(1809)
atgaaaaaaatttctagtgctacggtctggattgtagtgtttttagtggtcatttttactattttgatgctagtgcaaggtggtaaggctactaatactgtaagctttgatcaatttcaaaagcagtatatgggaaataatataaaaagttttgaaatgaaagacgataagatgacagttgatggtaaatataaagatggttcatcttttgaaactatcgtgcctttagaaagactcaatcaatttcttgcggatcatcctactaatggtgaaataggtgaatcatatgccgcaccagccaatatacctgtttggataagttggatgccaactataataatgattttggctatggttgtaatattagtgcttttcatgcagcaaacacaaggtggtacaggtaaaggcgtaatgggctttggaaaaagtagagcaaaaatgtcatcacctgatgatttaaagcaaaaagtcacctttaaagatgttgcgggggctgatgaggaaaaaggagaattggaagaaatagttgattttctaaaacagcctaagaggtatattgaaatgggagctaggatacctaagggagttcttcttgttggtcctcctggaactggtaagacacttttagcaaaagcagtttcaggtgaagcaggtgtgccatttttcagtatatcaggttcagactttgttgaaatgtttgttggtgtaggagcttctagagtaagagacctatttgagcaggcaaaaaagaattctccatgcataatttttatagatgaaatagatgcagttggaagacaaagaggagcaggactaggtggaggacatgatgaaagagaacaaactcttaatcagcttcttgttgaaatggatggttttggagtaaatgaaggtataataatacttgcagctaccaatagacctgacatattagatcatgcactcttgagaccaggtagatttgatagacagattcttgttggtgctccagatgttaaaggaagagaagaaattcttaaagttcattctaaaaataagaatttagatgattcaatacgtttagatgttttagctaagagaacacctggatttacaggtgcagatcttgagaatttaatgaatgaagcagcacttttggctgtaagaaataaaaagcctataattggaatggaagaacttgaagaagcaactacaagagttattgcaggaccagaaaagaagagcagggtaataagtgaagaggatagaaagatcacagcttatcatgaggcaggtcacgctgtattgatggaacttttaccttactctgacccagttcatcaaataagcatagttcctagaggtatggcaggtggatatacaatgcatcttcctgaaaaggatagttcatacatgtctaagaataaacttaaagatgaaatggttgggcttcttggtggaagaatagctgagaagttagtaataggagatattagtactggtgctaaaaatgatatagatagagctactagtatagctagaaaaatggttatggaatacggaatgagcgacaaacttggaactataacctttggaaaggatcaagacgaagtattccttggaagggatcttggaactagtagaaactttagtgaagagattgcagctaagatagacaatgaagttaaggaattaatagatgaagcatatactaaagctgagaatctattgaaagataatatgtcaaaacttgatgcagtagctaaggctttacttgaaaaagaaaagttagaagctgatgagtttaaagaaatatttgaaaatgcttaa

SEQ ID NO: 3625 - protein, 602 aa, Clostridium acetobutylicum
MKKISSATVWIVVFLVVIFTILMLVQGGKATNTVSFDQFQKQYMGNNIKSFEMKDDKMTVDGKYKDGSSFETIVPLERLNQFLADHPTNGEIGESYAAPANIPVWISWMPTIIMILAMVVILVLFMQQTQGGTGKGVMGFGKSRAKMSSPDDLKQKVTFKDVAGADEEKGELEEIVDFLKQPKRYIEMGARIPKGVLLVGPPGTGKTLLAKAVSGEAGVPFFSISGSDFVEMFVGVGASRVRDLFEQAKKNSPCIIFIDEIDAVGRQRGAGLGGGHDEREQTLNQLLVEMDGFGVNEGIIILAATNRPDILDHALLRPGRFDRQILVGAPDVKGREEILKVHSKNKNLDDSIRLDVLAKRTPGFTGADLENLMNEAALLAVRNKKPIIGMEELEEATTRVIAGPEKKSRVISEEDRKITAYHEAGHAVLMELLPYSDPVHQISIVPRGMAGGYTMHLPEKDSSYMSKNKLKDEMVGLLGGRIAEKLVIGDISTGAKNDIDRATSIARKMVMEYGMSDKLGTITFGKDQDEVFLGRDLGTSRNFSEEIAAKIDNEVKELIDEAYTKAENLLKDNMSKLDAVAKALLEKEKLEADEFKEIFENA

SEQ ID NO: 3626 - DNA, 1830 bp, Treponema pallidum subsp. pallidum (syphilis spirochete)
  CDS (1)..(1830)
atgcgcatcatcccgttctcggaatttaaagatcgcattgcaagtggggaaatcgtaaaggttgttgtcggttccccttactttgtcgggtacacttccgcgcgccctgcgccttctgcgcggggtttctcgttgctctctgagcgggaggctcctacctatcatgccatcggtgtcctctccgattcctttttgagcatgctcgatgagcggcaggtggtctacagtattaagccgcgcgagcgcaattacctcatagagacatttcaatatctctttccgctgctcatcctcttttttgtctggcgctttttctttaagcggatggcctcaaatgtaagcgggctggggagcagtattttctcagccggacacgcgcgctctgcggcggtggaagaaggaaaggtcaccacacgctttgcagacgttgcaggggtggatgaggcaaaagaagagctgatggaagtagttgattttctcaagttccctaaaaagtatactgaaatcggggggaaaattccccgcggggtgctgttggtcggtcccccagggacgggtaagacgttgcttgcacgcgcagtggcaggtgaggcgtcagtgcccttttttcgcatcagtggctcagacttcatcgaaatgtttgtggggattggcgcctcgcgtgtgcgcgatttattcaaacaagcgcgggagaaggcgccagggattatttttatcgatgagcttgacgcaattggaaaaagccgcctgaacgctatccattccaacgatgagcgggaacaaacgcttaaccagcttctggtagaaatggatgggtttgataacaccaccggtctcattttgcttgctgctaccaatcgccccgatgtgttagatcctgcgctcctacgccccggtcgttttgaccgacaggtttgcgtagatcggcccgatcttaagggaagagaggcaattctgcgtattcatgcgcagaacgtgaagttagcgccagaagtggatttgaaggcagtggcgcgcatcaccggtgggtattcaggtgctgatttggcaaacgtggtgaacgaggcagcgttgctcgcggtacggtctgggcgtgcgcaggtgattgaaacggatttggacgaagcggtcgaaaagacaatgataggattgcagaaaaaaagtcgggtaattcgagaagaagagcgccggattattgcgtatcacgagacaggacatgcccttgcaggtaccttcacgaagggtgcagacaaggtgcacaaaattacaattattccccggggcacctctgcgcttggatatacttttcacattcctgaagacgatcggcatattgttacggagcagcagttgttggcagaagtagatgtgctgctttcaggacgcgcagcggaatttgtagcctttggggaagtttcaactggtgcagggaacgatatttctcgcgcaacagacattgtccgcaagatgattacagattatgggatgagcgaaaagtttcaaaacgttgcacttactcgccgcggaaccgggtatctcgcggagccgcagttagcgcgcgagtattcggagtgcacacagcagtacgttgatgaggaagtggcgcgcgttctagctgagcgctaccgcgcggtggtagcactcttgacggagaaaaaagagctccttgagtacatcgcaacgcgccttttggagcgagaaaccatcgagcgcgacgagtttgaggaagttattcgctgcgaacacgacctagaggggctaaaaaagcgtctaagccagcagcaggaaggggcatctgcccctgcgcagggtcagtcgccaccttcctga

SEQ ID NO: 3627 - protein, 609 aa, Treponema pallidum subsp. pallidum (syphilis spirochete)
MRIIPFSEFKDRIASGEIVKVVVGSPYFVGYTSARPAPSARGFSLLSEREAPTYHAIGVLSDSFLSMLDERQVVYSIKPRERNYLIETFQYLFPLLILFFVWRFFFKRMASNVSGLGSSIFSAGHARSAAVEEGKVTTRFADVAGVDEAKEELMEVVDFLKFPKKYTEIGGKIPRGVLLVGPPGTGKTLLARAVAGEASVPFFRISGSDFIEMFVGIGASRVRDLFKQAREKAPGIIFIDELDAIGKSRLNAIHSNDEREQTLNQLLVEMDGFDNTTGLILLAATNRPDVLDPALLRPGRFDRQVCVDRPDLKGREAILRIHAQNVKLAPEVDLKAVARITGGYSGADLANVVNEAALLAVRSGRAQVIETDLDEAVEKTMIGLQKKSRVIREEERRIIAYHETGHALAGTFTKGADKVHKITIIPRGTSALGYTFHIPEDDRHIVTEQQLLAEVDVLLSGRAAEFVAFGEVSTGAGNDISRATDIVRKMITDYGMSEKFQNVALTRRGTGYLAEPQLAREYSECTQQYVDEEVARVLAERYRAVVALLTEKKELLEYIATRLLERETIERDEFEEVIRCEHDLEGLKKRLSQQQEGASAPAQGQSPPS

SEQ ID NO: 3628 - DNA, 1881 bp, Caulobacter crescentus
  CDS (1)..(1881)
atgaatttcagaaacctggccatctggctggtgatcgtggcggtgctgggcggcgtgtttgtcgtcagccagaactcgcgtacgaaaagcagcagcgagatcagctattcgcagctcctcaaggacgttgacgcgggcaagatcaagtcggccgagatcgccggccaaacggtgctggccaagaccgccgacaacaagaccctgacggtcaacgcgccgatgaactccgaggaactggtcaaccgcatggtggccaagaacgcggacgtgaagttcaagagcggctcgatcagcttcctggccatcctcgtgcagctgctgccgatccttctggtcgtcggcgtctggctgtttctgatgcgtcagatgcagggcggcgcgaagggcgccatgggctttggcaagtccaaggcgcggctgctgaccgagaacaagaaccgcatcaccttcgaggacgtcgcgggcgtcgacgaggccaaggaagaactgcaggaggtcgtcgacttcctgaaggacccggccaagttccagcgcctgggcggcaagatcccgaagggcgccctgctggtgggtcctccgggtacgggtaagaccctgatcgcccgcgcggtcgcgggcgaagccggcgtgccgttcttcaccatctcgggttcggacttcgtcgaaatgttcgtcggcgtcggcgccagccgcgtgcgcgacatgttcgagcaggccaagaaaaacgcgccctgcatcatcttcatcgacgaaatcgacgccgtgggtcgccatcgtggcgcgggcctgggcggcggcaacgacgagcgtgagcagacgctgaaccagctgctggtcgagatggacggctttgaggccaatgaaggcatcatcctgatcgccgccaccaaccgtccggacgttctggaccccgcgctgctgcgtccgggccgcttcgaccgtcaggtcgtggtgcccaaccccgacgtcgccggccgcgagaagatcatccgcgtgcacatgaagaacgtgccgctggccgccgatgtcgacgtcaagacgctggcgcgcggcaccccgggcttctcgggcgcggatctggccaacctcgtcaacgaagccgccctgatggccgcccgcaagaaccgccgcatggtcaccatgcaggacttcgagcaggccaaggacaaggtcatgatgggcgccgagcgccgctcgatggccatgaacgaggaagaaaagaagctgacggcctatcacgagggcggtcacgccatcgtggccctgaacgtgccgctggccgaccctgtccacaaggccaccatcgtgccgcgcggccgggctctgggcatggtcatgcagctgccggaaggcgaccgctactcgatgaagtaccagcagatgaccagccgtctggccatcatgatgggcggccgcgtggccgaggagatcatcttcggcaaggagaacatcacctcgggcgcgtccagcgacatcaaggcggccacggatctggcccgtaacatggtcacccgctggggctattccgacatcctgggcacggtggcctatggcgacaaccaggacgaggtcttcctgggccactcggtcgcccggacccagaacgtctcggaagagacggcgcgtctgatcgacagcgaggtcaagcgtctggtgcagtacggcctggacgaggctcgccgcattctgaccgacaagatcgacgacctgcacaccctgggtaaggccctgcttgagtacgagaccctgtccggcgaggagatcgccgacatcctcaagggcatcccccccaagcgcgaagaggaagaggcggccacggcggtcattgcgccgtccctggtgccgctgtcgccgggcgcgggcgccagcgtcaccgcctga

SEQ ID NO: 3629 - protein, 626 aa, Caulobacter crescentus
MNFRNLAIWLVIVAVLGGVFVVSQNSRTKSSSEISYSQLLKDVDAGKIKSAEIAGQTVLAKTADNKTLTVNAPMNSEELVNRMVAKNADVKFKSGSISFLAILVQLLPILLVVGVWLFLMRQMQGGAKGAMGFGKSKARLLTENKNRITFEDVAGVDEAKEELQEVVDFLKDPAKFQRLGGKIPKGALLVGPPGTGKTLIARAVAGEAGVPFFTISGSDFVEMFVGVGASRVRDMFEQAKKNAPCIIFIDEIDAVGRHRGAGLGGGNDEREQTLNQLLVEMDGFEANEGIILIAATNRPDVLDPALLRPGRFDRQVVVPNPDVAGREKIIRVHMKNVPLAADVDVKTLARGTPGFSGADLANLVNEAALMAARKNRRMVTMQDFEQAKDKVMMGAERRSMAMNEEEKKLTAYHEGGHAIVALNVPLADPVHKATIVPRGRALGMVMQLPEGDRYSMKYQQMTSRLAIMMGGRVAEEIIFGKENITSGASSDIKAATDLARNMVTRWGYSDILGTVAYGDNQDEVFLGHSVARTQNVSEETARLIDSEVKRLVQYGLDEARRILTDKIDDLHTLGKALLEYETLSGEEIADILKGIPPKREEEEAATAVIAPSLVPLSPGAGASVTA

SEQ ID NO: 3630 - DNA, 2094 bp, Staphylococcus aureus
  CDS (1)..(2094)
atgcagaaagcttttcgcaatgtgctagttatcgtaataataggcgttattatttttggtctattttcatatttaaacggtaatggaaatatgccgaaacagcttacatataatcaatttactgagaagttggaaaaaggtgaccttaaaactttagaaatccaaccacaacaaaatgtctatatggtaagtggtaaaacgaaaaatgatgaagactattcatcaactattttatataacaacgaaaaagaattacaaaaaattactgatgctgctaaaaagcaaaacggtgtaaaattaacgattaaagaagaagaaaaacaaagtgtctttgtgagtatactttcaacattaattccagttgtagtcatagcgttattatttattttcttcctaagccaagcacaaggtggcggtagtggcggtcgtatgatgaactttggtaaatctaaagcaaaaatgtacgataataataaacgtcgtgttcgtttctctgatgtagcaggggcagatgaagaaaaacaagaattaattgaaattgttgatttcttgaaagataataaaaaattcaaagaaatgggatctaggattcctaaaggtgtcttacttgttggacctccaggtactggtaaaacattacttgctagagcggttgcaggtgaagctggcgcaccattcttctctattagtggttcagactttgtagagatgtttgttggtgttggtgcgagccgtgttcgtgacttattcgataatgctaagaaaaacgcgccttgtatcatctttatcgatgagattgatgctgttggtcgtcaacgtggtgcaggtgttggtggcggtcatgatgaacgtgaacaaaccctaaaccaattattagttgaaatggatggtttcggtgaaaatgaaggtatcattatgatagctgctacaaaccgtcctgatatccttgacccagccttattacgtccaggtcgttttgatagacaaattcaagttggtcgtccagatgtgaaaggccgtgaagcaattcttcatgttcatgctaaaaacaaaccacttgatgaaacggttgatttaaaagcaatttcacaacgtacacctggtttctcaggtgctgatttagagaacttattaaatgaagcatctttaattgctgtacgtgaaggtaaaaagaaaattgacatgagagatatcgaagaggcaacggatagagttatagccggacctgctaagaaatctcgagttatttctaagaaagaacgtaatattgttgctcatcacgaagctggtcatacaattatcggtatggtacttgatgaggcagaagtagtgcataaagttactattgttccacgtggacaagcaggtggttatgcaatgatgctacctaaacaagatcgtttcttaatgactgaacaagagttattagataaaatctgtggtttacttggtggacgtgtatcagaagatattaactttaacgaagtatcaacaggtgcttcaaatgacttcgaacgtgcaacacaaatcgcacgctcaatggttacgcaatatggtatgagtaaaaaattaggaccattacagttcggtcatagcaatggtcaagtattcttaggtaaagatatgcaaggtgagcctaattattcaagccaaatcgcatatgaaattgataaagaagttcaacgaatcgttaaagaacaatacgaacgttgtaaacaaattttattagagcacaaagaacaattaattttaattgctgaaacattattaacagaagaaacattagttgctgaacaaattcaatcattattctacgaaggtaaattacctgaaattgattatgatgcagctaaagttgttaaagatgaagattctgaatttaatgatggtaaattcggtaaatcttatgaagagattcgtaaagagcaattagaagatggacaacgtgacgaaagtgaagatcgtaaagaagaaaaagatattgctgaggataaaaaagaagctgataaatctgatgaaaaagatgaaccagcacatcgacaagccccaaatatcgaaaaaccttacgatccaaatcacccagacaataaataa

SEQ ID NO: 3631 - protein, 697 aa, Staphylococcus aureus
MQKAFRNVLVIVIIGVIIFGLFSYLNGNGNMPKQLTYNQFTEKLEKGDLKTLEIQPQQNVYMVSGKTKNDEDYSSTILYNNEKELQKITDAAKKQNGVKLTIKEEEKQSVFVSILSTLIPVVVIALLFIFFLSQAQGGGSGGRMMNFGKSKAKMYDNNKRRVRFSDVAGADEEKQELIEIVDFLKDNKKFKEMGSRIPKGVLLVGPPGTGKTLLARAVAGEAGAPFFSISGSDFVEMFVGVGASRVRDLFDNAKKNAPCIIFIDEIDAVGRQRGAGVGGGHDEREQTLNQLLVEMDGFGENEGIIMIAATNRPDILDPALLRPGRFDRQIQVGRPDVKGREAILHVHAKNKPLDETVDLKAISQRTPGFSGADLENLLNEASLIAVREGKKKIDMRDIEEATDRVIAGPAKKSRVISKKERNIVAHHEAGHTIIGMVLDEAEVVHKVTIVPRGQAGGYAMMLPKQDRFLMTEQELLDKICGLLGGRVSEDINFNEVSTGASNDFERATQIARSMVTQYGMSKKLGPLQFGHSNGQVFLGKDMQGEPNYSSQIAYEIDKEVQRIVKEQYERCKQILLEHKEQLILIAETLLTEETLVAEQIQSLFYEGKLPEIDYDAAKVVKDEDSEFNDGKFGKSYEEIRKEQLEDGQRDESEDRKEEKDIAEDKKEADKSDEKDEPAHRQAPNIEKPYDPNHPDNK

SEQ ID NO: 3632 - DNA, 1935 bp, Escherichia coli
  CDS (1)..(1935)
atggcgaaaaacctaatactctggctggtcattgccgttgtgctgatgtcagtattccagagctttgggcccagcgagtctaatggccgtaaggtggattactctaccttcctacaagaggtcaataacgaccaggttcgtgaagcgcgtatcaacggacgtgaaatcaacgttaccaagaaagatagtaaccgttataccacttacattccggttcaggatccgaaattactggataacctgttgaccaagaacgtcaaggttgtcggtgaaccgcctgaagaaccaagcctgctggcttctatcttcatctcctggttcccgatgctgttgctgattggtgtctggatcttcttcatgcgtcaaatgcagggcggcggtggcaaaggtgccatgtcgtttggtaagagcaaagcgcgcatgctgacggaagatcagatcaaaacgacctttgctgacgttgcgggctgcgacgaagcaaaagaagaagttgctgaactggttgagtatctgcgcgagccgagccgcttccagaaactcggcggtaagatcccgaaaggcgtcttgatggtcggtcctccgggtaccggtaaaacgctgctggcgaaagcgattgcaggcgaagcgaaagttccgttctttactatctccggttctgacttcgtagaaatgttcgtcggtgtgggtgcatcccgtgttcgtgacatgttcgaacaggcgaagaaagcggcaccgtgcatcatctttatcgatgaaatcgacgccgtaggccgccagcgtggcgctggtctgggcggtggtcacgatgaacgtgaacagactctgaaccagatgctggttgagatggatggcttcgaaggtaacgaaggtatcatcgttatcgccgcgactaaccgtccggacgttctcgacccggccctgctgcgtcctggccgtttcgaccgtcaggttgtggtcggcttgccagatgttcgcggtcgtgagcagatcctgaaagttcacatgcgtcgcgtaccattggcacccgatatcgacgcggcaatcattgcccgtggtactcctggtttctccggtgctgacctggcgaacctggtgaacgaagcggcactgttcgctgctcgtggcaacaaacgcgttgtgtcgatggttgagttcgagaaagcgaaagacaaaatcatgatgggtgcggaacgtcgctccatggtgatgacggaagcgcagaaagaatcgacggcttaccacgaagcgggtcatgcgattatcggtcgcctggtgccggaacacgatccggtgcacaaagtgacgattatcccacgcggtcgtgcgctgggtgtgactttcttcttgcctgagggcgacgcaatcagcgccagccgtcagaaactggaaagccagatttctacgctgtacggtggtcgtctggcagaagagatcatctacgggccggaacatgtatctaccggtgcgtccaacgatattaaagttgcgaccaacctggcacgtaacatggtgactcagtggggcttctctgagaaattgggtccactgctgtacgcggaagaagaaggtgaagtgttcctcggccgtagcgtagcgaaagcgaaacatatgtccgatgaaactgcacgtatcatcgaccaggaagtgaaagcactgattgagcgtaactataatcgtgcgcgtcagcttctgaccgacaatatggatattctgcatgcgatgaaagatgctctcatgaaatatgagactatcgacgcaccgcagattgatgacctgatggcacgtcgcgatgtacgtccgccagcgggctgggaagaaccaggcgcttctaacaattctggcgacaatggtagtccaaaggctcctcgtccggttgatgaaccgcgtacgccgaacccgggtaacaccatgtcagagcagttaggcgacaagtaa

SEQ ID NO: 3633 - protein, 644 aa, Escherichia coli
MAKNLILWLVIAVVLMSVFQSFGPSESNGRKVDYSTFLQEVNNDQVREARINGREINVTKKDSNRYTTYIPVQDPKLLDNLLTKNVKVVGEPPEEPSLLASIFISWFPMLLLIGVWIFFMRQMQGGGGKGAMSFGKSKARMLTEDQIKTTFADVAGCDEAKEEVAELVEYLREPSRFQKLGGKIPKGVLMVGPPGTGKTLLAKAIAGEAKVPFFTISGSDFVEMFVGVGASRVRDMFEQAKKAAPCIIFIDEIDAVGRQRGAGLGGGHDEREQTLNQMLVEMDGFEGNEGIIVIAATNRPDVLDPALLRPGRFDRQVVVGLPDVRGREQILKVHMRRVPLAPDIDAAIIARGTPGFSGADLANLVNEAALFAARGNKRVVSMVEFEKAKDKIMMGAERRSMVMTEAQKESTAYHEAGHAIIGRLVPEHDPVHKVTIIPRGRALGVTFFLPEGDAISASRQKLESQISTLYGGRLAEEIIYGPEHVSTGASNDIKVATNLARNMVTQWGFSEKLGPLLYAEEEGEVFLGRSVAKAKHMSDETARIIDQEVKALIERNYNRARQLLTDNMDILHAMKDALMKYETIDAPQIDDLMARRDVRPPAGWEEPGASNNSGDNGSPKAPRPVDEPRTPNPGNTMSEQLGDK

SEQ ID NO: 3634 - DNA, 1989 bp, Schistosoma mansoni
  CDS (1)..(1989)
atgattgtcagtccgtgttgtcggattatcagaacttgctgtgtgagcaaccgagggacgtttcattctcgcttggccgccttgtacccttcatatatcaaaatacctaacaaccacgctcggatatttgttacaaagtctagaaaaatcaaccgtccttctagttcatttattattgacacgaaagaagctaggcaacgtaattcagattcatcaacagtgagttcagatctggatgaaattttaaaggatcaaacaccatcagcacagcttcgactagtagatgcctatcgtagaggttttcagtcgtcaactgacagtgggaagtcgtcaaataaaatgcagatgtggaggacaattattataaagactattctttttggggtggtctcttgcttcaccatagtgtttttaaaaaagacactggttggtacgttcccgaaattcttggaccagaatatagggtcgtttgctgaaaacactgacgttagctttagtgacgtccaaggatgtgatgaggtcaaaaaggaactcgtggatgtcgttgaatttcttagaaaccctgaaaagttcaatcagattggagctaaactccctaaaggtgtcctccttgtgggtcctcctggagttggaaaaaccctactcgctaaagccgtgtctggagaagcccaagtccctttcttatatgcttctgggagtagtttcgacgaagtcctcgttggactaggagcttctcgtattcgacaacttttcaccactgccaaacagaattcaccatgtttggtatttattgatgaaatagattctgtcgggggaaatcgaacattttctcctcatcatccctttgcgaatcagacaattaaccagcttctcgcagaaatggatgggttccagtcgaaagaaggaattattgttttaggtgcaacaaatcaagcagaagtcttagacaaggctttattgagacctggtcgttttgatgtccaaattcatgtatcaccaccaacttatgaaggcagaatagctcttctaaatctttacttaaaaaaagtaaaaacaggctcaaatattgatatagaaaagttggcccatggaacagttggatacactggtgcggatatacagaatttggttaatcaagctgctatcgctgctgcactacgtaatgatccttttgttgaaatgcatcatttatgggatgctcgtgatcgattaataatgggaccagctaaacgtcgtccattggatgatcaaactaatcgagtgtcagcatttcatgaggctggtcatgctttagtagcattgctgactgcggatagtataccattacacaaagttacaattattcctcgaggtgaggcaggcggtcttactagttttctacaagagaaagatataagttttatgactcgtgcacaattattagctcaattagatgtattgatgggtggtcgagttggtgaagaattagtttttggtgcagacaaagttaccaatggtgcagcagatgattttcgaaaagcaacaattttagctcaaaatatggtgaaacgcttcggtttttcaagtaaaattggaccaagagttataccagatactcaggatgaacaacttggtgaagccacacgtgacctaatcgataaagaagttgaccaattactcaatgattctttaactcgtgtacgtactttactatctagtcaaagtaaacaacataaacttctagctgaagcattactacattttgaaacattaaccaaagatgaagtattagcagtattagctggtaaaatgaaacctccaaaaactcaatcagtaacatcaaaatcaacaactcttctaccacaattaggtccttcaacatcaactgaaattccacgtatgattgtttcattaatcattgtacatgttgttgattttatttcgtttttttgtccattcaaggatactttacacacatatacacacacacacaaactgttattttcttga

SEQ ID NO: 3635 - protein, 662 aa, Schistosoma mansoni
MIVSPCCRIIRTCCVSNRGTFHSRLAALYPSYIKIPNNHARIFVTKSRKINRPSSSFIIDTKEARQRNSDSSTVSSDLDEILKDQTPSAQLRLVDAYRRGFQSSTDSGKSSNKMQMWRTIIIKTILFGVVSCFTIVFLKKTLVGTFPKFLDQNIGSFAENTDVSFSDVQGCDEVKKELVDVVEFLRNPEKFNQIGAKLPKGVLLVGPPGVGKTLLAKAVSGEAQVPFLYASGSSFDEVLVGLGASRIRQLFTTAKQNSPCLVFIDEIDSVGGNRTFSPHHPFANQTINQLLAEMDGFQSKEGIIVLGATNQAEVLDKALLRPGRFDVQIHVSPPTYEGRIALLNLYLKKVKTGSNIDIEKLAHGTVGYTGADIQNLVNQAAIAAALRNDPFVEMHHLWDARDRLIMGPAKRRPLDDQTNRVSAFHEAGHALVALLTADSIPLHKVTIIPRGEAGGLTSFLQEKDISFMTRAQLLAQLDVLMGGRVGEELVFGADKVTNGAADDFRKATILAQNMVKRFGFSSKIGPRVIPDTQDEQLGEATRDLIDKEVDQLLNDSLTRVRTLLSSQSKQHKLLAEALLHFETLTKDEVLAVLAGKMKPPKTQSVTSKSTTLLPQLGPSTSTEIPRMIVSLIIVHVVDFISFFCPFKDTLHTYTHTHKLLFS

SEQ ID NO: 3636 - DNA, 2478 bp, Saccharomyces cerevisiae
  CDS (1)..(2478)
atgttgctactttcttggtcaagaattgctactaaggtagttagaaggcccgttcgcttccggtcctattacggcttgacccatatcaagagtttacatactcaatatcggctactcaataggctgcaagagaataagagcggtaacaagaacgaggacaataacgaagacgctaaacttaacaaagaaattcccacagacgaagaggttgaagcaataagaaaacaagtagaaaaatatatcgaacaaactaaaaataatactataccggctaactggaaagaacagaaacgcaaaattgatgaaagtattaggcgtttagaagatgctgtattgaaacaagaatctaacagaattcaagaagaaagaaaggaaaaagaggaggaaaatggtccttcaaaagccaagtcaaacagaacaaaagagcagggctactttgaaggtaacaatagcagaaatattccaccgccaccaccacctcctcccccaaaaccacctctaaatgatcctagtaatcctgtatcgaaaaatgttaacttattccagataggactaacttttttcctcctttcgtttttattggatctcctcaacagtttggaagagcaaagtgagataacgtggcaggattttagagagaaactattggcaaaaggttatgttgcgaagttgattgttgtcaacaagtccatggtgaaagtgatgttaaatgacaacggaaaaaaccaagccgacaattacggtcgcaacttctattatttcacaattggttcaattgatagcttcgaacacaaacttcagaaagcacaggacgaactggacattgataaggatttcagaatacctgtactatatgttcaagaaggcaattgggctaaagctatgttccaaattttgccaactgttttaatgattgcaggtattatttggttgacaagaagatcggcacaagcagcgggcggtagccgtggaggcatatttggtctgagtcgttctaaggctaaaaaatttaacactgaaacagacgttaagatcaagttcaaggacgttgccggatgcgatgaggctaaggaagaaattatggagtttgttagcttcttgaaagaaccttctcgttatgaaaaaatgggagctaaaattcctagaggtgcgattctatctggtccaccaggtaccggtaaaactttgcttgcaaaggcaacagcaggtgaagccggtgttccgttttattttgtttctggttcagaatttgtagaaatgtttgttggtgttggtgcagcaagagtaagagatttgttcaaaactgcaagagaaaatgcaccctcaattgtgtttattgacgaaattgatgctataggaaaagcaagacaaaagggtaatttttcaggtgccaatgatgagagagagaacacgctaaatcaaatgttagtagaaatggatggtttcactccagctgaccacgttgttgttttagctggtaccaatagacccgatattctcgataaagcattattaaggcctggtagatttgacaggcatatcaatatcgacaagcccgaacttgagggtagaaaagccatttttgctgttcatttacatcatttgaaacttgccggggaaatttttgatttgaaaaatagattagcggctttgacgccaggcttttctggtgctgatattgccaacgtttgtaacgaggccgccttgattgctgctagaagtgatgaagatgcagtaaaattgaatcattttgaacaagctatcgaaagagtcatcggtggagtggaacgcaaatccaagctactctctcccgaagagaagaaagtagtggcttaccacgaggctggtcatgctgtatgtggatggtacttaaaatacgcagatcctcttctgaaagtcagtattattccacgtggccagggcgcccttggttatgcacagtatttgccaggtgatatcttcttactaactgaacagcaacttaaggacagaatgaccatgtctctgggtggaagagtttctgaagaattacatttcccatcagttacaagtggcgcatctgatgacttcaaaaaagttactagcatggccacggcaatggtcacagaattaggcatgagtgataaaattggctgggtcaattaccagaagagagatgatagcgatttgacaaaaccattttcggacgagacaggtgacattattgattccgaagtatacagaatcgtccaagaatgccatgacagatgtacaaagctgcttaaagaaaaagcagaagatgtagagaagattgctcaagtactactgaaaaaagaagttttgacaagagaagatatgattgatttacttggtaagcgccctttcccagaaaggaatgatgcttttgataagtacttgaacgattacgaaacggaaaaaatcaggaaggaagaagaaaaaaacgaaaaacgtaatgagcctaagccatctacaaactga

SEQ ID NO: 3637 - protein, 825 aa, Saccharomyces cerevisiae
MLLLSWSRIATKVVRRPVRFRSYYGLTHIKSLHTQYRLLNRLQENKSGNKNEDNNEDAKLNKEIPTDEEVEAIRKQVEKYIEQTKNNTIPANWKEQKRKIDESIRRLEDAVLKQESNRIQEERKEKEEENGPSKAKSNRTKEQGYFEGNNSRNIPPPPPPPPPKPPLNDPSNPVSKNVNLFQIGLTFFLLSFLLDLLNSLEEQSEITWQDFREKLLAKGYVAKLIVVNKSMVKVMLNDNGKNQADNYGRNFYYFTIGSIDSFEHKLQKAQDELDIDKDFRIPVLYVQEGNWAKAMFQILPTVLMIAGIIWLTRRSAQAAGGSRGGIFGLSRSKAKKFNTETDVKIKFKDVAGCDEAKEEIMEFVSFLKEPSRYEKMGAKIPRGAILSGPPGTGKTLLAKATAGEAGVPFYFVSGSEFVEMFVGVGAARVRDLFKTARENAPSIVFIDEIDAIGKARQKGNFSGANDERENTLNQMLVEMDGFTPADHVVVLAGTNRPDILDKALLRPGRFDRHINIDKPELEGRKAIFAVHLHHLKLAGEIFDLKNRLAALTPGFSGADIANVCNEAALIAARSDEDAVKLNHFEQAIERVIGGVERKSKLLSPEEKKVVAYHEAGHAVCGWYLKYADPLLKVSIIPRGQGALGYAQYLPGDIFLLTEQQLKDRMTMSLGGRVSEELHFPSVTSGASDDFKKVTSMATAMVTELGMSDKIGWVNYQKRDDSDLTKPFSDETGDIIDSEVYRIVQECHDRCTKLLKEKAEDVEKIAQVLLKKEVLTREDMIDLLGKRPFPERNDAFDKYLNDYETEKIRKEEEKNEKRNEPKPSTN

SEQ ID NO: 3638 - DNA, 1887 bp, chloroplast Porphyra purpurea
  CDS (1)..(1887)
atgaaactatcttggaaaacacttctgctttggtctttaccaatttttgtagttggtttctttttctggcaaggttttttaggcccaactactacagatgtaggaagtaatattgcaagttctagaatgacatatggtcgatttttagaatatttagatatgggttgggtaaaacgagttgatttgtatgagaataaccatacagcaatcgtcgaagccgttggaccagagttaggaaatagagtgcaacgtattcgagttgaactgccagcaagcgcaccagaactgattacaaagctacgtaaagctaacgttgatttagatgctcatcctccgaaaagtactagtgccgtttggggattattaggtaatttattattcccactaatattggttggtggattagcatttttatttagaaggtctaataatgcaagtggcggtcctggacaagcaatgtcatttggtaaatcaaaagctctttttcaaatggaagctaaaacaggcgtagtatttaatgatgttgctggtgttgaagaagcaaaagaagagtttcaagaagtagttacttttttaaaacaacctgaatcatttactgctgttggtgcgaaaataccaaaaggagtattactagttggacctcctggtaccggtaaaacattattagcaaaggcaattgcaggcgaagctggagtaccattttttagtatttctggttcagaatttgtagaaatgtttgttggagttggagcatctcgtgttagggacctcttcaagaaagctaaagataatgcaccttgtattgtttttattgatgaaattgatgctgttggccgacaaagaggtacaggtgttggtggaggtaatgatgaacgagaacaaacattaaaccaactattaactgaaatggacggttttgaaggtaatactggagttattgtaatagcagctactaatagggctgacattttagattctgctcttctgagaccaggaagatttgataggcaagtgtctgtagatgttcctgattttagaggtagattagctattcttgaagtgcatgcaaaaaacaaaaaaatggaatccaaggtttcattagaaactatagctaggcgaactcctggtttctctggagctgatttagctaatttattaaatgaagctgctattttaactgctagaagaagaaaaagtgcgatgactatgtctgaaattgacacatcaattgatagagtagtagctgggctggaaggaacacctctaattgatagcaaaagtaaaagattaattgcttatcacgaagttggacatgcaataataggaagtttattggagcatcacgatcccgttcaaaaagtgacattaatacctagaggacaagctagaggattaacttggtttacaccaagtgatgatcagagtttaatttctcgttctcaaatactggctcgtattgtaggagcgcttggaggaagagctgcagaagaaattatctttggagatgcagaagttacaactggagcaagtaatgatttgcagcaagttacgtcaatggcaagacaaatggtcactcgttttggaatgtctaaaattggtccattgtcattagagagtcaaggaagtgacccatttttaggaagaggaatggggggaggctcagaatactccgatgaagtggctactaatattgataaacaagtaagagaaattgtaagcgaatgctacaaagaagctaaaaagattgtcaaagataatcgcgtagttatggacaggctggttgacttactgatcgaaaaagaaaccatagaaggtaatgaatttagacatattgtaaaagaatatacagcgattcctgaaaaaaattactatatttctcaattttaa

SEQ ID NO: 3639 - protein, 628 aa, chloroplast Porphyra purpurea
MKLSWKTLLLWSLPIFVVGFFFWQGFLGPTTTDVGSNIASSRMTYGRFLEYLDMGWVKRVDLYENNHTAIVEAVGPELGNRVQRIRVELPASAPELITKLRKANVDLDAHPPKSTSAVWGLLGNLLFPLILVGGLAFLFRRSNNASGGPGQAMSFGKSKALFQMEAKTGVVFNDVAGVEEAKEEFQEVVTFLKQPESFTAVGAKIPKGVLLVGPPGTGKTLLAKAIAGEAGVPFFSISGSEFVEMFVGVGASRVRDLFKKAKDNAPCIVFIDEIDAVGRQRGTGVGGGNDEREQTLNQLLTEMDGFEGNTGVIVIAATNRADILDSALLRPGRFDRQVSVDVPDFRGRLAILEVHAKNKKMESKVSLETIARRTPGFSGADLANLLNEAAILTARRRKSAMTMSEIDTSIDRVVAGLEGTPLIDSKSKRLIAYHEVGHAIIGSLLEHHDPVQKVTLIPRGQARGLTWFTPSDDQSLISRSQILARIVGALGGRAAEEIIFGDAEVTTGASNDLQQVTSMARQMVTRFGMSKIGPLSLESQGSDPFLGRGMGGGSEYSDEVATNIDKQVREIVSECYKEAKKIVKDNRVVMDRLVDLLIEKETIEGNEFRHIVKEYTAIPEKNYYISQF

SEQ ID NO: 3640 - DNA, 1851 bp, Synechocystis sp.
  CDS (1)..(1851)
atgagcaaaaataataaaaaatggcgtaacgcgggcctatatgccttgttgttaattgtcgttttagcgttggcatcggcctttttcgaccgaccgacccaaactagggaaaccctcagctacagcgattttgtcaatcgggtagaagccaatcagatcgaacgggtcaacctcagtgccgaccgcacccaagcccaagtacccaatcccagcggtggtcctccctacttagtcaatctgcccaacgaccccgacttgatcaatattctcacccaacacaacgtggatattgctgtccaaccccagagcgacgaaggtttctggttccgcatcgccagcaccctatttttgcccatcttgctcttggtgggaatttttttcctcttccgtcgggcccagagtggccctggttcccaagccatgaactttggtaaatccaaagcacgggtgcaaatggaaccccaaacccaagttaccttcggggacgtggccggtattgagcaagccaaactagaactcaccgaagtggtggacttcctgaaaaatgcagaccgcttcaccgaattgggagccaaaattcccaagggtgttttgttggtaggcccccccggaaccggtaaaaccctgttggccaaagccgtggctggggaagcgggtgtaccgttcttttccatctccggttcggaatttgtggaaatgtttgtcggtgttggtgcttctcgggtacgggatttgtttgagcaggctaaagccaatgctccctgtatcgtcttcatcgatgaaattgatgccgttggtcgtcaacggggcgctggccttggtggtggtaatgatgagcgggaacagaccctcaaccagttgctaacggaaatggacggttttgaaggcaacaccggcattattatcgtcgccgccactaaccgtcccgatgtattggattctgccttgatgcgtcccggtcgtttcgatcgccaagtggtagtagaccgtcctgattatgctggccgtcgagaaatcctcaatgtccatgcccggggtaaaaccctttcccaggatgtggatttggataaaattgcccgtcgtacccctggatttaccggtgctgacctgtccaacctgttgaacgaagccgctattttggctgcccgtcgcaacttgaccgaaatttccatggacgaagtcaacgacgccattgaccgggtgttggctggtcctgagaagaaaaatcgggtgatgagcgaaaaacgcaaaaccctagtggcttaccatgaagctggccacgccttggtgggtgctttgatgcctgattatgatccagtacaaaaaattagcattattccccgcggccgggccggtggtttaacctggttcacccccagtgaagaccgtatggaatccggtttatactcccgttcctatctgcaaaatcagatggccgttgccctgggaggccgtattgctgaggaaattattttcggcgaagaggaagtcaccaccggtgcttccaacgacctccaacaggtagcccgggtcgcccgccaaatggtaacccgtttcggcatgagcgatcgcctgggcccggtagctttgggtcgtcagggtggtggggtattccttggtcgggacattgcctctgaccgggacttttccgatgaaaccgctgcggcgatcgatgaggaagtaagtcaattggtagaccaagcctatcaacgggccaaacaggtcttggtggaaaaccgtggcattttagatcaactggcagaaatcttggtagaaaaggaaactgttgattctgaagagctgcaaactctcctggctaacaacaatgccaaattggcacttctagtttaa

SEQ ID NO: 3641 - protein, 616 aa, Synechocystis sp.
MSKNNKKWRNAGLYALLLIVVLALASAFFDRPTQTRETLSYSDFVNRVEANQIERVNLSADRTQAQVPNPSGGPPYLVNLPNDPDLINILTQHNVDIAVQPQSDEGFWFRIASTLFLPILLLVGIFFLFRRAQSGPGSQAMNFGKSKARVQMEPQTQVTFGDVAGIEQAKLELTEVVDFLKNADRFTELGAKIPKGVLLVGPPGTGKTLLAKAVAGEAGVPFFSISGSEFVEMFVGVGASRVRDLFEQAKANAPCIVFIDEIDAVGRQRGAGLGGGNDEREQTLNQLLTEMDGFEGNTGIIIVAATNRPDVLDSALMRPGRFDRQVVVDRPDYAGRREILNVHARGKTLSQDVDLDKIARRTPGFTGADLSNLLNEAAILAARRNLTEISMDEVNDAIDRVLAGPEKKNRVMSEKRKTLVAYHEAGHALVGALMPDYDPVQKISIIPRGRAGGLTWFTPSEDRMESGLYSRSYLQNQMAVALGGRIAEEIIFGEEEVTTGASNDLQQVARVARQMVTRFGMSDRLGPVALGRQGGGVFLGRDIASDRDFSDETAAAIDEEVSQLVDQAYQRAKQVLVENRGILDQLAEILVEKETVDSEELQTLLANNNAKLALLV

SEQ ID NO: 3642 - DNA, 1998 bp, Synechocystis sp.
  CDS (1)..(1998)
atgagtcatcgtccccgttccgatcgccatagtttctccagccctagccgcttttggcaccgtttggggatgggtttactggtagctggcaccctagccctaccggtatctaccctggcccaggaagggggagaaggggcccaacccaaggccagtcccagtcccatccaatcccctaactccagcaatggagaagccacaccccgctccttttttaactctggctccccccggtctgctgaaccgaaaatgaactatgggcagttgatcgatgccattaaagctaatcaagtggccaaagtggaagtggacactaaccgccgccaggcgatcgttaccctcaaggatgctcccccagggtccaagccccaaaccgtgcagttactagacaataatccagagttgctcaacctcctgcggagccgttccgaaaccatcgatttagacatcaaccgcaccccggataattcggccctgtatggtctactaaccaatttgctggtggtggctattctgatcggtttggtggtgatggtggtgcgacgttctgccaatgcgtcgggtcaggccatgagttttggcaaatccaaggcccggttccaaatggaagcaaaaaccggtgtcggctttgacgatgtggccggcattgacgaagcgaaggaagaattgcaggaagtggtaactttcctcaagcaaccggaaaaatttaccgccatcggcgcaaaaattccccggggtgttctactcatcggccctcccggtacgggcaaaaccttattagctaaggcgatcgccggggaggcgggggtgccatttttcagcatttccggttcagaatttgtggaaatgtttgtcggggtgggggcttcccgggtcagggatttattcaaaaaagctaaggaaaatgccccctgcctagtatttatcgatgaaattgatgcggtgggtcgacaacggggtgtgggctatggcggcggcaacgatgaacgggaacaaaccctcaaccaattgttgacggaaatggatggctttgagggcaacagcggcatcattgtcattgcggccaccaaccgccccgatgtgctggatttggcccttttgcggccaggacggttcgatcgccaggtgacggtggattaccccgatgtccagggccgggaattaattttggcaatccacgcccaaaacaaaaaattgcacgaagaggtgcagttagcggcgatcgccaggagaactcccggatttacgggggcagatttggccaacgtgttaaatgaagcggccattttcaccgctcggcggcgcaaggaggccatcaccatggcggaagtgaatgatgccattgaccgggtggtggcggggatggaaggtacacccctagtggatagtaaaagtaaacgcttaattgcttaccatgaagtgggccacgccttgattggcaccctctgtcctggccacgatccggtggaaaaagttaccctcattccccggggccaagcccaaggtttgacctggttcacccctgatgaagaccaaagcctcatgacccgcaaccaaatgattgcccgcattgcaggattgttgggggggagggtggccgaagaagttatttttggcgacgacgaggtgaccaccggagccggtaacgacattgaaaaaatcacctacctagcccgacaaatggtgacgaaactgggcatgtcttccctgggtctagtggccttggaagaggaaggcgatcgtaactttagcggcggagattggggcaagcgttccgaatattccgaagacattgccgcccgcattgaccgggaaatccaagccattgtcaccgctgcccaccaacgggccacccgcattattgaagaaaatcgtaatttaatggatttactagtcgatgcgctcatcgatcaagaaaccattgaaggggagcattttcggcaactggtggaaagttatcaacaatctcaaaaacagcctgctctagccggtaagtag

SEQ ID NO: 3643 - protein, 665 aa, Synechocystis sp.
MSHRPRSDRHSFSSPSRFWHRLGMGLLVAGTLALPVSTLAQEGGEGAQPKASPSPIQSPNSSNGEATPRSFFNSGSPRSAEPKMNYGQLIDAIKANQVAKVEVDTNRRQAIVTLKDAPPGSKPQTVQLLDNNPELLNLLRSRSETIDLDINRTPDNSALYGLLTNLLVVAILIGLVVMVVRRSANASGQAMSFGKSKARFQMEAKTGVGFDDVAGIDEAKEELQEVVTFLKQPEKFTAIGAKIPRGVLLIGPPGTGKTLLAKAIAGEAGVPFFSISGSEFVEMFVGVGASRVRDLFKKAKENAPCLVFIDEIDAVGRQRGVGYGGGNDEREQTLNQLLTEMDGFEGNSGIIVIAATNRPDVLDLALLRPGRFDRQVTVDYPDVQGRELILAIHAQNKKLHEEVQLAAIARRTPGFTGADLANVLNEAAIFTARRRKEAITMAEVNDAIDRVVAGMEGTPLVDSKSKRLIAYHEVGHALIGTLCPGHDPVEKVTLIPRGQAQGLTWFTPDEDQSLMTRNQMIARIAGLLGGRVAEEVIFGDDEVTTGAGNDIEKITYLARQMVTKLGMSSLGLVALEEEGDRNFSGGDWGKRSEYSEDIAARIDREIQAIVTAAHQRATRIIEENRNLMDLLVDALIDQETIEGEHFRQLVESYQQSQKQPALAGK

SEQ ID NO: 3644 - DNA, 1884 bp, Synechocystis sp.
  CDS (1)..(1884)
atgaaattttcctggagaactgccctactttggtccctacccctgttggtagtcggctttttcttctggcaggggagctttggaggggcagatgccaacctcggttccaacactgccaacacccgcatgacctatggtcgcttcctcgaatatgtggatgctggccgcatcaccagtgtggatttatatgaaaatggccgcacggcgatcgtgcaagttagcgacccagaagtagaccggaccctccgttcccgggttgacctccccaccaatgccccggaattgattgcccgtttacgggactccaacattcgccttgattcccaccctgtccgcaacaatggcatggtttggggttttgtgggcaacttgattttccccgtgcttttgattgcttccctcttttttctcttccgccgttccagcaacatgcctgggggccccggccaagccatgaactttggtaaatccaaagctcgcttccaaatggatgccaaaaccggtgtcatgttcgatgatgtggccggtattgacgaagccaaggaagaattgcaagaggtggtaactttccttaaacagcccgaacgctttactgcagtgggggccaagattcccaaaggagtactcttagtgggccctcccggtaccggtaaaactctcctcgccaaggcgatcgccggggaagccggagttcctttcttcagcatttctggttccgagttcgtagaaatgtttgtcggcgttggtgcctcccgggtgcgggacttgtttaaaaaagccaaagagaatgccccctgtttgatcttcattgatgagattgatgccgtgggtcgtcaacggggtgctggtatcggtggtggtaacgatgaacgggaacaaaccctcaaccagctactaaccgagatggacggttttgaaggcaatacgggcattattatcattgccgccactaaccgccctgacgtgctagattctgccttgatgcgtcccggtcgtttcgatcgccaagtgatggtggatgcccctgactactctggtcgtaaggaaattttagaagtccacgcccgcaataaaaagttagcaccggaagtttccatcgactccattgcccgccgtactcccggttttagtggggctgacttggccaatttattgaatgaagccgccattctcaccgcccgccgtcgtaaatccgctatcactctgttggaaattgatgatgccgtggaccgggtggtagctggtatggaaggcacccccttggtggacagcaaaagtaagcggctaattgcttatcacgaagtaggccacgccattgtgggcacattgttaaaagaccatgatcccgtgcaaaaagtcacccttattcctcggggccaagcccaaggtttgacctggttcactcccaacgaagaacagggtttaaccaccaaagcccaactgatggcccgtattgctggagcaatgggcggtcgagccgctgaagaggaagtttttggcgatgacgaagtaaccactggggctggtggtgacctacaacaggtaactgagatggctcgccagatggtaactcgttttggcatgagcaaccttggtcccatttccctggagagttcaggtggggaagtattcctgggtggtggcttgatgaaccgttctgaatactccgaagaagtagccacccgcattgatgcccaagtacggcaattggctgaacagggtcaccaaatggctcgcaaaatcgtccaagaacaacgggaagtggttgatcgcctggtggatcttttaattgagaaagaaaccattgatggggaagaatttcggcaaattgtggcggaatacgccgaggttcccgtcaaggaacagttaattccccaactataa

SEQ ID NO: 3645 - protein, 627 aa, Synechocystis sp.
MKFSWRTALLWSLPLLVVGFFFWQGSFGGADANLGSNTANTRMTYGRFLEYVDAGRITSVDLYENGRTAIVQVSDPEVDRTLRSRVDLPTNAPELIARLRDSNIRLDSHPVRNNGMVWGFVGNLIFPVLLIASLFFLFRRSSNMPGGPGQAMNFGKSKARFQMDAKTGVMFDDVAGIDEAKEELQEVVTFLKQPERFTAVGAKIPKGVLLVGPPGTGKTLLAKAIAGEAGVPFFSISGSEFVEMFVGVGASRVRDLFKKAKENAPCLIFIDEIDAVGRQRGAGIGGGNDEREQTLNQLLTEMDGFEGNTGIIIIAATNRPDVLDSALMRPGRFDRQVMVDAPDYSGRKEILEVHARNKKLAPEVSIDSIARRTPGFSGADLANLLNEAAILTARRRKSAITLLEIDDAVDRVVAGMEGTPLVDSKSKRLIAYHEVGHAIVGTLLKDHDPVQKVTLIPRGQAQGLTWFTPNEEQGLTTKAQLMARIAGAMGGRAAEEEVFGDDEVTTGAGGDLQQVTEMARQMVTRFGMSNLGPISLESSGGEVFLGGGLMNRSEYSEEVATRIDAQVRQLAEQGHQMARKIVQEQREVVDRLVDLLIEKETIDGEEFRQIVAEYAEVPVKEQLIPQL

SEQ ID NO: 3646 - DNA, 1887 bp, Synechocystis sp.
  CDS (1)..(1887)
atggccatcaaaccccaaccccaatggcaacgtcgccttgctagcgtcctgctgtggggctccaccatttatctgttagtgaacttgcttgccccggcattatttcgctcccaaccgccccaggtgccctacagtcttttcattgaccaggtggaaggggacaaggtagccagcgtttacgtaggacaaaacgagattcgctatcaactcaaaccggaagcagaggatgaggggaaagaaaaagccgccgaggggcaaattttaagaactactcccatttttgatctggagttacccaagcgcttggaggccaagggcattgagtttgcggccgctcccccagcgaaaaattcttggtttggcacccttttgagttgggttatccctccgctgatttttgttggtatttggtcatttttcttgaaccgcaataataacggtgctcccggtggggctttggccttcactaaaagtaaagcgaaagtttatgtggaaggggactccactaaagtcacctttgacgacgtggccggggtggaagaagccaaaacggaattgagcgaagtggtggattttctcaaatttccccaacgttacaccgccctgggagcaaaaattcctaaaggcgtattgctagtcgggcctcccggcacaggcaaaaccctactggctaaagcggcggcgggggaagcaggggtgccatttttcatcatttctggttctgaatttgtggagttatttgtgggcgcaggggccgccagggtgcgggatttatttgagcaagccaaaaaacaagccccttgcattgtcttcattgacgaattggatgccattggtaaatcccgggccagcggcgcttttatgggtggtaacgatgagcgagaacaaaccctcaaccaactgctgacggaaatggatgggttcagtgcggcgggggcaacggtgattgtattggcggccactaaccgcccggaaaccttggatccagctttactgcgtcctggccgtttcgatcgccaggtattggtggaccggccagatttggcgggcaggctgaaaattttagaaatttatgccaagaaaattaaattggacaaagaggtggaattaaaaaatattgccacccgtacccctggttttgccggggctgacttggctaacttagtcaacgaagcggcactgctagccgctaggaataagcaagatagcgttaccgaagccgatttccgcgaggcgatcgaacgggtggtggctggcttggagaagaaaagtcgggtgctgtcggataaggagaaaaaaattgttgcctaccatgaagtgggccacgcactagtgggagcagtgatgcccggcggtggtcaggtggcgaaaatttccattgtgccccgggggatggccgccctgggttataccctacagatgcccacagaagaccgctttttgttaaacgagtctgagctacgggaccaaattgccactctgctggggggaagggccgccgaagaaattgtttttgacagcatcaccactggcgcggccaatgatttacaacgggccacggacttagcagaacagatggtcaccacctatggcatgagtaaggttttgggccccctcgcctacgataaaggtcagcaaaataactttctggggcagggcatgggtaatccccggcgcatggtcagtgacgacactgccaaagaaattgacctagaggtcaaagaaatcgttgagcagggccataaccaagctttggcaattctggagcacaatcgagatttactagaggcgatcgccgaaaaaattcttgaaaaagaggtcattgaaggggaagaactacatcacctattgggccaggttcaagctcctggcaccctagtggtataa

SEQ ID NO: 3647 - protein, 628 aa, Synechocystis sp.
MAIKPQPQWQRRLASVLLWGSTIYLLVNLLAPALFRSQPPQVPYSLFIDQVEGDKVASVYVGQNEIRYQLKPEAEDEGKEKAAEGQILRTTPIFDLELPKRLEAKGIEFAAAPPAKNSWFGTLLSWVIPPLIFVGIWSFFLNRNNNGAPGGALAFTKSKAKVYVEGDSTKVTFDDVAGVEEAKTELSEVVDFLKFPQRYTALGAKIPKGVLLVGPPGTGKTLLAKAAAGEAGVPFFIISGSEFVELFVGAGAARVRDLFEQAKKQAPCIVFIDELDAIGKSRASGAFMGGNDEREQTLNQLLTEMDGFSAAGATVIVLAATNRPETLDPALLRPGRFDRQVLVDRPDLAGRLKILEIYAKKIKLDKEVELKNIATRTPGFAGADLANLVNEAALLAARNKQDSVTEADFREAIERVVAGLEKKSRVLSDKEKKIVAYHEVGHALVGAVMPGGGQVAKISIVPRGMAALGYTLQMPTEDRFLLNESELRDQIATLLGGRAAEEIVFDSITTGAANDLQRATDLAEQMVTTYGMSKVLGPLAYDKGQQNNFLGQGMGNPRRMVSDDTAKEIDLEVKEIVEQGHNQALAILEHNRDLLEAIAEKILEKEVIEGEELHHLLGQVQAPGTLVV

SEQ ID NO: 3648 - DNA, 1884 bp, Arabidopsis thaliana (mouse-ear cress)
  CDS (1)..(1884)
atgtttgaaagccaaccttctttgcatgcgaatgcctctgcgttatcggaatacattaaggcattggttaaagttgataggctcgatcaaagtgagctggttcgaacattgcaaagaggtattgctggtgttgcaagggaggaagagacttttggaggtcttggggcatttagaaacgtaggaaaaccaacaaaagatggtgtccttggaactgctagtgcaccgatccatacgatatccacagaaaggactcactttaaagaacagctatggagtacaatccgaactattggagttggttttttactcatttctggtattggagctcttatcgaggacagaggaattggcaaaggacttggtttgcacgaagaagtgcaacctagtatggattcgagcaccaaattttctgatgtaaagggtgttgatgaagcaaaggctgagctagaggaaattgtgcattatcttcgcgaccccaaaaggttcactcgtctgggaggaaagcttcctaagggtgtgttgcttgtcggtcctcctgggacaggaaaaactatgcttgctagagctattgctggagaagctggagtgcctttcttctcctgcagtggtagtgagtttgaagagatgtttgttggagttggagccagaagagtgagagatctttttagtgctgcaaagaagtgctccccgtgtattatatttatcgatgaaatagatgctattggaggaagtcgcaatcccaaggaccagcaatacatgaagatgacattgaaccagatgctcgttgagttggatgggtttaaacagaatgaaggaattattgtggtcgcagcaacaaatttcccagagtctttggataaggccctggttagacctgggaggtttgatcgtcatattgttgtacctaacccagacgtggaaggtcgacgccagattttggagtctcacatgtcaaaggtacttaaggctgaagatgtcgatttaatgatcatcgctagaggaacgcctggattttctggcgctgatttggctaatctggtcaatgttgctgctttaaaagctgcaatggacggttctaaagatgtgacaatgtctgatcttgagtttgccaaagacagaatcatgatgggaagtgagaggaaatctgcagttatatctgacgagtcaagaaagctaactgctttccatgaaggtggtcatgcccttgttgccattcacaccgaaggtgctcttccagtccacaaagcaaccattgtgcctcgtggtatggctcttggcatggtttctcaactaccagataaagatgagacgagcatttctaggaaacagatgcttgctaggcttgatgtttgtatgggaggccgggtagccgaagagttgatttttggggaaagtgaagtaacttcgggtgcatcttctgatcttgagcaggcaaccaaactcgcgagagcaatggtcacgaaattcggtatgagcaaagaggtgggtcttgtggcacataactacgacgacaatgggaaaagcatgagcaccgagacaaggcttctcattgagagtgaagtgaaacaacttctggaaaaggcttataacaatgcaaaaacaatcctcacggtttacaacaaagagcttcatgcccttgcaaatgctttgcttcagcacgaaactctgtccggtaagcagattaaagaattgcttaccgatctcaactctccactgctgcaaaagcgtcaagaagtggttacaaagcaaagcaacccggttcctccatcaacccctagctcagcatcatcagcagccgcagcagctgccgcagctgcagccgccgccgccgcagcagctgcaacagccgcaaccaaaggtaaagacatggcgccagtatcgtaa

SEQ ID NO: 3649 - protein, 627 aa, Arabidopsis thaliana (mouse-ear cress)
MFESQPSLHANASALSEYIKALVKVDRLDQSELVRTLQRGIAGVAREEETFGGLGAFRNVGKPTKDGVLGTASAPIHTISTERTHFKEQLWSTIRTIGVGFLLISGIGALIEDRGIGKGLGLHEEVQPSMDSSTKFSDVKGVDEAKAELEEIVHYLRDPKRFTRLGGKLPKGVLLVGPPGTGKTMLARAIAGEAGVPFFSCSGSEFEEMFVGVGARRVRDLFSAAKKCSPCIIFIDEIDAIGGSRNPKDQQYMKMTLNQMLVELDGFKQNEGIIVVAATNFPESLDKALVRPGRFDRHIVVPNPDVEGRRQILESHMSKVLKAEDVDLMIIARGTPGFSGADLANLVNVAALKAAMDGSKDVTMSDLEFAKDRIMMGSERKSAVISDESRKLTAFHEGGHALVAIHTEGALPVHKATIVPRGMALGMVSQLPDKDETSISRKQMLARLDVCMGGRVAEELIFGESEVTSGASSDLEQATKLARAMVTKFGMSKEVGLVAHNYDDNGKSMSTETRLLIESEVKQLLEKAYNNAKTILTVYNKELHALANALLQHETLSGKQIKELLTDLNSPLLQKRQEVVTKQSNPVPPSTPSSASSAAAAAAAAAAAAAAAAATAATKGKDMAPVS

SEQ ID NO: 3650 - DNA, 2031 bp, Caenorhabditis elegans
  CDS (1)..(2031)
atgcagtcggcgatcaatttgaacattggcggtttgctccagaatacgggactgctcagaaatagtcgaaatggaatcaataggaaaccgttggatattgaagcaacagcagcatcactttcaagagtatatcatcaagtttggagacaattcagttctgatacttcttcacctgttacaatcaatcaaatgaataatattctcagagatagtacgctttcaaggcggatcgctagaaaatctgaaatttcgctgaattatgatgatgctgtcgttcggataattccggcgagctcttcgttttatatccaacgccgcggatttcgtactcgaaaacagacattcggagtcggaaatgccggaaaaccgacacaagatgaagtgaaatctccgttaacctatttctcagagcttctcgctggaaaaaagcaaaaaacgtcagaaggaggagttgaaaaatggaatcaatatgagtcggatctcaagaaattaccagaaaatcaacagagaacatatactgatggatttgttaagggattattgtcaaatggtgtttcgggagctggaaaagatgggaaaaaatcgaatacgctcacgcggttctacatttttcttatggacgaagcgaaattggaagtggaggagatcgtggattacctgaaagatccagaaaaatactcaagacttggtggtcgattaccgaaaggtgtcctactcgtcggaccccccggaaccggaaaaacgttgctcgcgagagcaatagccggtgaagcacaggttccattcttccatactgctggatcagaatttgatgaagtacttgttggacagggagcccgtcgtgttagggatcttttcgataaggctaaggctcgtgctccatgcatcattttcatcgacgaaatcgattcagttggctcaaaacgtgtttcgaattccatccatccatatgcaaatcaaacgattaatcaacttctcagtgaaatggatggcttcacccgtaacgagggaatcattgtaattgccgcaacaaatcgtgtcgacgacctcgacaaggcccttctccgacccggacgcttcgatgttcgtgtcacagttccaaaacctgatctcgctgggcgtgtggacattttcaacttttatctctcaaaaatcgtgcattccggtggaattgatcctaaagttctggcgaagggatcgacaggattcactggagccgacattgagaatatggtgaatcaggcggcattgaaagcggcgactgataatgctgtggaggttacgatggcctatttagatgaagcaagggatcgagtactgatgggaccggcacgtactggaggaaggattcctgatgaagaagcaaatagaaatacagcttatcatgaagcaggtcatactctggtgtctttgtacacaaaagatgctacacctctgcataaagtaactattattccacgtggacaatctctcggacacactgcaatgcttcctgaaaaggatagttatcagttgactaaagcacaaatgcttgctacgttggatgtgatgatgggcggtcgggtggctgaagagctcatctttggagatgataaggtcaccactggtgctgcggatgatttgagtaaggccactcagttggcggtgcagatggttaaggtttttggaatgagtgataaggtcggactccgtgatttcactgcccaagacaatgaaagtgcactggtaaaagtgtcggatttggcaccacaaacagccgaactaattgatgcagagattaatcgtgtactacaggagagctataaaagggctaaagtcattttggaaaccaagaagaaagagcatcaactgctcgcggaagctcttctcgaatacgaaactctctcagctgacgaggtgaaacgtgttatcagtggacagaaaatcaagcgaccaacaccggcggcagtgaagaaaagtaatgaaacaaaacgaaatcaaccgtcgcttgttcttcatttattcgaggaagaaggccgtggaaagcaataa

SEQ ID NO: 3651 - protein, 676 aa, Caenorhabditis elegans
MQSAINLNIGGLLQNTGLLRNSRNGINRKPLDIEATAASLSRVYHQVWRQFSSDTSSPVTINQMNNILRDSTLSRRIARKSEISLNYDDAVVRIIPASSSFYIQRRGFRTRKQTFGVGNAGKPTQDEVKSPLTYFSELLAGKKQKTSEGGVEKWNQYESDLKKLPENQQRTYTDGFVKGLLSNGVSGAGKDGKKSNTLTRFYIFLMDEAKLEVEEIVDYLKDPEKYSRLGGRLPKGVLLVGPPGTGKTLLARAIAGEAQVPFFHTAGSEFDEVLVGQGARRVRDLFDKAKARAPCIIFIDEIDSVGSKRVSNSIHPYANQTINQLLSEMDGFTRNEGIIVIAATNRVDDLDKALLRPGRFDVRVTVPKPDLAGRVDIFNFYLSKIVHSGGIDPKVLAKGSTGFTGADIENMVNQAALKAATDNAVEVTMAYLDEARDRVLMGPARTGGRIPDEEANRNTAYHEAGHTLVSLYTKDATPLHKVTIIPRGQSLGHTAMLPEKDSYQLTKAQMLATLDVMMGGRVAEELIFGDDKVTTGAADDLSKATQLAVQMVKVFGMSDKVGLRDFTAQDNESALVKVSDLAPQTAELIDAEINRVLQESYKRAKVILETKKKEHQLLAEALLEYETLSADEVKRVISGQKIKRPTPAAVKKSNETKRNQPSLVLHLFEEEGRGKQ

SEQ ID NO: 3652 - DNA, 1806 bp, Heliobacillus mobilis
  CDS (1)..(1806)
atgagccggattgtcaaaaacctggcaatatatatcctcatcgttctcttggccatctccgtattacgggtgaccaagacaccggaacctgcgcaggaacccatctcgtacactcagttttatcagttgctggtgacggatcagattaaagaactgaacgcaatcagcgaacgggaccgcacagagattaccggcgtgaaaaaagacggaaatcgatttaccaccattggacctgttgatatcaaacgcatcaccgatattgtgctggacaaacagattccctttacccaaaagcctgctcctgagccaccttggtggaccggattattctcgacactgctccccatcctggtactcgtcggacttttcttcttcatgatgcagcagacccagggcggcggctcgcgggtgatgcagttcggtaaaagccgggcgaaactgcatacggatgataagaaaaaggtcaccttcgaagacgtggctggtgcggacgaagtgaaggaagagcttcaggaagtcgttgactttctgaaacacccgaaaaaatttgtggagttgggagcgaagatccccaaaggggtattgctctttgggcctcccggaaccgggaaaaccttgctggctcgcgccgtcgctggtgaagccggagttcccttcttcagcatctccggttctgactttgtggaaatgttcgtcggtgttggcgcatcacgggttcgcgatctcttcgaacaagcgaagaagaactccccctgtatcgtctttatcgatgaaatcgacgctgtcggtcgtcaacggggcgccggcttaggcggcggtcacgatgaacgcgaacagaccctaaaccaactgctcgttgaaatggatggcttctccgccaatgagggcatcatcatcatcgcagctaccaaccgcccggacatcctcgatccagcgctgttgcgtcccggtcgatttgaccggcagatcgttgtcgatcgtccggacattcgtggacggaaagagatcctcggagttcacgtcaaaggcaagcccctcgatgaaacgatcgaccttgacgtattggcccgccggacccccggctttacaggtgctgacctggccaacatggtgaatgaagcagcactgctggccgctcgccgaggcacgaaaaaagtaggcatgcacgagatggaagatgccattgaacgggtcatcgccggacctgagaaaaaggcaagggtaatcagcgaattcgagaaaaaactggtcagttatcacgaagctggccacgctctggtaggcggtttgttggaacataccgatccggttcacaaaatctcgatcattcctcgaggttgggccggcggatataccttgttgcttcccgaggaagatcgtcattacatgaccaagtcccacctgctcgatcaggtcaccatgcttttaggcggccgtgtggcagaagcgattgtgctgaaagagatctctaccggcgcctcgaacgacctggaacgggcgaccgatctggtccgtaagatgatcaccgaatacggcatgtctgaagaactcggtcccttgaccttcggacacaagcaagaacaagtcttcttaggtcgggatttggcccgtgatcggaactactccgaagcggtcgccttctctatcgacaaagaagctcgccggatcatcgaagaatgctacggcaaagccaaaaagattctcgaatccaatgcagataaactgcacctcatcgctcagacgctgatggacaaagaaaccatcgaagcatcggagtttacggaactcatgaaaaaggtatcctag

SEQ ID NO: 3653 - protein, 601 aa, Heliobacillus mobilis
MSRIVKNLAIYILIVLLAISVLRVTKTPEPAQEPISYTQFYQLLVTDQIKELNAISERDRTEITGVKKDGNRFTTIGPVDIKRITDIVLDKQIPFTQKPAPEPPWWTGLFSTLLPILVLVGLFFFMMQQTQGGGSRVMQFGKSRAKLHTDDKKKVTFEDVAGADEVKEELQEVVDFLKHPKKFVELGAKIPKGVLLFGPPGTGKTLLARAVAGEAGVPFFSISGSDFVEMFVGVGASRVRDLFEQAKKNSPCIVFIDEIDAVGRQRGAGLGGGHDEREQTLNQLLVEMDGFSANEGIIIIAATNRPDILDPALLRPGRFDRQIVVDRPDIRGRKEILGVHVKGKPLDETIDLDVLARRTPGFTGADLANMVNEAALLAARRGTKKVGMHEMEDAIERVIAGPEKKARVISEFEKKLVSYHEAGHALVGGLLEHTDPVHKISIIPRGWAGGYTLLLPEEDRHYMTKSHLLDQVTMLLGGRVAEAIVLKEISTGASNDLERATDLVRKMITEYGMSEELGPLTFGHKQEQVFLGRDLARDRNYSEAVAFSIDKEARRIIEECYGKAKKILESNADKLHLIAQTLMDKETIEASEFTELMKKVS

SEQ ID NO: 3654 - DNA, 1947 bp, Streptomyces coelicolor
  CDS (1)..(1947)
atgaccaatccgtccccgccgcgcaaggcaccggagccgccctggcggaccgagggcacgcccgacgagccgcccaagccgccgcccggtggccggcggatgcgcggcggctggtggaacctgatcctggccgcgctgatcgtctacctcatcgccaacctcgtgctctccttcttcaacgagggcgacgagccgaccatctcctacacggagttcagcaagcaggtcgacgagggcaacgtcagcaagatctacgccaagggcgacgcgatccaggggcagctgaagaaggcccgggacaatcccgagggcgacgggacgtacaccaagttcacgaccgagcggccgaccttcgcggacgaccagctctgggccgacctgacgaagaacagggtcacggtcaccgccgagcccgtcgtgcagcaccgcagcttcctggccaacctgctgatcgcgctggccccgatgctgatcctggtggtgttgtggatcttcatcgcccggcgcatgcggggcgccctgggcggcggggcgggcgggatgctgggccgcaaggcgccgcccaagccggtcgagctggaggccgggaaaccgcgcaccaccttcgccgacgtcgcggggatcgacgaggtggagggcgagctgagcgatgtcgtcgacttcctgaagaacccggacgcctatcgccgcatgggcgccaagatgccccggggcgtcctgctgaccggcccgcccggcacgggaaagacgctcctcgcgcgcgcggtggccggcgaggcgggtgtgccgttcttctccgcgtcggcgtccgagttcatcgagatgatcgtgggcgtgggtgcctcccgggtgcgggagctgttcgccgaggcccgcaaggtggcgccgtcgatcatcttcatcgacgagatcgacaccatcggccgcgcccgcggcggcggctccggcacgggcggccacgacgagcgcgagcagaccctgaaccagatcctcaccgagatggacggcttctccggctcggagggcgtgatcgtcatcgcggccaccaaccgcgcggacatcctggacgcggccctgacccggcccggccgcttcgaccgggtggtcagcgtctcgccgccggacagaggcggccgggaggcgatcctggagatccacacccgcgagattccgctcgccccggacatcgacctcgcccaggtggcccgtacgacgccgggaatgaccggcgccgagctcgccaacctcgccaacgaggcggcgttgctcgcggtgaagcggaagcaggagcgggtgacgcaggcgaacctctccgaggcgctggagaaggtccagctgggggccgaacgcccgctggtgatgcccgaggaggagcgccggcgcaccgcctaccacgagagtggtcacgcgctgctgggcatgctgcagccgggcgccgatcccgtccgcaagatcacgatcgtgccgcgcggccgggcgctcggggtgacgctgtcgacgccggacgcggacaagtacgcgtacacggaggagtacctgcgcgggcggatcatcggggcgctcggcggcatggcggccgagcacgtcgtgtacgggatgatcacgaccggttcggagagcgacctcgaacaggtcaccaacatcgcccgcgggatggtcgcgcggtggggcatgagcgagcgggtcggcaggctctccgccctgcccggcgacgcccagcaggcgtacggcctcgccgccgcaccccagacgctcgacgcgatcgacggtgagatgcggcgggtcgtggactcctgctacgaggaggccgtgcgcaagctgcgcgaccaccggggacagctggacgcgctcgccgagtcgctgctggcgagcgagacgctggacgaggcggacgcctaccgcatcgccgggatcacccggctgacgaaggacgacccggaggcgtga

SEQ ID NO: 3655 - protein, 648 aa, Streptomyces coelicolor
MTNPSPPRKAPEPPWRTEGTPDEPPKPPPGGRRMRGGWWNLILAALIVYLIANLVLSFFNEGDEPTISYTEFSKQVDEGNVSKIYAKGDAIQGQLKKARDNPEGDGTYTKFTTERPTFADDQLWADLTKNRVTVTAEPVVQHRSFLANLLIALAPMLILVVLWIFIARRMRGALGGGAGGMLGRKAPPKPVELEAGKPRTTFADVAGIDEVEGELSDVVDFLKNPDAYRRMGAKMPRGVLLTGPPGTGKTLLARAVAGEAGVPFFSASASEFIEMIVGVGASRVRELFAEARKVAPSIIFIDEIDTIGRARGGGSGTGGHDEREQTLNQILTEMDGFSGSEGVIVIAATNRADILDAALTRPGRFDRVVSVSPPDRGGREAILEIHTREIPLAPDIDLAQVARTTPGMTGAELANLANEAALLAVKRKQERVTQANLSEALEKVQLGAERPLVMPEEERRRTAYHESGHALLGMLQPGADPVRKITIVPRGRALGVTLSTPDADKYAYTEEYLRGRIIGALGGMAAEHVVYGMITTGSESDLEQVTNIARGMVARWGMSERVGRLSALPGDAQQAYGLAAAPQTLDAIDGEMRRVVDSCYEEAVRKLRDHRGQLDALAESLLASETLDEADAYRIAGITRLTKDDPEA

SEQ ID NO: 3656 - DNA, 2007 bp, Streptomyces coelicolor
  CDS (1)..(2007)
atgtggatcgtgctggccgtccttgccgtggtcgtgttgatgcaggtcgtgggctcgtccggtggctacaagacggtcgacacgggccaggtcgtccaggcgatcaacgacaacagggtcgagtcggccaagctgaccaccggtgacgagcagaccatcaaggtccagctcaaggacggccagaaggtcgagggcagctcgaagatccaggcgagctacatcggcgaccagggcgtgaccctcgccaacacacttcagaacaagtaccaggacaagcagatccccgacggctacacggtgtcgccgtcgaagcagaacccgttcgtcgggatcctgctctccctgctcccgttcgtcctgatcgtggtcgtcttcctgttcctgatgaatcagatgcagggcggcggctcccgggtcatgaacttcgggaagtccaaggcgaagctcatcaccaaggacacccccaagacgacgttctccgacgtcgccgggtccgacgaggccgtagaggaactccacgagatcaaggagttcctccaggagccggccaagttccaggccgtcggcgccaagatccccaagggcgtgctgctgtacggcccgcccggtaccggcaagaccctgctcgcgcgtgccgtcgcgggcgaggcgggcgtgccgttctactcgatctccggttccgacttcgtcgagatgttcgtcggtgtcggtgcctcccgagtgcgtgacctgttcgagcaggccaaggcgaacgccccggccatcgtcttcgtcgacgagatcgacgcggtcggccgccaccgcggcgccggcctcggcggcggtcacgacgagcgcgagcagaccctgaaccagctgctcgtcgagatggacggcttcgacgtcaagggcggcgtgatcctcatcgccgcgacgaaccggcccgacatcctcgacccggcgctgctgcgtcccggccgcttcgaccggcagatcgccgtcgaccgcccggacatgcagggccgtctggagatcctcaaggtccaccagaagggcaagccggtcgcgcccgacgtcgacctgtcggccgtcgcccgccgtacgcccggcatgaccggtgccgatctggccaacgtgctgaacgaggccgccctgctgacggcccgcagcgaccagaagctgatcgacaaccacatgctggacgaggcgatcgaccgcgtggtcgcgggcccgcagaagcggacccggatcatgtcggacaaggagaagaagatcaccgcgtatcacgagggcggtcacgccctggtcgcggcggcctcaccgaactccgacccggtccacaagatcaccattctgtccagaggccgcgccctcggctacacgatggtgctcccggacgaggacaagtactcgaccacgcgcaacgagatgctcgaccagctcgcctacatgctgggcggccgcgcggccgaggagctcgtcttccacgacccgacgacgggcgcggccaacgacatcgagaaggccaccggcctggcccgggcgatggtcacccagtacggcatgaccgagcgcctcggcgccatcaagttcggcggcgacaacagcgagccgttcctcggacgtgagatggcgcaccagcgcgactactcggaagaggtcgccgcgctggtcgacgaggaggtcaagaagctcatcgagacggcgcacaacgaggcctgggagatcctggtcgagaaccgcgacgtcctcgacaacctcgtcctcgcgctgctggagaaggagacgctgggcaaggaggagatcgccgaggtcttctcccagatcgtcaagcgcccggcccggcccgcctggaccggttcctcccgccgtacgccctcgacgcgtccgccggtgctctcccccaaggagctggcactgacgaacggggcgaacggcgcgacggcggcgatctccaccgccaagagcaccacggtggagcccgctccggcaccggagcgagcaccggaggaccgcccggagagctga

SEQ ID NO: 3657 - protein, 668 aa, Streptomyces coelicolor
MWIVLAVLAVVVLMQVVGSSGGYKTVDTGQVVQAINDNRVESAKLTTGDEQTIKVQLKDGQKVEGSSKIQASYIGDQGVTLANTLQNKYQDKQIPDGYTVSPSKQNPFVGILLSLLPFVLIVVVFLFLMNQMQGGGSRVMNFGKSKAKLITKDTPKTTFSDVAGSDEAVEELHEIKEFLQEPAKFQAVGAKIPKGVLLYGPPGTGKTLLARAVAGEAGVPFYSISGSDFVEMFVGVGASRVRDLFEQAKANAPAIVFVDEIDAVGRHRGAGLGGGHDEREQTLNQLLVEMDGFDVKGGVILIAATNRPDILDPALLRPGRFDRQIAVDRPDMQGRLEILKVHQKGKPVAPDVDLSAVARRTPGMTGADLANVLNEAALLTARSDQKLIDNHMLDEAIDRVVAGPQKRTRIMSDKEKKITAYHEGGHALVAAASPNSDPVHKITILSRGRALGYTMVLPDEDKYSTTRNEMLDQLAYMLGGRAAEELVFHDPTTGAANDIEKATGLARAMVTQYGMTERLGAIKFGGDNSEPFLGREMAHQRDYSEEVAALVDEEVKKLIETAHNEAWEILVENRDVLDNLVLALLEKETLGKEEIAEVFSQIVKRPARPAWTGSSRRTPSTRPPVLSPKELALTNGANGATAAISTAKSTTVEPAPAPERAPEDRPES

SEQ ID NO: 3658 - DNA, 2130 bp, Schizosaccharomyces pombe
  CDS (1)..(2130)
atgtcaagggttttgcatcctatatttcttttcggaaagacaagtttcttgtattccggatgctcaaaattcggaggacggttgtttaacaatagcattgttcatggatggctacgaactcggagctatgcattagcttcggggcttcatccccttagaaaacaaaagcttgcgcattttgaagatttggcaaatgctaatatgtcagacccatatatgcaggctaaattgtataaggagctagctgataacttccccgaagcaattataagccgttatgaaacacaaggagttgccaggaactccgcatgtgatcgatattatcaagaggctttgcgaaaaaaatcgtggagcagaagtttatcgaacaacatatccttatctcaatcatcttcttcacctgccacctctagtttcagtgatccaaaagcattttcggcaggcgtaccaaaattcacatccgatacatcttctaccgtttcctcgactccttcacttaatcattctttgcaaaattccatgccaccttcgactcctactccacctccggtatgggcacccacgattgtttcatcagcattgggcacaagtagtaaaactcctgtctatgtggtagttgatgaaccgagatttacaaaatttttcagaatttttaaattcattgctggtcttagtgtggcctcctattttgttcttttaggaatgagtatttttgctgaaacttcaggtcttaacaatataatgaccaacactactgagcaagaacctatggaggagcgagctattaatgttcgcttctctgatgttcaaggtgttgacgaggccaaggaggaactggaggaaatcgttgattttttgcgcgatcctactcattttacacggttgggaggtaaattgcctagaggtgttttgcttacaggaccacccggaactggaaaaacaatgcttgctagggctgttgctggagaggcaaatgttccttttttctttatgagtggcagtcagtttgacgaaatgtatgtaggtgttggtgccaaacgagttcgagaattgttcgctgccgctagaaagcaagctccttccattatatttatcgatgaattggatgctattggacaaaaaagaaatgcacgagacgccgctcatatgagacagactttgaaccaattgctagttgatttagacgggttttcaaaaaatgaagatttagctcatccagtcgtttttattggtgctacgaatttccccgaaagtttggatcctgcgctaactcgtccagggcgtttcgatcgccatatacatgttcctttacccgatgttagagggcgtctggcaatcttactgcagcatacacgacatgtacctctcggcaaggatgtcgatctcagcattattgcaagaggaacctctgggtttgctggggctgatctagctaacctaatcaaccaagctgctgtctatgccagtaaaaacttatcaaccgcagtcagtatgcgtgatttagaatggtcaaaagatcgaatacttatgggtgctgaaagaaaaagtgcattcattactccagaaaataagctaatgactgcctatcacgaaggtggacatgcattagtagctttatttaccaaaaatgctatgagaccctacaaggctactattatgcctagaggtagtagtttgggaatgacgatttccttaccagatatggataaagatagctggacgcgtgaagaatatcttgctatgcttgacgtcaccatgggcggtcgcgccgcagaggagcttttgtacggaaaagataaaataacgtctggtgcacataatgatatagacaaggctactcaagttgcacgccgtatggtaacggagtttggaatgtctgaccgcattggcccggttagtttggaagctgaaatggataatctctcacctgctacgagagcgctagtggaatcagaaatcaagtctttgcttgaggcgtcatatgaacgttcattatctttgcttaaatctcacaagaaagagttagatgcattagctactgctctagtcgattatgagtttttgaccgctgaagagatgaaccgtgtcgttaaaggagaccgtgatttacttcgtaataagctaagttaa

SEQ ID NO: 3659 - protein, 709 aa, Schizosaccharomyces pombe
MSRVLHPIFLFGKTSFLYSGCSKFGGRLFNNSIVHGWLRTRSYALASGLHPLRKQKLAHFEDLANANMSDPYMQAKLYKELADNFPEAIISRYETQGVARNSACDRYYQEALRKKSWSRSLSNNISLSQSSSSPATSSFSDPKAFSAGVPKFTSDTSSTVSSTPSLNHSLQNSMPPSTPTPPPVWAPTIVSSALGTSSKTPVYVVVDEPRFTKFFRIFKFIAGLSVASYFVLLGMSIFAETSGLNNIMTNTTEQEPMEERAINVRFSDVQGVDEAKEELEEIVDFLRDPTHFTRLGGKLPRGVLLTGPPGTGKTMLARAVAGEANVPFFFMSGSQFDEMYVGVGAKRVRELFAAARKQAPSIIFIDELDAIGQKRNARDAAHMRQTLNQLLVDLDGFSKNEDLAHPVVFIGATNFPESLDPALTRPGRFDRHIHVPLPDVRGRLAILLQHTRHVPLGKDVDLSIIARGTSGFAGADLANLINQAAVYASKNLSTAVSMRDLEWSKDRILMGAERKSAFITPENKLMTAYHEGGHALVALFTKNAMRPYKATIMPRGSSLGMTISLPDMDKDSWTREEYLAMLDVTMGGRAAEELLYGKDKITSGAHNDIDKATQVARRMVTEFGMSDRIGPVSLEAEMDNLSPATRALVESEIKSLLEASYERSLSLLKSHKKELDALATALVDYEFLTAEEMNRVVKGDRDLLRNKLS

SEQ ID NO: 3660 - DNA, 2064 bp, Arabidopsis thaliana (mouse-ear cress)
  CDS (1)..(2064)
atgaaaatggcatcatcatcatcagctttgtctttccctctctccaacatcccaacctgtagtaagaagtctcaacaatttcaaaaaccggcttctttatccaaatccagtcacacacataaacctagtctcaaaacccaaattttacaccacaaattcactaagagaaatttactgagtttgacgactgccttgggatttacgtcagcgctaggaactgttcttgctcaccccgcaaaagctgaaccagaagctcccatcgaagccacttccaatagaatgtcgtattcgagattcctgcagcatctgaaagagaatgaagtgaagaaagttgacttgatcgagaacggaacggttgcgatcgtagagatctctaatccagtagtaggaaagatccagagggttagggttaaccttcccggtttaccagtcgatctggtgagggagatgaaggagaagaacgtcgatttcgctgctcatcccatgaatgtgaactggggagctttcttgctcaacttcttggggaatttagggtttcctttgatcttgcttgtctctctgcttttaacatcttcttcaagaagaaaccctgctggacctaacttgccttttggtcttggaagcaaagctaagtttcagatggagcctaacacagggataacgttcgaggatgtagcaggagtagacgaagccaagcaagactttgaagagatcgttgaatttttgaaaaccccagagaaattctcagctttgggggctaaaatcccaaaaggcgtcttgttgaccggaccgccaggaaccggaaagacactcttggccaaggctatagccggagaagccggtgttccttttttttcattgtctggttcggagttcatagagatgtttgttggtgtaggagcatctagagctagagacttgtttaacaaggcaaaggctaattcaccttgtatagtgttcattgatgagattgatgctgttgggagaatgagaggaaccggtataggaggaggaaacgacgaacgtgagcagacgctaaaccagatattaaccgaaatggatgggtttgcggggaataccggagtaattgtgatcgctgcaacgaaccggccagagattctagactctgctttgctccgaccaggaagattcgataggcaggtttctgttggtttaccggatataagaggaagagaggagatattaaaagttcacagcagaagcaagaaactcgacaaagatgtatctttgagcgtaattgccatgagaactccaggttttagtggagctgacttggccaatcttatgaacgaagcagcgattctcgccggaagaagaggaaaagacaagattacccttacagagatcgacgactctatcgatcggatagtcgccggaatggaagggacaaagatgatcgacggtaaaagtaaagcgattgtagcgtaccatgaagtaggacatgcaatttgtgcgactttgacggagggtcatgatccggttcagaaagttacgttggttcctagaggtcaagcacgtggtctcacgtggttcttaccgggagaagatccgacattggtgtctaaacagcaattgttcgctagaatcgtcggaggactcggaggcagagccgccgaagatgtaatttttggagaaccggagataaccaccggcgctgccggtgatctccagcaagtcactgagatagcaagacagatggtgacgatgtttggtatgtcggaaatcggtccatgggcactaaccgacccagcggttaagcaaaacgatgtggttctacggatgctagcgaggaactcaatgtccgagaaacttgcggaggatattgattcttgcgtgaagaaaataatcggtgacgcttacgaggttgcgaaaaagcacgtgaggaataatagagaagctatagacaagcttgttgatgttttgttggagaaagaaaccttaacgggagacgagtttcgagcaattctgtctgagtatactgatcaaccgttaaataccgatggcgatgtaagaattcgaatcaatgacttgattagtgtctaa

SEQ ID NO: 3661 - protein, 687 aa, Arabidopsis thaliana (mouse-ear cress)
MKMASSSSALSFPLSNIPTCSKKSQQFQKPASLSKSSHTHKPSLKTQILHHKFTKRNLLSLTTALGFTSALGTVLAHPAKAEPEAPIEATSNRMSYSRFLQHLKENEVKKVDLIENGTVAIVEISNPVVGKIQRVRVNLPGLPVDLVREMKEKNVDFAAHPMNVNWGAFLLNFLGNLGFPLILLVSLLLTSSSRRNPAGPNLPFGLGSKAKFQMEPNTGITFEDVAGVDEAKQDFEEIVEFLKTPEKFSALGAKIPKGVLLTGPPGTGKTLLAKAIAGEAGVPFFSLSGSEFIEMFVGVGASRARDLFNKAKANSPCIVFIDEIDAVGRMRGTGIGGGNDEREQTLNQILTEMDGFAGNTGVIVIAATNRPEILDSALLRPGRFDRQVSVGLPDIRGREEILKVHSRSKKLDKDVSLSVIAMRTPGFSGADLANLMNEAAILAGRRGKDKITLTEIDDSIDRIVAGMEGTKMIDGKSKAIVAYHEVGHAICATLTEGHDPVQKVTLVPRGQARGLTWFLPGEDPTLVSKQQLFARIVGGLGGRAAEDVIFGEPEITTGAAGDLQQVTEIARQMVTMFGMSEIGPWALTDPAVKQNDVVLRMLARNSMSEKLAEDIDSCVKKIIGDAYEVAKKHVRNNREAIDKLVDVLLEKETLTGDEFRAILSEYTDQPLNTDGDVRIRINDLISV

SEQ ID NO: 3662 - DNA, 2310 bp, Mycobacterium smegmatis
  CDS (1)..(2310): n means a or g or c or t/u
atgaaccggaaaaatgttatccgcaccctgaccgtgatcggggtcgtgctgctgctgggctggtcgttcttctatttcagtgacgaaacgcgcggctacaaacctgtagacaccacggtggcgctcgcccaaattcgcggcgacaacgtcaacagcgcccagatcgacaaccgcgaacaacaggtccggctggacctcaagagcggcaacggcaacaccgagaacagcgacaagatcatcacaaagtacccgaccgggtacggcttgacgctgttcaacgcgctccaggacaaaggcgcaaaaaccaatacggtcgtcaaccagggcagcgtgttcggcaccctgctcatatacatgctgccgctgcttatgctcgtggcgttgttcgtgatgttctcccggatgcagaccggcgggcggatgggcttcggcttcggcaagtcgcgcgccaagcagctgtccaaggacatgcccaagaccaccttcgccgacgtcgcaggcgtcgacgaggccgtcgaggagctgtacgagatcaaggacttcctgcagaacccgtcgcggtatcaggcgctcggcgccaagatccccaagggcgttctgctgtacggcccgcccggaaccggcaagacgctgctggcgcgcgccgtggcgggcgaggccggcgtgccgttcttcacgatctccggctcggacttcgtcgagatgttcgtcggcgtcggcgcctcccgtgtgcgcgacctgttcgagcaggccaagcagaacagcccgtgcatcatcttcgtcgacgagatcgacgccgtcggccgtcagcgcggggcgggcctcggcggtggtcacgacgagcgcgagcagaccctgaaccagctgctggtcgagatggacggcttcggcgaccgccagggtgtcatcctcatcgcggccaccaaccggcccgacatcctcgaccccgcgctgctgcgccccgggcgcttcgaccgccagatcccggtctccaacccggatctcgcgggccgccgcgcggtgctcaaggtgcactcgcagggcaagccgatcgcgcccgacgccgacctggacggcctggccaagcgcaccgtcggcatgtccggcgccgacctggccaacgtgatcaacgaggccgcgctgctcaccgcgcgcgagaacggcacggtcatcacgggtcccgcgctcgaagaggccgtcgaccgtgtggtcggtggcccgcggcgcaagagccgcatcatcagcgagcacgagaagaagatcaccgcctaccacgagggtggccacaccctggccgcgtgggcgatgcccgacatcgaaccgatctacaaggtcacgatcctcgcgcgtgggcgcacgggcggtcacgccgtcgccgtgcccgaggacgacaagggtctgatgacgcggtcggagatgatcgcgcgcctggtgttcgcgatgggcggccgcgcggccgaggaactcgtgttccgcgagcccaccacgggtgcggtgtccgatcgaacaggcaccaagatcgcccgcgccatggtcaccgagtacggcatgagctccaagctgggcgccgtgcggtacggcaccgagcacggcgacccgttcctgggccgcaccatgggcacgcaggccgattacagccacgaggtcgcgcagatcatcgacgacgaggtccgcaagctcatcgaggccgcccacaccgaggcgtgggagatcctcaccgagtaccgcgacgtgctggacatcctggccggtgagctgctggagaaggagacgctgcaccgcgccgagctggaggccatcttcggcgatgtcgagaagcgtccgcgcctgaccatgttcgacgacttcggcggccgtgtgccgtcggacaagccgcccatcaagacgccgggcgagctcgcgatggagcgcggcgagccgtggccgccgccggtgcccgagcccgcgttcaaggccgcgatcgccgcggcaaaccgcgangcgagaagcgcaacggcaccaacggcgcgcccagcaacggcgccccggctccggcagggcccgacgcagccggactacggcgccccggccgggtggcacgccccgggctggccgccgccgcagcagtcgcagcagccgggataccagccgcagcagggctactggtacccgccgccacatccgtcgggatggcagcagccccagccgtacccgtaccagccgtatcctcatcccggacagcaaggcaccagccccgagcacgggcgaccgagcgaacagtccggtcaggacgacgggcacaccggcgaccggtcgaacccgcacggctga

SEQ ID NO: 3663 - protein, 769 aa, Mycobacterium smegmatis
  misc_feature (660)..(660): Xaa can be Asp or Glu
MNRKNVIRTLTVIGVVLLLGWSFFYFSDETRGYKPVDTTVALAQIRGDNVNSAQIDNREQQVRLDLKSGNGNTENSDKIITKYPTGYGLTLFNALQDKGAKTNTVVNQGSVFGTLLIYMLPLLMLVALFVMFSRMQTGGRMGFGFGKSRAKQLSKDMPKTTFADVAGVDEAVEELYEIKDFLQNPSRYQALGAKIPKGVLLYGPPGTGKTLLARAVAGEAGVPFFTISGSDFVEMFVGVGASRVRDLFEQAKQNSPCIIFVDEIDAVGRQRGAGLGGGHDEREQTLNQLLVEMDGFGDRQGVILIAATNRPDILDPALLRPGRFDRQIPVSNPDLAGRRAVLKVHSQGKPIAPDADLDGLAKRTVGMSGADLANVINEAALLTARENGTVITGPALEEAVDRVVGGPRRKSRIISEHEKKITAYHEGGHTLAAWAMPDIEPIYKVTILARGRTGGHAVAVPEDDKGLMTRSEMIARLVFAMGGRAAEELVFREPTTGAVSDRTGTKIARAMVTEYGMSSKLGAVRYGTEHGDPFLGRTMGTQADYSHEVAQIIDDEVRKLIEAAHTEAWEILTEYRDVLDILAGELLEKETLHRAELEAIFGDVEKRPRLTMFDDFGGRVPSDKPPIKTPGELAMERGEPWPPPVPEPAFKAAIAAANRXARSATAPTARPATAPRLRQGPTQPDYGAPAGWHAPGWPPPQQSQQPGYQPQQGYWYPPPHPSGWQQPQPYPYQPYPHPGQQGTSPEHGRPSEQSGQDDGHTGDRSNPHG

SEQ ID NO: 3664 - DNA, 2154 bp, Arabidopsis thaliana (Mouse-ear cress)
  CDS (1)..(2154)
atggcttggaggcgcatcatcaccaaggtttcgagtcatgaaagggaattgagcagtttaagaagcttacttgttagagcttactcctcttttcctagagtgggagttactggagctgtgggtggtggtggagcttctttaccgcgaacgaggtttcaatcgagttatgttggtagctttgctcgcagagtccgtgatagagaagaagttaatgaggttgcacatctgagagaacttattcgaagaaatgatcctgaggctgttatcagaatgtttgaaagccaaccttctttgcatgcgaatgcctctgcgttatcggaatacattaaggcattggttaaagttgataggctcgatcaaagtgagctggttcgaacattgcaaagaggtattgctggtgttgcaagggaggaagagacttttggaggtcttggggcatttagaaacgtaggaaaaccaacaaaagatggtgtccttggaactgctagtgcaccgatccatacgatatccacagaaaggactcactttaaagaacagctatggagtacaatccgaactattggagttggttttttactcatttctggtattggagctcttatcgaggacagaggaattggcaaaggacttggtttgcacgaagaagtgcaacctagtatggattcgagcaccaaattttctgatgtaaagggtgttgatgaagcaaaggctgagctagaggaaattgtgcattatcttcgcgaccccaaaaggttcactcgtctgggaggaaagcttcctaagggtgtgttgcttgtcggtcctcctgggacaggaaaaactatgcttgctagagctattgctggagaagctggagtgcctttcttctcctgcagtggtagtgagtttgaagagatgtttgttggagttggagccagaagagtgagagatctttttagtgctgcaaagaagtgctccccgtgtattatatttatcgatgaaatagatgctattggaggaagtcgcaatcccaaggaccagcaatacatgaagatgacattgaaccagatgctcgttgagttggatgggtttaaacagaatgaaggaattattgtggtcgcagcaacaaatttcccagagtctttggataaggccctggttagacctgggaggtttgatcgtcatattgttgtacctaacccagacgtggaaggtcgacgccagattttggagtctcacatgtcaaaggtacttaaggctgaagatgtcgatttaatgatcatcgctagaggaacgcctggattttctggcgctgatttggctaatctggtcaatgttgctgctttaaaagctgcaatggacggttctaaagatgtgacaatgtctgatcttgagtttgccaaagacagaatcatgatgggaagtgagaggaaatctgcagttatatctgacgagtcaagaaagctaactgctttccatgaaggtggtcatgcccttgttgccattcacaccgaaggtgctcttccagtccacaaagcaaccattgtgcctcgtggtatggctcttggcatggtttctcaactaccagataaagatgagacgagcatttctaggaaacagatgcttgctaggcttgatgtttgtatgggaggccgggtagccgaagagttgatttttggggaaagtgaagtaacttcgggtgcatcttctgatcttgagcaggcaaccaaactcgcgagagcaatggtcacgaaattcggtatgagcaaagaggtgggtcttgtggcacataactacgacgacaatgggaaaagcatgagcaccgagacaaggcttctcattgagagtgaagtgaaacaacttctggaaaaggcttataacaatgcaaaaacaatcctcacggtttacaacaaagagcttcatgcccttgcaaatgctttgcttcagcacgaaactctgtccggtaagcagattaaagaattgcttaccgatctcaactctccactgctgcaaaagcgtcaagaagtggttacaaagcaaagcaacccggttcctccatcaacccctagctcagcatcatcagcagccgcagcagctgccgcagctgcagccgccgccgccgcagcagctgcaacagccgcaaccaaaggtaaagacatggcgccagtatcgtaa

SEQ ID NO: 3665 - protein, 717 aa, Arabidopsis thaliana (Mouse-ear cress)
MAWRRIITKVSSHERELSSLRSLLVRAYSSFPRVGVTGAVGGGGASLPRTRFQSSYVGSFARRVRDREEVNEVAHLRELIRRNDPEAVIRMFESQPSLHANASALSEYIKALVKVDRLDQSELVRTLQRGIAGVAREEETFGGLGAFRNVGKPTKDGVLGTASAPIHTISTERTHFKEQLWSTIRTIGVGFLLISGIGALIEDRGIGKGLGLHEEVQPSMDSSTKFSDVKGVDEAKAELEEIVHYLRDPKRFTRLGGKLPKGVLLVGPPGTGKTMLARAIAGEAGVPFFSCSGSEFEEMFVGVGARRVRDLFSAAKKCSPCIIFIDEIDAIGGSRNPKDQQYMKMTLNQMLVELDGFKQNEGIIVVAATNFPESLDKALVRPGRFDRHIVVPNPDVEGRRQILESHMSKVLKAEDVDLMIIARGTPGFSGADLANLVNVAALKAAMDGSKDVTMSDLEFAKDRIMMGSERKSAVISDESRKLTAFHEGGHALVAIHTEGALPVHKATIVPRGMALGMVSQLPDKDETSISRKQMLARLDVCMGGRVAEELIFGESEVTSGASSDLEQATKLARAMVTKFGMSKEVGLVAHNYDDNGKSMSTETRLLIESEVKQLLEKAYNNAKTILTVYNKELHALANALLQHETLSGKQIKELLTDLNSPLLQKRQEVVTKQSNPVPPSTPSSASSAAAAAAAAAAAAAAAAATAATKGKDMAPVS

SEQ ID NO: 3666 - DNA, 1947 bp, Wolinella succinogenes
  CDS (1)..(1947)
atggcctccaatcaacctaataataataaaaatcaacccgacaagaacccgaacttctttaatcaaaatcctttgatgctttttgccatcttctctatcgtggcgattctcctctttaaatccctctctcctgagggagagggaggcgaggggcttggagggaagctcggtggaagcaccatcaataaaagtgtgaactactttgaactcaagaaattgatcgaaaataaagaggtcaattttgtcgccattggacagggagtgatcaaggcggtttcggataaaaatggcgttaagactatctacaatgtgaaacgcgtcacacccgatgacactttgattcctttattagataagcatgaggtcgagtatagcggctacacggagggcaattggttcactgatatgctctttggctggattctccctgtctttatattcttcgccctatggatgttcctcgcctctaggatgcagaaaaacatgggtggaggaatccttggcatgggcagttccaaaaaacttgtgaactccgagaagcccaaggtgaaatttgatgacatggcgggtaatgatgaagccaaggatgaggtggtggagatcgtggattttctcaaaaatcccgaccgatatctcaaccttggagccaaaattcccaaaggagtgcttttggtgggccctcctggaaccggaaagacgcttttggctaaggccgttgcaggcgaggcgagcgtgcctttcttctcagtgagcggaagcagctttattgagatgtttgtgggcgtaggagccagtcgagtgagagatctttttgagactgccaaaaaagagtctccctctatcatttttattgatgagattgatgcgatcggtaagagccgtgctgcgggtggaatgatcagcgggaatgacgagagagagcagacgcttaatcagcttctggctgaaatggatggttttagctctgattcttcgcctgtgattgtattggctgcgaccaaccgacctgaagtgcttgatcctgcgctgcttcgacctggacgatttgatcgacaggttttggtcgataagcccgattacaatgggcgagtagagattttgaaagtgcatattcagagcatcaaaattgctcgagacgtggatctctatgagattgcgcgcctcacagcggggctagcgggggcggatttggccaatatcgtcaatgaagcggcgctcttggcggggcgagccaacaaaaaagaggttcagcagagtgacttcagagaggcggttgagcgaggaatcgcaggactagagaagaagtcccgccgaatctcccccaaagagaaaagaattgttgcctatcatgagagtggacacgctctcctagcagagattaccaaaggggcgaaacgcgtcagcaaggtctccatcatccctcgcgggctagcagcccttggctatacgctcaatacgcctgaagagaataaatacctcatgcaaaagcatgagctcatcgctgaagtggatgtgcttcttggtggaagggcggctgaagaggtctttattggagagatatctacaggcgcaagcaacgacctagagcgagccacggatatcatcaaggcaatggtgagctattatgggatgacggatgtggttggactgatggtgctagagaagcagaaaaatgtctttcttggcggtggcatgggctcctctagagagtttagcgacaagaccgctcaagaggtggatgcgtttgtgaaggcctctttgagtgagcgctatgaagcggtcaaaaagagcttggagtcctacaaaggggcgatcgagacaacggtcaaggagctttttgacaaagagacgattgatggagtgagggtgagagagatcatccgaagcttcgaagaggaaaacggtatggagacgcgactggttcctctagagagcgagcttgattaa

SEQ ID NO: 3667 - protein, 648 aa, Wolinella succinogenes
MASNQPNNNKNQPDKNPNFFNQNPLMLFAIFSIVAILLFKSLSPEGEGGEGLGGKLGGSTINKSVNYFELKKLIENKEVNFVAIGQGVIKAVSDKNGVKTIYNVKRVTPDDTLIPLLDKHEVEYSGYTEGNWFTDMLFGWILPVFIFFALWMFLASRMQKNMGGGILGMGSSKKLVNSEKPKVKFDDMAGNDEAKDEVVEIVDFLKNPDRYLNLGAKIPKGVLLVGPPGTGKTLLAKAVAGEASVPFFSVSGSSFIEMFVGVGASRVRDLFETAKKESPSIIFIDEIDAIGKSRAAGGMISGNDEREQTLNQLLAEMDGFSSDSSPVIVLAATNRPEVLDPALLRPGRFDRQVLVDKPDYNGRVEILKVHIQSIKIARDVDLYEIARLTAGLAGADLANIVNEAALLAGRANKKEVQQSDFREAVERGIAGLEKKSRRISPKEKRIVAYHESGHALLAEITKGAKRVSKVSIIPRGLAALGYTLNTPEENKYLMQKHELIAEVDVLLGGRAAEEVFIGEISTGASNDLERATDIIKAMVSYYGMTDVVGLMVLEKQKNVFLGGGMGSSREFSDKTAQEVDAFVKASLSERYEAVKKSLESYKGAIETTVKELFDKETIDGVRVREIIRSFEEENGMETRLVPLESELD

SEQ ID NO: 3668 - DNA, 2022 bp, Porphyromonas gingivalis (Bacteroides gingivalis)
  CDS (1)..(2022)
atggcgaacaatgggaataacaagaaacccggaaaaccgatgcgtttcaacccgatatggctctatgcccctgtatttctgatattggccaccctcttctttgtcgatcgggatattacatcccagaaagaactcagctggaatgagtttcagaatatcgccaaaaagcaagcctttacggacatcgtagtcaatcggaaagagaacactctcaaggcgagggtcgatccggccaaggtcgattcggtattcaagaaaggcgacatcccgtcctttcaggacagaggaaatatctcagactactatatcaacacgcaaattccgtcggtagacaaattctccgacttctacgaccaaaaccaaattacggctaaggtgaagtatgaagacagcaagttcagcttcacctctatcctcattacatggggcccactcatccttttgctcgttttctggttttggatgatgcgccgaatgagcggcggtggaggaggaagtggcggtggaggcggcgtcttcaacgtaggcaaatccaaagccaagctctatgacaagaccaatatccacgttacattcagcgatgtagcaggtctgcatgaagccaagcaggaagtggaagagatcgttcacttcctcaagaatccatccaaatacaccgaactgggaggaaagatccctaaaggagctttgctcgtaggacctccgggaacgggtaagactcttctggccaaggcagtagccggagaggcgcacgttcctttcttctctttgtccggttcggacttcgtagagatgtttgtcggcgtaggagcctctcgtgttcgcgaccttttcagacaagccaaggaaaaagccccgtgtatcatcttcatcgacgagatcgacgccgtagggcgtgctcgcggcaagggcaacaacttctccggcaatgatgagcgtgagaatacactcaaccagttgcttaccgaaatggatggcttcggctccaatagcggtgtgatcattctggctgctaccaaccgtgccgatgtgctggatagtgccttgctgcgtgccggacgtttcgaccgccagatctatgtagatcttcccgacctgaatgaccgcaaagagatcttccttgtacaccttaaaccgttgaagaccgacaaaagtgtagatgtggaattcctgtcgcgccaaacacccggcttctccggagcagacattgccaacgtttgcaacgaagcggcgttgatcgccgcgcgaagcaataaaaacttcgtagacaaggaagacttcatgaatgccgtggatcggatcgtaggcggattggagaaaaagaacaaaatcaccacagaggaggagcgtcgcagcatcgccatccacgaagccggacacgctactatcagttggatgctacgctatgccaatcctctcgtcaaagtcactatcgtaccgcgaggcaaggcactcggtgccgcctggtatctgccggaagagcgtcagatcacgacaacggaggctctgcaggatcagctttgcgcccttttgggtggacgtgccgccgaagatctcttcctcggacgtgtatcgaccggtgcagccaatgacttggagcgcgttacgaagttggcttacgccatggttacctattatggcatgagcgacaagctgcccaacatcaactactacgaaatgcaaaacgacggctggaatctgacaaagccgtacagtgatactaccgccgaggttatcgatgccgaagtaaacagaataatatccgaacaatacgagcgcgccaaaagcattctgcgcgagcatgaagccgggcaccacgaactggcagatctgttgctcaagcgcgaagtgattctggctgatgacgtagagcgtatattcggcaaacgcccctgggcttcgcgtacagaagaattgcttgggctgaatgcaccggctaccgccacagaagagacaacagcggatgccgaagcacccattcccgttgagggagaagagaagacggaagaacatcccgaataa

SEQ ID NO: 3669 - protein, 673 aa, Porphyromonas gingivalis (Bacteroides gingivalis)
MANNGNNKKPGKPMRFNPIWLYAPVFLILATLFFVDRDITSQKELSWNEFQNIAKKQAFTDIVVNRKENTLKARVDPAKVDSVFKKGDIPSFQDRGNISDYYINTQIPSVDKFSDFYDQNQITAKVKYEDSKFSFTSILITWGPLILLLVFWFWMMRRMSGGGGGSGGGGGVFNVGKSKAKLYDKTNIHVTFSDVAGLHEAKQEVEEIVHFLKNPSKYTELGGKIPKGALLVGPPGTGKTLLAKAVAGEAHVPFFSLSGSDFVEMFVGVGASRVRDLFRQAKEKAPCIIFIDEIDAVGRARGKGNNFSGNDERENTLNQLLTEMDGFGSNSGVIILAATNRADVLDSALLRAGRFDRQIYVDLPDLNDRKEIFLVHLKPLKTDKSVDVEFLSRQTPGFSGADIANVCNEAALIAARSNKNFVDKEDFMNAVDRIVGGLEKKNKITTEEERRSIAIHEAGHATISWMLRYANPLVKVTIVPRGKALGAAWYLPEERQITTTEALQDQLCALLGGRAAEDLFLGRVSTGAANDLERVTKLAYAMVTYYGMSDKLPNINYYEMQNDGWNLTKPYSDTTAEVIDAEVNRIISEQYERAKSILREHEAGHHELADLLLKREVILADDVERIFGKRPWASRTEELLGLNAPATATEETTADAEAPIPVEGEEKTEEHPE

SEQ ID NO: 3670 - DNA, 1881 bp, Gloeobacter violaceus
  CDS (1)..(1881)
atgggcgaacaatccggcggcgagcggacgaacacccccaaatccggacggggctgggactacattgccgtgctggtgctggtgctggtggcggtgaacctgctggtgttgcccgcggtgttgatgtccgcatccggcccgagcgaaccctacagccggtttatcgaacaactcgagcagggcaaggttgcccgcgcgctggtggcgggcgaccgcatcgaatacgaactggcgggcgagaaaaaacgccaccggacggtgcccctgcccaccgatccgcaactggccgggcttctgcgccgacacaaagtcgaatatacggcggcgccttcccgcggtgctgactggctgccgggggtgcttgggtggttgatgctgcctctggcggtgttgggtttctggtggctattgggccgaggtggagcgcaggggccgcagacactcacgatgagccgttcgcgggcacgcatctacgcccagggttcgaccggagtcgccttcggcgatgtggccggcgtcgacgaggccaagggcgaactgcaggagattgtccagtttctcaagcagcccgagcgctacacccgcatcggtgccaagattcccaagggggtgctgttggtcggtccccccggcaccggcaagacgctgctggccaaggccgtcgccggtgaggcgggggtgccgttcttttcgatttcgggatccgaatttgtcgaactgttcgtcggtgtcggggcggcgcgggtgcgcgacctgttcgagcaggccaagcagcaggctccgtgtatcatcttcatcgacgaactggatgccatcggcaagtcgcgggtcggctcgcccatggccgggggcaacgacgagcgcgagcagaccctcaaccagctattggccgagatggacggctttgcccccaacaccggcgttatcttgctggcggccaccaaccggccggagagcctcgatccggcgttgctcaggccggggcgcttcgatcggcgggtgctggtggatcggcccgataaaaccggccgcctcgccattttgcaggtgcacgcccgaccggtgaaactggcccccgatgtcgatctggtggcgatggcgggtcggaccgccggatttgccggggcggacctggccaatttgatcaacgaggcggcgttgctcgcggcccgccagggcaaagcggccgtgaccatggctgatctggccgaggcgctcgagcgggtggtggcgggcctggagaagcgctcgcgcgtgctgggggacgaggagcgcgccacggtcgcccaccacgagtccggacacgcgatcgtcgcccgcctggtgccctgcaccggccgggtcgagaaaatctcgatcgtcccccgggggatggctgccctcggctacacgctgcaactgccggaggaggatcgcttcttgatgagcgagcccgagatgcgcgggcggctggcggtgctgatgggcggccgggcggcggagcatattatctttggcgaactttcgaccggagccgcggacgacttgcagcaggccaccgatctggcgcagcggatgatcaccctctacggcatgggtgcggacctcggtccggtcgcctttgaaaaaccgcagtcggaatttttgggcgggacggcgctgcggcgccctgtgagcgaagcggtcgccgagcaaatcgatcgcgaagtgcgcgctgtgctcgaaagcgcctacgcccacgccctcggcctgttgcgggccaacgggccgctcttggaggagatggcccggctgttgctggtgcaggaggtgctcgagggcccgcagttgcgcgcgctgttggagcgggcggtgtcgcttgcgcagccgcggacggcactgtgcgcggaaagtgccccttaa

SEQ ID NO: 3671 - protein, 626 aa, Gloeobacter violaceus
MGEQSGGERTNTPKSGRGWDYIAVLVLVLVAVNLLVLPAVLMSASGPSEPYSRFIEQLEQGKVARALVAGDRIEYELAGEKKRHRTVPLPTDPQLAGLLRRHKVEYTAAPSRGADWLPGVLGWLMLPLAVLGFWWLLGRGGAQGPQTLTMSRSRARIYAQGSTGVAFGDVAGVDEAKGELQEIVQFLKQPERYTRIGAKIPKGVLLVGPPGTGKTLLAKAVAGEAGVPFFSISGSEFVELFVGVGAARVRDLFEQAKQQAPCIIFIDELDAIGKSRVGSPMAGGNDEREQTLNQLLAEMDGFAPNTGVILLAATNRPESLDPALLRPGRFDRRVLVDRPDKTGRLAILQVHARPVKLAPDVDLVAMAGRTAGFAGADLANLINEAALLAARQGKAAVTMADLAEALERVVAGLEKRSRVLGDEERATVAHHESGHAIVARLVPCTGRVEKISIVPRGMAALGYTLQLPEEDRFLMSEPEMRGRLAVLMGGRAAEHIIFGELSTGAADDLQQATDLAQRMITLYGMGADLGPVAFEKPQSEFLGGTALRRPVSEAVAEQIDREVRAVLESAYAHALGLLRANGPLLEEMARLLLVQEVLEGPQLRALLERAVSLAQPRTALCAESAP

SEQ ID NO: 3672 - DNA, 1893 bp, Gloeobacter violaceus
  CDS (1)..(1893)
atgaaattttcctggaaaacgctcttactgggtgccatccccctgattttgatcggggttttgctctggcagagtttgccgaacggcgcgacccggggcgattccccgaacatggccaccgccaacctctcctacaccgagtttttgagctacatcaggcagggcaaggtggagaaggtcgatattctcgaaggcggccgtatcgccatcgccatgctccccgacccgagcattcccgataccgctccgcagcgctttcgcgtcaacctgcccacctccgacctcgacgagctctatgggctgatgcgcgacaagaaagtcgattttgcctccctgccgcccaacaacagcggcgcgtttttggggattttgggcaacctctttttcccgattttgctgctgggcggcttgtttttgctgctgcgccgctcgagcaactccaacggccccggccaagcgatgaacttcggcaagtcgaaggcgcgcttccagatggaagcgaaaaccggcgtcaagttcgatgacgtggccggcatcgacgaagccaaagaagaactgcaggaagtcgtccagtttttgaagcgtcccgagcgctttaccgcggtgggcgccaagatccccaagggcgtgttgctcgtcggtcctcccggcaccggcaagaccttgcttgccaaggcgatcgccggtgaggcgggtgtgcccttcttctcgatctcgggttcggagttcgtcgagatgttcgtgggcgtgggggcttcccgcgtgcgcgacctctttaagaaggccaaagagaacgccccctgcatcgtgttcatcgacgaaatcgacgcggtcggccgccagcgcggcgccggtatcggcggcggcaacgacgagcgcgagcagaccctcaaccagctgctcgtcgagatggacggcttcgagggcaacaccggcatcatcatcatcgcggccaccaaccgccccgatgtgctggatgcggcgatcctgcgcccgggccgcttcgaccggcagatcaccgtcgaccgccccgatatggcgggccgcctggagatcctcaaagtccattcgcgcaacaagaagctcgcccccgacatcgacctcgatgtgatcgcccggcgcacccccggttttgccggtgcggatctctccaacctgcttaacgaagcggcgattttggccgcccgccgtcggcagaccgagatcaccatgcgcgagatcgacgatgccaccgaccgggtgatcgcgggccttgagaagccgcccctggtagacagcaagaagaagcggctcatcgcctaccacgaagtcggccacgccctggtgggtacgctgcttgccgagcacgacccggtgcagaaggtgacgattatcccccgcggccgggccggtggtctcacctggttcacgccttctgaagagcagatgctcatcacccgcaaccagcttctggcgcgcatcaccggtgcactgggcggccgggcggctgaggaagtggtcttcggcgaagacgaagtcaccaccggcgcctcctccgacctgcagcaggtctccaacctggcccgccagatggtcacccgcttcggcatgtccgaactcggtctgctctcgctcaccggcggcggcgaggttttcctgggccgcgacctgatgcagcgctccgacatgtccgaggatgtcgcttcgatggtcgacgagcaagtgcgcgccattgtcaaacagtgccaccggcaagccgtcagcatgctcaccgagcaccgcgccctgatggaccgcatcgtcgatgtgctgcttgaaaaagagaccgtcgacggcgaggagttgcgccgcatcgtcagcgaggtggtgccggtgccgatgaaggatcaggctctgccggttctcagctcgtaa

SEQ ID NO: 3673 - protein, 630 aa, Gloeobacter violaceus
MKFSWKTLLLGAIPLILIGVLLWQSLPNGATRGDSPNMATANLSYTEFLSYIRQGKVEKVDILEGGRIAIAMLPDPSIPDTAPQRFRVNLPTSDLDELYGLMRDKKVDFASLPPNNSGAFLGILGNLFFPILLLGGLFLLLRRSSNSNGPGQAMNFGKSKARFQMEAKTGVKFDDVAGIDEAKEELQEVVQFLKRPERFTAVGAKIPKGVLLVGPPGTGKTLLAKAIAGEAGVPFFSISGSEFVEMFVGVGASRVRDLFKKAKENAPCIVFIDEIDAVGRQRGAGIGGGNDEREQTLNQLLVEMDGFEGNTGIIIIAATNRPDVLDAAILRPGRFDRQITVDRPDMAGRLEILKVHSRNKKLAPDIDLDVIARRTPGFAGADLSNLLNEAAILAARRRQTEITMREIDDATDRVIAGLEKPPLVDSKKKRLIAYHEVGHALVGTLLAEHDPVQKVTIIPRGRAGGLTWFTPSEEQMLITRNQLLARITGALGGRAAEEVVFGEDEVTTGASSDLQQVSNLARQMVTRFGMSELGLLSLTGGGEVFLGRDLMQRSDMSEDVASMVDEQVRAIVKQCHRQAVSMLTEHRALMDRIVDVLLEKETVDGEELRRIVSEVVPVPMKDQALPVLSS

SEQ ID NO: 3674 - DNA, 1836 bp, Gloeobacter violaceus
  CDS (1)..(1836)
atgaataagaactggcgcaacgcaggtttgtacgtgctgctggcgattgtcgtgatttcgctggcgagcgcatttttcagcggtcagccccaggcccagccggagctgcgctacagcgaattcatccagcaggtccagcagggtcaggtcaagtcggtgatcgtcaatcaagaaggctccaacgccacggttaccctcaaggacgactccaaggtgcgggtgaatattccgcccggcgaccggcagctctacacgattctggagaagagcggcgtcgaggcgtcggtgaaccagcccagtagcaacaacttctggttctccgctctcagttccttcttcttcccgctgctgctgttgggtgggctcttcttcctgctgcgtcgcgcccaaggcggccccggcaaccaggcgatgaacttcggcaaatccaaggcccgcgtgcagatggagccgcagaccaagaccacctttaccgacgtggcgggggtcgaggaggcgaagctcgaactgcaggaagtcgtcgattttctgaaaaattccgagcgcttcaccgcggtgggcgccaagatccccaagggcgtgctgctcgtcggccctccgggcaccggcaagaccttgcttgccaaggccgtggccggtgaggcgggtgtgcccttcttttcgatctcgggttcggagttcgtcgagatgttcgtgggcgtgggggcttcccgcgtgcgcgacctctttgagcaggccaagaagaacgccccctgcatcgtgttcatcgacgaaatcgacgcggtcggccgccagcgcggtgccggcctgggcggcggcaacgacgagcgcgagcagaccctcaaccagttgctcgtcgagatggacggcttcgagggcaacaccggcgtgatcatcatcgcggccaccaaccgccccgatgtgctggacgcggccctgctgcgcccgggccgcttcgaccggcaggtggtggtcgatcgccccgacttcaagggacgtctggagatcctcaaagtccacgcccgcggcaagaccctgggcaaagacatcgatcttgagaaaattgcccgccgcacacccggtttcaccggcgcggatctggccaacttgctcaacgaagcggcgatcctcgccgcccgccgcagcctcaccgagatctcgatggacgaggtcaacgatgcggtcgaccgcgtcctggccggtcccgagaagaaaaaccgcctgatgaccgagaagcgcaagtggctggtggcttaccacgaagtcggccacgccctggtgggtgctttgttgcctgagtacgacccggtccagaagatctcgatcatcccgcgcggtatggccggtggtctcacctggtttgtgcccgacgaggagcgcgccgattcaggcctctacagccgcgtctacatgaccaacatgatggccgtcgccctgggcggccgcatcgccgaggagattgtctacggcgaagccgaagtgaccaccggtgccaccaacgacctgcagcaggtggcgcagattgcccgcaacatggtgacccgctacggcatgagcgagaagctcggcccggtggccctcggccgccagggcggcagcatgttcctgggccgcgacatcatgaccgagcgcgacttctccgagcacaccgcctcggtgatcgacgaagagatccgcgaactcatcgagaaagcctacgcgctctccaagagcgtcctgctcagccaccgcaacttgatggacagagtcaccgaagtgcttgtccagaaagaaacggtcgatgccgaagagctggaacagctcatcgaaacctcgctgaacaaggctgccgcctag

SEQ ID NO: 3675 - protein, 611 aa, Gloeobacter violaceus
MNKNWRNAGLYVLLAIVVISLASAFFSGQPQAQPELRYSEFIQQVQQGQVKSVIVNQEGSNATVTLKDDSKVRVNIPPGDRQLYTILEKSGVEASVNQPSSNNFWFSALSSFFFPLLLLGGLFFLLRRAQGGPGNQAMNFGKSKARVQMEPQTKTTFTDVAGVEEAKLELQEVVDFLKNSERFTAVGAKIPKGVLLVGPPGTGKTLLAKAVAGEAGVPFFSISGSEFVEMFVGVGASRVRDLFEQAKKNAPCIVFIDEIDAVGRQRGAGLGGGNDEREQTLNQLLVEMDGFEGNTGVIIIAATNRPDVLDAALLRPGRFDRQVVVDRPDFKGRLEILKVHARGKTLGKDIDLEKIARRTPGFTGADLANLLNEAAILAARRSLTEISMDEVNDAVDRVLAGPEKKNRLMTEKRKWLVAYHEVGHALVGALLPEYDPVQKISIIPRGMAGGLTWFVPDEERADSGLYSRVYMTNMMAVALGGRIAEEIVYGEAEVTTGATNDLQQVAQIARNMVTRYGMSEKLGPVALGRQGGSMFLGRDIMTERDFSEHTASVIDEEIRELIEKAYALSKSVLLSHRNLMDRVTEVLVQKETVDAEELEQLIETSLNKAAA

SEQ ID NO: 3676 - DNA, 1920 bp, Chromobacterium violaceum
  CDS (1)..(1920)
atgaacaatatcggcaaaaacatcgccatctgggtgatcatcggcctggtgctgatgaccgtcttcaatcagttcaacaagcgccaggacactcagaaccagctcgagtactcgcagttcgtcagcgatgtcgagtcgggcaaggtgcaatccctgaccatcgaggggcatccgctgcgcggccagtggctgaaaggcaagctgaccgacggcaccgcgttttccaccttcgcgccgtacgatccgcagctggtcgacgacctgatcaagaacaacgtccgcttctccgccaagccggaggaggagccgtcgatgctgatgagcatcttcatcagctggttcccgatgctgctgttgatcggcgtgtgggtgttcttcatgcgccagatgcagggcggcggcaagggcggcgcgttctcgttcggcaagagcaaggcgcgcatgctggaccaggacgccaacaccgtggtgttcgccgacgtggcgggctgcgacgaggccaaggaagaagtgaaggagatcgtcgactacctgcgcgatccttcccgctaccagagcctgggcggccgcatcccgcgcggcatcctgctggcaggcagcccgggcaccggtaaaaccttgctggccaaggccatcgccggcgaggccaaggtgccgttcttcagcatttccggttccgacttcgtcgaaatgttcgtcggcgtgggcgcggcccgcgtgcgcgacatgttcgagcaggcgaagaagaactccccgtgcatcatcttcatcgacgaaatcgacgcggtcggccgccagcgcggcgccggcctcggcggcggcaacgacgagcgcgagcagacgctgaaccagctcttggtggagatggacggcttcgacaccaattccaccgtgatcgtgatcgccgcgaccaaccgtccggacgtgctggacccggcgctgcagcgtccgggccgcttcgaccgccaggtgatcgtgccgctgccggacatccgcggccgcgagcagatcctgaacgtgcacatgcgcaaggtgccgatcgcagccgacgtcaacgccgaggtgatcgcgcgcggcacgccgggcttctccggcgccgacctcgccaacctgatcaacgaggccgccctgttcgctgcccgccgcaacaagcgcctggtggacatggaggacctggagtccgccaaggacaagatcatgatgggcgccgagcgccgcagcatggtgatgaccgaggaggagaagcgcaacaccgcctaccacgagtccggccacgccgtcgtcgccaagctgctgccgaagtccgacccggtgcacaaggtcaccatcatcccgcgcggccgcgcgctgggcgtgaccatgcagctgccggaacaggaccgcttcgcctacgaccgcggctacctgatggaccgtctggccatcctgttcggcggccgcatcgccgaagagctgttcatgaaccagatgaccaccggcgccagcaacgacttcgagcgcgcgacgcagatggcgcgcgacatggtcacccgctacggcatgtccgacaagctgggcccgatggtgtacggcgaaaacgagggcgaggtcttcctcggccgctcgatcaccacccacaagaacctgtcggaagcgacgctgcaacaggtggacgccgaaatccgccgcatcatcgacgagcagtacgcgctggcgcgccgcctgctggaagagaaccgcgacaaggtggaggcgatgaccgccgcgctgctggaatgggaaaccatcgacgccgagcagatcaacgacatcatggatggcaagccgccgcgtccgcccaagccgggctccggtttcgccgccaaggcggaggagaagccggccgaatcggaggagccggcggcgccgtcggccacctcggacccggcccaggaagtctga

SEQ ID NO: 3677 - protein, 639 aa, Chromobacterium violaceum
MNNIGKNIAIWVIIGLVLMTVFNQFNKRQDTQNQLEYSQFVSDVESGKVQSLTIEGHPLRGQWLKGKLTDGTAFSTFAPYDPQLVDDLIKNNVRFSAKPEEEPSMLMSIFISWFPMLLLIGVWVFFMRQMQGGGKGGAFSFGKSKARMLDQDANTVVFADVAGCDEAKEEVKEIVDYLRDPSRYQSLGGRIPRGILLAGSPGTGKTLLAKAIAGEAKVPFFSISGSDFVEMFVGVGAARVRDMFEQAKKNSPCIIFIDEIDAVGRQRGAGLGGGNDEREQTLNQLLVEMDGFDTNSTVIVIAATNRPDVLDPALQRPGRFDRQVIVPLPDIRGREQILNVHMRKVPIAADVNAEVIARGTPGFSGADLANLINEAALFAARRNKRLVDMEDLESAKDKIMMGAERRSMVMTEEEKRNTAYHESGHAVVAKLLPKSDPVHKVTIIPRGRALGVTMQLPEQDRFAYDRGYLMDRLAILFGGRIAEELFMNQMTTGASNDFERATQMARDMVTRYGMSDKLGPMVYGENEGEVFLGRSITTHKNLSEATLQQVDAEIRRIIDEQYALARRLLEENRDKVEAMTAALLEWETIDAEQINDIMDGKPPRPPKPGSGFAAKAEEKPAESEEPAAPSATSDPAQEV

SEQ ID NO: 3678 - DNA, 2022 bp, Fusobacterium nucleatum subsp. vincentii ATCC 49256
  CDS (1)..(2022)
atgaacgataatcagtttgaaaatgaagatttaaaagacaaagatgactctgatggtcatgagaaagaagaaaataaaaaagaagagccaaaacaagaaaatcaacaagaacaagatagccaagataaagataaaaaatcatctgatgaagataaaaaacaagatgataaatacaatccttttaataataaaaataaaagagatgaggaaagaagaagagttgttggtaaagctataaaagttaattttaactttaaaggtttattaatgttaatctttataataactttggcagtggttgttccaaatataatggatgaaaacaaaaatcaacaggtagttgatgtaagttattcagattttataaaaaatattgaaaataaaaagattggtgtagttgaagaaaaagatggttatgtctatggttataaagcaagtgaagtaaaatatcttgaaactaaatcaaatagtataaaatctaaattaggttttgatggtaaaaaagaagttcaaggacttaaagctagacttataacaaatagattaggtgaagatgctaacttaatggctgttattaataataatgctgctattattcaatctgttgatccacctgaaccatcattgttccttagtatagtattagcattcttaccttatatcataatgataggcttcttagtatttatgctaaatagaatgaatagaggtggaagtggtggtggaccacaaatatttaatatgggtaaatcaagagcaaaagagaatggagaaaatatttctaatgtaacttttgctgatgttgctggtattgatgaagctaaacaagaattaaaagaagttgttgatttcttaaaagaacctgaaaaatttagaaaaattggtgcaaaaattcctaagggagttcttcttttagggcaaccaggaacaggtaaaactctacttgcaaaagctgttgctggtgaagcaaaagttccattttttagtatgtctggttctgaatttgtggaaatgtttgttggagttggagcttcaagagttagagatttatttaacaaagcaaggaaaaatgcaccttgtatagtatttattgatgaaatagatgctgttggtagaaaaagaggaactggacaaggtggaggaaatgatgaaagggaacaaactctaaatcaacttcttgttgaaatggatggttttggtactgatgaaactatcattgtcctagctgcaacaaacagggctgatgtacttgataaagctttaagaagacctggaagatttgatagacaagttgttgttgatatgcctgatataaaaggtagagaagaaatattaaaggttcatgccaaaggtaaaaaatttgctcctgatgtagattttaaaattattgctaagaaaacagcaggaatggcaggtgcagatttagctaatattttaaacgaaggtgctatacttgcagcaagagcaggaagaactgaaataactatggcagatttagaagaagcctctgagaaagttcaaatgggacctgagaaaaaatctaaggttgttccagaagatgaaaaaaagatggtagcttatcacgaagttgggcatggtattgtaggctatataattggtggaggagacagagtccataagattactatgataccaagaggacaagctggaggatatacactatcacttccagaagaagagaaaagttttcattcaaaaaaatatatgttagatagaattgctagatactttggtggaagagcagcagaagaaatcatttttggtaaagaaaatattactgatggtgcaggcagtgatatttattatgcaactttaatcgctaaggatattgttacaaaatatggaatgacagaaaagtttggacctgtatttttagaggcaaccgaagaagattatatgcttcaaagaaaatattattctgaacaaactggaaaagaagttgatgatgaaataagaaaaatatcactgaacaatattcaagagctaaaaatatcctattag

SEQ ID NO: 3679 - protein, 673 aa, Fusobacterium nucleatum subsp. vincentii ATCC 49256
MNDNQFENEDLKDKDDSDGHEKEENKKEEPKQENQQEQDSQDKDKKSSDEDKKQDDKYNPFNNKNKRDEERRRVVGKAIKVNFNFKGLLMLIFIITLAVVVPNIMDENKNQQVVDVSYSDFIKNIENKKIGVVEEKDGYVYGYKASEVKYLETKSNSIKSKLGFDGKKEVQGLKARLITNRLGEDANLMAVINNNAAIIQSVDPPEPSLFLSIVLAFLPYIIMIGFLVFMLNRMNRGGSGGGPQIFNMGKSRAKENGENISNVTFADVAGIDEAKQELKEVVDFLKEPEKFRKIGAKIPKGVLLLGQPGTGKTLLAKAVAGEAKVPFFSMSGSEFVEMFVGVGASRVRDLFNKARKNAPCIVFIDEIDAVGRKRGTGQGGGNDEREQTLNQLLVEMDGFGTDETIIVLAATNRADVLDKALRRPGRFDRQVVVDMPDIKGREEILKVHAKGKKFAPDVDFKIIAKKTAGMAGADLANILNEGAILAARAGRTEITMADLEEASEKVQMGPEKKSKVVPEDEKKMVAYHEVGHGIVGYIIGGGDRVHKITMIPRGQAGGYTLSLPEEEKSFHSKKYMLDRIARYFGGRAAEEIIFGKENITDGAGSDIYYATLIAKDIVTKYGMTEKFGPVFLEATEEDYMLQRKYYSEQTGKEVDDEIRKISLNNIQELKISY

SEQ ID NO: 3680 - DNA, 1914 bp, Rickettsia sibirica
  CDS (1)..(1914)
atgaataatcaaggtagaagtattttagcttgggcaacactttttatttttgtaatattactttttaatgtgttccaatctgacagtttacttggtggaagaaataatataactttctcggattttttaacacgagttgatgaaaagaccgttaattcggtaaaaattcagggtagagtaattgaaggcacttcaaatgacggctctacttttaatacttatgctcctgattatcctgatttagtaaatcgtcttactagcaatgacgttaatattgaagtagtgcctcttgaaacaagaatgaatacctttttaggctttttaatttcttggtttcctatgcttttattgataggtgtttgggtttttttcatgcgtcaaatgcatggaggtgggaaagccatggggtttggaaaatctaaagctaggttgctatcagataaaggaccaaaaattacctttaaagatgtagcaggtatcgatgaagcaaaagaagaattaactgaaatagtagattttttaagggatccaagcaagttccaaaagcttggtggtaaaataccgaaaggctgcttacttataggtcctcctggaaccggtaagacacttcttgctaaagcaattgcaggtgaggctaatgttccgttttttagcatatccggctctgattttgttgaaatgtttgtaggtgtcggtgcaagccgtgtgcgtgacatgtttgaacagggtaaacgtaatgctccttgtattatctttatcgatgaaattgatgcggtaggtcgtcatagaggtatcggtatgggtggcggcaatgatgaacgtgagcaaaccttaaaccaaatgttagtcgaaatggatggatttgaagcaaacgagggagttgtgatcattgcagctacaaaccgtcctgacgttcttgatcgtgcattattgcgtcccggtaggtttgatcgtcaaattgccgttgcaaaccctgatataaacggtcgtgagcaaattctaaaagtacatttaaagaaaattaaatataatagtacggtactagcacgaattattgctcgcggtaccccgggcttttccggtgctgaacttgctaacttagttaatgaagctgctcttattgctgcaaggcttggtaagaaagaagtagatatgcacgacatggaagaggcaaaagataaggtgctgatgggagttgcacgtcgctccattgcaatgtcggagaaagaaaaaaggttgactgcatatcatgaaggcggacatgcattagtaggactttattgtcctgcagcatcgcctattcataaggctacgattataccgcgtggtaatgctcttgggatggtgcaaagacttcctgaaactgatgaatattctcagaatcgtgaacagatggaatcatctatagcagtttatatggcaggaagagtagcggaggaaattattttcggtagaaataaagttacctcaggagcttcgtcggatataaaaggtgcaactaatattgccagagcgatggttacaaaagcaggtttaagtgatttaataggaccgatatttcacggttcaagtggtgatgatatgtatggtagacaacctaataatgaaacctcggaagctactgcagagttaattgatgctgaagttaaaagaattattacgcaaggatatgaatttgcaaaagatattttaacaaaacatatagatcaacttcataccttagcaaatgctttaattgaatatgagacattgtccggtcagcaaattaaaaatttacttagtggtagagctttagattcagaagaggagaataaatttccttttaatgattcatctactataaaaatagataaagaaaaatcacctgagaaaacaaaaacaactaaagctaaaaaagaaaattacgcttcctaa

SEQ ID NO: 3681 - protein, 637 aa, Rickettsia sibirica
MNNQGRSILAWATLFIFVILLFNVFQSDSLLGGRNNITFSDFLTRVDEKTVNSVKIQGRVIEGTSNDGSTFNTYAPDYPDLVNRLTSNDVNIEVVPLETRMNTFLGFLISWFPMLLLIGVWVFFMRQMHGGGKAMGFGKSKARLLSDKGPKITFKDVAGIDEAKEELTEIVDFLRDPSKFQKLGGKIPKGCLLIGPPGTGKTLLAKAIAGEANVPFFSISGSDFVEMFVGVGASRVRDMFEQGKRNAPCIIFIDEIDAVGRHRGIGMGGGNDEREQTLNQMLVEMDGFEANEGVVIIAATNRPDVLDRALLRPGRFDRQIAVANPDINGREQILKVHLKKIKYNSTVLARIIARGTPGFSGAELANLVNEAALIAARLGKKEVDMHDMEEAKDKVLMGVARRSIAMSEKEKRLTAYHEGGHALVGLYCPAASPIHKATIIPRGNALGMVQRLPETDEYSQNREQMESSIAVYMAGRVAEEIIFGRNKVTSGASSDIKGATNIARAMVTKAGLSDLIGPIFHGSSGDDMYGRQPNNETSEATAELIDAEVKRIITQGYEFAKDILTKHIDQLHTLANALIEYETLSGQQIKNLLSGRALDSEEENKFPFNDSSTIKIDKEKSPEKTKTTKAKKENYAS

SEQ ID NO: 3682 - DNA, 2604 bp, Plasmodium yoelii yoelii
  CDS (1)..(2604)
atgtataattattacaaaaattttacaagtaaaattatgaattctaatcaatatgcaaatgataattatgcatcttccgaatcagacaaacatggtgaagaagatgagtctgcattactttcaaatggagatagaaaatatatgaataagagcaagagtaaccaatatgatattgataatgggtattatggatattatgataaaatttttggtaaacgaagaaacaaaaaatggaattattttgtcatattttttctaggcgtatgtctaggatttgctatatggccattttttatgacaatcattacatataaattagtttataaagataattataataatcataattttccaacaagtgataattcaaattctttaaaaccttatgtaaatgacaaaaatagaaaaaatgataatcctaataatagaacgcctccaagtgagcaaggtcaaaaaaagccatctccacattttaagcctgtaaaatttgatgaaattgctggaatagatgaatcaaaattagaacttttagaagttgttgattttataaaaaatagagaacgttatcaagaaatgggtgcacgaatgcctaaaggtgtgttattagttggacccccaggatctggtaaaactatgctagctcgggcagtagctacagaagctaatgttccatatatatatacatctgggcctgaatttatagaaatatatgtaggtcaaggagcaaaaagaatcaggcaattattttcacatgctagatcagttgcaccatcaattgtttttattgatgaaattgatgcaataggagggaaacgaagtcctagtgcatctaatggtgcagggcaaaaagaacatgatcaaacattaaatcaattattagttgaaatggatggatttagtaatactgtgcatattatggttataggggcaacgaatagaattgatactttagatagtgctttacttagacctggcagatttgatagaattgtatatgttccattaccagatgtaagcggcaggaaaaaaatactagaaatttacataaaaaaaattaaaagtaatttaaatgcgaatgatattgaaagaatgtcaagattgacacctggtttttcgggcgccgatttagaaaatcttgtaaatgaagcaactatattagctacgagaaataaaaaaagtttagttactataaacgaattatttgaagcaagagataaagtttcgatggggcctgaaagaaaatcgttaaaacaatcagaacatcaaaggagaataactgcttatcatgaagctggacatgcaatagttgcatattttcttcaccccaaaacagatcctatacataaagctactattatttctagaggtaatgctttagggtatgtagagcaaatacctgttgatgataggcataattattttaaaagtcaaatggaagcaaaattagcagtatgtatggggggaagaacagcagaagaaatcgttttcggaaaatctgaaacaagtagtggagcatctagtgacatttcaagagctactgatatagcttataaaatggtaaccgaatggggaatgtcagataaattaggcccattaaattataaaaaaagaatgggtgatggttattcttctatgagattatcagctcaaactatatcagctatagagacggaagttaaaactttagtagaaaagggaaaaagcatatcagaagaaattttaagaagacatagaaaagaattagataatttagcttttgcattattagataaagaaacattaactggagaagaaattaaaaaaatagttgatcctaataattcaagggatcaatcaaatagatatcaactcttaaataaagatcctaagaatgatgatacacaaaatgataacaataatagtggaaagaaacctgtacgaagcgatgggaaaacaaacacatcaaaaaacgaaaaaaatgaaccaaattctcatgaaaatgaatataacgattctaaagaaatagataccaatgacaaagataacagcaataatatgaaatctgatgaagttaatgatcttaataaaatggagaattttgtcgaaaatgaatacattgatactaaagatataacgacactttcgtctgaaaacgaaattggaattttaagtaaacattttaaaaatgaaaacaaaaaacttaagaaaaaatattcgagggatccaaacaccaagaataacaatgtactaaaaatgataaatagtcacaaaccatcatactattctaaaaatgaaaacattgattcagaaaatagtattaataactcattggatgatttttctgacaatattagaaatactagagacagtgaaaacaactatgataataataacactgtaaaaaatactagtgaactttttacaaacgatttttctgaagaaaataataatgataatttaagttctgtaaaaacaaaagatataaattacaataattttcaggaaatagtagatatatcacctattaaaaatgtttctgaaatgaaaaagcaaaaaacgataaattttctttatttttatgatttcaataatctgaaaattataattttatttttgcaaatttaa

SEQ ID NO: 3683 - protein, 867 aa, Plasmodium yoelii yoelii
MYNYYKNFTSKIMNSNQYANDNYASSESDKHGEEDESALLSNGDRKYMNKSKSNQYDIDNGYYGYYDKIFGKRRNKKWNYFVIFFLGVCLGFAIWPFFMTIITYKLVYKDNYNNHNFPTSDNSNSLKPYVNDKNRKNDNPNNRTPPSEQGQKKPSPHFKPVKFDEIAGIDESKLELLEVVDFIKNRERYQEMGARMPKGVLLVGPPGSGKTMLARAVATEANVPYIYTSGPEFIEIYVGQGAKRIRQLFSHARSVAPSIVFIDEIDAIGGKRSPSASNGAGQKEHDQTLNQLLVEMDGFSNTVHIMVIGATNRIDTLDSALLRPGRFDRIVYVPLPDVSGRKKILEIYIKKIKSNLNANDIERMSRLTPGFSGADLENLVNEATILATRNKKSLVTINELFEARDKVSMGPERKSLKQSEHQRRITAYHEAGHAIVAYFLHPKTDPIHKATIISRGNALGYVEQIPVDDRHNYFKSQMEAKLAVCMGGRTAEEIVFGKSETSSGASSDISRATDIAYKMVTEWGMSDKLGPLNYKKRMGDGYSSMRLSAQTISAIETEVKTLVEKGKSISEEILRRHRKELDNLAFALLDKETLTGEEIKKIVDPNNSRDQSNRYQLLNKDPKNDDTQNDNNNSGKKPVRSDGKTNTSKNEKNEPNSHENEYNDSKEIDTNDKDNSNNMKSDEVNDLNKMENFVENEYIDTKDITTLSSENEIGILSKHFKNENKKLKKKYSRDPNTKNNNVLKMINSHKPSYYSKNENIDSENSINNSLDDFSDNIRNTRDSENNYDNNNTVKNTSELFTNDFSEENNNDNLSSVKTKDINYNNFQEIVDISPIKNVSEMKKQKTINFLYFYDFNNLKIIILFLQI

SEQ ID NO: 3684 - DNA, 2112 bp, Plasmodium yoelii yoelii
  CDS (1)..(2112)
atgttactcctacgtaatattgttgtactagatttgaaaaggagtaattttctatatataaaaaatatcccagatgtaaaaaaattattaaatagcaaaagatattttagtgtactaaatacagaaaggttagatagactgaaaagagaaattcgctataagcctaatgataattttttaatattacaattttataaagaagcaaatttacataatccgaacgaagttataaaacattatgaaaatagtagctatattaaaaatgaaagcacaacaaaagaatatttaaaagcattagtttatactaataaactaaaatataccaatcttaataacataaaatatgatagcgaacctaatttttatagaagatctatggaggatggaaataataatataagtgggataaacaatgaacgctcaaatatatatgaaacacataatataaatatagaccctaattatagtaatatatcccgttcagggcatacaaataattataatgataaaaaaaatggcacccactctgaagtgtttagtttacaaattgaccccaaaatacccttaaaggtatccttaataaatacaaataaaaaaggcttatggggggtacttaaatcgactattggattcttaattttagttgcagcagcaagcgtatatttagagggggtatcacaaaatgttcaaaagggtataggtgtgtcaaataaaaaagtagttccagtagagaatgtaaaggtaactttagcagatgtaaaagggtgtgacgaagtaaaacaagaacttcaagaaataattgattatttaaaaaattcagataaatttactaaaattggtgcaaaattgcccaaaggtatattattatcaggtgaacctggaacaggaaaaacattaattgctagagctattgcaggcgaagcaaatgtaccttttatccaagcatctggttcagaatttgaagaaatgtttgttggtgtaggtgcaagaagaataagagagctttttcaaaccgcaaaaaaacatgcaccttgcattgtttttattgatgaaatagatgcagttggttctaaaagaagtaatagagataatagcgcagttagaatgacacttaatcaattattagttgaattagatggttttgaacaaaatgaaggaattgtcgtaatttgtgctaccaattttccacaaagtttagataaagcactagtcagacctggtagattagataaaactattgtagtaccattacctgatatcaatggtagatatgaaattttaaaaatgtatagtaataaaatcatcttatcaaaagatgtcgatttaaatattttagctagaagaactgttggtatgacaggtgccgatttaaaaaatatattaaatatagcagctattaaatgttcagtagaaggtaaaaaatcagttgatatgaattctattgagcaagcttttgatagagttgtagttggattacaaagaaaatcaccattaagtgacgaagaaaaaaacataacagcatatcatgaaggaggacatacattagttaacttttatacagaaggttcagaccctgttcataaagctactattatgccaagaggtatgtctttaggtgttacttggaaaataccagttaccgataaatatagtcaaaaaattaaagacattcaaagtgaaattgatgtactaatgggtggtatggtatcagaagaaattatttttggaaaaaataatgtaacaacagggtgttcaagtgatttacaaagagctacacatattgctcaatcacttgtgatgaactatggagtcggtataaacgaagaaaatatatctatgtttttacaagataaaaaaaatataagtgaagacatgaaaattaaaatagataaatctattcaaagaatattgttagattcttataatagagcaaaaaaggttttaaatcaacatattgatgaattacatagagttgcatctgcattagtcgaattcgaaaccttaacaaatgacgaaattaaattggctatgcaaggaaaaaatgatcaaatacgaaaaaatagagaattaaaacaaaaggaatttaatttgaaagacaacagagtttcataa

SEQ ID NO: 3685 - protein, 703 aa, Plasmodium yoelii yoelii
MLLLRNIVVLDLKRSNFLYIKNIPDVKKLLNSKRYFSVLNTERLDRLKREIRYKPNDNFLILQFYKEANLHNPNEVIKHYENSSYIKNESTTKEYLKALVYTNKLKYTNLNNIKYDSEPNFYRRSMEDGNNNISGINNERSNIYETHNINIDPNYSNISRSGHTNNYNDKKNGTHSEVFSLQIDPKIPLKVSLINTNKKGLWGVLKSTIGFLILVAAASVYLEGVSQNVQKGIGVSNKKVVPVENVKVTLADVKGCDEVKQELQEIIDYLKNSDKFTKIGAKLPKGILLSGEPGTGKTLIARAIAGEANVPFIQASGSEFEEMFVGVGARRIRELFQTAKKHAPCIVFIDEIDAVGSKRSNRDNSAVRMTLNQLLVELDGFEQNEGIVVICATNFPQSLDKALVRPGRLDKTIVVPLPDINGRYEILKMYSNKIILSKDVDLNILARRTVGMTGADLKNILNIAAIKCSVEGKKSVDMNSIEQAFDRVVVGLQRKSPLSDEEKNITAYHEGGHTLVNFYTEGSDPVHKATIMPRGMSLGVTWKIPVTDKYSQKIKDIQSEIDVLMGGMVSEEIIFGKNNVTTGCSSDLQRATHIAQSLVMNYGVGINEENISMFLQDKKNISEDMKIKIDKSIQRILLDSYNRAKKVLNQHIDELHRVASALVEFETLTNDEIKLAMQGKNDQIRKNRELKQKEFNLKDNRVS

SEQ ID NO: 3686 - DNA, 1875 bp, Synechococcus sp. (strain WH8102)
  CDS (1)..(1875)
atgccgatccgacaggacgacaaccgaccgaaccgtcgcttcggaatcatcaacctagtgttgatcggcttcggggtgctgctcctgttgagcagcttcgtgccgaataacgcgatgcaacaggtgcccaaggtgccttattcgctgttcctcgatcaggtgaatgatggcgccgtgaagcgcgcctacatcacccaggaacagatccgctacgagctcagcgacccggatgagggcacgccgccggtgctggcgaccacgccgatcttcgacatggatctgccccagcggttggaaaccaagggtgttgagttcgccgctgccccgccgaagaagcccaacatctttaccaccatcctcagctgggtggtgccgccgctgatcttcatcctggtgctgcagttcttcgcccgccgttcgatgggcggcggcgcccaaggggcgttgagcttcaccaagagcaaggccaaggtttatgtgccggacgaggaatcccgcgtcaccttcgctgatgtggcgggcgtcgatgaggccaagcaggaactcaccgaaatcgttgatttcctcaagacccctgagcgctatgccgaaatcggagcgcggattcccaagggtgtgttgcttgtgggccctcctggcaccggcaagaccttgctgtcgaaggccgttgcgggagaagcgggtgtgccctttttcattatctcaggctcggaattcgttgaattgttcgttggtgccggtgccgcccgtgttcgggatctgttcgaagaagccaaaaagaaagccccttgcatcattttcatcgacgagctcgacgccatcggcaagagccgttccggctctatgggcgtggtcggcggcaacgacgagcgggaacagaccctgaaccagctcctcaccgagatggatggcttcaccgctcaggacaaaccggtgatcgtgttggcagccaccaaccagcctgaagtgctggatgctgccctgctgcgcccgggccgctttgaccgccaggtgttggtggatcgcccggatctgtccggccgtaagaccatcctcgagatttacgccaagaaggtgaaacttgctgatgctgtggatctggacagcgtggcgcaggccaccagcggctttgccggcgccgatctggccaacctggtgaacgaagcggccctgctcgctgcccgtgcttacagaaccaaggttgagcaacaggatctgggagaagccatcgagcgggtggtggcgggccttgagaagaagagccgcgtgctgcaggacgacgagaagaaagtggtggcgtaccacgaagtaggtcacgcgatcgtcggtcacttgatgccaggcggaagcaaggtggccaagatctcgatcgtgccccggggcatgagcgccctcggctacacccttcaattgcctactgaagaacggttcctcaattccaaggaggaactgcaagggcagatcgccacgctgctagggggccgctcggctgaggagatcgtgttcggcaagatcaccacgggtgccgccaatgatctgcagcgggccaccgaccttgctgaacaaatggttggcacctatggcatgagcgacaccctgggacctctggcttacgacaaacaggggggcggacgcttcctcggcggcaacaacaacccccgccgttcggtgagtgatgccaccgctcaggcgatcgacaaggaagtgcgtggcctggtggacagagcacacgacgacgccctggcaatcctgcgtcagaacatggccttgctggagaccattgcccagaagatcctcgaaaaagaggtgatcgagggggatgacctcaagcagatgcttgaggccagcgtgctgcccgagaccgtcagtgcttga

SEQ ID NO: 3687 - protein, 624 aa, Synechococcus sp. (strain WH8102)
MPIRQDDNRPNRRFGIINLVLIGFGVLLLLSSFVPNNAMQQVPKVPYSLFLDQVNDGAVKRAYITQEQIRYELSDPDEGTPPVLATTPIFDMDLPQRLETKGVEFAAAPPKKPNIFTTILSWVVPPLIFILVLQFFARRSMGGGAQGALSFTKSKAKVYVPDEESRVTFADVAGVDEAKQELTEIVDFLKTPERYAEIGARIPKGVLLVGPPGTGKTLLSKAVAGEAGVPFFIISGSEFVELFVGAGAARVRDLFEEAKKKAPCIIFIDELDAIGKSRSGSMGVVGGNDEREQTLNQLLTEMDGFTAQDKPVIVLAATNQPEVLDAALLRPGRFDRQVLVDRPDLSGRKTILEIYAKKVKLADAVDLDSVAQATSGFAGADLANLVNEAALLAARAYRTKVEQQDLGEAIERVVAGLEKKSRVLQDDEKKVVAYHEVGHAIVGHLMPGGSKVAKISIVPRGMSALGYTLQLPTEERFLNSKEELQGQIATLLGGRSAEEIVFGKITTGAANDLQRATDLAEQMVGTYGMSDTLGPLAYDKQGGGRFLGGNNNPRRSVSDATAQAIDKEVRGLVDRAHDDALAILRQNMALLETIAQKILEKEVIEGDDLKQMLEASVLPETVSA

SEQ ID NO: 3688 - DNA, 1914 bp, Synechococcus sp. (strain WH8102)
  CDS (1)..(1914)
atgaatcagcgttggcgccttgtcgccctctggcttctgcccatcggcgtcgtgctcctgatcggttggcaggtgatcagtaacggtggtctgaacagtcagaacgccgggggcaccaccgtggcgcctcgcaatgcagcggtggcccgcatgagctatggccgcttcctcgactacgtggaagccggtcgcgtgacagctgtcgacatctacgacggtggtcgcaacgctgtaatcgaagccgttgatcctgacctggacaaccgtgtccagcgtctgcgggtggatcttcccggtctcgctccggaactggtcaacaccctgaaggaagaagggatcagctttgacatccatcccccacggacagcacctccagcccttggcctgttgggcaatctgctgttcccgttgctgttgatcggatcattgattttcctggcccgtcgcaacagcggcatgccaggaggtcccggtcaggccatgcagttcggtaagagcaaggctcgcttcatgatggaagccgaaaccggtgtgatgttcgatgacgtcgccggtgttgcagaggccaaacaggagctccaggaagtagtgaccttcctgaagcaacccgagcgtttcacgtctgttggtgctcagattccccgcggactcctactagtcggccctcctggaactggcaagacactgctcgccaaggcgatcgctggtgaagctggtgttccgttcttctccctctccggttctgaattcgtcgaaatgttcgtgggtgtcggtgcaagccgagtccgcgacctgttcaagaaagcgaaggaaaacagcccttgcttaatcttcatcgacgaaatcgatgccgttggacgtcaacggggcgctggcattggtggtggtaatgacgagcgtgagcagaccctcaaccagctgctcaccgaaatggatggtttcgagggcaacagcggcatcatcatcattgcggcaaccaaccggccggacgtgttggactcagccctgatgcgtcccggtcgcttcgaccgtcaggtcaccgtcgatgcccctgacatcaagggtcgactctccatccttgaagttcactgccgcaacaaaaagcttgaagaggagctttccctcgaaagcattgcccgacgcacccccggattcacgggtgctgacctggccaacctgatgaatgaggcagccatcctcacggcccgtcgccgcaaagaagccattggcctgagcgagatcgatgatgcggttgaccggatcattgccggcatggaaggccgtccattaaccgatggccgcagcaagcgtttgatcgcgtaccacgaggtgggccatgcgttgatcggcaccctggtgaaggaccatgacccggtccagaaggtcacactgattccccgagggcaagcacagggcctcacctggttctcaccggacgaagagcagacccttgtgacccgatctcagctcaaagcaagaatcatgggagcacttggtggacgagccgctgaagatgtggtgtttggccatgaggaagtgaccaccggtgctggtggtgacattcagcaagttgcgtccatggctcgccagatggtgacccgcctcgggatgagcgacctgggtcctgttgcacttgaaggcggaggtcaggaggtgttccttggccgagacttgatgtcccgcaacgacatctcggaatcaatctcccagcagattgatgctcaagtccgtcaaatggtgaagcgctgctatgaggaaactgtcgacattgtcgcggccaaccgtgaggcaatggatcgtctcgtggaactgttgattgaaaaagaaaccatggatggcggcgagttcgcagctgtggtggctgaattcactcaggttccagccaaggaccgcacggtagtgacgctcgactga

SEQ ID NO: 3689 - protein, 637 aa, Synechococcus sp. (strain WH8102)
MNQRWRLVALWLLPIGVVLLIGWQVISNGGLNSQNAGGTTVAPRNAAVARMSYGRFLDYVEAGRVTAVDIYDGGRNAVIEAVDPDLDNRVQRLRVDLPGLAPELVNTLKEEGISFDIHPPRTAPPALGLLGNLLFPLLLIGSLIFLARRNSGMPGGPGQAMQFGKSKARFMMEAETGVMFDDVAGVAEAKQELQEVVTFLKQPERFTSVGAQIPRGLLLVGPPGTGKTLLAKAIAGEAGVPFFSLSGSEFVEMFVGVGASRVRDLFKKAKENSPCLIFIDEIDAVGRQRGAGIGGGNDEREQTLNQLLTEMDGFEGNSGIIIIAATNRPDVLDSALMRPGRFDRQVTVDAPDIKGRLSILEVHCRNKKLEEELSLESIARRTPGFTGADLANLMNEAAILTARRRKEAIGLSEIDDAVDRIIAGMEGRPLTDGRSKRLIAYHEVGHALIGTLVKDHDPVQKVTLIPRGQAQGLTWFSPDEEQTLVTRSQLKARIMGALGGRAAEDVVFGHEEVTTGAGGDIQQVASMARQMVTRLGMSDLGPVALEGGGQEVFLGRDLMSRNDISESISQQIDAQVRQMVKRCYEETVDIVAANREAMDRLVELLIEKETMDGGEFAAVVAEFTQVPAKDRTVVTLD

SEQ ID NO: 3690 - DNA, 1848 bp, Synechococcus sp. (strain WH8102)
  CDS (1)..(1848)
atgaacaagcgttggcgcaacatcggcctaacagccctactagtcctggcgatcgtggtgatcgccccggccttcctcggcggtggtaacacccagcaggaagcgcggaccatgcgctacagcgatttcgttgaagcggttgaggacaaccagatcagtcgtgtgctgatctccccggatcggggcacagctcaggtggtggaaaacgacggccgccgcgcccaggtgaacctggctcccgataaggagctgctgggtctgctgacgcagcacgacgtggacatcgctgtgcagcccacccgccaggctccggcctggcagcaggccgctggaagcctgatcttcccgctgctgttgctgggtgggttgttcttcctcttccgccgtgcccagggcggtggcggtggcaatcccgccatgcagttcggcaagagcaaggccagggtgcagatggagccctccacccaggtcaccttcaccgatgtcgccggcatcgaaggcgccaagctcgaactcaccgaggtcgtcgactttctcaagaatcctgatcgattcacagccgttggcgccaagatccccaagggtgtgttgctggtgggccccccaggcaccggtaagactctgcttgctaaggccgttgcaggtgaggcgggtgttcccttcttctcaatctccggctctgagttcgtcgagatgttcgtgggcgtcggtgccagccgtgtccgtgacctattcgaacaggccaagaagaatgccccttgcatcgtctttatcgacgaaatcgatgctgtcggccgtcaacgtggagcaggccttggtggcggtaacgatgagcgggaacaaaccctcaaccagctcctgacggagatggatggtttcgagggcaacaccggcatcatcattgtcgcggcgaccaatcgccctgacgtcctggatgctgcgctgatgcgccccggccgtttcgatcgacaggtcaccgttgatcggcccgattacgccggtcgcctccagatcctcaatgtccacgcccgcggtaagacgttgtccaaggacgtcgacctggacaaagtggcgcgccggacccccggctataccggtgctgatctggccaacctgctgaatgaggctgccatcctggctgcccgtcgcgaactgaccgaggtcagcaacgacgagatcagtgatgcgattgagcgcgtcatggccggtcctgagaaaaaggatcgcgtcatgagcgaacgccgcaagcgtttggtggcgtatcacgaggctggtcacgctctggtcggtgctctgatgcccgactacgaccccgtccagaagatctcaatcattccccgcggaaatgccggtggtctcaccttcttcacgcccagcgaggaacgaatggagtccggtttgtactccagggcttatctgcagaaccagatggcggtcgccctgggtggccgtgtcgctgaggagattgtctacggcgaggacgaagtcaccacaggtgcctccaacgacctgcagcaggtggcctcaacggcccgtcagatgatcacccgcttcggcatgagcgataccctcggccccgtggcccttggccgcgcccagggcggaatgttcctcggccgcgatattgcagcagagcgtgacttctctgaagacactgccgccaccatcgaccaggaggtgtctgagctggtggacgtggcttacaagagggccaccaaagtgttggtcgataaccgggctgtgctggatgaactagccgacatgctggtggaacaggagactgttgacgccgaggagttgcaggaactcctgattacccgcgacgtccgcgttgccgaatacatctga

SEQ ID NO: 3691 - protein, 615 aa, Synechococcus sp. (strain WH8102)
MNKRWRNIGLTALLVLAIVVIAPAFLGGGNTQQEARTMRYSDFVEAVEDNQISRVLISPDRGTAQVVENDGRRAQVNLAPDKELLGLLTQHDVDIAVQPTRQAPAWQQAAGSLIFPLLLLGGLFFLFRRAQGGGGGNPAMQFGKSKARVQMEPSTQVTFTDVAGIEGAKLELTEVVDFLKNPDRFTAVGAKIPKGVLLVGPPGTGKTLLAKAVAGEAGVPFFSISGSEFVEMFVGVGASRVRDLFEQAKKNAPCIVFIDEIDAVGRQRGAGLGGGNDEREQTLNQLLTEMDGFEGNTGIIIVAATNRPDVLDAALMRPGRFDRQVTVDRPDYAGRLQILNVHARGKTLSKDVDLDKVARRTPGYTGADLANLLNEAAILAARRELTEVSNDEISDAIERVMAGPEKKDRVMSERRKRLVAYHEAGHALVGALMPDYDPVQKISIIPRGNAGGLTFFTPSEERMESGLYSRAYLQNQMAVALGGRVAEEIVYGEDEVTTGASNDLQQVASTARQMITRFGMSDTLGPVALGRAQGGMFLGRDIAAERDFSEDTAATIDQEVSELVDVAYKRATKVLVDNRAVLDELADMLVEQETVDAEELQELLITRDVRVAEYI

SEQ ID NO: 3692 - DNA, 2187 bp, Rhodopirellula baltica
  CDS (1)..(2187)
atgagcaacgaacccaagtcgaaacgcggtggatcgtccgagaatcgaggcggaggaaatgtttggttggttttgctggcggtcaccggcgcagtcgtgctgagcgcgttcctcttcagtgacaatcgccgacgtttggcctacccgcatttgaaagaattgctggcgatgtcggccgaacgccaagagatgctcgaggcccagcgatctgcttcggaatccggtgacgcagcagcgaacgtggacggcgaatcgcgaccggagtcctcggtaatttcgagatcctcatcagcattgatcagcggtgatccggccaacgacattccggtgccgaagatcgtcgttcccagcagcacgaaggaagacgtttggcacgaattcagtcggctcgacaacatcttcgtcgcggacgatcgaatcaccgggaaggtccacttcaagtcgtttgtgaagaaccatccgagcgagaaggaaccagcagaagaggtcacctttctgacgattcgcggatatcccaacgatctaatcgcggccgagttggaagatttgctcgtgcaatcgggcgtcaaatgggacaacgatcgccccagccgcttcctggaaaatcattggcctgagttgttgatgatcggggtattggtcgcgctcggcatcgtgatgcttaaacgaatgggcggcgttggttcgccgatgtcattctcaagaagccgcggcaaactctacagcgaagacgacttgccgaccacgtttgaggacgtcgctggcatcgaagaggcggtcgatgaagttcgcgaagtcgttgactttctaaaaaacagcgaaaagtatcaaagcctcggcggccgaattcccaaaggtgtcttgttggtcggacctcccggcaccggtaaaacattgctggccaaagcgatcgcgggtgaagccggtgtgccgttcttcagtctgtcaggcagtgactttgtcgaaatgtttgtcggcgtcggtgctgctcgagtacgtgacatgttcacccaagccgtcaatcgcgcaccatgcatcatcttcatcgacgaattggacgcactcggtaaaagccgaagcggcagcgttgttggtggacacgatgaacgcgagcaaacgctaaatgctttgctggtcgaaatggatgggtttgattccaattcgggcgtcattgtcgttgcggctacgaaccgtccagaaaccctggacccagcgttgctgcgtcctgggcgtttcgatcgtcatgtcttggtcgatcgtcccgatgttgcaggacgcgaagaaatcctcgccgttcacgtcaagaacgtcaaactcgatgagacagtggagctgaaaggcatcgcgtcgatcaccagcggtttcgtgggggccgacttggccaacctggtcaacgaagctgctttgctggccgctcggaatggcaaacccgctgtggcgatggaggagttcaacgaggcggttgagcgtgtcaccgctgggttggaaaagaaaaatcgggtgatgaatgaggacgaaaaaattcgcgtggcttatcacgagtccggtcacgcactcgtcgctgcggcacttcccaacacggatccagtgcacaaggtcagtattattcctcgaggtttggcggcgctcggttacatgatgcagcgtcccgagtcagagcgtttcttgatgaccaagagcgaactggagagccaaatgaaagtcatgttggccggaaccttggccgaggaaatgatcttccaagacatcagcaccggagcgcagaacgacttggaacgctgcaccgaaacggcccgcagcatggtgatggactatggaatgagccgtttggggcgaatcaatcttcgccgcaacacgcgcagcccattcctcgctggatccggtggtggcgaataccaaatcatgcacagcgatgagatggccaagatgattgacaaagaagtttcacgcattgtcgatgacatgctggtgcatacgcgagagattttggaacagcgtcgtgacgtcttggaggcggtcacgcagcgattgctggaggtcgaagcgatcgacagtgacgagctgatgcggttgattcaagaaaacagtcgcggcccgtggttggtgcccggaacggtcacggaaaaaccaaaagccaaaattgtgccccgcgaggaaacggaatctcaacagtccaatcgctcgtaa

SEQ ID NO: 3693 - protein, 728 aa, Rhodopirellula baltica
MSNEPKSKRGGSSENRGGGNVWLVLLAVTGAVVLSAFLFSDNRRRLAYPHLKELLAMSAERQEMLEAQRSASESGDAAANVDGESRPESSVISRSSSALISGDPANDIPVPKIVVPSSTKEDVWHEFSRLDNIFVADDRITGKVHFKSFVKNHPSEKEPAEEVTFLTIRGYPNDLIAAELEDLLVQSGVKWDNDRPSRFLENHWPELLMIGVLVALGIVMLKRMGGVGSPMSFSRSRGKLYSEDDLPTTFEDVAGIEEAVDEVREVVDFLKNSEKYQSLGGRIPKGVLLVGPPGTGKTLLAKAIAGEAGVPFFSLSGSDFVEMFVGVGAARVRDMFTQAVNRAPCIIFIDELDALGKSRSGSVVGGHDEREQTLNALLVEMDGFDSNSGVIVVAATNRPETLDPALLRPGRFDRHVLVDRPDVAGREEILAVHVKNVKLDETVELKGIASITSGFVGADLANLVNEAALLAARNGKPAVAMEEFNEAVERVTAGLEKKNRVMNEDEKIRVAYHESGHALVAAALPNTDPVHKVSIIPRGLAALGYMMQRPESERFLMTKSELESQMKVMLAGTLAEEMIFQDISTGAQNDLERCTETARSMVMDYGMSRLGRINLRRNTRSPFLAGSGGGEYQIMHSDEMAKMIDKEVSRIVDDMLVHTREILEQRRDVLEAVTQRLLEVEAIDSDELMRLIQENSRGPWLVPGTVTEKPKAKIVPREETESQQSNRS

SEQ ID NO: 3694 - DNA, 2019 bp, Rhodopirellula baltica
  CDS (1)..(2019)
atgaaaaaggattccgaatcgaactcttcggacaaatccaacaaggaagagctctcgacgggacgccgtggtggcaatccgatgatcatcgctttggtgatcacggtgctagccgcgatgctgtttttcaatcaacccgagccatcctctttgatttcggcgagctttttccgaagtcagcttgaaaaaaacaacatcgagtcggtcgagatcggcgacatcgaagtttcgggaacgttcaagactcgtccacaaatgccggccagcgagtctgcagatggtgatgcgaagccgaaggagttgctgaagcgttttcgattcacgcgtcccgcgggagcggattatgccgtgcagctatccgaagaccttgagaagcggaacatcaaggattggaaattctcgccgccggacaacaccgccgcgatcttgaatttgttgatcctggttggattgccgctggcgatcttcttcttcatcttcatgatgatccgtcgcacccgaaacgacatgatgggcggcgggtttctgtccgggttcagcaagagtccggcgaaacgattcgaagctactgacaaagtcatcacgttcaacgatgttgctggtttggaaggcgttaaggctgaccttcaagagatcgttgatttcctgaagactccagagaagtttcaaaagctcggtggccaagttcccaagggcgttttgctgaatggacctccgggtacaggcaaaacgttgttggctcgtgccgtggcgggtgaggcggacgtgccgttcttcagcgttaacggtagtgaattcattcagatgttcgttggcgttggtgccagccgcgtgcgtgatttgttcaagacggcaaaagaacagtctccgtcgatcatcttcattgacgagattgacgcagtcggtcgtcaacgtggtgctggtttgggtggcggacacgatgaacgcgaacagacgttgaatcagattctcggagagatggacggtttcggtggtgctcaagcggtcatcgtgattgcggcaaccaaccggcccgacgtgctggatccggcgttgcttcgaccaggacgttttgaccgtcacgtgaccgtgggtcgtccgacgatgaagggccgcgaagagattttcaaggttcacgttcgagacgtgccactgggcgacgatgttgatttgcatcgtttggcggcgggaacggttggcctgaccggtgccgacattcgcaacatggtcaacgaggctgctctttgggcggcacgtggcgacaagaaaatcgtcgagatgagcgacttcgactacgctcgcgacaagattttgatgggtgcgaagcgtgaagaggtcttgctggaaagcgagaaagaaaaaaccgcttatcacgaagccggccacacgttgacggcttggcacttggaaggttcgcacattgttcacaaggtgacgatcatccctcgaggtcgcgcgttgggggtgactcagtatgtgccgaatgaggaccgattgagcatgagcaagcgagagcttgagcatcaattgatcgtgttgctcgggggccgcgcggcagagaagatcatctacacggagacttgtgtgggtgcggagaacgatttggaacgagcgaccagtatcgcgcggcgaatggtcacgcattggggcatgagtccgaagattggtccggtcagttacaagacgagcgacgaagatccgtttttgggtcgcgagattcatcagcaacgtcaattcagcgaacacacgcaggaattgatcgatgaagaggtcgcgagaattctgatggaagcggatcagaaggcagagcaactgttgcgagaacatcgcggtcagttggagacgatcacgcgtgagttgctggatcgtgaggagctgaacgaggctgaattgacggaactgattggtccttcgattcacaaacgtttgggtgacgaagagggcaaggtcgagcagatcatggcccccgaaggagccgccgagcggacttcgaacgcttccgcacgacgcgaagactga

SEQ ID NO: 3695 - protein, 672 aa, Rhodopirellula baltica
MKKDSESNSSDKSNKEELSTGRRGGNPMIIALVITVLAAMLFFNQPEPSSLISASFFRSQLEKNNIESVEIGDIEVSGTFKTRPQMPASESADGDAKPKELLKRFRFTRPAGADYAVQLSEDLEKRNIKDWKFSPPDNTAAILNLLILVGLPLAIFFFIFMMIRRTRNDMMGGGFLSGFSKSPAKRFEATDKVITFNDVAGLEGVKADLQEIVDFLKTPEKFQKLGGQVPKGVLLNGPPGTGKTLLARAVAGEADVPFFSVNGSEFIQMFVGVGASRVRDLFKTAKEQSPSIIFIDEIDAVGRQRGAGLGGGHDEREQTLNQILGEMDGFGGAQAVIVIAATNRPDVLDPALLRPGRFDRHVTVGRPTMKGREEIFKVHVRDVPLGDDVDLHRLAAGTVGLTGADIRNMVNEAALWAARGDKKIVEMSDFDYARDKILMGAKREEVLLESEKEKTAYHEAGHTLTAWHLEGSHIVHKVTIIPRGRALGVTQYVPNEDRLSMSKRELEHQLIVLLGGRAAEKIIYTETCVGAENDLERATSIARRMVTHWGMSPKIGPVSYKTSDEDPFLGREIHQQRQFSEHTQELIDEEVARILMEADQKAEQLLREHRGQLETITRELLDREELNEAELTELIGPSIHKRLGDEEGKVEQIMAPEGAAERTSNASARRED

SEQ ID NO: 3696 - DNA, 1914 bp, Prochlorococcus marinus subsp. pastoris (strain CCMP 1378 / MED4)
  CDS (1)..(1914)
atgaatcaaaaacttaaaacaataattttatgggcgcttccaattatcctagttatagctctttcatatcaattcctttcaacaagcaatattgactcattaaaatccaatggcactacaatagcccccaaaaattcagctgtagcaagagttagttatggaagatttttagattatattaattcaggtcgagttacatcagttgatatttttgatggaggtagaaatgctgttatcgaaactatagactcagatctggataataaagtacaaagattaagagtagacttgcctggtcttacacctgaattaataactaatcttaaaaatgaaggaataagttttgacgttcaccctgtgaaaactacaccaccagcattaggtattctcggtaatcttttattccctgcaattctgataggaggcttaattctcttagctaggagatcaaatggtatgcctggcggaccaggtcaagctatgcaatttgggaaatcaaaagctagatttgctatggatgctgatactggagttgtatttgacgatgtcgcaggagtaaatgaggcaaaagaggatctagaagaggtggttacatttttaaaaaaacctgaaaaatttacttctgttggtgctcgtatacccaaaggggttttacttgtaggtcctccaggaactggtaaaacacttttagcaaaagcaattgcaggagaagcaggagttcccttcttctcgcttgcagggtcagaatttgtagaaatgtttgttggtgtaggtgctagtagagttagggatcttttcaaaaaagccaaagagaatagtccatgcttaatatttattgatgaaattgatgcagtaggaaggcaaagaggagctggtatcggtggtggaaatgacgaaagagagcaaactctaaatcaacttttaactgaaatggatggatttgaaggtaatagtgggattattattattgctgcaactaaccgaccggatgttttggattcagccttaatgaggccaggaagattcgacagacaagttacagttgatgctcctgatattaaaggaagattatcgattcttgaagttcactcaaaaaataaaactctacaggaagatttgactttagaaagtattgcaagaaggacacctggttttaccggagctgatttagcaaatctcctaaatgaagccgcaatcttaacagcaagaagaagaaaagagtcaataggaattttagaaattgatgattcagtggatagaatagttgccggaatggaaggttctccactaacagatggaagaagcaaaagattaattgcttatcatgaagttggacatgcaataataggaactttagtaaaagctcatgatcctgttcagaaagtaactgtaattccgagagggcaagcaaaaggtcttacttggtttactcctgatgatgaccaatctcttataagtagggcaaatttgaaggcaagaataatgggtgctcttggaggaagagcggctgaggatgttgttttcggcaaaggggaaataacaactggagctggaggagattttcaacaagtagcttcaatggctagacaaatggttacaagatttggaatgagtgaacttggcccaattgctcttgaaggtggtaatcaagaagtttttgtaggaagagatttaatgactagaagcgaggtttctgactctatctctaaacaaattgatgaaagtgtaagagttatggtaaaagactgttataaagaaacctactcaataataagtaaaaacagagaggcaatggataagattgtagatcttttaattgaaaaagaaacattggatggtgaagagtttgtaaaaattctttctaaatttacacaaattcctgaaaaagaaagaactccgcaaatacttaattaa

SEQ ID NO: 3697 - protein, 637 aa, Prochlorococcus marinus subsp. pastoris (strain CCMP 1378 / MED4)
MNQKLKTIILWALPIILVIALSYQFLSTSNIDSLKSNGTTIAPKNSAVARVSYGRFLDYINSGRVTSVDIFDGGRNAVIETIDSDLDNKVQRLRVDLPGLTPELITNLKNEGISFDVHPVKTTPPALGILGNLLFPAILIGGLILLARRSNGMPGGPGQAMQFGKSKARFAMDADTGVVFDDVAGVNEAKEDLEEVVTFLKKPEKFTSVGARIPKGVLLVGPPGTGKTLLAKAIAGEAGVPFFSLAGSEFVEMFVGVGASRVRDLFKKAKENSPCLIFIDEIDAVGRQRGAGIGGGNDEREQTLNQLLTEMDGFEGNSGIIIIAATNRPDVLDSALMRPGRFDRQVTVDAPDIKGRLSILEVHSKNKTLQEDLTLESIARRTPGFTGADLANLLNEAAILTARRRKESIGILEIDDSVDRIVAGMEGSPLTDGRSKRLIAYHEVGHAIIGTLVKAHDPVQKVTVIPRGQAKGLTWFTPDDDQSLISRANLKARIMGALGGRAAEDVVFGKGEITTGAGGDFQQVASMARQMVTRFGMSELGPIALEGGNQEVFVGRDLMTRSEVSDSISKQIDESVRVMVKDCYKETYSIISKNREAMDKIVDLLIEKETLDGEEFVKILSKFTQIPEKERTPQILN

SEQ ID NO: 3698 - DNA, 1857 bp, Prochlorococcus marinus subsp. pastoris (strain CCMP 1378 / MED4)
  CDS (1)..(1857)
atgaacaaacgttggagaaacgtaggactttacgtcctagcagtaattacagtaatttttataggtacttctgtttttgataaacctaagactgagaatgccaccaaaacccttagatatagtgattttatagaagctgttcaagataaagaagttagcagggttttattatccccagatagtggaactgcacaagttgttgaaaacgatggcagtagatctgaagttaatctggctccagataaagatttattaaaaatcctaaccgagaatgatgtagatatagccgttacacccacaaaattagctaatccttggcagcaagctataagtagtttaattttcccggttttattaataggaggtttattcttcctatttagaagatcacaaaatggaagtggaggtggtggtggtaatccagcaatgagttttggaaaaagcaaagctagacttcaaatggaaccttctactcaagtaactttttcagatgttgctggtgttgaaggagcaaaattagagttaacagaggttgtagactttcttaaaagccctgacagatttactgccgttggtgcaaaaattcctaaaggtgttcttctagttggaccaccaggaacaggaaagactcttttagcaaaagcagttgcgggcgaagcaggtgtgccttttttctcaatctctggatctgaatttgttgaaatgtttgttggagttggtgcaagtagggttagagatttatttgaacaagctaaaaaaaatgccccatgtattgtttttattgatgaaatagatgctgttggaagacaaagaggtgctggcatgggaggtggaaatgacgagagagaacaaactttaaaccaacttttaactgaaatggatggttttgagggtaattctggaattattattgttgcggcaactaacagaccggatgttttggactcagcattaatgagaccaggtagatttgatagacaagtaactgtagataggcctgattacgctggaagattacaaattttaaatgttcatgccaaggataaaactctttcaaaagatgtagaccttgataaggttgcgagaagaactcctgggtttacaggtgctgatttagctaatcttttaaacgaggcagctatccttgcagcaagaaaagatctcgatactgtaagtaatgatgaagtaggagatgctatcgagagagtaatggcaggaccagaaaagaaagatagagttataagtgacagaaagaaagaacttgttgcctatcacgaggcaggtcatgctttagttggcgcttgcatgcctgattatgacgctgtagcaaaagtttccataattcctaggggccaagcaggaggtctaaccttctttactcctagtgaagaaaggatggagtccggcctttactcacgttcttacctacaaaatcaaatggctgtagccctaggtggaagagttgctgaggaaatagtatatggagaagaggaagttactacaggagcttctaacgatttacagcaagttgctaatgttgcaagacaaatgattactaaatttggaatgagcgataaaataggtccagtagctttgggtcaatcacaagggggaatgttcctcgggagagacatgagcgcgacaagagacttctctgaagatacagctgcaacaattgatgtagaagtttcagaacttgttgatacagcatacaaaagagcgacaaaagtcctttcagataacagaagtgttcttgatgaaatggcttcaatgctaattgagcgagaaacaattgatactgaagatatccaagatttacttaatcgatctgaggttaaagttgctaactatatctaa

SEQ ID NO: 3699 - protein, 618 aa, Prochlorococcus marinus subsp. pastoris (strain CCMP 1378 / MED4)
MNKRWRNVGLYVLAVITVIFIGTSVFDKPKTENATKTLRYSDFIEAVQDKEVSRVLLSPDSGTAQVVENDGSRSEVNLAPDKDLLKILTENDVDIAVTPTKLANPWQQAISSLIFPVLLIGGLFFLFRRSQNGSGGGGGNPAMSFGKSKARLQMEPSTQVTFSDVAGVEGAKLELTEVVDFLKSPDRFTAVGAKIPKGVLLVGPPGTGKTLLAKAVAGEAGVPFFSISGSEFVEMFVGVGASRVRDLFEQAKKNAPCIVFIDEIDAVGRQRGAGMGGGNDEREQTLNQLLTEMDGFEGNSGIIIVAATNRPDVLDSALMRPGRFDRQVTVDRPDYAGRLQILNVHAKDKTLSKDVDLDKVARRTPGFTGADLANLLNEAAILAARKDLDTVSNDEVGDAIERVMAGPEKKDRVISDRKKELVAYHEAGHALVGACMPDYDAVAKVSIIPRGQAGGLTFFTPSEERMESGLYSRSYLQNQMAVALGGRVAEEIVYGEEEVTTGASNDLQQVANVARQMITKFGMSDKIGPVALGQSQGGMFLGRDMSATRDFSEDTAATIDVEVSELVDTAYKRATKVLSDNRSVLDEMASMLIERETIDTEDIQDLLNRSEVKVANYI

SEQ ID NO: 3700 - DNA, 1848 bp, Prochlorococcus marinus (strain MIT 9313)
  CDS (1)..(1848)
atggataaacgctggcgcaacgtaggtctttacgttcttctggtggtcgtggtggtcgtggtcggcacggctttcctcggcaaacctggcacgactgagcgggagactctccgctacagcgaatttgttgaagcagttcaggacaaccaagtgagtcgtgtgctgatctccccagaccaggccaccgctcaggttgttgaaagcgatggtcgacgcgcggatgtcaaccttgcccctgacaaggatcttttgaagttgttaacggatcacaacgttgatattgctgttcaaccaacccgtcaggcaggtgcttggcaacaggccgccggaagtttgatattccccttgttgttattgggtggacttttctttctcttccgacgttctcagagtggtggtggcggtggtaaccctgcaatgaattttggtaagagcaaggccagagttcagatggagccgtccactcaggtcacctttagtgatgttgctgggatcgaaggggcaaagcttgaacttaccgaagtcgttgactttctcaaaaaccctgatcgatttactgctgttggcgcaaaaatccccaaaggtgttctgcttgtaggccctcccggaactggcaaaacactgcttgccaaagcagtggcaggtgaagcggcggtgccgttcttctcgatctcaggctcggagtttgtcgagatgtttgttggggttggtgccagtcgagtccgggacctatttgagcaggccaagaagaacgctccttgcattgttttcattgatgaaattgatgcggtgggtcggcagcggggggctggtcttggcggtggcaacgatgaacgtgagcagactcttaaccagctgcttactgaaatggatggtttcgagggcaataccggcatcatcatcgtggcggccaccaatcgacctgatgtgctcgattcggcgttgatgcgccctggtcgatttgatcgacaggttgttgtggagcgccctgattacaccggtcgcctgcagatcctcaatgtgcatgcccgcgataagaccctgtccaaggatgttgatctcgacaaagtggcgcggcgcacaccaggcttcacaggggctgatcttgccaacttgctcaatgaagcggcaatcctcgcagcgcgtcgtgagctcacagaagtaagcaatgacgagattagcgacgccattgagcgagtcatggttggtcctgagaagaaggatcgtgtcatgagtgaacggcgtaagcgactggttgcttatcacgagtctggtcatgccctggtaggagcccttatgcctgattacgactcggtgcagaagatttccatcattcctcgtggtcaggcgggtggtctcacattcttcaccccgagtgaggagaggatggagtcgggtctctattccagggcttatttgcagaaccagatggctgtcgctcttggtggtcgagttgcagaagaaatcgtctatggcgaagacgaggtgaccactggtgcatcaaatgaccttcaacaggtcgctcaggtcgccaggcagatggtgacgaggtttgggatgagcgacaagcttggtccggtcgccttggggcggtctcagggagggatgtttcttggccgtgacatcgcctctgaacgcgatttctctgaagacactgcagcaattatcgatgcagaggtctctgatcttgttgatgtggcttacaagcgtgccaccaaagtattgatcgagaatcgttctgttcttgatgagttggctgatttgcttgtagagaaggaaacacttgatgctcaggatttgcaggaattgttgatccgacgcgatgtaagggttgccgaatacgtctga

SEQ ID NO: 3701 - protein, 615 aa, Prochlorococcus marinus (strain MIT 9313)
MDKRWRNVGLYVLLVVVVVVVGTAFLGKPGTTERETLRYSEFVEAVQDNQVSRVLISPDQATAQVVESDGRRADVNLAPDKDLLKLLTDHNVDIAVQPTRQAGAWQQAAGSLIFPLLLLGGLFFLFRRSQSGGGGGNPAMNFGKSKARVQMEPSTQVTFSDVAGIEGAKLELTEVVDFLKNPDRFTAVGAKIPKGVLLVGPPGTGKTLLAKAVAGEAAVPFFSISGSEFVEMFVGVGASRVRDLFEQAKKNAPCIVFIDEIDAVGRQRGAGLGGGNDEREQTLNQLLTEMDGFEGNTGIIIVAATNRPDVLDSALMRPGRFDRQVVVERPDYTGRLQILNVHARDKTLSKDVDLDKVARRTPGFTGADLANLLNEAAILAARRELTEVSNDEISDAIERVMVGPEKKDRVMSERRKRLVAYHESGHALVGALMPDYDSVQKISIIPRGQAGGLTFFTPSEERMESGLYSRAYLQNQMAVALGGRVAEEIVYGEDEVTTGASNDLQQVAQVARQMVTRFGMSDKLGPVALGRSQGGMFLGRDIASERDFSEDTAAIIDAEVSDLVDVAYKRATKVLIENRSVLDELADLLVEKETLDAQDLQELLIRRDVRVAEYV

SEQ ID NO: 3702 - DNA, 1917 bp, Prochlorococcus marinus (strain MIT 9313)
  CDS (1)..(1917)
atgaatcaacgctggcgtctcattgctctctggctgctgcccatcggtgttgccttgctgctcgcctggcaaattttaggaaatggcaagctcacaggagagcagccgagtaacgcaactctcgctccgcgcaatgctgcggttactcggatgagctacggccgcttcctcgactacgtggaagcaggaagagtcaccgccgtggatatttacgacggtggacggaatgcagtagtggaagccgtagatcccgaactcgacaatcgcgtacaacggctaagagttgatctccccggtcttgctccggagctaatcaacacactcaagagcgaggggatcagtttcgatattcatcctgctcgtaccactcctccggcgcttggcttattaggcaatctcctcttcccgctactcctcattggcggcctaattctgctggcccgtcgatcaagctcaatgcctggaggcccagggcaggcaatgcagttcggcaagacaaaagcccgcttcgcaatggaagctgaaactggagtcaaattcgatgatgttgcaggagtaactgaagcaaaacaggatcttgaggaagtggtgacattcctgaagaaacccgaacgcttcacctcggtaggtgctcaaattccaagaggtgttctgctggtagggcctccaggcactggcaaaacactgcttgccaaagcaattgcaggagaagcaggtgttcccttcttctcactttctggttcggaatttgtagagatgttcgttggtgtcggcgcgagtcgagtccgagatttattcaaacgggcaaaagagaacacaccctgcctaatcttcattgatgaaattgatgccgtaggccgacaacgtggtgccggaataggtggcgggaatgatgaacgagaacaaactctaaaccaactgttaacagaaatggacggatttgaaggtaatagcggaatcatcattattgcagcaacaaaccgtccagatgtactggattctgcgctgatgcgaccagggcgttttgacaggcaagtcagtgtggatgcaccagacatcaaaggacgacttgcaattcttgaagtgcacgcacgtgacaagaaacttgaagaagatctttccttaaagaatgtagcccgaaggacacctggatttaccggggcagaccttgccaacctacttaatgaggcggcaatcctaacagctagacgtcgtaaaaaggctatcagccttgatgaaattgacgatgccgttgacagaatcatcgcaggcatggaagggcacccactcactgatggacgtagcaagagattgatcgcttaccacgaagttggacatgcgctaataggaacattagttaaagatcatgaccctgtccaaaaagtgactctgataccacgaggtcaggctcaggggcttacatggtttgctccagatgaagagcaaatgctggtgactcgagcccaactcaaggctcgaatcatgggagcactaggaggcagagcagcagaagatgttgtttttggcgatgcagagatcacaacaggtgcaggtggagacatccagcaggtagcatccatggcacgccaaatggtgacacgttttggcatgagcgatttagggccagtctctctggagagcggaaatcaagaagtatttattggacgagacctgatgactcgaagcgagatttcagatgcaatatcccgccaaatagatgaggcagttcgggaaatggttaagcattgctatagcgaaactgtaaaaatcgtcaagcaacatcgggaagctatggatagactcgttgaaatcctcatcgaaaaggaaaccatagacggagaagaatttgtttcagtagtagcagagtttacatctgttccagagaaggaaagaagcatacctatcctccagagctaa

SEQ ID NO: 3703 - protein, 638 aa, Prochlorococcus marinus (strain MIT 9313)
MNQRWRLIALWLLPIGVALLLAWQILGNGKLTGEQPSNATLAPRNAAVTRMSYGRFLDYVEAGRVTAVDIYDGGRNAVVEAVDPELDNRVQRLRVDLPGLAPELINTLKSEGISFDIHPARTTPPALGLLGNLLFPLLLIGGLILLARRSSSMPGGPGQAMQFGKTKARFAMEAETGVKFDDVAGVTEAKQDLEEVVTFLKKPERFTSVGAQIPRGVLLVGPPGTGKTLLAKAIAGEAGVPFFSLSGSEFVEMFVGVGASRVRDLFKRAKENTPCLIFIDEIDAVGRQRGAGIGGGNDEREQTLNQLLTEMDGFEGNSGIIIIAATNRPDVLDSALMRPGRFDRQVSVDAPDIKGRLAILEVHARDKKLEEDLSLKNVARRTPGFTGADLANLLNEAAILTARRRKKAISLDEIDDAVDRIIAGMEGHPLTDGRSKRLIAYHEVGHALIGTLVKDHDPVQKVTLIPRGQAQGLTWFAPDEEQMLVTRAQLKARIMGALGGRAAEDVVFGDAEITTGAGGDIQQVASMARQMVTRFGMSDLGPVSLESGNQEVFIGRDLMTRSEISDAISRQIDEAVREMVKHCYSETVKIVKQHREAMDRLVEILIEKETIDGEEFVSVVAEFTSVPEKERSIPILQS

SEQ ID NO: 3704 - DNA, 1878 bp, Prochlorococcus marinus (strain MIT 9313)
  CDS (1)..(1878)
atggcgatccgtgaggatgacaacaaaccgaatcgacgctttggcatcgtcaatttggtgttgatcggtttcggtgttttgttgcttttcagcagcttcttacccaatcctgctgcacaggtgccgagggttccctactcactatttattgatcaggttgacgatggcgccgtgaagcgggcattcatcactcaggatcagatccgatacgaactggccaatcctgaggagggagcaccttcgttgctggccactacgccgatcttcgatatggatctgccccaacgcttggaaagcaaaggagttgaatttgcagcagcgccgccgaagaagcccaatgttttctccaccatcctcagctgggttgttcctccgctgatcttcatccttgtactgcagttttttgccaggcgttcgatgggtggtggtggtgcccagggcgctcttagtttcacgaagagcaaggcgaaggtttatgtgcctgatgaagagtcacgagtcacctttgccgatgtggcaggggtcgatgaggcaaaagatgagctcactgagatcgttgattttctcaaaacacctgagcgatatacagacataggtgctcgcattcctaagggtgtactgcttgtgggcccgcctggtacaggtaagaccttgctctccaaggctgttgctggggaggcagaggttccctttttcattatttctggttcggagtttgtcgagctgtttgtcggcgctggtgcagcccgcgtgagggacctgtttgagcaggctaagaagaaggctccttgcatcatcttcatcgatgaacttgatgccatcggtaaaagtcgttctggctcaatgggtgtcgtaggaggcaacgatgagcgtgagcagacccttaaccagctgctcacggaaatggatggcttctcgtccacagataagcccgtcatcgtgttggctgcgaccaaccagcccgaggtccttgatgcggccctcctacggccaggtcgttttgaccgacaggtccttgtggatcgcccagacctctctggccgcaagacgattctcgagatctatgtcaagaaagtgaaattggccgaaggggttgatttagaccgcatcgctcaggcgaccagcggttttgctggagctgatctagccaatgtggtgaacgaagcggccctgttggcagctcgtggtaaacgaaaagaggtagagctgcaggatctcaacgaagcgatcgagcgtgttgtggcaggccttgagaagaagagccgagtgctccaggatgatgagaagaaggttgtggcctatcacgaggtggggcacgccatcgttggacacctgatgcctggaggtagcaaggtcgccaagatttcaatcgtgccaagggggatgagtgctcttggttacaccttgcagttacctactgaggagcgtttcctcaattccaagcaagaccttgaaggtcagattgccaccttgttaggagggcgttcagcagaagaaatcgtgtttggcaagatcaccactggtgctgctaatgatctacagcgcgctactgaccttgctgagcagatggtggggacttatgggatgagcgatattttgggccctctggcttatgacaagcaaggtggggggcgtttccttggtggtaacaacaatccacgccgagttgtgagtgatgccactgctcaggccatcgataaggaggtgaggagtttggtggatcaaggtcatgagagtgccctttcgattcttcggcataacctcgccttgctggagaccatcgcccagaagatcctcgaaaaggaagtgatcgaaggcgatgagctgatacagatgcttgattccagttctctccctagaggtgttgttattgcctga

SEQ ID NO: 3705 - protein, 625 aa, Prochlorococcus marinus (strain MIT 9313)
MAIREDDNKPNRRFGIVNLVLIGFGVLLLFSSFLPNPAAQVPRVPYSLFIDQVDDGAVKRAFITQDQIRYELANPEEGAPSLLATTPIFDMDLPQRLESKGVEFAAAPPKKPNVFSTILSWVVPPLIFILVLQFFARRSMGGGGAQGALSFTKSKAKVYVPDEESRVTFADVAGVDEAKDELTEIVDFLKTPERYTDIGARIPKGVLLVGPPGTGKTLLSKAVAGEAEVPFFIISGSEFVELFVGAGAARVRDLFEQAKKKAPCIIFIDELDAIGKSRSGSMGVVGGNDEREQTLNQLLTEMDGFSSTDKPVIVLAATNQPEVLDAALLRPGRFDRQVLVDRPDLSGRKTILEIYVKKVKLAEGVDLDRIAQATSGFAGADLANVVNEAALLAARGKRKEVELQDLNEAIERVVAGLEKKSRVLQDDEKKVVAYHEVGHAIVGHLMPGGSKVAKISIVPRGMSALGYTLQLPTEERFLNSKQDLEGQIATLLGGRSAEEIVFGKITTGAANDLQRATDLAEQMVGTYGMSDILGPLAYDKQGGGRFLGGNNNPRRVVSDATAQAIDKEVRSLVDQGHESALSILRHNLALLETIAQKILEKEVIEGDELIQMLDSSSLPRGVVIA

SEQ ID NO: 3706 - DNA, 1917 bp, Prochlorococcus marinus
  CDS (1)..(1917)
atgaatccaaggtttagatcatttgctttatggttaatccctatggttattcttctgcttgttacatggcagatatttaccagcaacagtactaatgccacaaaaacacctgatgcggcaataggttctagaaatactgcagtgtcaaggatgagctatggaagatttatagactatgtagatgctggaagagttactgctgttgatatttttgaaggtggaagaaatgcgatagtcgaagcagtagatcctgacttagataacagggttcaaaaaataagagttgacctacctggattgacacctaatctaatcagcaaattaaaagaagaaggaattagttttgatgttcatcctgctaaaactgctcctcctggaattggtttgataggaaacctaatatttccagtaattttaattgggggactgatatttcttgcaagaagatcaaactctatgcctggcggacctggccaagcaatgcaattcggtaagacaaaggcaagatttgcaatggaagccgaaactggagttcaatttgatgatgttgcaggagtagaagaagctaaagaagatctagaagaagtagttacttttttaaaacaaccagaaagatttacttcagtaggagcaaagattccaagaggtgtacttttagttggccctcccgggacaggtaaaactcttttagcaaaagcaatagctggggaagctggcgtgcctttcttttccttatctggatcagaatttgttgaaatgtttgttggagttggtgcaagtagagttagagatttatttaaaagagcaaaagaaaatagtccttgtttaatttttattgacgaaattgatgctgtaggaagacaacgaggcgcaggtattggaggtggtaatgatgaaagggaacagactttaaatcaacttctaacagaaatggatggatttgaaggtaatagcggaatcataatcattgcagcaacgaataggccagacgttttagattcagccttactaagaccaggaaggtttgaccgacaagtatcagtagatgcaccagatataaaaggcaggttatcgatattgacagtacattctaaaaataaaaaactagaagaagtactttctttagaaagtatcgcaagaaggactccaggttttactggggctgatttagctaacttgctaaatgaagctgcaatacttacagcaagaagaagaaaagaagctattggaatatcagagatagatgatgctgttgatagaattattgccggaatggaaggacagcctttaacagatggaagaagcaaaagattaattgcatatcatgaaatagggcatgcaattgtgggaacacttttaaaagatcatgacccagttcaaaaggtaactcttattccaagagggcaagccaaaggtttgacctggttctcaccagatgaagatcaaatgttagtaagtagagctcagttaaaagcaagaattatgggagctctaggaggtagagcagctgaggacgttgtatttggtagaggagaagttaccactggagccggaggggacatacagcaagttgcatcaatggctaggcaaatggttacaaggtttggaatgagtaggcttggcccaatatcactagaaaatgattctcaagaagtatttattggaagggatctaatgacaagatcagatatatcagactcaatttctcaacaaattgatgagcaagtaaggaagatagtaaaagaatgttatcaagctacattcgaattagtaaaatctaacagacaatctatagacaaattagttgaattactaatagaaaaagaaactattaatggtgaggaattagttaatgtactttctcaatatacagaaatacctgagaaagttagaactgaaaatatattaaacaaatag

SEQ ID NO: 3707 - protein, 638 aa, Prochlorococcus marinus
MNPRFRSFALWLIPMVILLLVTWQIFTSNSTNATKTPDAAIGSRNTAVSRMSYGRFIDYVDAGRVTAVDIFEGGRNAIVEAVDPDLDNRVQKIRVDLPGLTPNLISKLKEEGISFDVHPAKTAPPGIGLIGNLIFPVILIGGLIFLARRSNSMPGGPGQAMQFGKTKARFAMEAETGVQFDDVAGVEEAKEDLEEVVTFLKQPERFTSVGAKIPRGVLLVGPPGTGKTLLAKAIAGEAGVPFFSLSGSEFVEMFVGVGASRVRDLFKRAKENSPCLIFIDEIDAVGRQRGAGIGGGNDEREQTLNQLLTEMDGFEGNSGIIIIAATNRPDVLDSALLRPGRFDRQVSVDAPDIKGRLSILTVHSKNKKLEEVLSLESIARRTPGFTGADLANLLNEAAILTARRRKEAIGISEIDDAVDRIIAGMEGQPLTDGRSKRLIAYHEIGHAIVGTLLKDHDPVQKVTLIPRGQAKGLTWFSPDEDQMLVSRAQLKARIMGALGGRAAEDVVFGRGEVTTGAGGDIQQVASMARQMVTRFGMSRLGPISLENDSQEVFIGRDLMTRSDISDSISQQIDEQVRKIVKECYQATFELVKSNRQSIDKLVELLIEKETINGEELVNVLSQYTEIPEKVRTENILNK

SEQ ID NO: 3708 - DNA, 1800 bp, Prochlorococcus marinus
  CDS (1)..(1800)
atgatctttgtcgggactgctttcttagacaggccaaatcaatctcaagaatctagaacccttcgatatagcgattttattgaggcagtacaagagaatcaaattagtagggttttcatttctcctgacaatggaactgctcagatcattgagaatgatggaggcagagcagcagtaaatcttgccccagataatgatctcttacaactacttactgaacatgatgtcgatattgctgttcaacctcctcaacaagcaaacccttggcagcaagctgcaagcagtttactttttccaatacttctattaggaggcctattctttctattcagacgttctcaaggcggagctggaggaggtaatccagccatgagttttggcaaaagcaaagctcgccttcaaatggaaccgtctacacaagtcacttttggagatgtcgcgggtatagaaggagcaaaattagaattagctgaagtagttgatttcttaaagaatcctgatcgatttactgcagtaggagccaagatcccaaaaggggtactgcttgtagggcctccaggaacaggaaaaacacttttagctaaggccgttgcaggggaagcagcagtcccatttttctcaatatcaggctctgagtttgtagaaatgtttgtaggtgttggtgccagcagagtacgagatctttttgaacaagcaaaaaagaatgcaccttgcatagtatttattgatgaaattgatgctgttggacgtcaaagaggggctggcttaggaggaggcaatgatgaaagagagcaaactcttaatcaattgcttactgaaatggatggatttgaaggcaatacaggaattattattgttgctgctacaaatagaccagatgttcttgactctgctttattaagacctggacgttttgatagacaagttgttgttgatagacctgactatttagggcgtctccaaatattaaaagtacacgctagagaaaaaactttgtcgaaagatgttgaccttgatcaagtcgcaagaaggactccagggttcacaggggcagatttagctaatttactcaatgaatctgcaattcttgctgctagaagagaacatacagaagtaagcaatatagagattagcgatgctattgaacgagtaatggcaggccctgagaaaaaagatcgcgtaatgagtaacaaacgaaaagaacttgttgcttatcacgaagctggtcacgctctcgttggagcagttatgccagactatgatccagtccaaaaaatatcgattatcccaagaggtcaagccggtggattaacttttttcactcccagcgaagaaagaatggaatctggtctctattcaaggtcatatcttcaaaaccaaatggcagtagctctaggtgggcgagtagcagaagaaattgtctatggagaagatgaagtcaccactggagcttctaatgacttaaaacaagttgcacaagtagcaagacaaatggtcacacgttttggcatgagtgaaaaattaggcccggtggcattaggtcgttctcaaggaggaatgtttctcggtcgtgatattgcagcagaaagagatttctcagaagatacggctgcaaccattgacgatgaagtatcttgtttagttgatattgcctataaacgagcaaccaaagcactgcttgaaaatagatctgtacttgatgaactcgctgaaatgcttattgaaaaagaaactgttgattctgaagatctacaacaactgttaatcaagcgtaaagtgaaagttgctgaatatatttaa

SEQ ID NO: 3709 - protein, 599 aa, Prochlorococcus marinus
MIFVGTAFLDRPNQSQESRTLRYSDFIEAVQENQISRVFISPDNGTAQIIENDGGRAAVNLAPDNDLLQLLTEHDVDIAVQPPQQANPWQQAASSLLFPILLLGGLFFLFRRSQGGAGGGNPAMSFGKSKARLQMEPSTQVTFGDVAGIEGAKLELAEVVDFLKNPDRFTAVGAKIPKGVLLVGPPGTGKTLLAKAVAGEAAVPFFSISGSEFVEMFVGVGASRVRDLFEQAKKNAPCIVFIDEIDAVGRQRGAGLGGGNDEREQTLNQLLTEMDGFEGNTGIIIVAATNRPDVLDSALLRPGRFDRQVVVDRPDYLGRLQILKVHAREKTLSKDVDLDQVARRTPGFTGADLANLLNESAILAARREHTEVSNIEISDAIERVMAGPEKKDRVMSNKRKELVAYHEAGHALVGAVMPDYDPVQKISIIPRGQAGGLTFFTPSEERMESGLYSRSYLQNQMAVALGGRVAEEIVYGEDEVTTGASNDLKQVAQVARQMVTRFGMSEKLGPVALGRSQGGMFLGRDIAAERDFSEDTAATIDDEVSCLVDIAYKRATKALLENRSVLDELAEMLIEKETVDSEDLQQLLIKRKVKVAEYI

SEQ ID NO: 3710 - DNA, 1836 bp, Helicobacter hepaticus
  CDS (1)..(1836)
atgattctcacattgcttttgtttaaactattttcgcctaatggtgattcatttacagagcgtttgatgggaggaaatattacaaaagaaattagctataatgagttaaaagagcttattactcggggtgagattagtgcagtaaatattgggcagacttacattaaagcatattctgctaatacttcgccacggattctttatactacaaaaaaagtagcagatttgggactcgtgcctttgcttgatgagaagaaaattgaatatagtggctttagcgaaggtagctttttgggagatttagtaaatatgctcttgcctatttttattattctagcgctttggatgtttcttactgcgcgtatgcaaaaaagtatgggtggaggcatttttggtatgggcaatgctaaaaagcttgtgaatgcggaaaagcctaatgtgcgttttgatgatatggctggaaatgcggaagcaaaggaagaagtcgtagaaattgtagattttcttaaatatcccgaacgttatgctgcagtgggagccaagattccacgtggtgtgcttttagttggacctccgggcacaggtaagacacttcttgcaaaagctgtggcgggtgaagcgaatgtgccatttttctctatgagtggaagtagttttattgaaatgtttgtagggcttggggctagtcgtgtaagagatttgtttgaaatggcaaagaaagatgcaccaagtattatttttattgatgaaattgatgccattggaaaaagtcgtgcagctggaagtatggttggtggcaatgatgagcgtgagcaaacgctcaatcaattacttgcagaaatggacggatttggttcagaatccgcgcctgtaattgtgcttgctgcaacaaatcgtcctgaaatccttgaccctgcattattgcgcccagggcgatttgatagacaggtgcttgtagataagcctgattttgaagggcgacttgaaattctcaaagtgcatattaaaaatgtttctttagcgcgtgatgtggatttacacgagattgcaaaatttacggctggacttgcgggggcagatttggcaaatatcattaatgaagccgctttgcttgctgggagagaaaatcaaaaagaagtaagtcaaaaacatcttaaagaagcagtagagcgaggaattgcaggattagaaaaaaaatcaagacgcatttctcctaaagagaaaaaaattgttgcttaccacgagagtgggcacgctgtggtatccgagatgacaaaaggtgctgatagagtgaataaagtatcaattattccaagaggtatggcagctcttggttatacgcttcatacacctgaagagaatcgctatttgatgcaaaaacacgagcttatggcagaggttgatgtacttttaggtgggcgtgcagccgaagaagtatttttaggcgagatttctacaggcgcaagcaatgatttagaacgtgctacagggattctcaaatcaatgattagttattatggtatgacagatgtaagcggacttatggtgcttgaaaaacaacgcaatactttccttggtggcggcaatgcgcaaagggaatttagcgaacagcttgctcaagaaattgatacccatattaaaaatacacttgatgaacgatatagttatgtaaagcagcttttgagtgattatcaagatgcgattgaaaatatggtcaaagagctttttgaaaaggaagtcattgatggtgcgcgtgtgagggagattattcaagaatacgaaatgcaaaataatatagaatctcgtcttattccgcttgaagaagaggaagtctaa

SEQ ID NO: 3711 - protein, 611 aa, Helicobacter hepaticus
MILTLLLFKLFSPNGDSFTERLMGGNITKEISYNELKELITRGEISAVNIGQTYIKAYSANTSPRILYTTKKVADLGLVPLLDEKKIEYSGFSEGSFLGDLVNMLLPIFIILALWMFLTARMQKSMGGGIFGMGNAKKLVNAEKPNVRFDDMAGNAEAKEEVVEIVDFLKYPERYAAVGAKIPRGVLLVGPPGTGKTLLAKAVAGEANVPFFSMSGSSFIEMFVGLGASRVRDLFEMAKKDAPSIIFIDEIDAIGKSRAAGSMVGGNDEREQTLNQLLAEMDGFGSESAPVIVLAATNRPEILDPALLRPGRFDRQVLVDKPDFEGRLEILKVHIKNVSLARDVDLHEIAKFTAGLAGADLANIINEAALLAGRENQKEVSQKHLKEAVERGIAGLEKKSRRISPKEKKIVAYHESGHAVVSEMTKGADRVNKVSIIPRGMAALGYTLHTPEENRYLMQKHELMAEVDVLLGGRAAEEVFLGEISTGASNDLERATGILKSMISYYGMTDVSGLMVLEKQRNTFLGGGNAQREFSEQLAQEIDTHIKNTLDERYSYVKQLLSDYQDAIENMVKELFEKEVIDGARVREIIQEYEMQNNIESRLIPLEEEEV

SEQ ID NO: 3712 - DNA, 1935 bp, Candidatus Blochmannia floridanus
  CDS (1)..(1935)
atgagtgatatgataaagaacctgattctttggttagcgattgcggttgtattgatttctttatttcaaagttttggttctaatgattctagtaatcgaaaagttgattattccacttttatgtatgaattgaatcaagatcaaattaaagaagcgcgtattaatggtcgggaaattgtggttataaaaaaagatagtagtcgttatactacttatattcctgtaaatgatccgaagttgcttgatatattattaacaaaaaaagttaaagttgttggagaacctcccgaagaacctagtttaattacatctatttttatttcttggtttccgatgttattgttgattggtgtatggattttttttatgcgtcaaatgcaaggaggtggaaagggagcaatgtcttttggtaaaagtaaggctaggatgttgtctgaaaatcagattaaaactacttttgacgatgtagcaggatgtgatgaagcgaaggaagaggtgaaagaattagtagattatttgcgtgagcctaataagtttcaaaaattaggaggaaaaattcctaagggtattttattaattggacctcctggaacaggtaaaactttattagctaaagctattgctggagaagctaaagttcctttttttactatttctggatctgattttgtagaaatgtttgttggggtaggtgcatctagagtacgagatatgtttgatcaagctaaaaaatctgctccttgtattatttttattgatgagattgacgctgttggaagacaaagaggtgcaggattaggaggaggacatgatgaacgagaacagacgttgaatcaaatgttggtagaaatggatggttttgaaggaaatgaaggtattattgtaatagcagctactaaccgaccagatgtgttagatcctgcgttgttgaggccgggaagatttgatcggcaagttgtagtaggattgcctgatattcgaggtagggctcagatattgcaagttcatattaaatctgtacctttagggtcagatgttgatatatcagtaattgctcggggtacgcctggattttctggagcagatttagctaatcttgtaaatgaagcagcattatttgctgttagagattctaaacaagcggtatcgatgttacagtttgaaaaagctaaagataaaatcatgatgggatcagaacgacgatctatggttatgactgaaattcaaaaagagtttactgcttatcatgaagcgggacatgctataataggaagattagtgccagaacatgatcctgtgcataaggtaacgattattcctagaggtcgtgctttagggataacgttttttttacctgaatcagattcaatcagtattagtaaacaaaagttagaaagtcaaatttctacattatacggtggtcgtcttgctgaagaaataatttatggtgtgaatagagtatctactggttctgctaatgatattaaagtagctacatctattgctcgtaatatggtaacgcaatggggtttttcagaaaaactagggccattattatatgcagaagaggaaggggaaatttttcttggtcgttcagtagctaaagttaaacatgtatctgatgaaactgctcgtattattgatcaagaaattaaattattgattgagaggaattatttaagggctcgtacattattaacagaaaatatggatattttacattctatgaaagatgctctaatgcaatatgagactataaatgcatctcaaatagataatttaatgaatagaaaatcaatccaatctttatcgtatgataaagattgtgacgaaataaatgatgatgaaaagaataatatttgtgttgatcacgaaatgcaatcaaaatctatggataaaaagtcttacgataataaaccaaatgttgtatcgtaa

SEQ ID NO: 3713 - protein, 644 aa, Candidatus Blochmannia floridanus
MSDMIKNLILWLAIAVVLISLFQSFGSNDSSNRKVDYSTFMYELNQDQIKEARINGREIVVIKKDSSRYTTYIPVNDPKLLDILLTKKVKVVGEPPEEPSLITSIFISWFPMLLLIGVWIFFMRQMQGGGKGAMSFGKSKARMLSENQIKTTFDDVAGCDEAKEEVKELVDYLREPNKFQKLGGKIPKGILLIGPPGTGKTLLAKAIAGEAKVPFFTISGSDFVEMFVGVGASRVRDMFDQAKKSAPCIIFIDEIDAVGRQRGAGLGGGHDEREQTLNQMLVEMDGFEGNEGIIVIAATNRPDVLDPALLRPGRFDRQVVVGLPDIRGRAQILQVHIKSVPLGSDVDISVIARGTPGFSGADLANLVNEAALFAVRDSKQAVSMLQFEKAKDKIMMGSERRSMVMTEIQKEFTAYHEAGHAIIGRLVPEHDPVHKVTIIPRGRALGITFFLPESDSISISKQKLESQISTLYGGRLAEEIIYGVNRVSTGSANDIKVATSIARNMVTQWGFSEKLGPLLYAEEEGEIFLGRSVAKVKHVSDETARIIDQEIKLLIERNYLRARTLLTENMDILHSMKDALMQYETINASQIDNLMNRKSIQSLSYDKDCDEINDDEKNNICVDHEMQSKSMDKKSYDNKPNVVS

SEQ ID NO: 3714 - DNA, 1887 bp, Bordetella parapertussis
  CDS (1)..(1887)
atgaacaattcgttttctaaagtcgcggtctggatggtgatcgcgctggtgctgttcacggtgtttaagcagttcgacggacgtgcacaaacccaggacggcgtcagctacacccaattcatggacgacgccaaggcgggccgcatccgcaaggtcgacgtgcagggcgacgtgctgtatgtcacgccggacgccggccgtccctattcgctgacgtcgccgggcgacctgtggatggtgtcggacctgctcaagtacggcgtgcaggtttcgggcaaggcccgcgaagagccgtcgctgctgatgagcatcttcgtgtcgtggttcccgatgctgctgctgatcggcgtatggatcttcttcatgcgccagatgcagggcggcgggcgcggcggcgcgttcagcttcggcaagtcgcgcgcgcgcatgctcgacgagaacaccaatcaggtgaccttcgccgacgtcgccggctgcgacgaagccaaggaagacgtccaggagctggtcgatttcctgcgcgaccccagcaagttccagaagctgggcggccgcatcccgcgcggcgtgctgatggtcggctcgcccggcaccggcaagacgctgctggccaaggccatcgccggcgaggccaaggtgccgttcttcagcatctcgggctccgatttcgtggaaatgttcgtcggcgtgggcgcggcccgcgtgcgcgacatgttcgagaacgccaagaagcacgccccgtgcatcatcttcatcgatgaaatcgacgcggtcggccgccagcgtggcgccggcctgggcggcggcaacgacgagcgcgaacagaccctgaaccagatgctggtcgagatggacggcttcgagtcgggccagggcgtgatcgtcatcgccgcgaccaaccgtcccgacgtgctcgatccggcgctgctgcgtccgggccgcttcgaccgccaggtggtggtgccgctgcccgacatccgcggccgcgagcagatcctcaaggtgcacatgcgcaaggtgccgctgtcgcccaacgtcgacgccaccatcctggcgcgcggcacgccgggcttttcgggcgccgacctggccaacctggtcaacgaggcggccctgttcgccgcgcgccgcaacggccgcacggtggacatgtccgacttcgagaaggccaaggacaagatcatcatgggcgccgagcgccgctccatcgtcatgcccgaggaagagcgcaagaatacggcctaccacgagtccggccacgccatcgtggcgcgcatgctgcccaagaccgacccggtccacaaggtcaccatcatcccgcgcggccgtgcgctgggcgtgacgatgcagttgcccgaaaccgaccgctacagcatggacaaggagcgcctgctcaacaccatcgcggtgctgttcggcgggcgcatcgccgaagaaatcttcatgaaccagatgaccaccggcgcttcgaacgacttcgagcgcgccacggccatcgcccgcgacatcgtcacccgctacggcatgaccgacgagctgggccccatggtgtatgccgagaacgaaggcgaggtcttcctgggccgcagcgtcaccaagaccacgcatgtctcggaagcgaccatgcagaaggtcgacagcgagatccgccgcatcatcgacgagcagtacggcgtggcgcgcaagatcctggaagacaaccgtgcccgggtcgaggtgatgacctcggcgctgctcgaatgggaaaccatcgacgccgaccagatcgacgacatcgtcaacgaccgtccgccgcgtccgcccaagacgccgcaaggtccgtctgatacgtccgacaccctgcccaccgggctggctgccggcggcaatacggcggccgcggtctga

SEQ ID NO: 3715 - protein, 628 aa, Bordetella parapertussis
MNNSFSKVAVWMVIALVLFTVFKQFDGRAQTQDGVSYTQFMDDAKAGRIRKVDVQGDVLYVTPDAGRPYSLTSPGDLWMVSDLLKYGVQVSGKAREEPSLLMSIFVSWFPMLLLIGVWIFFMRQMQGGGRGGAFSFGKSRARMLDENTNQVTFADVAGCDEAKEDVQELVDFLRDPSKFQKLGGRIPRGVLMVGSPGTGKTLLAKAIAGEAKVPFFSISGSDFVEMFVGVGAARVRDMFENAKKHAPCIIFIDEIDAVGRQRGAGLGGGNDEREQTLNQMLVEMDGFESGQGVIVIAATNRPDVLDPALLRPGRFDRQVVVPLPDIRGREQILKVHMRKVPLSPNVDATILARGTPGFSGADLANLVNEAALFAARRNGRTVDMSDFEKAKDKIIMGAERRSIVMPEEERKNTAYHESGHAIVARMLPKTDPVHKVTIIPRGRALGVTMQLPETDRYSMDKERLLNTIAVLFGGRIAEEIFMNQMTTGASNDFERATAIARDIVTRYGMTDELGPMVYAENEGEVFLGRSVTKTTHVSEATMQKVDSEIRRIIDEQYGVARKILEDNRARVEVMTSALLEWETIDADQIDDIVNDRPPRPPKTPQGPSDTSDTLPTGLAAGGNTAAAV

SEQ ID NO: 3716 - DNA, 1902 bp, Bacillus cereus (strain ATCC 14579 / DSM 31)
  CDS (1)..(1902)
atgaatcgtatcttccgtaataccatcttttatttactgatattcttagtagtaattggaatcgtgagctattttaatggttcgacacaaaaaacgacatcagttagctacgacaaattcattactaaactagaaagcggtgaagtgcgtaatgtgcaacttcaaccgaaaaatggtgtatttgaggtaaaaggacaatttaataactctagccaaggagaacaatttgttacttatgcaccaaatactgaggaattacaaaagaaaattaatgataaagcgaaaggtgccgaagttaagtatcaaccagcagaagaaacaagtgcttgggtaacattctttacttcaatcattccatttgtcatcatcttcattttattcttcttcttattaaaccaagctcaaggcggcggtagccgtgttatgaacttcgggaaaagtaaggcgaagttatataatgatgaaaagaaaaaagttcgtttcagagatgttgctggtgcggatgaagagaaacaagaacttgttgaggtagttgaattcttgaaagaccctcgtaagttctctgaagttggtgctcgtattccaaagggtgtcctattagttggacctccaggtacaggtaaaactttattagcacgtgctgttgcaggtgaggctggcgttccattcttctctatcagtggttctgacttcgtagagatgtttgtcggtgtcggtgcatcacgtgtacgtgatttatttgaaaatgcaaagaaaaatgctccttgtatcattttcattgatgaaattgatgcagtaggtcgtcaacgtggcgcaggtcttggtggtggtcatgatgagcgtgagcaaacattgaaccaattacttgttgaaatggatggattcggtgcaaacgaaggtattattatcgttgctgcgacaaaccgtccagacattcttgacccagcgttattacgtccaggtcgttttgaccgtcaaattacagtagatcgtccagatgtaaatggccgtgaagctgtactgaaagtacatgcgcgtaataaaccacttgatgagcatattaatttaagagcaattgcgactcgtacaccaggattctctggtgcggatcttgaaaacttattaaacgaagctgctttagtagctgcacgtcaagataagaagaaaattgatatgagtgatatcgatgaagcgacggatcgtgttattgcaggtccagctaagaaaagtcgtgttatctctgaaaaagaacgtaatatcgttgctttccatgaagcaggtcatactgtaattggtgttgttcttgatgaagcagatgtcgttcataaagtaacaattgtccctcgtggtcaggctggtggatatgcggtaatgcttccgaaagaagatcgttacttcatgacgaaaccagagttacttgataaaatcactggtttacttggtggccgagtagctgaggagattgtatttggtgaagtgagtacaggtgctcataatgacttccaacgtgcgactggtattgcaagacgtatggttacggaatttggtatgagtgacaaacttggaccgatgcaatttggtagctcgcaaggtggtcaagtgttcttaggaagagacttccactcagaacaaaactatagtgatgcgattgcacatgaaatcgatatggaaatgcaatcaattatgaaagaatgttatgctcgtgcaaaacaaattcttactgaaaaccgtgataaactagatattatcgcacaaacgttacttgaagtagaaacgttagatgcagagcaaatcaatcatttatgtgattacggcagattgccagaacgtccaacatcttcagatgatgtgaaagtaaacatcaacatgaagaaagacgatgaggataaagaagataagtaa

SEQ ID NO: 3717 - protein, 633 aa, Bacillus cereus (strain ATCC 14579 / DSM 31)
MNRIFRNTIFYLLIFLVVIGIVSYFNGSTQKTTSVSYDKFITKLESGEVRNVQLQPKNGVFEVKGQFNNSSQGEQFVTYAPNTEELQKKINDKAKGAEVKYQPAEETSAWVTFFTSIIPFVIIFILFFFLLNQAQGGGSRVMNFGKSKAKLYNDEKKKVRFRDVAGADEEKQELVEVVEFLKDPRKFSEVGARIPKGVLLVGPPGTGKTLLARAVAGEAGVPFFSISGSDFVEMFVGVGASRVRDLFENAKKNAPCIIFIDEIDAVGRQRGAGLGGGHDEREQTLNQLLVEMDGFGANEGIIIVAATNRPDILDPALLRPGRFDRQITVDRPDVNGREAVLKVHARNKPLDEHINLRAIATRTPGFSGADLENLLNEAALVAARQDKKKIDMSDIDEATDRVIAGPAKKSRVISEKERNIVAFHEAGHTVIGVVLDEADVVHKVTIVPRGQAGGYAVMLPKEDRYFMTKPELLDKITGLLGGRVAEEIVFGEVSTGAHNDFQRATGIARRMVTEFGMSDKLGPMQFGSSQGGQVFLGRDFHSEQNYSDAIAHEIDMEMQSIMKECYARAKQILTENRDKLDIIAQTLLEVETLDAEQINHLCDYGRLPERPTSSDDVKVNINMKKDDEDKEDK

SEQ ID NO: 3718 - DNA, 1932 bp, Nitrosomonas europaea
  CDS (1)..(1932)
atgaataatctgattaagaacatggctatctggttggtgattgctttggtactgatgacagtattcaatcaattctccacacggcaaccatcacagccccccatggaatattcacagtttattagtgaaatgcatcagggcaggattgccaaggtagtgattgacggccggactttacgaggatcgaaaacagatggtcgtcagtttatcgttcattcaccctccgatccgtggctggtaagtgatctgttgaaagcgggtgtatcagtggaagcaaaaccggaagaagagccatccatgctgatgagcatactggtgtcatggttcccgatgttgctgttgattgccgtctggatcttttttatgcgtcagatgcagggaggcggccggaatggcggtgctttctcgttcgggaaaagtaaagccaggatgcttgatcataagaacaacaatgtgacttttgcggatgtggctggttgtgaagaagccaaggaagaggttgccgaactggtggaattcctgagagatccctccagattccagaaactgggcggacgtattcctcgtggcgttttgatgtgcggcagtccgggaacgggtaagacattactcgctcgtgccattgccggtgaagcaaaagtgccattcttcagcatttccggttcggattttgttgaaatgtttgtaggtgtgggtgcttccagggtgagagatatgttcgagcaggcgaaaaagcatgcaccctgcatcatcttcatcgacgagatcgatgcggttgggcgtcagcgcggtgccgggctgggaggtggaaacgatgaacgtgaacagaccctgaaccagttgctggtcgagatggatggtttcgaaggcaatatgggtgtgatcgtcattgcggctaccaaccgtcctgacgtacttgatcctgcattgttgcgtccaggccggttcgacagacaagtcgtcgttccattgccggatatacgtggccgggaacagatcctgcaggtgcacatgcgcaaggttccggtatctcctgatgtcaaagccggtatcctcgccagaggtacacccggtatgtcaggagctgatcttgccaatctggtcaatgaggctgcgctgtttgctgcacgcgctggtaaacgcctggtcgatatggatgatttcgaacgtgcgaaagacaagattctgatgggtgctgagcgtcgttccgtcgtcatgccggaaaatgagcgccgtaatactgcctatcatgaatccggacatgcagtggtagcttacctgttgcctaaaactgatccggttcacaaggtttcgatcattccgcgcgggcgtgcactgggtgtcaccatgcaattgccttccgaggatcgttacagcatggatcgtgatcagatattgcaaaccatagcggtcatgtttggcggccgcattgcagaagaagtgttcatgagccagatgactaccggtgcctccaatgactttgaacgggcaacggatactgctcgcaaaatggtaatgcagtggggtatgtctgagacgctgggacctatggtgtatggtgaaaatgagggcgaagtgttccttggtcgttcagtcaccacacacaagaatctaagtgaagcaaccatgcagaaggtcgatgccgagatccgccgtatcattgatgagcagtatgcacttgcacgcaagctgatcgaagagaacaaggataaaatcgaggcaatgactcaggcactgcttgaatgggagacgatagacagcgaccagatcaaggatatcatggagggtcgcccgccacgtccgccacaggcaccgacttcttctgcgcggcaggataaaggttcggcaggctcagcagccagtgaagtaaaacaacctgctggtgaacctgcaacgaccgaggctcctgctgcccagaaagtcgaaatctaa

SEQ ID NO: 3719 - protein, 643 aa, Nitrosomonas europaea
MNNLIKNMAIWLVIALVLMTVFNQFSTRQPSQPPMEYSQFISEMHQGRIAKVVIDGRTLRGSKTDGRQFIVHSPSDPWLVSDLLKAGVSVEAKPEEEPSMLMSILVSWFPMLLLIAVWIFFMRQMQGGGRNGGAFSFGKSKARMLDHKNNNVTFADVAGCEEAKEEVAELVEFLRDPSRFQKLGGRIPRGVLMCGSPGTGKTLLARAIAGEAKVPFFSISGSDFVEMFVGVGASRVRDMFEQAKKHAPCIIFIDEIDAVGRQRGAGLGGGNDEREQTLNQLLVEMDGFEGNMGVIVIAATNRPDVLDPALLRPGRFDRQVVVPLPDIRGREQILQVHMRKVPVSPDVKAGILARGTPGMSGADLANLVNEAALFAARAGKRLVDMDDFERAKDKILMGAERRSVVMPENERRNTAYHESGHAVVAYLLPKTDPVHKVSIIPRGRALGVTMQLPSEDRYSMDRDQILQTIAVMFGGRIAEEVFMSQMTTGASNDFERATDTARKMVMQWGMSETLGPMVYGENEGEVFLGRSVTTHKNLSEATMQKVDAEIRRIIDEQYALARKLIEENKDKIEAMTQALLEWETIDSDQIKDIMEGRPPRPPQAPTSSARQDKGSAGSAASEVKQPAGEPATTEAPAAQKVEI

SEQ ID NO: 3720 - DNA, 1995 bp, Streptomyces avermitilis
  CDS (1)..(1995)
atgtggatcgtgctggccgtccttgccgtggtcgtgttgatgcaggtcgtcggctcgtccggcggctacaagacagtggacaccggccaggtcgtccaggcgatcaatgagaacaaggtccagcaggccaaaatcaccaccggtgacgagcaggtcatcaaggtcgagctgaaggacggccagaaggtcgacggcagctcgaagatccaggcgagttacatcggcgaccagggcgtgaccctcgcgggcacgctccaggacaagtaccagaacaagcagatcccggacggctatacggtctcgccgtccaagcagaacccgttcgtgggcatcctgctctctctgctccccttcgtcctgatcgtcgtcgtcttcctgttcctgatgaaccagatgcagggcggcggctcccgggtcatgaacttcgggaagtccaaggcgaagctcatcaccaaggacacccccaagacgacgttctcggacgtcgcgggttcggacgaggcggtcgaggagctccacgagatcaaggagttcctccaggagccggcgaagttccaggccgtcggggcgaagatccccaagggcgtgctcctgtacgggcctcccggtaccggcaagacgctgctggcgcgtgccgtcgcgggcgaggccggggtccccttctactcgatctccggttccgacttcgtcgagatgttcgtcggtgtcggtgcctcccgagtccgtgacctcttcgagcaggccaaggcgaacgccccggcgatcgtcttcgtcgacgagatcgacgcggtcggccgccaccgcggcgccggcctcggcggcggtcacgacgagcgcgagcagacgctgaaccagctgctcgtcgagatggacggcttcgacgtgaagggcggcgtcatcctgatcgccgccacgaaccggcccgacatcctcgacccggctctcctgcgccccggccgcttcgaccgccagatcgcggtcgaccgcccggacatgcagggccgtctggagatcctcaaggttcaccagaagggcaagccggtcgccccggacgtcgacctgtcggccgtcgcccgccgcacccccggcttcacgggtgccgacctcgccaacgtgctgaacgaggccgcgctcctcacggcccgcagcgacaagaagctggtcgacaactccatgctggacgaggcgatcgaccgcgtggtcgcgggcccgcagaagcggacccggatcatgtcggacaaggagaagaagatcaccgcgtaccacgagggcggccacgccctggtcgcggcggcgtctccgaactccgacccggtccacaagatcacgatcctgtcgcgcggccgtgccctcggctacacgatggtcctgccggacgaggacaagtactccacgacccgcaacgagatgctcgaccagctggcgtacatgctgggcgggcgcgcggccgaggagctcgtcttccacgacccgacgacgggcgctgcgaacgacatcgagaaggccaccgccacggcccgcgcgatggtcacgcagtacggcatgaccgagcgtctcggcgcgatcaagttcggcggcgacaacaccgagcccttcctgggccgggagatgtcgcatccgcgcgactactcggaagaggtcgccgcgctcgtcgacgaagaggtcaagaagctcatcgagaacgcgcacaacgaggcctgggaaatcctggtcgagaaccgcgacgtcctcgacgccctggtgctccagctgctggagaaggagacgctgagcaaggagcagatcgccgaggtcttcgctcccatcgtcaagcgcccggcccgccccgcgtggaccggctcctcccggcgcaccccgtccacccgcccgccggtgctctcccccaaggagctgtcactgacgaacggggcgaacggcgcgtcgccggcgatcgccaacgcgacggagtcggtgccggccgcggagtcggctccggaggaccgcaccgagggctga

SEQ ID NO: 3721 - protein, 664 aa, Streptomyces avermitilis
MWIVLAVLAVVVLMQVVGSSGGYKTVDTGQVVQAINENKVQQAKITTGDEQVIKVELKDGQKVDGSSKIQASYIGDQGVTLAGTLQDKYQNKQIPDGYTVSPSKQNPFVGILLSLLPFVLIVVVFLFLMNQMQGGGSRVMNFGKSKAKLITKDTPKTTFSDVAGSDEAVEELHEIKEFLQEPAKFQAVGAKIPKGVLLYGPPGTGKTLLARAVAGEAGVPFYSISGSDFVEMFVGVGASRVRDLFEQAKANAPAIVFVDEIDAVGRHRGAGLGGGHDEREQTLNQLLVEMDGFDVKGGVILIAATNRPDILDPALLRPGRFDRQIAVDRPDMQGRLEILKVHQKGKPVAPDVDLSAVARRTPGFTGADLANVLNEAALLTARSDKKLVDNSMLDEAIDRVVAGPQKRTRIMSDKEKKITAYHEGGHALVAAASPNSDPVHKITILSRGRALGYTMVLPDEDKYSTTRNEMLDQLAYMLGGRAAEELVFHDPTTGAANDIEKATATARAMVTQYGMTERLGAIKFGGDNTEPFLGREMSHPRDYSEEVAALVDEEVKKLIENAHNEAWEILVENRDVLDALVLQLLEKETLSKEQIAEVFAPIVKRPARPAWTGSSRRTPSTRPPVLSPKELSLTNGANGASPAIANATESVPAAESAPEDRTEG

SEQ ID NO: 3722 - DNA, 1860 bp, Nitrosomonas europaea
  CDS (1)..(1860)
atgaataaccagtcacccatggacaagaaggcgcagatcaacttctggtacgtgctgattgcagtactcagcattctcttcatccagaacctttacaatcagtatacgcgaatagagccgattccctacagccgcttccagtctctgttggagcaggacaaggtgtccgaagtggccatcactgatcaacagatcttcggcaagctcaaggaatcgaccagtgaaaaattcaccgaattcgtcaccacccgggttgaatcggatctggcagaaatgctggataagcacaatgttacttatactggtgtcgtccagagtacctggttgcgcgatctgctttcctggatcgtaccgatggccgttttcgttggtatctggctgtttatcatccgacgaatgaataaaggcatgatgggaagcggcctgatgtcgatcggcaaaagccgcgccaaggtctacgtggaaaaagaaaccaaggtaacctttgccaatgttgccggggtggatgaggccaaggaagagttggtcgaaatcgtcaattttctcaagaatcccaaggaatacagccggctgggcggacgggcacccaaaggtatcttgctggttggtccgcctggtaccggtaaaaccctgttggcgcgcgcagtggcaggtgaggcaggtgtaccgtttttctcgatttccggctctgaatttgtcgagatgttcgtaggcgttggtgctgccagagtgcgtgatctgtttgaacaggctcgccagatggcgccggcaatcattttcatcgatgagctggattcactcgggcgcgcgcgcggtgcaggcggatttggcggccatgatgaaaaagaacagacactgaatcaattactggccgaactcgatggattcgatccttccagtggaattgtcctgcttgccgcgactaaccgtccggaaatcctggatgcagccttgctgcgcgccgggcgtttcgatcgtcaggtactggtggaccggcctgataaaaaaggtcgtcagcaaatcctgggtgttcatattggcaaaatcacactggcgcccgatgttgataccgaacagatcgcagcactgacacctggcttcacaggtgctgatctggctaatttgatcaatgaggctgcgctgctggcgacccggcgtggtggtcaggcagtcagcatggacgacttcaataatgcaatcgagcggatcgtagctggcctggaaaagaaaaatcgtctgctcaatccggaagaaaggcgtaccgttgcttaccatgaactgggccataccatggtggcacttgctctgccgggatcggatgaagtacataaagtttcgatcatcccacgtggtattggtgcacttggctataccattcagcgtcccaccgaggatcgctttcttatgacacgcaaggagctggaaaacaaaatggcggtattgctgggtgggcgtgcagcggaaaggttggtattcgacgagatttccaccggtgcttccgatgatctggcgcgtgctaccgatatcgcccgtgccatggttttacgctatggcatgagcgaggcaatcgggaatgtggtttatgatcgcgaacaaatggcgtttttgcaacctggttttcccatgccccaaagccgtgattacagtgaagaaactgccaataaaattgaccagactgtacgttcactgcttgatttggcgcttgaacgtgccattaaaattctggataaaaatcgggaactgcttgatcgaactgcgcagcaattgctggaaactgaaacactgaatcagccggagttactggagctgaaacgcaacttgcgtgcggaggaaaccaatccgtcaacacagcagaactaa

SEQ ID NO: 3723 - protein, 619 aa, Nitrosomonas europaea
MNNQSPMDKKAQINFWYVLIAVLSILFIQNLYNQYTRIEPIPYSRFQSLLEQDKVSEVAITDQQIFGKLKESTSEKFTEFVTTRVESDLAEMLDKHNVTYTGVVQSTWLRDLLSWIVPMAVFVGIWLFIIRRMNKGMMGSGLMSIGKSRAKVYVEKETKVTFANVAGVDEAKEELVEIVNFLKNPKEYSRLGGRAPKGILLVGPPGTGKTLLARAVAGEAGVPFFSISGSEFVEMFVGVGAARVRDLFEQARQMAPAIIFIDELDSLGRARGAGGFGGHDEKEQTLNQLLAELDGFDPSSGIVLLAATNRPEILDAALLRAGRFDRQVLVDRPDKKGRQQILGVHIGKITLAPDVDTEQIAALTPGFTGADLANLINEAALLATRRGGQAVSMDDFNNAIERIVAGLEKKNRLLNPEERRTVAYHELGHTMVALALPGSDEVHKVSIIPRGIGALGYTIQRPTEDRFLMTRKELENKMAVLLGGRAAERLVFDEISTGASDDLARATDIARAMVLRYGMSEAIGNVVYDREQMAFLQPGFPMPQSRDYSEETANKIDQTVRSLLDLALERAIKILDKNRELLDRTAQQLLETETLNQPELLELKRNLRAEETNPSTQQN

SEQ ID NO: 3724 - DNA, 2157 bp, Enterococcus faecalis (Streptococcus faecalis)
  CDS (1)..(2157)
atgaacaaaaagaataatggcatgaaaaatggtttatactacgtcttagtagtacttgccatggtcatggttgtctatttcatttttggaaataacaaccaacaatcgccagacatcgattactcaaccttccaacaacaattggaagacggaaaagtcaaagacatgaccattcaaccaactaatggggtttaccggattgaaggtcagtataaagaaaaacaagaagtgaaagacacaggtggtctgtcattgtggggctcaacgcaagcgtcgtcaaaaggcttcacaacaaccgttttacctagtgatacaaccttagctggcattcaagatgcggcacaaaataacaaggtgaagctagttgtcaaagaacaatcaacaagtggtgcttggttgtcactgttgtttagtttcttaccattagtgattattttcttcttcttctacatgatgatgagccaacaaggcggtggcggtggcggcggtggccgtgtgatgaacttcggtaaatcaaaagccaaagaagccgataaaaaagctaaccgtgtccgcttctcagatgtagctggtgcggaagaagaaaaacaagaattagttgaagtagtggaattcttaaaagatccacgtcgtttcgctgaattaggcgcacggattcctgcgggcgtactattagagggacctccagggactggtaaaacgttacttgctaaagccgtagcaggtgaagcaggtgtgccattttactcaatctcaggttcagatttcgttgaaatgtttgtcggggtcggtgctagccgtgtccgggatttatttgaaacagcgaagaaaaacgcgcctgcaattatctttatcgatgaaatcgatgcagttggtcgtcaacgtggtgctggtatgggtggcggacacgacgaacgtgaacaaacccttaaccaattattagttgagatggatggttttgatggcaatgaaggagttatcgtaattgctgcaacgaaccgttcagacgtgttagacccagcgttgttacgtccaggtcgttttgaccgccaaatcttggtaggacgtccagatgtcaaaggtcgtgaagcgattttacgtgttcatgcgaaaaacaaaccgttagctgatgacgttgatttgaaagttgttgcacaacaaacaccaggttttgctggtgctgatttagaaaatgtcttaaacgaagcagccttagttgccgctcgtcgtaacaagaaaaaaattgatgcttctgatgtggatgaagccgaagaccgcgtaattgctggtccagctaaaaaagatcgcgtgattaataaaaaagaacgcgaaatggtggcttaccatgaagcaggacacacaattgttggtttagtcttaagccgtgctcgtgttgtccacaaagtaacaattatccctcgtggtcgcgcaggcggttatatgattgctttaccaaaagaagatcaattcttaatgactaaagaagatatgtttgaacaaatcgttggcttacttggtggacgtacagcagaagaaattatctttggcgttcaatcaacaggggcttcaaatgactttgaacaagcaacagggattgctcgtagcatggtaactgaatatggaatgagcgacaaattaggacctgttcaatatgaaggaaaccatcaagtctttgtcggtcgtgattatggtcaaacaaaagcttactcagaacaagtggcgtttgaaatcgatcaggaagttcgtcgtatcttaatggatgctcatacgaaagcgcatgaaattatcgaagcgcaccgtgaacaacataaactaatcgctgaaaaactattagaatatgaaacattagatgcaaaagcaatcaaatcattatttgaaacaggtaaaatgcctgaaggtgctgacagcgactatcctagtgaaaaagaagcgcaaacattcgaagaagcaaaacgtgctttagaagaaaaagaagcgcaaaaacaagttgaagaaaaacaagactttgaagaagcgaaaaaagaattacatgatgaagcagaagaagtcaaagtagaaagcgaacaaacagaaaaagaagtccaatctgaagagaaaaaagattcagattccaattctgaatatgatcgcaataactacgaagatcgttataaataa

SEQ ID NO: 3725 - protein, 718 aa, Enterococcus faecalis (Streptococcus faecalis)
MNKKNNGMKNGLYYVLVVLAMVMVVYFIFGNNNQQSPDIDYSTFQQQLEDGKVKDMTIQPTNGVYRIEGQYKEKQEVKDTGGLSLWGSTQASSKGFTTTVLPSDTTLAGIQDAAQNNKVKLVVKEQSTSGAWLSLLFSFLPLVIIFFFFYMMMSQQGGGGGGGGRVMNFGKSKAKEADKKANRVRFSDVAGAEEEKQELVEVVEFLKDPRRFAELGARIPAGVLLEGPPGTGKTLLAKAVAGEAGVPFYSISGSDFVEMFVGVGASRVRDLFETAKKNAPAIIFIDEIDAVGRQRGAGMGGGHDEREQTLNQLLVEMDGFDGNEGVIVIAATNRSDVLDPALLRPGRFDRQILVGRPDVKGREAILRVHAKNKPLADDVDLKVVAQQTPGFAGADLENVLNEAALVAARRNKKKIDASDVDEAEDRVIAGPAKKDRVINKKEREMVAYHEAGHTIVGLVLSRARVVHKVTIIPRGRAGGYMIALPKEDQFLMTKEDMFEQIVGLLGGRTAEEIIFGVQSTGASNDFEQATGIARSMVTEYGMSDKLGPVQYEGNHQVFVGRDYGQTKAYSEQVAFEIDQEVRRILMDAHTKAHEIIEAHREQHKLIAEKLLEYETLDAKAIKSLFETGKMPEGADSDYPSEKEAQTFEEAKRALEEKEAQKQVEEKQDFEEAKKELHDEAEEVKVESEQTEKEVQSEEKKDSDSNSEYDRNNYEDRYK

SEQ ID NO: 3726 - DNA, 1944 bp, Coxiella burnetii
  CDS (1)..(1944)
atgaatagtatgattaaaaatttactgctgtggttagtcattgccgtagtccttatcactgtttttagcaattttggttcgcgtcagtccgatgtgcagccatacagttattcgcaatttgttcaggcggtgaataatgacaaagttagcagcgtggtaattcaaggtcatgaaatcaagggggtgactaaggataataaacatttcaccacctatttgcccatggaagatcaagcgttattaaatcaattaatggcgaagggcgtcagcgttaagggtgaacctcctaaacaacaaagcatgtttttgcatattcttattagttggttgccattcttaatattaatatttgtatggattttgtttatgcgccaaatgcagggcggcgggcgtggcggcggcccaatgtcttttgggcgtagtaaagcgcggttgctgagtcaagatcaggttaaagtgacgtttgatgacgtagccggtgtcgatgaagccaaagaagaagttaaagaactggtggaattcctgcgtgatcccggaaaattccagcgcttaggcggtaaaatgccctgtggtgtgctgcttgtgggtccgccgggaaccggtaaaacattgttggctaaagccgttgctggtgaagcgaaggttcctttcttcaccatttccggttcggattttgtggagatgtttgttggcgtgggtgcttcgcgggttcgggatatgttcgatcaggctaaaaagcaagcgccttgcattatttttatcgatgaaattgacgccgtgggacggcatcgcggtgctggtttgggtggcggacatgatgaacgcgaacaaaccttgaaccagctcttagtagaaatggatgggtttgaaggtaaagagggcattattgtaatggccgcgaccaaccgtccggatgttcttgatcctgcgcttttacgccctggtcgatttgatcgccaggtggtagtgcctttgcctgacatcaaaggacgcgaatatattctaaaagtgcacatgaataaattgcctctggcaaaagacgttaaagcctccgtgattgcgcgtgggacgcccggtttttcaggcgctgacttagccaatattgtaaacgaagcggctttgtttgcagctcgggaaaataagaaagacgtcagtatgtccgaatttgaacgagctaaagataagatcatgatgggtgcagaacgtcgatcgatggtgatgagtgatgatgaaaagaaattaacggcttatcatgaagccggtcacgccatcgtgggcttgcacatgctagaacatgatcccgtttacaaagtcacgatcatcccgcgagggcgggcgctcggcgtgacgatgtttcttcctgagcatgatcgttacagcatgaccaagcggcgtttggaatgtcagcttgctggattgtttggtgggcgtattgcggaagaaatcatctttggtcccgacctcgtgacaacgggcgcttccaacgatattgaaaaagcaaccgaaattgcacgcaacatggtcactaagtggggtttgtctcaaaaattaggacccttgacttatcgagaagaagaaggcgaggtctttttaggtcgttcagttactcagcgtaaagatatttctgatgcgactaacaaagagatcgattcggaagtccgtcgcattgttgacacggcttatacaacagcaaaacaaaccttggaagaacacatcgaacagctccatttgatggctaaagcgcttattaaatatgaaaccattggtgaggctcaaattaaggaaattctagcgggtaaagagccttcgccgccgccggattggaaagaggaaaatgggagcgcgtcagctcacaaagaaaattccgaaaaagaactatcggaagagaaaggcgaagaaaaaacagtaaatcctagcaggcctcgacctgcagaagatggctga

SEQ ID NO: 3727 - protein, 647 aa, Coxiella burnetii
MNSMIKNLLLWLVIAVVLITVFSNFGSRQSDVQPYSYSQFVQAVNNDKVSSVVIQGHEIKGVTKDNKHFTTYLPMEDQALLNQLMAKGVSVKGEPPKQQSMFLHILISWLPFLILIFVWILFMRQMQGGGRGGGPMSFGRSKARLLSQDQVKVTFDDVAGVDEAKEEVKELVEFLRDPGKFQRLGGKMPCGVLLVGPPGTGKTLLAKAVAGEAKVPFFTISGSDFVEMFVGVGASRVRDMFDQAKKQAPCIIFIDEIDAVGRHRGAGLGGGHDEREQTLNQLLVEMDGFEGKEGIIVMAATNRPDVLDPALLRPGRFDRQVVVPLPDIKGREYILKVHMNKLPLAKDVKASVIARGTPGFSGADLANIVNEAALFAARENKKDVSMSEFERAKDKIMMGAERRSMVMSDDEKKLTAYHEAGHAIVGLHMLEHDPVYKVTIIPRGRALGVTMFLPEHDRYSMTKRRLECQLAGLFGGRIAEEIIFGPDLVTTGASNDIEKATEIARNMVTKWGLSQKLGPLTYREEEGEVFLGRSVTQRKDISDATNKEIDSEVRRIVDTAYTTAKQTLEEHIEQLHLMAKALIKYETIGEAQIKEILAGKEPSPPPDWKEENGSASAHKENSEKELSEEKGEEKTVNPSRPRPAEDG

SEQ ID NO: 3728 - DNA, 2001 bp, Tropheryma whipplei (strain TW08/27) (Whipple's bacillus)
  CDS (1)..(2001)
atgtcgaagataacaaaatcccctgtgctctatatcgtgctccttgttgtgggggtttgggtcgctgtcaatctgtttctcacaaatgcatatcaatctatacgcaccgaagaggggttagagctgataaaaagcgactccctggtgtccgtgaggatagttgacagagatcagagggttgatctggagcttgcgaccccctacaagaaccacggaacaaaagtacagttcaattatgtcagtcagcgtgctaccgagatcgtaaatgccgtaaacaaagcaaaaataaaggatggctttacagatgaagtgccagcgcccagtgtctgggggtctattatcagcatgctattgccaattgctgcaattggactatttctctggtttatggcaggtccgcaagctgccggcggccgggggattgcccagttttctaggatgcgctcacgtcttgttagcaaggaaatgcccaaggtgcgttttacagatgttgcaggcgccgatgaagccgttgaggagcttcaggagataaaggattttctaagcgaccctgataaataccgcaaactcggtgcgcgtatcccaaagggggttttactgttcggacctccggggaccggaaaaacccttttggctcgtgcagttgccggtgaggccggcgtcccgtttttctcaatttccggttctgattttgttgagatgtttgttggtgttggtgcaagtcgcgtcagggatttgtttgagcaagcgaagcagaattctccttcgataatatttatagacgaaattgacgccgtgggtcgccgccgtgggtcaggctttggtggtggtcatgatgaacgcgaacagaccctcaatcagcttttggttgagatggatggattcgatgttaaaacaaacataatactcattgccgcaacaaacaggtctgatgttctcgactctgcgctattgcgccccggtcgttttgaccgacatgttgcaattgatgcgccaaatttgcagggtcgcctaaaaatacttcaagttcatgcacgcacgaagcctgttagtaagtcggttgatcttgaagtgttagctcgtaaaacccctggctttacaggcgcagatcttgccaatgttttaaatgaggctgcgcttcttacagccaggagcaatgcccagataatcgatgaccgcgcgcttgatgaggctgttgatcgggttatggcagggcctcaacgccgcagcagggttatgacggatcacgaaaagcttgttacggcttatcacgaagctggacacgccttgaccgccgcggctatgcgttattcggatccggttacgaaggtcactattcttccgcgcagcagggccctaggttacacgatggttatgccggtccaggatcgctactcagttacgcgcaatgaattacttgacaagttggcatatgcaatgggaggtcgcgccgcagaggagcttgtctttcatgaccccacgacaggtgcaagtaatgatattgagaaggcaaccagtatcgcccgcaagatggtaaccgaatttggtcttagtaaagatttgggtgcagtgaaatttggtaacgcacataacgaaacgcttatgggtgtaggtcaaatgaccgctcgtgattattctgaagttactgcggaaaggattgatgtccaggttcgggcgcttatacagaatgcccgtgacgaggcttgggaagtgataagcaataatagaaacctcttggacgatttagccctaaatcttcttgagaaagaaactctgaatcaggatgaaattgctgagattttcaaaggtgttcgcaaattgcctgagcgtcatgtttggcagtccgcccctaatcgcgagccgagtaataaaccacccgtaaagtacagtgcgatggggcccgattccgaagtgaccgcaaaatcgccaaagagaacttccaacagacgtaggttgccttcagcaaggcgcccgaggaaggattcggagactcaggaataa

SEQ ID NO: 3729 - protein, 666 aa, Tropheryma whipplei (strain TW08/27) (Whipple's bacillus)
MSKITKSPVLYIVLLVVGVWVAVNLFLTNAYQSIRTEEGLELIKSDSLVSVRIVDRDQRVDLELATPYKNHGTKVQFNYVSQRATEIVNAVNKAKIKDGFTDEVPAPSVWGSIISMLLPIAAIGLFLWFMAGPQAAGGRGIAQFSRMRSRLVSKEMPKVRFTDVAGADEAVEELQEIKDFLSDPDKYRKLGARIPKGVLLFGPPGTGKTLLARAVAGEAGVPFFSISGSDFVEMFVGVGASRVRDLFEQAKQNSPSIIFIDEIDAVGRRRGSGFGGGHDEREQTLNQLLVEMDGFDVKTNIILIAATNRSDVLDSALLRPGRFDRHVAIDAPNLQGRLKILQVHARTKPVSKSVDLEVLARKTPGFTGADLANVLNEAALLTARSNAQIIDDRALDEAVDRVMAGPQRRSRVMTDHEKLVTAYHEAGHALTAAAMRYSDPVTKVTILPRSRALGYTMVMPVQDRYSVTRNELLDKLAYAMGGRAAEELVFHDPTTGASNDIEKATSIARKMVTEFGLSKDLGAVKFGNAHNETLMGVGQMTARDYSEVTAERIDVQVRALIQNARDEAWEVISNNRNLLDDLALNLLEKETLNQDEIAEIFKGVRKLPERHVWQSAPNREPSNKPPVKYSAMGPDSEVTAKSPKRTSNRRRLPSARRPRKDSETQE

SEQ ID NO: 3730 - DNA, 2145 bp, Lycopersicon esculentum (Tomato)
  CDS (1)..(2145)
atggctttaatgcgccttctaactcaggttgaaaggcaacaatctcaactgaggcatattagctctttgttcaatcgaacatatctttcctctggacggatcataggaagtgaagttcatggagttgcaaataccaagcaaaggtttcagtctagttatgtgggaagtctagcccgcagagtacgtgaaagagaggaaactagtaatgcttcatttcatagaagtgatccagaggcagtcataaggtcgtttgaaagccaaccttcattgcattccaatccagcggcagtgtcggagtatgttaaggcactggtaaaggctgacagacttgatgaaagtgagcttctccggactttgcagagagggattgctggttctgctaggtctcatatggaggaagagaatataggggctctgtcagctcttagaaatgttgggaaatcaacaaaggatggtgttcttggtactcgtaatactcctatacatatggtggccgtggaaggaggtaacttcaaagaacagttgtggcgtacattccggtctctggctgtggcctttctcttgatttctggagttggtgctctcattgaagatagaggaatcagcaaaggtataagaggacttggtctaaatgaggaagtgcaaccaaccatggaaaccaatacaagattttctgatgtgaagggtgttgatgaagcaaaatctgagctggaagaaattgttcactatctccgagatcctaagcgtttcactcgtcttgggggcaagctcccaaaaggagtattacttgttggcccccctggaactggtaagaccatgttggcgagggccatagctggagaagctggggttccctttttctcatgcagtggcagtgagtttgaagaaatgtttgttggtgtcggagctcgcagagtgagagacctttttgctgctgctaagaagcgatcaccatgcattatattcattgatgagattgatgccattggaggaagccgtaaccctaaggatcagcaatatatgaggatgactttaaatcaattgcttgtcgagctggatggcttcaaacaaaatgatggaatcattgtgattgctgccactaattttgctgagtcactggataaggctttggtgagacctggacgatttgatcgcaacattgttgtcccaaatcctgatgttgaagggcggaagcagattttggaatctcacatgtcaaagattctgaaggcggatgatgttgaccttatgatcattgctcgggggactcctggattttctggtgcagaccttgcaaacttggtgaatatcgctgctgtgaaggctgctatggatggtgccaaagccgtaagcttggctgatctagagcatgcgaaggacaagatcatgatgggaagtgagcgcaaatcagcttttatatcccaagagtcgagaaaactcacagcataccatgaaggtgggcatgcacttgtagctattcatacagatggggctcttccggtgcacaaagcaactattgttccacgtggaatggctcttggtatggttgctcaattgcctgaaaaggacgagactagcatctcccgtaagcagatgcttgcacgacttgatgttgccatgggtgggcgagttgctgaagagctcattttcggggaaagtgaagtaacttctggtccatctgatgatctcaagcaagcaaccaagctagccagaaccatggtcaccaagtttggtatgagcaaagaagttgggctcgttacccataactacgacgataatgggaagagcatgagcactgagactagacttctaatcgagaaggaagtaagagaattacttgaaagggcttacaacaatgcgaaaactattctcactacccataataaagaacttcatgctcttgctaatgcattgcttgagaaggaaacactaaccggaggtcagatcaaagccttgcttgcccaggtcaaatctcaacaaactcagcagaagcaacatcaatcagtatcagttgaaagtacaccacagtccaatccaagacctccacagagtccaagtgcagcagcagctgcggccgctgctgcagcagccgctgcagctacagctgctgctaaaaccaaaggcattgctccagtaggatcttag

SEQ ID NO: 3731 - protein, 714 aa, Lycopersicon esculentum (Tomato)
MALMRLLTQVERQQSQLRHISSLFNRTYLSSGRIIGSEVHGVANTKQRFQSSYVGSLARRVREREETSNASFHRSDPEAVIRSFESQPSLHSNPAAVSEYVKALVKADRLDESELLRTLQRGIAGSARSHMEEENIGALSALRNVGKSTKDGVLGTRNTPIHMVAVEGGNFKEQLWRTFRSLAVAFLLISGVGALIEDRGISKGIRGLGLNEEVQPTMETNTRFSDVKGVDEAKSELEEIVHYLRDPKRFTRLGGKLPKGVLLVGPPGTGKTMLARAIAGEAGVPFFSCSGSEFEEMFVGVGARRVRDLFAAAKKRSPCIIFIDEIDAIGGSRNPKDQQYMRMTLNQLLVELDGFKQNDGIIVIAATNFAESLDKALVRPGRFDRNIVVPNPDVEGRKQILESHMSKILKADDVDLMIIARGTPGFSGADLANLVNIAAVKAAMDGAKAVSLADLEHAKDKIMMGSERKSAFISQESRKLTAYHEGGHALVAIHTDGALPVHKATIVPRGMALGMVAQLPEKDETSISRKQMLARLDVAMGGRVAEELIFGESEVTSGPSDDLKQATKLARTMVTKFGMSKEVGLVTHNYDDNGKSMSTETRLLIEKEVRELLERAYNNAKTILTTHNKELHALANALLEKETLTGGQIKALLAQVKSQQTQQKQHQSVSVESTPQSNPRPPQSPSAAAAAAAAAAAAAATAAAKTKGIAPVGS

SEQ ID NO: 3732 - DNA, 1938 bp, Xylella fastidiosa (strain Temecula1 / ATCC 700964)
  CDS (1)..(1938)
atgaggatgaacgacttaaccaaaaatgtgttgctgtgggtggtcgtcgccgtcgtgctgatggtggtatttcaaagtttctcgccacgtattggtggagtgataggcaacgaaccaatcacctatacacaatttctgaatgaagtggatagcggtcggatcaagtcggtgaactacaccgacgagagtggcctgactgtcaacgcgattcgcttcaaacgcaccgacggtagcgagggtttggtctacggaccacgcgacgacaaattggtcgacgtgttatacagcaagaacattgagatgacccggcaaaagccttccaccggcccaggcttttggtctctagtattgaattttctaccagtcatcctaatcattggattctgggttttcatcatgcgccagatgcaaggtggtggggctaaaggtgcgatgtcgtttgggaaatcccgtgcaaaattgcaaggcgatgaccagatcaaaatcacttttgctgacgtcgccggttgcgacgaagccaaagaggaagttggtgagctggtcgattttttgcgtgaccccactaaattcaccaagcttggcggcaagattccacgtggagtcttgatggtgggtcctccaggcaccggcaagacgttattagccaaagcaatcgctggggaagcaaaagtgcctttcttttcgatttctggatctgacttcgtcgaaatgtttgttggggtcggtgctagccgtgttcgtgacatgtttgagcaagccaaaaagcatgccccatgcattattttcatcgacgaaatcgacgcggtaggccgtcatcgaggtgcaggcttaggcggaggccatgacgaacgcgaacaaactttaaaccagctcctggtcgaaatggacggctttgaaggcggtgaaggcgtgattgtgatcgccgcgacgaatcgccctgacgtgctcgaccctgcgctgctgcgcccaggtcgcttcgaccgtcaagttgtggttgctctaccagacgttaaaggccgtgagcagatcctaggtgttcatatgcgtaagttactgttagccaatgacgtcgagccgctcgtgattgcacgtggaacccctggtttttctggagctgacttagccaatctgtgcaatgaagcagcgttattcgccgcgcgtagcaacgaaaaggaagtcagaatgaaccatttcgacgctgcccgcgacaaaatactcatgggcactgaacgtcgctcaatggcaatgagtgaggaagaaaaaacccttactgcttaccacgaagctggtcatgccatcgttggccgcttagtacctgagcatgaccctgtgtacaaagtcacgattatcccccgtggccgtgctttgggcgtcaccatgtatcttcctgaaggtgacaaatactcaatcaataaagtggctattcagtcccaactatgctccttatatggtggccgtgttgccgaagaattaatcttcggtgaggataaagtcacaactggcgcttctaatgatattgaacgtgtgaccaagatggcacgcaatatggtcaccaagtggggactctcggatgaactgggtccggttgcttatggcgaggaagaggatgaagtttttcttggccgttctgtgactcaacataaaaatgtctcagatgaaacggcccgcaaaattgatgaggtagtgcgctctatcttggacaaagcgtacgctcgtaccaagcggattttggcagataacttagataagctccacgcgatgtcccagctgctgctgcagtacgaaaccatcgacgcacctcagattgatgccattatggagggtcgtgccccccccccgccggttggctggggtaaaccttctgacaatggtagcgacgacgacatgagtaagccccgcccattaactaccatcgttgttccagctgagcaggtttga

SEQ ID NO: 3733 - protein, 645 aa, Xylella fastidiosa (strain Temecula1 / ATCC 700964)
MRMNDLTKNVLLWVVVAVVLMVVFQSFSPRIGGVIGNEPITYTQFLNEVDSGRIKSVNYTDESGLTVNAIRFKRTDGSEGLVYGPRDDKLVDVLYSKNIEMTRQKPSTGPGFWSLVLNFLPVILIIGFWVFIMRQMQGGGAKGAMSFGKSRAKLQGDDQIKITFADVAGCDEAKEEVGELVDFLRDPTKFTKLGGKIPRGVLMVGPPGTGKTLLAKAIAGEAKVPFFSISGSDFVEMFVGVGASRVRDMFEQAKKHAPCIIFIDEIDAVGRHRGAGLGGGHDEREQTLNQLLVEMDGFEGGEGVIVIAATNRPDVLDPALLRPGRFDRQVVVALPDVKGREQILGVHMRKLLLANDVEPLVIARGTPGFSGADLANLCNEAALFAARSNEKEVRMNHFDAARDKILMGTERRSMAMSEEEKTLTAYHEAGHAIVGRLVPEHDPVYKVTIIPRGRALGVTMYLPEGDKYSINKVAIQSQLCSLYGGRVAEELIFGEDKVTTGASNDIERVTKMARNMVTKWGLSDELGPVAYGEEEDEVFLGRSVTQHKNVSDETARKIDEVVRSILDKAYARTKRILADNLDKLHAMSQLLLQYETIDAPQIDAIMEGRAPPPPVGWGKPSDNGSDDDMSKPRPLTTIVVPAEQV

SEQ ID NO: 3734 - DNA, 1989 bp, Vibrio parahaemolyticus
  CDS (1)..(1989)
atgagtgacatggcaaaaaatttaattctgtggcttgttatcgctgtcgtattgatgtcggtattccagagctttggccctggagagagcaatggcagaaccgtggattacaccacgtttgtacaggaagttggccaaggccagattcaagaagcaacttttaaagacggtgaaattagctttgttcgtcgtggcggcggtgccaaaatggtcacttacatgccagtgtatgatcagaagcttctagatgacctaattaaccaaaacgtgaaagtgcaaggtacgcctcctgaagagcaaagcttgcttggcacaattttcatttcttggttcccaatgatcttactgattggtgtgtggattttcttcatgcgtcaaatgcaaggcggcggcggtaaaggcgctatgtctttcggtaagagtaaagctcgtatgatgagcgaagaacaaatcaaaaccactttcgctgatgttgcgggctgtgacgaagcaaaagaagacgtaaaagaacttgttgattacctacgtgatccaagccgtttccaaaaactgggtggtaagattccaactggtgttttaatggttggtcctccaggtacgggtaaaacgttacttgcaaaagctatcgcaggtgaggcaaaagtaccgttctttactatttcaggttccgatttcgtagaaatgttcgttggtgttggtgcatctcgtgtacgtgacatgttcgagcaagcgaagaaagccgcgccttgtattatctttatcgatgaaatcgatgctgtaggtcgtcagcgtggtgctggtgtaggtggtggtcacgatgaacgtgagcaaacactgaaccaaatgctagtagaaatggatggttttgagggcaacgaaggtattatcgttattgctgcgaccaaccgcccagacgtattagaccctgcattgctacgtccgggtcgttttgaccgtcaagtagttgtaggtcttcctgatgtacgcggtcgtgaacagattctaaaagtacacatgcgcaaagtgccattagctggtgacgtagagccttctttaatcgctcgtggtacaccaggtttctctggtgctgacctagcaaacttagttaacgaagctgcgctatttgctgcacgtggcaacaaacgcaatgtctctatggttgagtttgagctagcgaaagacaaaatcatgatgggtgcagagcgccgttctatggtgatgtcagaagagaccaaagagtcaacagcgtaccatgaagctggtcacgcgattgttggccgtttagtacctgagcatgatcctgtgtacaaagtgtctatcattccacgtggtcgtgcacttggtgtaacgatgtacttgccagaacaagaccgcgtaagtatgtctcgtcagcacttagaatctatgatttcaagcctgtatggcggtcgtcttgctgaagagctaatttacggtcctgaaaaagtatcgacaggtgcttccaacgacattgaacgtgcgactgatattgctcgtaagatggtgacacaatggggcttctctgaaaaacttggtcctctactttatgcagaagatgaaggtgaagtattccttggtcgtagcgtaacgcagactaaacacatgtctgatgataccgctaagctgatcgatgatgaggttcgtcaaatcatcgaccgcaactacgaccgtgcgaaaaagattttggaagacaacatggacatcatgcatgcgatgaaagatgcgctaatgaagtatgaaaccattgatgctcgccaaattgatgatctcatggaacgtaaagcggaaattcgtgagccagcaggctggggtgataacccaatgaataagccaaaggatgacgataagtctcaagcaactcctgaagtgaaagaggaagagaaagcaacggattctgcgaatgccgcagagcaagttacttctcaagattctgcttcaagtgaagttccagaaaagaaagactctgaataa

SEQ ID NO: 3735 - protein, 662 aa, Vibrio parahaemolyticus
MSDMAKNLILWLVIAVVLMSVFQSFGPGESNGRTVDYTTFVQEVGQGQIQEATFKDGEISFVRRGGGAKMVTYMPVYDQKLLDDLINQNVKVQGTPPEEQSLLGTIFISWFPMILLIGVWIFFMRQMQGGGGKGAMSFGKSKARMMSEEQIKTTFADVAGCDEAKEDVKELVDYLRDPSRFQKLGGKIPTGVLMVGPPGTGKTLLAKAIAGEAKVPFFTISGSDFVEMFVGVGASRVRDMFEQAKKAAPCIIFIDEIDAVGRQRGAGVGGGHDEREQTLNQMLVEMDGFEGNEGIIVIAATNRPDVLDPALLRPGRFDRQVVVGLPDVRGREQILKVHMRKVPLAGDVEPSLIARGTPGFSGADLANLVNEAALFAARGNKRNVSMVEFELAKDKIMMGAERRSMVMSEETKESTAYHEAGHAIVGRLVPEHDPVYKVSIIPRGRALGVTMYLPEQDRVSMSRQHLESMISSLYGGRLAEELIYGPEKVSTGASNDIERATDIARKMVTQWGFSEKLGPLLYAEDEGEVFLGRSVTQTKHMSDDTAKLIDDEVRQIIDRNYDRAKKILEDNMDIMHAMKDALMKYETIDARQIDDLMERKAEIREPAGWGDNPMNKPKDDDKSQATPEVKEEEKATDSANAAEQVTSQDSASSEVPEKKDSE

SEQ ID NO: 3736 - DNA, 1905 bp, Pseudomonas syringae (pv. tomato)
  CDS (1)..(1905)
atggcaaagaatttgatcctgtggttgatcatcgcggctgtccttgtgacggtgatgaacaacttctcaagccctaacgagccgcagaacttcaactattccgagttcatccagcaggtcaaggatggcaaggtcgagaaggtttctgtcgatggctacgtgatcacgggcaagcgcagtgacggtgacaccttcaagaccattcgtccgaacattccggacaatggcctgatcggcgatctggtcagcaacaacgttgtggtcgaaggcaagcagcccgaacagcagagcatctggacccagttgctggtcgccagcttcccgattctggtgatcatcgcggtcttcatgttcttcatgcgccagatgcagggcggagcgggcggcaaaggcggcccgatgagctttggcaaaagcaaggcgcgtctgttgtctgaagatcaggtcaagaccaccctggcggatgttgcagggtgtgacgaagccaaggaagaagtcggcgagctcgtcgagttcctccgtgatcctggcaagttccagcgtctgggtggtcgaattccgcgcggcgtgctgatggttggtcctccgggtaccggcaagacgttgattgccaaggcgattgccggcgaagccaaagtgccgttcttcacgatttccggttccgacttcgtcgaaatgtttgtgggtgtcggtgcaagccgcgtccgtgacatgttcgaacaagccaagaaacacgcgccctgcatcatcttcatcgacgaaatcgatgcggtcggtcgtcatcgtggtgccggcatgggtggtggtcacgacgagcgcgagcagaccctcaaccagttgctggtagagatggacggctttgaaatgaatgacggcatcatcgtcattgccgcgaccaaccgtcctgacgtactggaccctgcattgctgcgtccaggccgtttcgaccgtcaggttgtggtgggtctgccggacattcgtggtcgcgagcagattctcaaggtccacatgcgcaaagtgcctatgggtgaggacgtcaatccaggcgttatcgctcgcggtactccgggtttctccggtgccgatctggccaacctggtcaacgaagcgtcgctgttcgctgcgcgctccggcaagcgtgtcgtcgaaatgaaggaattcgaactggccaaggacaagatcatgatgggcgccgagcgcaaatcgatggtcatgtccgacaaggaaaaacgcaacacggcttaccacgaggcgggtcacgccatcgtcggtcgtctggtgcccgagcatgatccggtctacaaggtgtcgatcattcctcgcggccgcgctttgggtgtgaccatgttcctgcccgaagaagaccgttacagcctgtccaagcgtgcgttgatcagccagatatgctcgttgtacggcggtcgtatcgctgaagaaatgaccctgggctttgatggcgtcacgacgggtgcgtccaacgacatcatgcgtgccagccagattgcccggaacatggtcaccaaatggggcctgtctgaaaagctgggtccattgatgtactctgaagacgaagatggtggttacctggggcgcggcggcagccagaattccagtgtttccggcgacaccgccaagctgatcgactcggaagtacgcagcatcatcgaccactgctacggcaccgccaagcagctgctgacggacaatcgcgacaagcttgaagcgatggccgacgcgttgatgaagtacgagaccatcgatgctgatcagatcgatgacatcatgaccggtcgcccaccgcgcgagccgcgtgactgggatggcggttcaggtaccaacggtactccgatcacacctgatcctcgtccggaaacgcctattggcggtcctgctgctgagcattaa

SEQ ID NO: 3737 - protein, 634 aa, Pseudomonas syringae (pv. tomato)
MAKNLILWLIIAAVLVTVMNNFSSPNEPQNFNYSEFIQQVKDGKVEKVSVDGYVITGKRSDGDTFKTIRPNIPDNGLIGDLVSNNVVVEGKQPEQQSIWTQLLVASFPILVIIAVFMFFMRQMQGGAGGKGGPMSFGKSKARLLSEDQVKTTLADVAGCDEAKEEVGELVEFLRDPGKFQRLGGRIPRGVLMVGPPGTGKTLIAKAIAGEAKVPFFTISGSDFVEMFVGVGASRVRDMFEQAKKHAPCIIFIDEIDAVGRHRGAGMGGGHDEREQTLNQLLVEMDGFEMNDGIIVIAATNRPDVLDPALLRPGRFDRQVVVGLPDIRGREQILKVHMRKVPMGEDVNPGVIARGTPGFSGADLANLVNEASLFAARSGKRVVEMKEFELAKDKIMMGAERKSMVMSDKEKRNTAYHEAGHAIVGRLVPEHDPVYKVSIIPRGRALGVTMFLPEEDRYSLSKRALISQICSLYGGRIAEEMTLGFDGVTTGASNDIMRASQIARNMVTKWGLSEKLGPLMYSEDEDGGYLGRGGSQNSSVSGDTAKLIDSEVRSIIDHCYGTAKQLLTDNRDKLEAMADALMKYETIDADQIDDIMTGRPPREPRDWDGGSGTNGTPITPDPRPETPIGGPAAEH

SEQ ID NO: 3738 - DNA, 1914 bp, Pseudomonas putida (strain KT2440)
  CDS (1)..(1914)
atgaacgacatggcaaagaatctgatcctgtggttgatcatcgcagctgtcctggtgacagtgatgaacaacttctccagccctaacgagccgcagaccctcaactactccgacttcatccagcaggtcaaggatggcaaggtcgagcgtgtgaccgtcgatggctacatcattactggcaagcgcaccgatggcgacaacttcaagactgtgcgcccggccatcaccgacaatggcctgatcggcgatctggtcgacaaccacgtggtcgtcgaaggcaagcagcctgagcaacagagcatctggacgcagttgctggtggcgagcttcccgatcctggtgatcattgccgtgttcatgttcttcatgcgccagatgcaaggtggcgcgggcggcaagggcgggccgatgagcttcggcaagagcaaggcgcgcctgctgtccgaagaccaggtcaagaccacgctggctgacgttgcgggctgcgacgaggccaaggaagaggttggcgagctggtcgagttcctgcgcgatccgggcaagttccagcgcctgggtggccgtatcccgcgcggtgtgctgatggtcggcccacccggtaccggtaagaccctgctggccaaggccatcgcgggcgaagcgaaagtaccgttcttcaccatttccggttcggacttcgtggaaatgttcgtgggtgtcggtgccagccgtgtgcgcgacatgttcgagcaggccaagaagcacgccccgtgcatcatcttcatcgacgaaatcgacgccgttggtcgccatcgtggcgccggcatgggcggcggtcacgacgagcgtgagcaaaccctcaaccagttgctggtggagatggacggcttcgagatgaatgatggcatcatcgtcatcgccgccaccaaccgtccggatgtgctcgaccctgcgctgctgcgccccggccgcttcgaccgccaggtggtggttggcctgccggacatccgtggtcgcgagcagatcctcaaggtgcacatgcgcaaggtgccgattggcgagaacgtcaacccggcggtcatcgcgcgtggtaccccaggcttctccggcgccgacctggccaacctggtcaacgaggcttcgctgtttgccgcgcgttccaacaagcgcctggtcgaaatgaaagagttcgagctggccaaggacaagatcatgatgggcgccgagcgcaagaccatggtcatgtccgaaaaggaaaagagaaacactgcctatcacgaggctggccacgccattgtcggtcgcctggtgcctgagcacgacccggtctacaaggtttcgatcatcccgcgtggtcgtgccttgggtgtgaccatgttcctgccggaagaagaccgctacagcctctccaagcgtgcgctgatcagccagatctgctcgctgtatggcggccgtatcgccgaggagatgaccttgggcttcgatggcgtgaccactggcgcgtccaacgacatcatgcgcgccagccagctcgctcgtaacatggtgaccaaatggggcctgtccgagaagctcggcccgctgatgtatgcagaggaagagggcgaggtgttcctcggccgcagtgccggtagccagcatgccagcgtgtccggcgagactgccaaattgatcgactccgaggtgcgcagcatcatcgatcagtgctacgccactgccaagcagttgctgatcgacaaccgcgacaagctcgaggcgatgaccgaagcgctgatgaagtacgagaccatcgatgccgatcagattgacgacatcatggctgggcgcacaccacgtgagccacgtgattgggacgatgacaagcactcgggcacgcctgcggcccaggatgagcgtccggaatcgccaatcggcggcccagcggctgaacactaa

SEQ ID NO: 3739 - protein, 637 aa, Pseudomonas putida (strain KT2440)
MNDMAKNLILWLIIAAVLVTVMNNFSSPNEPQTLNYSDFIQQVKDGKVERVTVDGYIITGKRTDGDNFKTVRPAITDNGLIGDLVDNHVVVEGKQPEQQSIWTQLLVASFPILVIIAVFMFFMRQMQGGAGGKGGPMSFGKSKARLLSEDQVKTTLADVAGCDEAKEEVGELVEFLRDPGKFQRLGGRIPRGVLMVGPPGTGKTLLAKAIAGEAKVPFFTISGSDFVEMFVGVGASRVRDMFEQAKKHAPCIIFIDEIDAVGRHRGAGMGGGHDEREQTLNQLLVEMDGFEMNDGIIVIAATNRPDVLDPALLRPGRFDRQVVVGLPDIRGREQILKVHMRKVPIGENVNPAVIARGTPGFSGADLANLVNEASLFAARSNKRLVEMKEFELAKDKIMMGAERKTMVMSEKEKRNTAYHEAGHAIVGRLVPEHDPVYKVSIIPRGRALGVTMFLPEEDRYSLSKRALISQICSLYGGRIAEEMTLGFDGVTTGASNDIMRASQLARNMVTKWGLSEKLGPLMYAEEEGEVFLGRSAGSQHASVSGETAKLIDSEVRSIIDQCYATAKQLLIDNRDKLEAMTEALMKYETIDADQIDDIMAGRTPREPRDWDDDKHSGTPAAQDERPESPIGGPAAEH

SEQ ID NO: 3740 - DNA, 2238 bp, Lactobacillus plantarum
  CDS (1)..(2238)
atgaacaatcgacgcaatggactctttcgtaatagcttattttacattttgatgtttctgagcttgatgggaattatctactttttctttggcggtaattccggctcacaaacgcaaaatattcgttatagcgaatttgtcaaacaattagataagaataacgttaaaaacgttagtatccagcctagtggcggcgtctacaaggtaactggttcataccggaaagcacggacgacttcttctgcaaacgcccttggtatcaagagcgcatctacaaagacgacgtcattttcaacaacgatgttggaaaacaactccacggttgaccaagtttctaagttggcggctaagcatgacgtcaaggttacggctaaggccgaagaatctagcggcatctgggtcacgttattaatgtacatcgcgccagtcatcctgatgttattcctcttctatatgatgatgggacaagcaggacaaggcggcgggaacaaccgggttatgaactttggtaagaccaaagcaaaaccagctgatagtaagcaaaataaggttcgtttctcagatgttgccggtgaagaagaagaaaagcaagaattggtcgaagttgtcgaattcttgaaagatccgcggaagttcgtgtccttaggtgcacggatcccatctggggtactcctcgaggggcctcctggtactggtaaaacgttgcttgctaaagcggttgccggtgaagctggtgtcccattcttctcaatctctggttctgacttcgtcgaaatgttcgtcggggttggtgctagccgggttcgggacttattcgaacaagctaagaagaacgccccatctatcatctttattgatgaaattgatgcggttggtcggcaacgtggcaatggtatgggcggcggtcatgatgaacgtgaacaaaccctgaaccaattgttagttgaaatggatggttttacaggtaatgaaggtgtcatcgtcatggcggcgacaaaccgttctgatgtacttgatcctgccttacttcgtccaggtcgtttcgaccggaagatcttagttggtcgtccagacgtcaagggtcgggaagccatcttaaaagtccatgctaagaataagccattagcagctgacgttgatttgaaggaaattgccaagcaaacacctggattcgtgggtgccgatttggaaaacttattgaacgaagcggccttgttagctgcccgtcgtaataagaagcaagttgacgctgcggatctcgatgaagcagaagatcgggtcattgccggacctgctaagcatgatcgcgttgtgaataagcatgaacgggaaaccgtggcttatcacgaagctggtcatacgattgttggattggtcttgaatgatgcacgggtcgttcataaagtaacgatcgtgccacggggtcgtgctggcggttatgccatcatgttaccacgtgaagatcagatgttgatgtcgaaacgtgatgcgaaggaacaaatggctggtttaatgggtggtcgtgctgctgaagaaattatctttggggcgcaatcatcaggtgcttctaatgactttgaacaggcaacgcaaattgcccgggcaatggttactcaatatgggatgagtgaaaagcttggtcctgttgagttagaaaatgccaaccaacaagcagcttaccaacagggtatgggtgcgagtgccttttcacaacatacggcacaattgatcgatgatgaagtccggcgtttgagccaagaagcgcatcaaactgctacggatattatcgagtcacaccgtgaacagcataagttaattgcggaagccttattgaagtacgaaacattggatgaaaagcaaattctcagtctgtttaagactggtaagatgcctgaaaaggatagtaatgaatttccaagtgagaaagcagctaccttcgaagaatccaaacgtgaattggaacgtcgcgaagctgaaaagcacgcgcaaaaccaaagtgcggatgataagcaagcagactcagctgacactacgactaatgtgagtgttgctgaaccaagtttcccaagtgaatcggatgctagttcagaagttagtgctgacagtagtgtcaattcaacagctaattcagccactgaatcagctaccgacagtgatgtcgcaacttcagccaccggtttaccaaatgctgaaagtgccacaccatcatcgcaggatgatactaattcgcaagcatag

SEQ ID NO: 3741 - protein, 745 aa, Lactobacillus plantarum
MNNRRNGLFRNSLFYILMFLSLMGIIYFFFGGNSGSQTQNIRYSEFVKQLDKNNVKNVSIQPSGGVYKVTGSYRKARTTSSANALGIKSASTKTTSFSTTMLENNSTVDQVSKLAAKHDVKVTAKAEESSGIWVTLLMYIAPVILMLFLFYMMMGQAGQGGGNNRVMNFGKTKAKPADSKQNKVRFSDVAGEEEEKQELVEVVEFLKDPRKFVSLGARIPSGVLLEGPPGTGKTLLAKAVAGEAGVPFFSISGSDFVEMFVGVGASRVRDLFEQAKKNAPSIIFIDEIDAVGRQRGNGMGGGHDEREQTLNQLLVEMDGFTGNEGVIVMAATNRSDVLDPALLRPGRFDRKILVGRPDVKGREAILKVHAKNKPLAADVDLKEIAKQTPGFVGADLENLLNEAALLAARRNKKQVDAADLDEAEDRVIAGPAKHDRVVNKHERETVAYHEAGHTIVGLVLNDARVVHKVTIVPRGRAGGYAIMLPREDQMLMSKRDAKEQMAGLMGGRAAEEIIFGAQSSGASNDFEQATQIARAMVTQYGMSEKLGPVELENANQQAAYQQGMGASAFSQHTAQLIDDEVRRLSQEAHQTATDIIESHREQHKLIAEALLKYETLDEKQILSLFKTGKMPEKDSNEFPSEKAATFEESKRELERREAEKHAQNQSADDKQADSADTTTNVSVAEPSFPSESDASSEVSADSSVNSTANSATESATDSDVATSATGLPNAESATPSSQDDTNSQA

SEQ ID NO: 3742 - DNA, 1875 bp, Clostridium tetani
  CDS (1)..(1875)
atgtttgataaaaataaaaaagatccaaactatgataataaaaagttcaaatatattatttattatgtaattgctgtaactatagtggtatatttaattaatgactatgtagttaagactcaaactaaaaatataaaatatactaactttttaaatatgataacagaacagcaaataaaagaagtaaaatttgctaaagataaaattataatatatccaaaagaaggtataggatttaacgaaaagatattatatacaggcaaattcaataatgatgaacaattattagaaaaactaaataaagctaacattacttatgattttataattcctgaacaggatagccctttaaagagttttatatttaattggttgatgccttttgctatacttatggctttagagcgtattttcttttcaagattaaataagaaaatgggaagcggagtaatgtcttttggtaaaaatactgctaaaatatatgcagaaaacgaaacaggagttacttttaaagatgtagcaggccaggaagaagcaaaagaatctttaatggagatagtagattttctgcataactctgataaatatacgggaataggtgcgaaacttcctaagggtgctttattagtaggtcctccgggaacaggtaaaacattacttgcaaaagcagtagcaggagaagctaaagtaccattcttttcaatatcaggttcgggatttgttgaaatgtttgtaggtatgggagcagcaagagttagggatttatttgaacaagcacaagaaaaagcaccatgtataatttttatagatgagatagatgctataggaaaaagcagagacggacacgtttctggaaacgatgaaagagagcaaactctaaatcaacttttagctgaaatggatggatttgattcctcaaaaggagttgtaatacttgcagctacaaatagaccagaagtattagataaagcattattaagacctggaagatttgacagaagggttattgtagataggccagacttaaagggaagagaagagatattaaaagttcatgcaaagggagtaaaaatggatgaaaaagtagacttaacatccatagctaaggctacccctggagctgtaggagctgatttagccaatattataaatgaggctgcactaagagctgtaaaaataaatagagacaaagtttttcaaggagatttagaagaagctgttgaaataataatagcgggaaaagagaagaaagatagaataatgtcaccagaggaaaagaaaatagtagcttttcatgaagtagggcatgctttggttgcagctcttttacctaatacggatccagttcataaaataaccatagttccaagaaccatgggagctttgggatacactatgcagttacctgacacagaaaagtatttaatatctaaagaagaaatgcttgataagatatgtgtaatgctagggggaagagcagctgaagaggttcaatttaatagaatatccacaggagcctctaatgacatagaaaaagctacagaaactgcaagaaacatggttactgtatatggaatgtctgaaagatttgatatgatgggattagaatctataagtaatagatatttagatggaagacctgttagaaattgtagtaatgaaacatcagctattatagatgatgaggttttaaaaataataaagaactctcatgaaaagtctataaatttgttagaagaaaataaagaacttttaaatagaatagcagaaacacttttagaaaaagagactataactggtgaagaatttatgaagatagtagaaggaaaagatatagaaatcgaagatttagaaactgttatccaagagccataa

SEQ ID NO: 3743 - protein, 624 aa, Clostridium tetani
MFDKNKKDPNYDNKKFKYIIYYVIAVTIVVYLINDYVVKTQTKNIKYTNFLNMITEQQIKEVKFAKDKIIIYPKEGIGFNEKILYTGKFNNDEQLLEKLNKANITYDFIIPEQDSPLKSFIFNWLMPFAILMALERIFFSRLNKKMGSGVMSFGKNTAKIYAENETGVTFKDVAGQEEAKESLMEIVDFLHNSDKYTGIGAKLPKGALLVGPPGTGKTLLAKAVAGEAKVPFFSISGSGFVEMFVGMGAARVRDLFEQAQEKAPCIIFIDEIDAIGKSRDGHVSGNDEREQTLNQLLAEMDGFDSSKGVVILAATNRPEVLDKALLRPGRFDRRVIVDRPDLKGREEILKVHAKGVKMDEKVDLTSIAKATPGAVGADLANIINEAALRAVKINRDKVFQGDLEEAVEIIIAGKEKKDRIMSPEEKKIVAFHEVGHALVAALLPNTDPVHKITIVPRTMGALGYTMQLPDTEKYLISKEEMLDKICVMLGGRAAEEVQFNRISTGASNDIEKATETARNMVTVYGMSERFDMMGLESISNRYLDGRPVRNCSNETSAIIDDEVLKIIKNSHEKSINLLEENKELLNRIAETLLEKETITGEEFMKIVEGKDIEIEDLETVIQEP

SEQ ID NO: 3744 - DNA, 1812 bp, Clostridium tetani
  CDS (1)..(1812)
atgaacaataaaaagttttcaagtgcaacggcctgggttattatttttgtttttgtgatttttgcatctttgtatttagctagaaacaatgaaacagcaacaactattacattcaataagtttcaaaagcattggattaataatgagataaaaagtttcgaagtaaaagaagataaaatgactgtgtcaggtaatttgaaggacgggagtcaatatgaaactatagttccctttgagaggttaaatcaatttataagtgcccatgataaaaatggagaagttatagaaaaatatgcattacctgcaaaaacacctatgtggttaaattggataccgacggccttagttattttaatgtttgtgatattttggtttatgtttatgcaacaatcgcaaggtggcggtggaaatagaaatgttatgaactttggtaaaagtcgagccaagatggcaacgccagacaagcagaaagtcacttttaacgatgtggcaggtgcagaggaagaaaaagaagagttagcagaaattgtagattttctaaaacagcctaaaagatatattgaaatgggagctagaatacctaagggagtgttactagtaggtcctccaggtacaggtaaaactttactagcgaaagctatagcaggtgaagcaggagttccattttttagtatatcaggttcagattttgtggaaatgtttgttggggtaggagcatcaagggttagagatttatttgatcaagctaaaaaaaattcaagatgtataatatttatagatgaaattgatgcagttggaagacaaagaggagcaggattaggtggaggtcatgatgaaagagagcaaacactaaatcagcttttagttgaaatggatggatttggagttaacgaaggaattataatggttgcagcaactaatagaccagatattttggacccagccttattaagaccgggaaggtttgatagacaaatattagttggagctccggacgttagaggcagagaagaaatattaaaagtacattcaagaaataaacctttatctgaggaagtaaaactagatgtattagctaaaagaactccaggattcacaggtgctgatttggaaaacttaatgaatgaatccgcattattagcagtaagaaaagataaaaaacaaatagacatggaagaattagaagaagcagtaactagagtaatagcaggacctgaaaagaaaagtagagtcatagatgaagaggatagaagattgacggcttatcatgaagcagggcatgctgtagttatgaaattattacctcatgcagatccagtacatcaaataagtatagtacctagaggtatggcaggaggatatactatgcatcttcctgaaaaagatagagcgtatatgtcaaaatctaagttagaagaggaaatagtaggattactgggaggaagagtagcggaaaaactaataataggagatataagtactggagcacaaaatgacatcgaaagagcaactactatagccaagaaaatgattatggattatggtatgagtgaagtgcttggtccaatagcatttggaagtgggcatgatgaggtattcctaggtagagactttggaaaatctaaagactttagtgaagaagtagcatctaagatagataaagaagttaagggtataatagacacagcatatgatagagcccaaaacttactaatggaaaatataaataaacttcatgcagtagccaaagagcttctagaaaaagaaaaattagaagcagaagaatttgaagaaatatttgaaagtaattaa

SEQ ID NO: 3745 - protein, 603 aa, Clostridium tetani
MNNKKFSSATAWVIIFVFVIFASLYLARNNETATTITFNKFQKHWINNEIKSFEVKEDKMTVSGNLKDGSQYETIVPFERLNQFISAHDKNGEVIEKYALPAKTPMWLNWIPTALVILMFVIFWFMFMQQSQGGGGNRNVMNFGKSRAKMATPDKQKVTFNDVAGAEEEKEELAEIVDFLKQPKRYIEMGARIPKGVLLVGPPGTGKTLLAKAIAGEAGVPFFSISGSDFVEMFVGVGASRVRDLFDQAKKNSRCIIFIDEIDAVGRQRGAGLGGGHDEREQTLNQLLVEMDGFGVNEGIIMVAATNRPDILDPALLRPGRFDRQILVGAPDVRGREEILKVHSRNKPLSEEVKLDVLAKRTPGFTGADLENLMNESALLAVRKDKKQIDMEELEEAVTRVIAGPEKKSRVIDEEDRRLTAYHEAGHAVVMKLLPHADPVHQISIVPRGMAGGYTMHLPEKDRAYMSKSKLEEEIVGLLGGRVAEKLIIGDISTGAQNDIERATTIAKKMIMDYGMSEVLGPIAFGSGHDEVFLGRDFGKSKDFSEEVASKIDKEVKGIIDTAYDRAQNLLMENINKLHAVAKELLEKEKLEAEEFEEIFESN

SEQ ID NO: 3746 - DNA, 2091 bp, Bacteroides thetaiotaomicron
  CDS (1)..(2091)
atgcccaagttcaatctgaactggctatatatgattattgccctcatgcttctcggcctttggtggagcagcgattcaagaggaagcggaagtaaagtcgttccttacagcgacttccagaagtatgtcactaacggctacatcagcaaagtactgggctctgagaaaactctcgaagctcatgtcaaaccgaatgccgtaggtgcaatattcggtgcggactccaccaaagtaggaagaaacccaattattaccagtaaccctccttctaaggacaggctggataaatttctgcaggacgaaaaagcagccggtcattttgacggaatagcagattaccctgccgattcggatattttcccggcaatcctgattaatattcttccgctggttttattaatcgccctgtggatattcttcatgcgtcgtatgagcggcggtggcggcggtggtgccggcggtgtattcaatgtaggaaaatccaaagcccagcttttcgaaaagggaggctccatcaagattacattcaaggacgtagccggcctggcggaagccaaacaggaggtagaagaaatcgtagagtttctgaaagaacctcagaagtatactgacctaggaggtaagattcccaaaggcgcattgctcgtaggccctccgggaaccggtaagacattgcttgcgaaggctgttgccggtgaagcaaacgttccgttcttctcactggcaggttctgacttcgtagaaatgtttgtcggtgtaggtgcttcccgcgtacgtgacctgttcaagcaagctaaagaaaaagctccttgtattgtctttatcgacgaaattgacgcggtaggccgtgctcgtggcaaaaaccctgcaatgggtggaaatgatgagcgtgaaaacaccctgaatcagttgctgactgaaatggacggcttcggctccaacagtggtgtgattatccttgccgctaccaaccgtgtggacgtacttgacaaggcattgcttcgtgccggacgtttcgaccgtcagatacacgtagacctgcccgaccttaacgaacgtaaagaagtattcggcgtacacctgcgtccgatcaagatagacgatacagtagatgtagatttgctagcacgtcagactccgggattctccggtgcggacattgcgaatgtctgcaatgaagctgccttgatcgcagcccgtcacggaaagaaatttgtaggcaagcaggattttctggatgcggtagaccgtatcatcggtggtctggaaaagaagaccaagattaccacagaagcggaaagacgctcgattgccttgcatgaagcaggacacgcctctatctcgtggttgctggaatatgcaaatccattgatcaaggtaacgattgttccccgcggacgtgcattgggtgctgcctggtatctgccggaagaacgtcagatcactaccaaagagcaaatgcttgacgaaatgtgcgctaccctcggaggacgtgcagccgaagacctgtttatcgggcgcatctctaccggtgctatgaacgacctcgaaagagttacgaaacaagcatacggcatgattgcttatttaggtatgagtgacaaactacccaacttatgctattataataatgaggaatattctttcaaccgcccgtatagcgaaaagacagccgaactcatcgatgaagaagtgaaacggatggtgaacgagcaatatgaacgtgccaagaagattttgtccgaacatatggaaggacacaatgaactggctcagttactgatcgacaaagaagtgatctttgccgaagacgttgaacgtattttcggtaaacgcccgtgggcatcccgctcggaagaaatcatggctgccaaagaaagccaggatgctgccagagcggaaagagaacttgccgagaaactgaaagcagaagaacaagaaatcaaagaagaggaagctaaaaattctgctcaggaagaagcaactacagaaacgaaaatcactgcggaaggaaaaaaagtaaccgtagaaggaaaagttactatagaagcaaaatccaatgagaaagaacaaactaccgaatctaaataa

SEQ ID NO: 3747 - protein, 696 aa, Bacteroides thetaiotaomicron
MPKFNLNWLYMIIALMLLGLWWSSDSRGSGSKVVPYSDFQKYVTNGYISKVLGSEKTLEAHVKPNAVGAIFGADSTKVGRNPIITSNPPSKDRLDKFLQDEKAAGHFDGIADYPADSDIFPAILINILPLVLLIALWIFFMRRMSGGGGGGAGGVFNVGKSKAQLFEKGGSIKITFKDVAGLAEAKQEVEEIVEFLKEPQKYTDLGGKIPKGALLVGPPGTGKTLLAKAVAGEANVPFFSLAGSDFVEMFVGVGASRVRDLFKQAKEKAPCIVFIDEIDAVGRARGKNPAMGGNDERENTLNQLLTEMDGFGSNSGVIILAATNRVDVLDKALLRAGRFDRQIHVDLPDLNERKEVFGVHLRPIKIDDTVDVDLLARQTPGFSGADIANVCNEAALIAARHGKKFVGKQDFLDAVDRIIGGLEKKTKITTEAERRSIALHEAGHASISWLLEYANPLIKVTIVPRGRALGAAWYLPEERQITTKEQMLDEMCATLGGRAAEDLFIGRISTGAMNDLERVTKQAYGMIAYLGMSDKLPNLCYYNNEEYSFNRPYSEKTAELIDEEVKRMVNEQYERAKKILSEHMEGHNELAQLLIDKEVIFAEDVERIFGKRPWASRSEEIMAAKESQDAARAERELAEKLKAEEQEIKEEEAKNSAQEEATTETKITAEGKKVTVEGKVTIEAKSNEKEQTTESK

SEQ ID NO: 3748 - DNA, 2103 bp, Staphylococcus epidermidis
  CDS (1)..(2103)
atgcagaaagcttttcgcaatgtgctagttatcgcaattattggcgttattatatttggcctcttttcatttttaaatggaaatgggaatatgccaaaacaacttacatatactcagtttgttaataagttgaataaaggcgatttaaaaactttagaaattcaaccagagcaaaacgtatatatggtaagtggtaaaacaaaaaaagatgaagattactcatcgacaattttatataacaatgaaaaagatttacaaaaaatcacagatacagctaagaaacaagataatcttaaatttacagttaaagaagaagaaaaacaaagtgtattcgttagtattttaacgacactgattcctgtattaatcattgcattattatttattttcttccttagccaagcccaaggtggcggcggcggtggtcgtatgatgaactttggaaaatccaaagctaagatgtacgacagtaataaacgtcgagttcgtttctcagatgtagcaggagctgacgaagagaaacaagaattaatagaaattgtagatttcttaaaagataacaagaaatttaaacaaatgggttcaagaattccaaaaggtgtcttacttgttgggcctccaggtacaggtaaaacattattagcacgtgcggttgcaggtgaagctggtgcaccattcttctcaattagtggatctgacttcgttgagatgtttgttggtgttggtgcgagtcgtgttcgtgatttatttgaaaatgctaagaaaaatgccccatgtatcatttttattgatgaaattgatgctgttggacgtcaacgtggtgcaggtgtaggtggcggtcatgatgagcgtgaacaaacattaaaccaactattagttgagatggatggttttggagaaaatgaaggtattattatgattgcggctacaaaccgcccagatatcttagaccctgcattgttacgtcctggtcgttttgatagacaaattcaagttggacgaccagatgttaaaggtcgtgaagcaattcttcatgtgcatgcgaaaaataaacctcttgatgaaacagtagatttaaaagctatttctcaaagaacgccaggtttttctggtgcagacttagaaaacttgctaaatgaggcatctttaattgcagcacgtgagggtaaaaataaaattgatatgcgcgatattgaagaagcaactgaccgtgttattgcaggtccagctaaaaaatctcgtgtaatttctgaaaaagaacgtaatattgtagcgcatcacgaagcaggtcatactatcatcggtatggtgcttgatgaagctgaaattgtacacaaggtaacaattgtccctcgtggacaagcaggcggttatgcaatgatgttaccaaaacaagatcgcttcttaatgacagaaccagaattactcgacaaaatatgtggtttattaggtggacgagtatctgaggatattaactttggtgaagtatcaacaggtgcttcgaatgactttgaacgagcaacgcaaattgcaagatctatggttacagaatatggtatgagtaagaaattaggaccattacaattctcaagcaatagtggtggacaagtattccttggtaaagatatgcaaggtgagccgaattattctggtcaaattgcttatgaaattgacaaagaagttcaacgaattgttaaagagcaatatgaacgttgtaaacaaatcttgttagaacatgaagaacaacttaagttaattgctaaaacactactttcagaagaaacattagttgcagaacaaattcaatcattattctatgatggtgttttaccagaagtagattatgactctgcaaaagttgtgaaaaatgaaaatagtgattatagtgatggaaagtatggaaaatcatacaacgacattcgtaaagaacagttagaagatgacgataaagaagatgatgacaaccatgaaaaagatgaagtaaaccaagacaacacagacagagaagctgataatacttcacatacgaatgaaccaggtcatcaacaatctccgaacatcgataaaccatacaatcctaacgatccaaatcatagacaatag

SEQ ID NO: 3749 - protein, 700 aa, Staphylococcus epidermidis
MQKAFRNVLVIAIIGVIIFGLFSFLNGNGNMPKQLTYTQFVNKLNKGDLKTLEIQPEQNVYMVSGKTKKDEDYSSTILYNNEKDLQKITDTAKKQDNLKFTVKEEEKQSVFVSILTTLIPVLIIALLFIFFLSQAQGGGGGGRMMNFGKSKAKMYDSNKRRVRFSDVAGADEEKQELIEIVDFLKDNKKFKQMGSRIPKGVLLVGPPGTGKTLLARAVAGEAGAPFFSISGSDFVEMFVGVGASRVRDLFENAKKNAPCIIFIDEIDAVGRQRGAGVGGGHDEREQTLNQLLVEMDGFGENEGIIMIAATNRPDILDPALLRPGRFDRQIQVGRPDVKGREAILHVHAKNKPLDETVDLKAISQRTPGFSGADLENLLNEASLIAAREGKNKIDMRDIEEATDRVIAGPAKKSRVISEKERNIVAHHEAGHTIIGMVLDEAEIVHKVTIVPRGQAGGYAMMLPKQDRFLMTEPELLDKICGLLGGRVSEDINFGEVSTGASNDFERATQIARSMVTEYGMSKKLGPLQFSSNSGGQVFLGKDMQGEPNYSGQIAYEIDKEVQRIVKEQYERCKQILLEHEEQLKLIAKTLLSEETLVAEQIQSLFYDGVLPEVDYDSAKVVKNENSDYSDGKYGKSYNDIRKEQLEDDDKEDDDNHEKDEVNQDNTDREADNTSHTNEPGHQQSPNIDKPYNPNDPNHRQ

SEQ ID NO: 3750 - DNA, 2028 bp, Oceanobacillus iheyensis
  CDS (1)..(2028)
atgagtcaggtatttcgtaatgccttattctggttactcatattctttgtaatcattggagttattggagtaatcaacaatcaaggtgaagaaagagaacagtatgatgtagagcaatttataagtgctttaaataatggcgaaatcgaagaactcgtttttcagccatcacatggaattattcgtctaacagggacactaactgatggagaaacagaatttgttgctcaggttcctgataataatgacctcgtgtcacaaattactgatactgctagagaacaaagccaattaaccgttatggaagaagaacagccaagtccatggcttacattcctaactggaattattccgttcttattaatcggtttattcttcttatttatacttagtcaggcacaaggaggcggcggtggcggccgtgtaatgaacttcggtaagagtaaagcaaaaatgtactctgaagataagaaaaaggttcgctttaaagatgtcgctggtgcagatgaagaaaaacaagagcttgttgaagtagttgaattcttaaaagacccacgcaaattctcgcaagtaggagcccgtatacctaaaggggtacttctagttggacctcctggtacaggtaaaacgttacttgctcgtgccgttgctggagaagctggaacaccgttcttctctattagtggttcggactttgtggaaatgtttgtaggtgtcggtgcttctcgtgtacgtgacctatttgaaaacgcgaaaaagaatgctccatgtattatctttattgatgaaattgatgctgtagggcgtcaacgtggtgcagggcttggtggcggtcacgatgaacgtgaacaaacacttaaccaattactagttgaaatggacgggtttggagcaaatgaaggtattattattattgccgctacaaaccgtgcggatatattagaccctgcattattacgtccgggtcgtttcgatagacaaataatggttgatcgtcctgatgtgaaaggtcgtgaagctgtactaggtgtacacgctcaaaacaaaccattagatgcaaatgtagatttaaaaacaatcgcaatgcgtactccaggtttctctggtgcagatttagagaacttacttaacgaagcggcgttaattgctgcgcgtgatgatcgcaagaaacttaaccagttagatattgatgaagcaattgaccgggttattgctggaccggctaagaagagccgtgttatttctcaaaaagagagaaatattgttgcatatcatgagagtggtcatacggttataggtatggttctggatgatgcggatgtcgtgcataaagttacgattgttccacgtggtcaagccggcggttatgctgtaatgctacctcgtgaagatcgatatttcatgacaaaaccagaactctttgacaagattactgggctacttggtggccgagtagcagaagaaattatctttggagaagtaagtacgggagcatctaatgacttccagcgtgctacaaatatcgctcataagatgattacagagtatggtatgagtgacaagatcgggccattgcaatttagcagtggtggtggaggaaacgtcttcttaggacgtgatatccaaaatgaacagacatactctgatgcaatagcacacgaaattgataaagaaatgcagtcatttatcaattactgctatgatcgtgcgaaaaccattcttacagaaaacaaagatcaattagaattgattgcgaagaccttgttagaggtagaaacgttagatgcaaaacaaattaaatctttatttgaagaaggaatattaccagagcctgaagaagaaacagatgagttgaaggtaaatattaattctaaagaagatgaagataaaaaagggatttcttatgaagaagcgaaacaaaagcttgatgatgaagaaaaatcggaacgagaagaaatagattctgaaaatacttccagcgatgaaactcaggacgatacttcagaggatcaaaaccctaaaaattaa

SEQ ID NO: 3751 - protein, 675 aa, Oceanobacillus iheyensis
MSQVFRNALFWLLIFFVIIGVIGVINNQGEEREQYDVEQFISALNNGEIEELVFQPSHGIIRLTGTLTDGETEFVAQVPDNNDLVSQITDTAREQSQLTVMEEEQPSPWLTFLTGIIPFLLIGLFFLFILSQAQGGGGGGRVMNFGKSKAKMYSEDKKKVRFKDVAGADEEKQELVEVVEFLKDPRKFSQVGARIPKGVLLVGPPGTGKTLLARAVAGEAGTPFFSISGSDFVEMFVGVGASRVRDLFENAKKNAPCIIFIDEIDAVGRQRGAGLGGGHDEREQTLNQLLVEMDGFGANEGIIIIAATNRADILDPALLRPGRFDRQIMVDRPDVKGREAVLGVHAQNKPLDANVDLKTIAMRTPGFSGADLENLLNEAALIAARDDRKKLNQLDIDEAIDRVIAGPAKKSRVISQKERNIVAYHESGHTVIGMVLDDADVVHKVTIVPRGQAGGYAVMLPREDRYFMTKPELFDKITGLLGGRVAEEIIFGEVSTGASNDFQRATNIAHKMITEYGMSDKIGPLQFSSGGGGNVFLGRDIQNEQTYSDAIAHEIDKEMQSFINYCYDRAKTILTENKDQLELIAKTLLEVETLDAKQIKSLFEEGILPEPEEETDELKVNINSKEDEDKKGISYEEAKQKLDDEEKSEREEIDSENTSSDETQDDTSEDQNPKN

SEQ ID NO: 3752 - DNA, 1944 bp, Yersinia pestis
  CDS (1)..(1944)
atgagtgacatggcgaaaaacctaattctctggttagttattgcagtcgtcttgatgtctgtattccagagctttggtcccagcgaatcgaatggccgtagagtggattactctactttcatgtccgacgtaacccaagatcaagtgcgtgaagcacgtatcaacggacgtgaaattaacgttagtaagaaagataacagcaaatatacgacttttattccggtcaatgatccaaagctgctagataccttattgactaaaaatgtgaaagttgttggtgagcctccagaagagcaaagcttactggcatctatctttatatcttggttcccaatgttgttattgattggggtctggatcttctttatgcgtcaaatgcagggcggcggtggcaaaggagcaatgtcctttggtaaaagcaaagctcgaatgctgacggaagatcagataaaaacctcgtttgctgatgttgctggttgtgacgaagcaaaagaagaggtcagtgaattagttgactacctgcgtgagccaagccgtttccagaaattgggcggtaaaattcctaaaggcgtgttgatggtaggccctccggggacgggtaaaaccttgctggcgaaagccattgcaggtgaagctaaagtgccattcttcacaatttctggttctgacttcgtagaaatgttcgttggtgtcggtgcatcccgtgtccgtgacatgtttgaacaggctaaaaaagctgcgccttgtatcatcttcattgatgaaatcgatgcggttggccgtcaacgtggcgctggtctgggtgggggtcatgacgaacgtgaacagacgctgaaccaaatgctggttgaaatggatggcttcgaaggtaatgaaggcatcattgttattgcggcaactaaccgcccagacgttctggatcctgcgttattgcgcccaggccgttttgaccgtcaggttgtcgttggtttacctgatgttcgtggtcgtgaacaaattcttaaagttcacatgcgccgtgtgccattagataccgatattgatgcttcagtgatcgctcgtggtactccaggcttctctggtgctgatttggcgaacctggtaaacgaagctgcattgtttgccgcccgcggtaacaaacgcgttgtttctatggttgagttcgaaaaagcgaaagacaaaattatgatgggtgcggaacgtcgctccatggtaatgacagaagcgcagaaagaatctacggcctaccatgaagcagggcatgccattattggtcgtttagtgccagagcatgatccagtgcataaagtgacgatcattcctcgtggccgtgctctgggtgtcaccttcttcttgccggaaggcgatgcaatcagtgctagccgccagaagttggaaagtcagatttctaccttgtacggtggtcgtcttgcagaagagatcatttatggcccggaaaaagtgtctaccggtgcttcgaatgatatcaaagtggcaacgtctattgcgcgtaacatggtaacgcagtggggcttctccgaaaaactggggccgttgctgtatgctgaagaagagggcgaaattttcctcggccgttctgtagcgaaagctaagcatatgtctgatgagactgcgcgtatcatcgatcaggaagttaaattacttgttgagcgtaactatcagcgtgcacgtaaattgctgttagaaaatatggatgttttacactccatgaaagacgcgttgatgaagtatgaaactattgatgcgccacagattgatgacttgatgaatcgcaaagaagttcgcccgccagcgggttgggacaatgtgaccaaaaataaatcatctgacaatgacaatacaccaacggcaaccatgccggctgatgaaccgaatactccaacgtcgggcaatacagtgtcagaacagttgggtgataagtaa

SEQ ID NO: 3753 - protein, 647 aa, Yersinia pestis
MSDMAKNLILWLVIAVVLMSVFQSFGPSESNGRRVDYSTFMSDVTQDQVREARINGREINVSKKDNSKYTTFIPVNDPKLLDTLLTKNVKVVGEPPEEQSLLASIFISWFPMLLLIGVWIFFMRQMQGGGGKGAMSFGKSKARMLTEDQIKTSFADVAGCDEAKEEVSELVDYLREPSRFQKLGGKIPKGVLMVGPPGTGKTLLAKAIAGEAKVPFFTISGSDFVEMFVGVGASRVRDMFEQAKKAAPCIIFIDEIDAVGRQRGAGLGGGHDEREQTLNQMLVEMDGFEGNEGIIVIAATNRPDVLDPALLRPGRFDRQVVVGLPDVRGREQILKVHMRRVPLDTDIDASVIARGTPGFSGADLANLVNEAALFAARGNKRVVSMVEFEKAKDKIMMGAERRSMVMTEAQKESTAYHEAGHAIIGRLVPEHDPVHKVTIIPRGRALGVTFFLPEGDAISASRQKLESQISTLYGGRLAEEIIYGPEKVSTGASNDIKVATSIARNMVTQWGFSEKLGPLLYAEEEGEIFLGRSVAKAKHMSDETARIIDQEVKLLVERNYQRARKLLLENMDVLHSMKDALMKYETIDAPQIDDLMNRKEVRPPAGWDNVTKNKSSDNDNTPTATMPADEPNTPTSGNTVSEQLGDK

SEQ ID NO: 3754 - DNA, 1917 bp, Wigglesworthia glossinidia brevipalpis
  CDS (1)..(1917)
atgagtgacatggctaaaaacctaattctttggttaataatagcagttgttttaatgtctatttttcaaagttttggcccaaatgattcaaatagaagaaaagtagaatattctgcttttatttcagagcttaatcaagatcaaataaaagaaactagaattaatggtagagaaatttttgctttaaaaaaagatggaagtagatatgttacatatattcctattaatgattctaaattattagatatattattatctaagaatgtaaaaataataggcgaacctcctgaagaaccaagtttattaacttctatttttatatcttggtttccaatgctattattaataggagtatggatattttttatgaggcaaatgcaaggaggaggagggaaaggagcaatgtcttttggtaaaagtaaagctaaaatgcttacagaagatcaaataaaaactacattctcagacgttgcaggatgtgatgaagctaaagaagaagtaagcgaattagtagattatttaaaagagccaagcagatttcaaaaacttggtgggaaaatcccaaagggaatattaatggtagggcctcctggtactggaaaaactcttttagcaaaagctattgctggagaagcaaaagttccattttttacaatttctggatctgatttcgtagaaatgtttgtaggagttggagcatctagggtacgagacatgtttgatcaagctaaaaaaactgctccatgcattatatttattgatgaaattgatgcagtaggaagacaaagaggggctggattgggaggaggtcatgatgaaagagagcaaactttaaatcaaatgttagtagaaatggatgggtttgaaggaaatgaagaaattattgtaattgctgctacaaatagacctgatgttttagatccagctcttttaagacctggtagattcgatagacaagttgtagttggtcttccagatgttagaggtagagaacaaatacttaaagttcacatgaaagctattcctctttcttctgatatagatgccgcagttattgctagaggaactcctggattttctggggcggacttagcaaacttagtaaatgaagcagctttatttgctgctaggaaaaataaaaaaaatgtgtctatgatggagtttgaaaaagcaaaagataaaataatgatgggtgcagaaagaaaatcacttgttatgacagaaaaacaaaaagaagccactgcatatcatgaagctggccatgcaatagttggcaggttagttccaggtcatgatcctgttcataaagtgacaataatccctagaggaagagctttaggaattacattttttttacctaaaggagatgttataagcataagtagacaaaaactagaaagccaaatttcaactttatatggaggtagattagcagaagaaattatatatggactatctaatgtatctactggtgcgtctaatgacataaaagtagcaacatctattgcaagaaatatgataactcagtggggattttctgataaattaggtccgttgttgtattcagaagaagaaggagagatatttttaggacgctcagtgacaaaatctcaaaatatatctgataaaactgccagaattattgatcaagaaataaaaatattaatagaaaaaaattatttaagagctaaaaatctaattatagataacattgatatattacatgcaatgaaagatgctttgatgaaatacgagactataaatgcatatcaaatagatgatttaatgaaaagaaaaccagttaggccaccatgtgataaccaagattctaaaagacataataataaagatgatattataaataaatctaaaaataacatatctaacaatacaagtgttactaataatatacaatga

SEQ ID NO: 3755 - protein, 638 aa, Wigglesworthia glossinidia brevipalpis
MSDMAKNLILWLIIAVVLMSIFQSFGPNDSNRRKVEYSAFISELNQDQIKETRINGREIFALKKDGSRYVTYIPINDSKLLDILLSKNVKIIGEPPEEPSLLTSIFISWFPMLLLIGVWIFFMRQMQGGGGKGAMSFGKSKAKMLTEDQIKTTFSDVAGCDEAKEEVSELVDYLKEPSRFQKLGGKIPKGILMVGPPGTGKTLLAKAIAGEAKVPFFTISGSDFVEMFVGVGASRVRDMFDQAKKTAPCIIFIDEIDAVGRQRGAGLGGGHDEREQTLNQMLVEMDGFEGNEEIIVIAATNRPDVLDPALLRPGRFDRQVVVGLPDVRGREQILKVHMKAIPLSSDIDAAVIARGTPGFSGADLANLVNEAALFAARKNKKNVSMMEFEKAKDKIMMGAERKSLVMTEKQKEATAYHEAGHAIVGRLVPGHDPVHKVTIIPRGRALGITFFLPKGDVISISRQKLESQISTLYGGRLAEEIIYGLSNVSTGASNDIKVATSIARNMITQWGFSDKLGPLLYSEEEGEIFLGRSVTKSQNISDKTARIIDQEIKILIEKNYLRAKNLIIDNIDILHAMKDALMKYETINAYQIDDLMKRKPVRPPCDNQDSKRHNNKDDIINKSKNNISNNTSVTNNIQ

SEQ ID NO: 3756 - DNA, 1953 bp, Vibrio vulnificus
  CDS (1)..(1953)
atggcaaaaaatttaattctgtggctggttatcgctgtcgtgttaatgtcggtatttcagagctttggccctggagaaagtaacggcagagcagtggattacaccacattcgtacaggaagttggtcaaggccagattcaagaagcaacgtttaaagacggtgaaattaccttcgttagacgcggcggcggcggtaagtttgtaacttacatgccggtatatgatcagaaattgctggacgacctgatcaaccaaaacgttaaagtacaaggtacgcctccagaagagcaaagcttgctcggtactatctttatttcttggttcccaatgattctactcattggtgtgtggatattcttcatgcgtcaaatgcaaggtggcggtggcaaaggtgccatgtcatttggtaagagcaaagctcgcatgatgagtgaagagcagatcaaaacgacgtttggtgatgtcgcaggttgtgacgaagccaaagaagacgttaaagagctagtggattatctacgtgacccaagtcgtttccaaaagctgggtggtaagattccaactggtgttttgatggtaggtcctccaggtacgggtaaaaccttattggcaaaagccattgctggtgaggcgaaggtgccatttttcactatctctggttctgacttcgttgaaatgtttgttggtgttggtgcttcgcgtgttcgtgatatgttcgaacaggccaaaaaagcctcaccatgcatcatcttcattgatgaaatcgatgccgtaggtcgccagcgtggtgcaggtgttggtggtggtcatgatgaacgtgagcaaacactaaaccaaatgctagtagaaatggatggtttcgaaggtaacgaaggcattatcgttattgcggcaaccaaccgtccagatgttttggatcctgcactactgcgtcctggtcgttttgaccgtcaagttgtggtcggtctgccggatgtacgtggtcgtgaacagatcctgaaagtgcatatgcgtaaagtaccgctagccggtgacgttgagccttctcttattgcgcgtggtacaccaggtttctcgggtgctgatttagccaacctagttaacgaagcggcgctatttgctgcgcgtggtaataaacgcaacgtctctatggttgaatttgaactggcaaaagacaaaatcatgatgggtgcagaacgtcgctctatggtgatgtctgaagaaatcaaagagtcaacggcataccatgaagcgggccatgcgatcgttggtcgccttgtgcctgagcatgatcctgtttacaaagtgtcgattattcctcgcgggcgtgcacttggtgtaaccatgtacttgccagagcaagaccgagtcagtatgtctcgtcagcacttagagtctatgatttcaagcctatatggcggtcgtttagctgaagaactgatttacggtgtagatcgtgtatcaacaggggcttcaaacgatatcgaacgtgcaactgatattgctcgcaagatggtgacacagtggggcttctctgaaaaacttggtccgatgctttatgcggaggaagaaggtgaagttttcttaggtcgtagtgtgacacaaactaaacatatgtcagacgacaccgcaaaactgattgatgatgaagttcgtaagttgattgaccgcaactatgagcgtgcaagacaaatcttaatcgataacatggatatcatgcacgcaatgaaagatgcgttaatgaaatacgaaaccatcgatgctggtcaaattgatgatctgatggctcgcaaagagaccattcgtgaaccagcgggttggggtgatcaagcggcgacggagaaaacggaaaaatcagaagcaaaagctgaagagaaaaccgcagagccggaagtgactgctcagtctcaaccagatgaagttcagcagcctactgacaaaaaagatgcagaatag

SEQ ID NO: 3757 - protein, 650 aa, Vibrio vulnificus
MAKNLILWLVIAVVLMSVFQSFGPGESNGRAVDYTTFVQEVGQGQIQEATFKDGEITFVRRGGGGKFVTYMPVYDQKLLDDLINQNVKVQGTPPEEQSLLGTIFISWFPMILLIGVWIFFMRQMQGGGGKGAMSFGKSKARMMSEEQIKTTFGDVAGCDEAKEDVKELVDYLRDPSRFQKLGGKIPTGVLMVGPPGTGKTLLAKAIAGEAKVPFFTISGSDFVEMFVGVGASRVRDMFEQAKKASPCIIFIDEIDAVGRQRGAGVGGGHDEREQTLNQMLVEMDGFEGNEGIIVIAATNRPDVLDPALLRPGRFDRQVVVGLPDVRGREQILKVHMRKVPLAGDVEPSLIARGTPGFSGADLANLVNEAALFAARGNKRNVSMVEFELAKDKIMMGAERRSMVMSEEIKESTAYHEAGHAIVGRLVPEHDPVYKVSIIPRGRALGVTMYLPEQDRVSMSRQHLESMISSLYGGRLAEELIYGVDRVSTGASNDIERATDIARKMVTQWGFSEKLGPMLYAEEEGEVFLGRSVTQTKHMSDDTAKLIDDEVRKLIDRNYERARQILIDNMDIMHAMKDALMKYETIDAGQIDDLMARKETIREPAGWGDQAATEKTEKSEAKAEEKTAEPEVTAQSQPDEVQQPTDKKDAE

SEQ ID NO: 3758 - DNA, 1896 bp, Synechococcus elongatus (Thermosynechococcus elongatus)
  CDS (1)..(1896)
atgaaagtctcttggaaaactgttctcctttggtcaatccccctactgctcattgggattctcctgtggcagggggtgagcaactttatgctcaatcaaagccagcctcccctgaataccgccagtacgcgcatgagctatgggcgattcctcagctatttggatgcgggccgcattagtaaagtcgacattttcgataatggtcgcaccgccattgtggatgtctctgatccagaattgattaacggtcgccccctgcgggtacgggtagatatgccggggacagcgccggaagtcattagtaaactgcgcgagcagcacgtagaaattgatgtgcatccggctcgcaatgatggtgccctgtggggtctcttgggtaatttactctttcccatcttgcttttggggggactctttttcctcttccgccgctccagcaatgtaccagggggaccgggccaagcgatcaacttcggcaaatctcgtgcccgcttccaaatggaggccaaaaccggcgtgatgtttgacgatgtcgctggtgtcgatgaagccaaggaagaactgcaagaggtggtcaccttcctgaagaagccggagaaatttacagcagtcggtgctcgcattcccaagggggttctgctggtgggccctccgggcactggcaaaacgatgctcgccaaggcgatcgcgggtgaggcaggcgtccccttcttttccatctcgggttcagaatttgtcgagatgtttgttggcgtcggcgcttcccgcgtccgcgatctcttccgcaaagcgaaagaaaatgccccctgcttgatctttatcgatgaaattgatgccgtgggtcgccagcggggtgccgggattggcggtggcaacgatgagcgggagcaaaccctcaaccaactcctcacagaaatggatggctttgaggggaacacaggcatcattgttattgctgcaacaaaccgtcccgatgttcttgatgcagcactgttgcgtcccggtcgctttgaccgtcaagtcattgtcgatgcccctgatattaagggacgtttggcaattctcaaggtgcacgcccgcaacaaaaaactggcgcccgaagtgtccttagaagccattgctcgccgtactcccggttttaccggggcggatttggccaacctcctcaatgaagcagcaattctcacggcccgtcgtcgcaagccggcgatcacgatgctggaaattgacgatgccgtggatcgggtggttgctggtatggagggcacacccctgattgatggcaagagcaaacgccttattgcctaccatgaagtgggccatgctattgtcggtacactgctcaaggatcacgatccggtgcaaaaagtaaccttggtgccccgtggtcaagcccgtggtcttacttggttcatgccctcagaggattcagggctgatctcgcgatcgcaactcatggcgcggatggccggtgctcttggcggtcgggcagctgaatacgttgtctttggcgatgctgaagtcaccactggcgcaggcaatgatctgcaacaggtgacggcaatggcacggcaaatggtgacccgctttgggatgtccgaccttgggccactgtctttagaaacccaaaatggcgaagtgttcttagggcgggatttggtgtctcgaactgaatactccgaggaaattgccgctcgcattgatgcccaagtgcgggaactggtgcagcacagctacgaactggccattaagatcattcgcgaaaaccgcgtcgtcattgaccgtttggtggatctattggtggaaaaagaaacgattgatggtgaagagttccgtcagattgttgctgagtacaccgtagttcccgataaagagcgatttgtgccccaactgtag

SEQ ID NO: 3759 - protein, 631 aa, Synechococcus elongatus (Thermosynechococcus elongatus)
MKVSWKTVLLWSIPLLLIGILLWQGVSNFMLNQSQPPLNTASTRMSYGRFLSYLDAGRISKVDIFDNGRTAIVDVSDPELINGRPLRVRVDMPGTAPEVISKLREQHVEIDVHPARNDGALWGLLGNLLFPILLLGGLFFLFRRSSNVPGGPGQAINFGKSRARFQMEAKTGVMFDDVAGVDEAKEELQEVVTFLKKPEKFTAVGARIPKGVLLVGPPGTGKTMLAKAIAGEAGVPFFSISGSEFVEMFVGVGASRVRDLFRKAKENAPCLIFIDEIDAVGRQRGAGIGGGNDEREQTLNQLLTEMDGFEGNTGIIVIAATNRPDVLDAALLRPGRFDRQVIVDAPDIKGRLAILKVHARNKKLAPEVSLEAIARRTPGFTGADLANLLNEAAILTARRRKPAITMLEIDDAVDRVVAGMEGTPLIDGKSKRLIAYHEVGHAIVGTLLKDHDPVQKVTLVPRGQARGLTWFMPSEDSGLISRSQLMARMAGALGGRAAEYVVFGDAEVTTGAGNDLQQVTAMARQMVTRFGMSDLGPLSLETQNGEVFLGRDLVSRTEYSEEIAARIDAQVRELVQHSYELAIKIIRENRVVIDRLVDLLVEKETIDGEEFRQIVAEYTVVPDKERFVPQL

SEQ ID NO: 3760 - DNA, 1860 bp, Synechococcus elongatus (Thermosynechococcus elongatus)
  CDS (1)..(1860)
atggccatcaaaaactcgcccgaagtcccacgcaatcgttggattggtaatgccttactcttcctcggcttggggtttttgctcctgaacctcttctttccccaactctttgcaccgcgcccgcctcaggttccctacagtatgtttatccatcaggtgcaagagggagatgtcgctcgcgtctatctgggtcaaaatgagattctctatcaactgaagccccaaggggataaaccgcctcaagttttagcaaccacgccgatctttgatcttgagttacccaagcgcctcgaggaaaagggagtggaatttgcagctgctccgcccccccgcaatagctggttgttaaatatcttgggttgggtgattccaccaattgtttttgtcttgattcttcagttctttgccaatcgccaagcaggcggtggtccccagggggtactctccatcagtaaaagccgggcgaaggtctatgtggagggagcaaacaccggcattcgctttgatgatgtggctggggttgaggaagctaaggcagaactggtggagattgtggatttcctaaaaaatccccaacgctacattcaaattggtgcccgcattcccaagggggtgctgctggtggggccaccgggaacagggaaaaccctgctggccaaggccgttgccggcgaagccaatgtcccttttttctccatttcgggttcggagtttgtcgagctatttgtgggcgtggggtctgcccgtgtacgggatctctttgagcaggcgaaaaagcaagccccctgtattgtctttattgatgaattggatgccattggtaagtcccgttctagtgcgggtttctatggcggcaatgatgaacgggagcaaaccctgaaccaactgctcacagaaatggatggctttgatgccacgggggcaacggtgattgtccttgctgcaaccaaccgcccagaaacccttgatccggcattgctgcgccccggacgctttgatcgtcaagtcttagtggatcgccctgatttgagtggtcgtgaagccattttgaaaatccatgccaaaaaggtgaaactagcccctgaggtagatctgcacgcgatcgctgcccgtacgcccgggtttgccggtgccgatttggccaacttggtcaatgaagcagccctcctagcagctcgtcatcagcgggaaatggtgacccagcaggactttgccgaagcaattgaacgcattgtggcaggtctggagaagaaaagccgtgtcctcaacgacaaagagaagaaaattgtcgcttaccacgaagtcggtcatgcccttgtgggctgtgcgctgccgggcagtggtcgggtagaaaagatctccattgtgccccgcggcatggcggctcttggttacacattgcagttgccgacggaggaccgcttcctccttgatgagcgggagctgcgtgcccaaattgccacgctgctgggggggcgatcggcggaggagattgtctttggcacaatcactactggagccgccaatgatttgcaacgggcaaccgatttggcagagcggatggtgcgcagctacggtatgagcaaagttcttggcccccttgcctttgagcaacaacagtccagctttttgacaaacactggcatgatgctacgggccgtgagtgaggaaaccgctcaagccatcgaccgtgaagtaaaggaaattgttgagtcagctcaccagcaggcgctcagtatcctccaagaaaaccgtgaccttcttgaggcgatcgcccaaaaactcttggaaaaagaagtgattgagggtgaagaacttcaggagctactggctcaggtgaaaactcccgccgctgcctaa

SEQ ID NO: 3761 - protein, 619 aa, Synechococcus elongatus (Thermosynechococcus elongatus)
MAIKNSPEVPRNRWIGNALLFLGLGFLLLNLFFPQLFAPRPPQVPYSMFIHQVQEGDVARVYLGQNEILYQLKPQGDKPPQVLATTPIFDLELPKRLEEKGVEFAAAPPPRNSWLLNILGWVIPPIVFVLILQFFANRQAGGGPQGVLSISKSRAKVYVEGANTGIRFDDVAGVEEAKAELVEIVDFLKNPQRYIQIGARIPKGVLLVGPPGTGKTLLAKAVAGEANVPFFSISGSEFVELFVGVGSARVRDLFEQAKKQAPCIVFIDELDAIGKSRSSAGFYGGNDEREQTLNQLLTEMDGFDATGATVIVLAATNRPETLDPALLRPGRFDRQVLVDRPDLSGREAILKIHAKKVKLAPEVDLHAIAARTPGFAGADLANLVNEAALLAARHQREMVTQQDFAEAIERIVAGLEKKSRVLNDKEKKIVAYHEVGHALVGCALPGSGRVEKISIVPRGMAALGYTLQLPTEDRFLLDERELRAQIATLLGGRSAEEIVFGTITTGAANDLQRATDLAERMVRSYGMSKVLGPLAFEQQQSSFLTNTGMMLRAVSEETAQAIDREVKEIVESAHQQALSILQENRDLLEAIAQKLLEKEVIEGEELQELLAQVKTPAAA

SEQ ID NO: 3762 - DNA, 1971 bp, Streptococcus mutans
  CDS (1)..(1971)
atgaaaaataatcgaaataatggatttgttagaaattctcttgtttatatcatattgattttagctattgtgacaggttttcaatatttttttagaggaacaggttcacaaagtgaaaaaattagttatacaactctcgttaaacgcgtcaaatcgggtgatataaaatcaattacttaccaaccaagtggtagtatcgtccaagtaacaggtgattacacaaagtctcgggaaattaaaactaacagtgacttagcttttttcaacgggacaacaacaaaagttaaaaagtttacctcaattgtccttcctaatagtacttctattgaaaaaattgaaaaattagcagaagataaaggaactaaaatttctgttaaacaagagagttcaagcggagcttggatctccttcttaatgagtttcttgccaattttcataatgatcttcttcttcactatgatgttaaatcaaagtggcggcggtgcccgtggtgccatgagttttggtaaaaataaagctcgttcttcttctaaaagtgatgttaaggttcgattctcagatgttgctggtgcagaagaagaaaaacaagaacttattgaagttgttgattttctaaaagatcctaaacgttataatgctttaggtgctcgtattccagccggtgttctgcttgaaggccctccaggaacaggaaaaacacttcttgctaaagcagtagccggtgaagctggtgttccgttcttctctatttctggttctgactttgttgaaatgtttgttggggttggtgctagccgcgttcgttcattatttgaagatgctaagaaagcagagcgtgccattatctttattgatgaaattgatgcggtcggtcgtcgccgtggcgctggtatgggcggcggaaatgatgaacgcgaacaaacacttaaccaactgttgattgaaatggatggttttgaaggtaatgaaaatattattgttattgcagcaaccaaccgtagtgatgtcttggatccagcccttcttcgtccaggtcgttttgaccgtaaagttcttgttggtcaaccagatgttaaaggtcgtgaagcgattttacgtgttcatgctaaaaacaaacctctagctagtgatgttaatctaaaagttgttgcgcaacaaacaccaggttttgtaggtgctgatttagaaaatgttctgaatgaagctgctcttgttgctgcccgtcgcagtaaaaaaattattgatgccagtgatattgatgaagcagaagatcgcgttattgcaggcccgtctaagaaagataagactgtttctgaacatgaacgtcagatgattgcctaccacgaagctggacataccattgtaggacttgttttatcgaatgcacgagttgttcataaagttactattgttcctcgtggtcgagctggcggttacatgattgctcttccaaaagaagatcaaaatctcttatcaaaaagtgatttgaaggaacagttagctggactgatgggaggacgtgtcgcagaagaaattatcttcaatgctcaaacaacaggtgcttcaaatgactttgaacaagccactcaattggcacgatcaatggtaacagaatatggtatgagtgaaaagctcggtccagttcaatatgaaggtaatcattcaatgatgccaggacaatttgcatcagaaaagacttattcagcacaaacagcccttcttattgatgaagaagttcgtgaacttcttaatgaagctcgcaataaggcagctggaattatcaatgataatcgtgaaacgcataaattaattgcagaagcgcttcttaaatatgaaactttggatgcagcgcaaattaaatctatttatgagactggtaagatgcctgaaaaatcagaggattcaaaggatgcacatgcgctttcttatgatgaaataaaagaaaaaatgtctgaagataatactgattga

SEQ ID NO: 3763 - protein, 656 aa, Streptococcus mutans
MKNNRNNGFVRNSLVYIILILAIVTGFQYFFRGTGSQSEKISYTTLVKRVKSGDIKSITYQPSGSIVQVTGDYTKSREIKTNSDLAFFNGTTTKVKKFTSIVLPNSTSIEKIEKLAEDKGTKISVKQESSSGAWISFLMSFLPIFIMIFFFTMMLNQSGGGARGAMSFGKNKARSSSKSDVKVRFSDVAGAEEEKQELIEVVDFLKDPKRYNALGARIPAGVLLEGPPGTGKTLLAKAVAGEAGVPFFSISGSDFVEMFVGVGASRVRSLFEDAKKAERAIIFIDEIDAVGRRRGAGMGGGNDEREQTLNQLLIEMDGFEGNENIIVIAATNRSDVLDPALLRPGRFDRKVLVGQPDVKGREAILRVHAKNKPLASDVNLKVVAQQTPGFVGADLENVLNEAALVAARRSKKIIDASDIDEAEDRVIAGPSKKDKTVSEHERQMIAYHEAGHTIVGLVLSNARVVHKVTIVPRGRAGGYMIALPKEDQNLLSKSDLKEQLAGLMGGRVAEEIIFNAQTTGASNDFEQATQLARSMVTEYGMSEKLGPVQYEGNHSMMPGQFASEKTYSAQTALLIDEEVRELLNEARNKAAGIINDNRETHKLIAEALLKYETLDAAQIKSIYETGKMPEKSEDSKDAHALSYDEIKEKMSEDNTD

SEQ ID NO: 3764 - DNA, 1977 bp, Streptococcus agalactiae (serotype III)
  CDS (1)..(1977)
atgaaaaataataaaaataatggttttctgaaaaattcctttatttacatattattgattattgcggttattacaacctttcaatactatttaaaaggaactagctctcaaaaccagcaaatttcttatacaaaacttgttaaacaattaaaagctggagaaattaagtctatctcataccagccaagtggtggtgttgttgaagttagtgggacatataagaaagccaaaacaattaaatcagctaatagttttacttttttaggtggtagtgttgctactaaagttacaggatttaattctgttatactaccaaatgactcttcaataaaatctcttgttagcgctgctgaagaaaataacactaatattcaggtcaaacatgaaagttcaagtgggacatggatttcttatattgccagttttttacctttagttatcatgattggtttcttcatgatgatgatgaaccaaggcggtggcggtggcgctcgtggtgccatgagctttggtaaaaataaagcaagatcatctagtaaagatgaggttaaagttcgattttcggatgttgctggagcagaggaagaaaagcaagaattaatagaagtcgttgacttccttaaagatcctaaacgatataaatctctaggtgcccgaattccagcaggggttctattagaaggacctccagggacaggtaaaaccctattagcaaaagctgttgccggtgaagcaggggttccattctttagtatttccggttcagattttgttgaaatgtttgtcggtgttggagctagtcgagtacgctctttgtttgaagatgctaaaaaagctgaacgtgctattattttcattgatgaaattgatgctgttggacgtcgacgtggagctggtatgggtggcggaaacgatgaacgtgaacaaacgctcaaccaacttttaattgaaatggatggttttgaaggaaacgaaagtattatcgttatcgctgctaccaaccgtagtgatgtgttagatcccgcattactgcgtccaggacgttttgatagaaaagttctagttggacaacctgatgtaaaaggtcgtgaagcaattctgagagtacatgctaaaaataaaccattagcagataatgttgacttaaaagtagtagctcaacaaaccccaggatttgttggtgctgatttggagaatgttctcaatgaagctgctttagttgctgcgcgacgaaataaaaaagttattgatgcttcagatattgatgaagcagaagaccgtgtaattgctggtccttctaaaaaagatcgtactatttctgaaagagaaagagctatggttgcttaccatgaagctgggcacacaattgtcggtttgattctttcaaatgcgcgagttgttcataaagttactatcgtaccacgtggtcgtgcaggtggatatatgattgctttacctaaagaagatcaaatgcttctttcaaaagatgatatgaaagagcaattagcaggtcttatgggaggacgtgtagcggaagaaattattttcaacgctcagacaacaggtgcctcaaatgacttcgaacaagccactgctatggcccgcgctatggtaactgaatatggtatgagcgagaaacttggaccagttcaatacgaaggcaaccacgcaatgatggctggtcaaatgtcacctgaaaaatcatattctgctcaaactgcacaacttattgatgatgaagttcgtcaccttcttaatgaagcacgtaataaggcagctgatattatcaacgaaaaccgtgatactcataaattaattgcagaagccctcttaaaatatgagactcttgatgctgctcagattaaatcgatttttgagacaggtaaaatgcctgagacagaaaatgatgaagataaagcaagagcgttatcatacgatgaaatcaaagaaaaaatgcaagaagaagataaaaaatga

SEQ ID NO: 3765 - protein, 658 aa, Streptococcus agalactiae (serotype III)
MKNNKNNGFLKNSFIYILLIIAVITTFQYYLKGTSSQNQQISYTKLVKQLKAGEIKSISYQPSGGVVEVSGTYKKAKTIKSANSFTFLGGSVATKVTGFNSVILPNDSSIKSLVSAAEENNTNIQVKHESSSGTWISYIASFLPLVIMIGFFMMMMNQGGGGGARGAMSFGKNKARSSSKDEVKVRFSDVAGAEEEKQELIEVVDFLKDPKRYKSLGARIPAGVLLEGPPGTGKTLLAKAVAGEAGVPFFSISGSDFVEMFVGVGASRVRSLFEDAKKAERAIIFIDEIDAVGRRRGAGMGGGNDEREQTLNQLLIEMDGFEGNESIIVIAATNRSDVLDPALLRPGRFDRKVLVGQPDVKGREAILRVHAKNKPLADNVDLKVVAQQTPGFVGADLENVLNEAALVAARRNKKVIDASDIDEAEDRVIAGPSKKDRTISERERAMVAYHEAGHTIVGLILSNARVVHKVTIVPRGRAGGYMIALPKEDQMLLSKDDMKEQLAGLMGGRVAEEIIFNAQTTGASNDFEQATAMARAMVTEYGMSEKLGPVQYEGNHAMMAGQMSPEKSYSAQTAQLIDDEVRHLLNEARNKAADIINENRDTHKLIAEALLKYETLDAAQIKSIFETGKMPETENDEDKARALSYDEIKEKMQEEDKK

SEQ ID NO: 3766 - DNA, 1935 bp, Brucella suis
  CDS (1)..(1935)
atgaatccgaactatcgcaacttcgccctttgggcgatcattgctcttcttttgatcgcactgttcaacctgttccaaagcccaggtcagcgcacgaattctcgtgaaatttcttattcgcaatttattgacgacgtttccaacggtcgtgtgaaatcggtcacgattaccgggcagcggatatccggcacccttgccgataacggctccaccttccagacctattcgccgggggatacgggcctcgtgtcgcgtcttgaagacaagggcgtcgcaatcacggcacggcctgaatcggacggttcgagctcgctgatcggcattcttctgtcatggttgccgatgatcctcattctcggtgtgtggattttcttcatgcgccagatgcagggtggctcccgcggcgcgatgggattcggcaagtcgaaggcgaagcttctcaccgaagcccatggccgcgtgacctttcaggacgtggcgggcgtggatgaggccaagcaggaccttgaggaaattgttgaattcctgcgcgatccgcagaagttccagcgcctcggcggcaagattccgcgcggtgtgctgctcgtaggccctcccggcaccggcaagacgctgcttgcgcgttcggttgcgggcgaagccaatgtgcctttcttcaccatttccggttcggacttcgttgaaatgttcgtcggtgtcggcgcaagccgcgtccgcgatatgtttgaacaggccaagaagaatgcgccctgcattatcttcatcgatgaaatcgatgcggtgggccgtcatcgtggcgccggtcttggcggcggcaatgacgagcgcgaacagacgctcaaccagcttttggtcgagatggacggttttgaagccaatgaatcgatcatcctgattgcggccaccaaccgtcccgacgttcttgatccggcgctcttgcgtccgggccgtttcgaccgtcaggtcgtggtgccgaaccctgatattgtcggccgcgaacagatcctcaaggtgcatgtgcgcaatgttccgcttgcacccaatgttgatctcaaggttgtcgcacgcggtacgccgggcttctccggtgccgatcttgccaacctcgtcaacgaagccgccctcatgaccgcgcgccgcaacaagcgcctcgtgaccatgcaggaattcgaggattccaaggacaagatcatgatgggtgcggaacgccgttccgccatgacgccggaagaaaagacgaataccgcctatcatgaggccggtcatgccatcgtcgcgctgaatgtccccaaggccgacccggtccataaggcgaccatcattccgcgcggtcgtgcgctcggcatggtgatgcagttgccggaaggcgaccgttattcggcgacctatacgtggatggtttctcgccttgcgatcatgatgggtggccgtgtggctgaagagctgaaattcggcaaggaaaacatcacgtccggtgcttcctccgatatccagcaggccacgaaactggcccgttcgatggtgacgcagtggggctattccgacaagcttggccgtgtggcctatggcgacaatcaggaagaagtcttccttggtcattcggtgtctcgcacgcagaatatttcggaagagaccgcgcagatcatcgacgccgaagtgcgccgcctgattgatgaagcctatgctgaagcaacccggatcctgaccaagaagaagaaggactggattgcactggctgaaggcctgctggaatatgaaacgcttaccggcgacgagatcaacgaactgattgcgggcaacaagccatcgcgcgatcagggcaatgatacgccgtcgcgcggttcgggtgtgcctaaggccggtagctcgcgcaagcgcaagggcagcgaacccggtggcgaacccggcatggagccgaaaccgcagccgcaataa

SEQ ID NO: 3767 - protein, 644 aa, Brucella suis
MNPNYRNFALWAIIALLLIALFNLFQSPGQRTNSREISYSQFIDDVSNGRVKSVTITGQRISGTLADNGSTFQTYSPGDTGLVSRLEDKGVAITARPESDGSSSLIGILLSWLPMILILGVWIFFMRQMQGGSRGAMGFGKSKAKLLTEAHGRVTFQDVAGVDEAKQDLEEIVEFLRDPQKFQRLGGKIPRGVLLVGPPGTGKTLLARSVAGEANVPFFTISGSDFVEMFVGVGASRVRDMFEQAKKNAPCIIFIDEIDAVGRHRGAGLGGGNDEREQTLNQLLVEMDGFEANESIILIAATNRPDVLDPALLRPGRFDRQVVVPNPDIVGREQILKVHVRNVPLAPNVDLKVVARGTPGFSGADLANLVNEAALMTARRNKRLVTMQEFEDSKDKIMMGAERRSAMTPEEKTNTAYHEAGHAIVALNVPKADPVHKATIIPRGRALGMVMQLPEGDRYSATYTWMVSRLAIMMGGRVAEELKFGKENITSGASSDIQQATKLARSMVTQWGYSDKLGRVAYGDNQEEVFLGHSVSRTQNISEETAQIIDAEVRRLIDEAYAEATRILTKKKKDWIALAEGLLEYETLTGDEINELIAGNKPSRDQGNDTPSRGSGVPKAGSSRKRKGSEPGGEPGMEPKPQPQ

SEQ ID NO: 3768 - DNA, 2091 bp, Bifidobacterium longum
  CDS (1)..(2091)
atgagcttcccgcaagggccgggtaacggcaataacccgaacccggacaacaaccgtaacaacggcaacccgttcaccaacccgttcaaccgtggcaataacgggaacaatggcaaaggcaacaaagagaaccgcccgatatggcagtccccctggctgtggggtgccgtgctcgtggtcatggtcgtgctgatgttccagatgttcgccggcggtggcaccaaaaccatcgatactaaagatggtttcgcgctgatcaatcagggcaaggccacctacgccgagatcacggacaacaagcaggtcgtccgccttgagctgaagaatgactacaccaagaagaacgccgacaccggcaaggtgaccaactacggcaagaacgtgcagttctactacaccttcgcccagggcgcacaggtggccaaggccgtggagaacggcgatctcgaaaagggctggacctcgaatatcgagcagaccagtgtgatgagctacctcatcacctcgattctgccgttcgtcatcatccttgccttgttctggtggctgatgagccgcatgggcggtgccggcggcatgctcggcatgggcggcaagaaaaacagcggcaagctgctcgacggccagacccccaccaccaagttcgccgatgtggccggcgaagacgaggccgtggccgaagtcgaggagatcaaggacttcctcaaggatccgtccaagtacaaggcgctgggcgctcgtattccgcgtggcgtgctgctgtacggtcctcccggcaccggtaagacgttgctggcccgagccatcgcaggcgaggccggcgtgccgttctactcgatggccggctccgacttcgtcgaaatgttcgtgggtctcggtgcctcccgtgtgcgtgacctgttcgatgaggccaagaagaacgcccccgccatcatcttcatcgatgaaatcgatgctgtgggccgcaagcgtggctccggcatgggcggtggccacgacgagcgcgagcagacgctgaaccagctgctcgtcgagatggatggtttcgacaacgacaccaacctcatcatcatcgccgccaccaaccgccctgacgtgcttgaccccgctctgctgcgtccgggtcgattcgaccgtcaggtgggcgtggccgcccctgatctggaaggccgtgaggcaattctgagggtgcatgccaagggcaagccgttcgtaccggacgtcgacctgcacatggtcgccgtgcgcacgccgggcttcaccggtgccgatctggccaacgtgctcaacgaagccgcgttgctgtgcgcccgtgccggtgcccagttgatcgacaaccgcgccatcgacgaggccatcgaccgcgttcaggccggaccgaagcgcaagtccaagggcatggctctggaagagctgcgcaacaccgcataccacgagggtggtcatgcgctggtggccgccgccctgaacaacaccgatccggtgaccaaggtgacgattctgccgcgaggccgcgccctcggctacaccgccgtcatgccgacctccgaccgctactcgcagtcgcgcaaccagctgctcgaccagatggcctacgcgatgggcggtcgcaccgccgaggaaatcgtcttccacgacccgaccaccggtgcctcgaacgatatcgagaaggctacgagcatcgcccgtacgatggtgatcgaatacggcttctccgacaagctcggcgccatcaagtggggttccgacgacgatcagaccaccgtgatggacggtctgcagccgcgcaaatactccgaccgcaccgccgaagtgattgacgacgaggtgctgaagctggtggaaaccgcccacaccgaggcgtggaccatcatcaacgacaaccgcgatatcctcgacgagttggtccgtcagctgctggtcaaggagaccctgaacgagaaggaacttgcggagatcttcgcgccgatcaagaaggctccggttcgtccggtgtggctgtccaacgaccgccgccccgactcggacaagccgccggtggagattcccgaaagcctcaagcgctcggtcggcatgaagccggaagagtag

SEQ ID NO: 3769 - protein, 696 aa, Bifidobacterium longum
MSFPQGPGNGNNPNPDNNRNNGNPFTNPFNRGNNGNNGKGNKENRPIWQSPWLWGAVLVVMVVLMFQMFAGGGTKTIDTKDGFALINQGKATYAEITDNKQVVRLELKNDYTKKNADTGKVTNYGKNVQFYYTFAQGAQVAKAVENGDLEKGWTSNIEQTSVMSYLITSILPFVIILALFWWLMSRMGGAGGMLGMGGKKNSGKLLDGQTPTTKFADVAGEDEAVAEVEEIKDFLKDPSKYKALGARIPRGVLLYGPPGTGKTLLARAIAGEAGVPFYSMAGSDFVEMFVGLGASRVRDLFDEAKKNAPAIIFIDEIDAVGRKRGSGMGGGHDEREQTLNQLLVEMDGFDNDTNLIIIAATNRPDVLDPALLRPGRFDRQVGVAAPDLEGREAILRVHAKGKPFVPDVDLHMVAVRTPGFTGADLANVLNEAALLCARAGAQLIDNRAIDEAIDRVQAGPKRKSKGMALEELRNTAYHEGGHALVAAALNNTDPVTKVTILPRGRALGYTAVMPTSDRYSQSRNQLLDQMAYAMGGRTAEEIVFHDPTTGASNDIEKATSIARTMVIEYGFSDKLGAIKWGSDDDQTTVMDGLQPRKYSDRTAEVIDDEVLKLVETAHTEAWTIINDNRDILDELVRQLLVKETLNEKELAEIFAPIKKAPVRPVWLSNDRRPDSDKPPVEIPESLKRSVGMKPEE

SEQ ID NO: 3770 - DNA, 2643 bp, Plasmodium falciparum (isolate 3D7)
  CDS (1)..(2643)
atgagttcgaagtatgacaatcagagttttctgtcaacaggatcagataaatatggtgaacaagaaaattctgttttattgcatgatgaggaagatgaatatataaatgagaataaaaagaagagaaatgaacgtgataagaaatttcgatattatgaaaatttttttaatagaaggagaagtaaaaagtggaattatttcataatattttttttaggtgtatgtttaggttttgccatatggccattttttatgactataataacgtatagattattttataaagataattttaataatacaaattatcgaacaaataattcttccacttctttgaaatcttatggaaatgagaaaaataagaagagtgataacaatggaaaagtacccatgaaagatcaatctccaaataaagtatctccacattttaaacctatacgatttgaagaaatagcaggaatagatgaatctaaattagaattattagaagtagttgattttataaaaaatagagaaaagtatcatgaaatgggtgctagaatgccaaagggtgttttattagttggacctccgggttcaggaaaaaccatgttagctagagctgtagcaactgaagctaatgttccatatatttatacttctggaccagaatttatagaaatatatgtaggtcaaggggctaaaagaatacggcagttatttgctcatgcaagatcagttgctccatccattgtatttattgatgaaattgatgcaattggtggaaagagaagttcaggatctgttaacggtgcaggtcaaagagaacatgatcaaacattaaatcaattgttagttgaaatggatggatttagtaatactgtacatattatggttataggtgcgacaaacagaattgataccttagacagtgctttattacgaccaggtagatttgataggatcgtttatgtaccattacccgatattaatggaagaaagaaaattttagaaatatatattaaaaaaattaagagtgatttaaaattagaagatattgaaaagatagcaagattaacacctgggttttctggtgcagatttagaaaatgttgtaaatgaggctactattttagctacaagaaataataaaagtttagttacaattaatgaattatatgaagccagagataaagtttctatgggcccagaaagaaaatcattaagacaatcagaccatcaaagaaggataacagcttatcatgaagctggtcatgctatcgttgcatattttcttcaacctaaaacagatccaatacataaggctacaattatttcaagaggtaatgctcttggatatgttgaacaaattccagttgatgatagacataattattttaagagtcaaatggaagcaaaattagctgtttgtatgggaggtagaacagctgaagaaattgtttttggtaaatcagaaactagtagtggtgcttcaagtgatatatctagagctaccgaaattgcttataaaatggtaacggaatggggtatgtctgataaattaggaccattaaattataaaaaaagaatgggagatggttattcgtccaatcgattatctgctcaaactgtttcatctatagaagtcgaagtaaagtccttagtagaaaaaggaaaaagcttatcagaagaaatattaagaagacatagaaaagaattagataatttagcttttgcattattagataaagaaaccttatccggagaagagatcaaaaatattattgatccaaataattccaaaaattattcaggtaaggtagaaatgttaaaaaatgatacaaagaaaaatgagaaaaagagtaacagtgtatctaaaaataaaagcaccatttctgaggattatgacaaaaatcaaaataatgtggaacaaaattaccaatcacatgatcataccttagttaaaaatgaagaaaatttgaataatatgaaaaatgatattgatgacaataatacgagagatggtcaagtaaattcagactcatttgtaaaaagaaaagaagtaacggatcaggatataaatggaaaagaattaagtgagatggataataaagagataaaagaaaataaaaagttagatggagaggaattaaataaaattattattgataacgataaaatgggtgatatgaaaaagaatataaaagaagttattaaaaaaatgaaaaaaaaacaatctaaaggttcttacaagacatataaaaatgtattgaaatctgtaagtgaacacaaggaattgaaaactcagaagaaagcggatgaaaataaaatcgtggctgataataatgagaagtcatctaataatagcttggataaaaataatacacaaggttcaatagatgaaaagggatataaaaataataataataataataataatatggtgaaaaatatcaatgaattgtttgaagagaattttcctgaatataagaaatatgataatgaaaataacgattttgtaaaaaccaaagaaaattactttgacaattttaatgaagtaatagatatatctcatataaaaaatgttgatgaaatgaaaaagtttaatatatttgaacataacttaaataaattatttttatttgacatatttaaaagcgactag

SEQ ID NO: 3771 - protein, 880 aa, Plasmodium falciparum (isolate 3D7)
MSSKYDNQSFLSTGSDKYGEQENSVLLHDEEDEYINENKKKRNERDKKFRYYENFFNRRRSKKWNYFIIFFLGVCLGFAIWPFFMTIITYRLFYKDNFNNTNYRTNNSSTSLKSYGNEKNKKSDNNGKVPMKDQSPNKVSPHFKPIRFEEIAGIDESKLELLEVVDFIKNREKYHEMGARMPKGVLLVGPPGSGKTMLARAVATEANVPYIYTSGPEFIEIYVGQGAKRIRQLFAHARSVAPSIVFIDEIDAIGGKRSSGSVNGAGQREHDQTLNQLLVEMDGFSNTVHIMVIGATNRIDTLDSALLRPGRFDRIVYVPLPDINGRKKILEIYIKKIKSDLKLEDIEKIARLTPGFSGADLENVVNEATILATRNNKSLVTINELYEARDKVSMGPERKSLRQSDHQRRITAYHEAGHAIVAYFLQPKTDPIHKATIISRGNALGYVEQIPVDDRHNYFKSQMEAKLAVCMGGRTAEEIVFGKSETSSGASSDISRATEIAYKMVTEWGMSDKLGPLNYKKRMGDGYSSNRLSAQTVSSIEVEVKSLVEKGKSLSEEILRRHRKELDNLAFALLDKETLSGEEIKNIIDPNNSKNYSGKVEMLKNDTKKNEKKSNSVSKNKSTISEDYDKNQNNVEQNYQSHDHTLVKNEENLNNMKNDIDDNNTRDGQVNSDSFVKRKEVTDQDINGKELSEMDNKEIKENKKLDGEELNKIIIDNDKMGDMKKNIKEVIKKMKKKQSKGSYKTYKNVLKSVSEHKELKTQKKADENKIVADNNEKSSNNSLDKNNTQGSIDEKGYKNNNNNNNNMVKNINELFEENFPEYKKYDNENNDFVKTKENYFDNFNEVIDISHIKNVDEMKKFNIFEHNLNKLFLFDIFKSD

SEQ ID NO: 3772 - DNA, 2121 bp, Plasmodium falciparum (isolate 3D7)
  CDS (1)..(2121)
atgttacttctacggaatattgtaatactagatttaaaaaggagtaataaattactaaatattaataatttaccaaaaatcgcttgtattttaaatacaagaaagggattttctgtattaaaaaatgaaagattagataggttaaaaagagaagtaaggaataaacctaatgataactttttaatattacaattttataaagaggcaaatgtgcataatccaaatgaagtcataaaacattatgaaaatgctaattatataaaagatgaaagtataacaaaagaatatataaaagcattagtatatacaaataaattaaaatataccaatctcgataatattaaatatgatagcgatcataatatgtataataaatctatgcatgatactactacaaatgaaatgcattcaaatgaacgctcaaataatatatatgaaggaaataatgtaaatagtgaaaataattataataatatgtcctcaaatcattcaacacacaaagtagaatatatggataaaaaaagaaatcaacatcctgaaatgtatagtctacatattgatccaaagaaaccattaaaagtttctgtgatagatagtaataaaaaaggtttatggaatttacttaagtctaccattggatttttaatattagtagctgcaggaagtgtatacatggaaggagtatcacaaaatgttcaaaaaggtataggagtgtcaaataaaaaaattattccagtagaaaatgtaaaagtaacatttgcagatgtgaaaggatgtgatgaagtgaaacaggagctagaagaaattattgattatttaaaaaattcagataaatttaccaaaattggtgccaaattaccaaaaggtattttattatcaggagaaccaggtaccggaaaaacattaattgctagagctattgcaggagaagctaatgttccatttttacaagcctcaggttcagaatttgaagaaatgtttgttggtgtaggtgcaaggagaataagagaactttttcaagcagcaaagaaacatgcaccatgtattgtttttattgatgaaatcgatgccgtaggatcaaaaagaagtagtagagataatagtgctgtacgtatgacacttaatcaattattagtcgaattagacggtttcgaacaaaatgaaggtattgttgtaatatgtgcaactaactttccacaaagtttagataaagctttagttagaccaggtagattggataaaactattgtagtacctttgcctgatattaaagggagatatgaaattctaaaaatgtatagtaataaaattgtattatcaaaagatgttgatttacatgttttatcaaggagaactgtaggaatgacaggtgccgatttaaataatatattaaatattgctgctattaaatgttcagtcgaagggaaaaaatcagtagatatgaattcgattgaacaagcttttgatagagttgtagttggtttacaaagaaaatcaccattaaatgaagaagagaaaaacattactgcatatcatgaaggaggacatacacttgtcaatttttataccaaaggatctgatcctgttcataaagctaccataatgccaaggggaatgtctctaggtgttacatggaaaatacctattagtgataaatatagtcaaaaaattaaagatgtacaaagtgaaattgatatattaatgggaggtctagtttctgaggaaattatttttggaaaaaataatgtgacgacaggatgttcaagtgatttacaaaaggcaacacatattgctcaatcgctagttatgaattatggagtaggtataaatgaagacaacatatctatgtttttgcatgacaaacaaaatattagtgaagaaatgaaaattaaaattgataaatctatacaaagaatattattagattcttataatagagccaaaaatgttctaaatcaacacattgatgaattacatagaattgcatcagctctagtagaatatgaaaccttaacaagtgatgaaattaaattagcaatgcaaggaaaatgtgatcaaattagaaaaaatagagaaattaaacaaaaggaatataatttaaaagacagtagaatatcttaa

SEQ ID NO: 3773 - protein, 706 aa, Plasmodium falciparum (isolate 3D7)
MLLLRNIVILDLKRSNKLLNINNLPKIACILNTRKGFSVLKNERLDRLKREVRNKPNDNFLILQFYKEANVHNPNEVIKHYENANYIKDESITKEYIKALVYTNKLKYTNLDNIKYDSDHNMYNKSMHDTTTNEMHSNERSNNIYEGNNVNSENNYNNMSSNHSTHKVEYMDKKRNQHPEMYSLHIDPKKPLKVSVIDSNKKGLWNLLKSTIGFLILVAAGSVYMEGVSQNVQKGIGVSNKKIIPVENVKVTFADVKGCDEVKQELEEIIDYLKNSDKFTKIGAKLPKGILLSGEPGTGKTLIARAIAGEANVPFLQASGSEFEEMFVGVGARRIRELFQAAKKHAPCIVFIDEIDAVGSKRSSRDNSAVRMTLNQLLVELDGFEQNEGIVVICATNFPQSLDKALVRPGRLDKTIVVPLPDIKGRYEILKMYSNKIVLSKDVDLHVLSRRTVGMTGADLNNILNIAAIKCSVEGKKSVDMNSIEQAFDRVVVGLQRKSPLNEEEKNITAYHEGGHTLVNFYTKGSDPVHKATIMPRGMSLGVTWKIPISDKYSQKIKDVQSEIDILMGGLVSEEIIFGKNNVTTGCSSDLQKATHIAQSLVMNYGVGINEDNISMFLHDKQNISEEMKIKIDKSIQRILLDSYNRAKNVLNQHIDELHRIASALVEYETLTSDEIKLAMQGKCDQIRKNREIKQKEYNLKDSRIS

SEQ ID NO: 3774 - DNA, 2409 bp, Mus musculus (Mouse)
  CDS (1)..(2409)
atggcccaccgctgcctgctgctgtggagccggggcggctgccgtcgcggccttcctcccctgctcgtgcccagaggttgcctgggtccggaccggcggccctgcctccgtacgctctatcaatatgctactgtccagacagcaagcagcaggcgttctctgctgagggatgtaattgctgcttatcaaagattctgttctcgacctcccaaaggatttgaaaagtactttcctaatgggaaaaacggaaaaaaggccagtgagcctaaggaggctgttggagaaaaaaaagaaccacagccctcgggcccccagccttctggaggtgcaggtggtgggggagggaagcgccgtggcaagaaagaagattctcactggtggtccaggttccagaagggtgacttcccatgggatgacaaggatttcaggatgtactttctctggactgctcttttttggggtggagtcatgatttacttcgtgttcaagagctctgggagagaaatcacgtggaaagactttgtcaataactatctttctaagggcgtggtggacagactagaagttgtcaacaagcgttttgttcgtgtgacctttacaccaggaaaaactccggttgatgggcaatacgtctggtttaatattggcagtgttgacacatttgagcggaatctggagactttgcagcaagaattgggcatagaaggggagaaccgggtccctgtggtttatattgctgagagcgatggctccttcctgctgagcatgttgcccaccgtactcattatcgcttttctactctacaccataagaagagggcccgctggcattggtcggaccggccggggaatgggtggactcttcagcgttggggaaaccacagccaaggtcttaaaggatgagatagatgtgaagtttaaagatgtggctggctgtgaggaggccaagctagaaataatggaattcgtgaatttcttgaaaaacccaaagcaatatcaagacctaggagcaaaaatcccaaagggtgccattctcaccggtcccccaggtactgggaagacgctgctagctaaggccacagctggagaagccaatgtcccctttatcactgtgagcggatctgagtttctggagatgtttgttggcgttggtccagccagagtccgagacttatttgcccttgctcggaagaatgcgccttgcattctcttcattgatgagattgatgctgtgggaaggaagcgcggcagaggcaacttcggtgggcagagcgagcaggagaacacactcaaccagctgcttgtggagatggacggcttcaacacaaccaccaatgtggtcatcctggcaggcacaaatcgaccagacatcctggatccagctctgttgagaccaggccgctttgacaggcagatttttattggacccccagacataaaaggacgagcctcaatcttcaaagttcaccttcgaccattgaagctggacagtgccttggaaaaagataaattggccagaaaactggcgtccttaactccagggttttcaggcgctgatgttgccaatgtctgcaatgaagctgctttgattgctgcaagacacctttcagatgccattaatgagaagcacttcgaacaagcgattgagcgagtgattggaggcttggagaaaaaaacccaagttctgcagcctgaggagaagaagacggtggcttaccacgaagcaggccatgcggtcgctggctggtatctggagcatgcagacccactcttaaaggtctccatcatcccgcgtggcaaggggctgggctatgctcagtacttgcccaaggagcagtatctgtacacaaaggagcagctgctggacaggatgtgcatgactctgggcggccgtgtctccgaggagatcttctttgggagaattacaaccggtgcccaggacgacttgaggaaggttacccagagtgcctatgcccagatcgttcagtttggcatgaacgagaaagtggggcagatctcctttgacctcccacgacagggggacatggtgttagagaagccttacagtgaggccactgcgaggatgatagacgatgaagtgaggatactcatcagcgatgcctacagaaggacggtggctcttctcacagagaagaaggctgacgtggagaaggtcgctctcttactgttagaaaaggaagtcctagacaagaatgacatggtccagcttctcggtcccagaccatttacagaaaagtccacatatgaagaatttgtggaaggcactggcagcttagacgaggacacttctcttcctgaaggccttcaggattggaacaaggagcgggagaaggaggagaagaaggagaaggagaaggaggagccgctgaatgagaaggttgtcagctag

SEQ ID NO: 3775 - protein, 802 aa, Mus musculus (Mouse)
MAHRCLLLWSRGGCRRGLPPLLVPRGCLGPDRRPCLRTLYQYATVQTASSRRSLLRDVIAAYQRFCSRPPKGFEKYFPNGKNGKKASEPKEAVGEKKEPQPSGPQPSGGAGGGGGKRRGKKEDSHWWSRFQKGDFPWDDKDFRMYFLWTALFWGGVMIYFVFKSSGREITWKDFVNNYLSKGVVDRLEVVNKRFVRVTFTPGKTPVDGQYVWFNIGSVDTFERNLETLQQELGIEGENRVPVVYIAESDGSFLLSMLPTVLIIAFLLYTIRRGPAGIGRTGRGMGGLFSVGETTAKVLKDEIDVKFKDVAGCEEAKLEIMEFVNFLKNPKQYQDLGAKIPKGAILTGPPGTGKTLLAKATAGEANVPFITVSGSEFLEMFVGVGPARVRDLFALARKNAPCILFIDEIDAVGRKRGRGNFGGQSEQENTLNQLLVEMDGFNTTTNVVILAGTNRPDILDPALLRPGRFDRQIFIGPPDIKGRASIFKVHLRPLKLDSALEKDKLARKLASLTPGFSGADVANVCNEAALIAARHLSDAINEKHFEQAIERVIGGLEKKTQVLQPEEKKTVAYHEAGHAVAGWYLEHADPLLKVSIIPRGKGLGYAQYLPKEQYLYTKEQLLDRMCMTLGGRVSEEIFFGRITTGAQDDLRKVTQSAYAQIVQFGMNEKVGQISFDLPRQGDMVLEKPYSEATARMIDDEVRILISDAYRRTVALLTEKKADVEKVALLLLEKEVLDKNDMVQLLGPRPFTEKSTYEEFVEGTGSLDEDTSLPEGLQDWNKEREKEEKKEKEKEEPLNEKVVS

SEQ ID NO: 3776 - DNA, 1980 bp, Chlorobium tepidum
  CDS (1)..(1980)
atgcagccaaataaaagcaacgacaaggctccgcgaaaccggcccgacaaccgtttcatgccgccagacagagatacggatcaggacgaccgctttcccggaaaggagggaaacggggacagattccccaggttcatcctcttcctgatgctggcagtgcttggtctttttgttttccagcgctttttctcccaggacatctccccggaaatctcctataatgagtaccgttcaattgtttccggagggtctctgtctgaagtgaccgtcaaaaccagccaggacaactccgccctgctaaccggaaagctcaaggcgcccgacagccttcgactgaccagtggttccactgtacgctccgaccagttcatggtcaggcttccgggcttcgaccgcgcccaggccgacagcctttcggcgagcggcgtccaggtcaagatcacccagagcagcgacgagttttcaaattttctgttgctcatgctgccgtggggactgttcggcttcgcctacttcttcatcttcagacgaatgtcgatgcagaacgacgtacagagaaacatcttcagctttggcaagagccgagccaaactcatcagcgagtttgacgtcaaggtaacgtttaatgatgtggctggtgttgatgaagcgatcgaggagctgaaggagaccgtggagttcctcatgaaccctgagaagttccagaagatcggcggtaaaatccccaaaggcgtgctgctgctcggccctcccggaaccggcaaaacattgctcgccaaggcaatcgccggagaagccaaggtaccgtttttctcgatttcgggcgctgatttcgtggagatgttcgtcggcgtcggcgcggcgagagttcgggatttgttcgaaaccgccaaaaagaattcgccctgcatcgtcttcatcgatgagatcgacgccgttggccggagccgtggcgcgggcctcggcggcggccacgacgaacgtgagcagacgctaaaccagctcctggtggagatggacgggttcaccgccagggacaacgtgatcctgattgctgcgaccaaccgcccggatgtgctcgacagcgcgctgttgcgacctggcaggttcgaccggcagatcaccatcgacaaacccgacattcgcggacgcaaagcaattctggaaattcacacaagaaaaaagccgcttgacagttcggtcgatctggagacgattgccaagagcactccgggcttctcgggagccgatctggccaatctggtcaatgaagcggccttgctcgcatcgcgatacaaccagaccgaaatcaccgccgacaacttcgaagaggcgcgcgacaaggttcttatgggccccgaacgccggagcatgtacatctccgaggagcagaaaaagctgaccgcctatcacgaggccggccatgtaatcgtctcgaaattcaccagcggctccgacccgattcacaaggtcacgatcatcccgcgaggccgcagcctcggccaaaccgcctacctgccgctcgaagaccgttatacccagaaccgggagtacctgatcgccatgatcacctatgcacttggcggccgggcagcagaagagctgatcttcaatgaggtgagcaccggcgcggccaacgatatagaaaaagcaaccgagattgcccggaaaatggtgaaaaactggggtatgagcgacaagctcggcccgatcaattacggcgacggacacagggaggtctttctcggcaaagactattcgcatgtgagggagtacagcgaggatacagctcttcagatcgatgtcgaggtgcgcagaatcataaccgaatgcatggacaatgcacgaaaaattcttacagcgcatgtccggattctgcacgaaatggctgctcgtttgattgaaaaggagtcgctcgattcggaggaaatcgacgctatcgtcagttcggaaacagctgttgcaaactctccggcatga

SEQ ID NO: 3777 - protein, 659 aa, Chlorobium tepidum
MQPNKSNDKAPRNRPDNRFMPPDRDTDQDDRFPGKEGNGDRFPRFILFLMLAVLGLFVFQRFFSQDISPEISYNEYRSIVSGGSLSEVTVKTSQDNSALLTGKLKAPDSLRLTSGSTVRSDQFMVRLPGFDRAQADSLSASGVQVKITQSSDEFSNFLLLMLPWGLFGFAYFFIFRRMSMQNDVQRNIFSFGKSRAKLISEFDVKVTFNDVAGVDEAIEELKETVEFLMNPEKFQKIGGKIPKGVLLLGPPGTGKTLLAKAIAGEAKVPFFSISGADFVEMFVGVGAARVRDLFETAKKNSPCIVFIDEIDAVGRSRGAGLGGGHDEREQTLNQLLVEMDGFTARDNVILIAATNRPDVLDSALLRPGRFDRQITIDKPDIRGRKAILEIHTRKKPLDSSVDLETIAKSTPGFSGADLANLVNEAALLASRYNQTEITADNFEEARDKVLMGPERRSMYISEEQKKLTAYHEAGHVIVSKFTSGSDPIHKVTIIPRGRSLGQTAYLPLEDRYTQNREYLIAMITYALGGRAAEELIFNEVSTGAANDIEKATEIARKMVKNWGMSDKLGPINYGDGHREVFLGKDYSHVREYSEDTALQIDVEVRRIITECMDNARKILTAHVRILHEMAARLIEKESLDSEEIDAIVSSETAVANSPA

SEQ ID NO: 3778 - DNA, 2121 bp, Chlorobium tepidum
  CDS (1)..(2121)
atggcaaacaacccattcaagctgaacaatccatacaataacgagccggataacgggccgcgcaagccccggttttcgatattctactacatagcagtcatcctgctgatcatcggttttcaactcgcctttttctggtcaggctcaacccgcgagatcgcctacagtgacttccgcaaactgatcgaccagaacagggtcgaatcggtcaaactcgctcccgaaaaaatctacgtccagctcaaggaggactccctctcaacagcgacaaacaaacccttcgggcaaaatccgccggcgttccagatgccaggcaaaaactcatcaaaaaacgaggtgacggtcaaccccgtgcgggacgagcagctgattccgcttcttgaatcgaaaggtatccattacgaagcgatcccgggcaacggctggatcaatgaactgctgcaatggcttctgcccttcgggcttcttatcggcatctatttcttcatgttccgcagaatgggcggccccggttcgcagttcatgaacatcggcaagaacaaggccgcgctctatgaaaacctcgacgagcacacccgcatcacctttaaggatgttgccggactggacgaagcgaaggccgaggtgatggaggtggtcgacttcctcaaggatccgaaaaagtataccaagctcggcggcaagctgcccaagggcgtgctgctggtcggtcctcccggcaccggcaagacgctgctcgccaaagcggttgcgggcgaagccaacgtgccttttttcagcatcagcggctcggacttcgtcgagatgtttgtgggcgttggcgcggcgcgcgtgcgcgatctgttcaagtcggccaaggaaaaagcgccttgcatcatcttcatcgatgaaatcgacgcagtcggacgcagccgtggcaagggctttatgatgggcgcaaacgacgaacgcgaaaacaccctgaaccagcttctggtcgaaatggacggcttcgccaccgacaagggcgtgatcctcatggccgccaccaaccgcgcggatgtgctcgactcggcgctgctcagaccgggccgctttgaccggcaaatcgtggttgacaggcccgacctgaagggacgtaccgacatcttcgcggtgcataccaagaacctctcgctctcgcccgacgtcaacctcaaggcgctggcctcgcagacacccggtttcgcgggcgcggagattgccaatgcggccaacgaagcggccctgctcgcatcgaggcgcggcaagcagagcattgaaatgaaggatttcgaggacgccatcgagcgagtcatcgccggtctggaaaagaaaaacaaggtgatcaacccgcgcgaaaaggagatcgtggcctatcacgagtccggccacgccattgtaagctggctgatgccggaaaacgacccggtgcagaagatttcgatcgtgccacgcggcgtcagcgcgcttggctacactctgaacatcccgctcgaagaccgctacctgatgacccgcagcgagctgatcgcccgcatctgcggcctcctcggcgggcgcgttgccgaagagatcatcttcggcgaaatttcgaccggcgcgcaaaacgacctcgaacgggtgactgaaatcgcctacaacatggtgatcgtgtacggcatgagcgaaaaggtcggctacctgtcgttcctcgaaagcaacaacccgtactacggcggccccggcattgacaagaagtatggcgacgaaaccgccaggctgatcgacaacgaggtcaaggagatcgtcgaggccgcccgcaagcaggttcaccagatgctttcggacaatcgtgacaagctcgaaatgcttgccaaagagctgctctcgaaggagatcgtgcagtactgccggatcgaggagattctcggcaagcgcccggcaggcaagttcagcgaacaccttgcccacgactgccagaacggtgtcgatatggcgatgtcacagctccataccgaacctgaagaggctgcatctcctgcagtttctgcccagcaggaaacggcaacagatccggagcgcaaggaactggaagaggccgtcgaaaggctccggcagtccagaaacctgtcgtcgaattga

SEQ ID NO: 3779 - protein, 706 aa, Chlorobium tepidum
MANNPFKLNNPYNNEPDNGPRKPRFSIFYYIAVILLIIGFQLAFFWSGSTREIAYSDFRKLIDQNRVESVKLAPEKIYVQLKEDSLSTATNKPFGQNPPAFQMPGKNSSKNEVTVNPVRDEQLIPLLESKGIHYEAIPGNGWINELLQWLLPFGLLIGIYFFMFRRMGGPGSQFMNIGKNKAALYENLDEHTRITFKDVAGLDEAKAEVMEVVDFLKDPKKYTKLGGKLPKGVLLVGPPGTGKTLLAKAVAGEANVPFFSISGSDFVEMFVGVGAARVRDLFKSAKEKAPCIIFIDEIDAVGRSRGKGFMMGANDERENTLNQLLVEMDGFATDKGVILMAATNRADVLDSALLRPGRFDRQIVVDRPDLKGRTDIFAVHTKNLSLSPDVNLKALASQTPGFAGAEIANAANEAALLASRRGKQSIEMKDFEDAIERVIAGLEKKNKVINPREKEIVAYHESGHAIVSWLMPENDPVQKISIVPRGVSALGYTLNIPLEDRYLMTRSELIARICGLLGGRVAEEIIFGEISTGAQNDLERVTEIAYNMVIVYGMSEKVGYLSFLESNNPYYGGPGIDKKYGDETARLIDNEVKEIVEAARKQVHQMLSDNRDKLEMLAKELLSKEIVQYCRIEEILGKRPAGKFSEHLAHDCQNGVDMAMSQLHTEPEEAASPAVSAQQETATDPERKELEEAVERLRQSRNLSSN

SEQ ID NO: 3780 - DNA, 2064 bp, Listeria monocytogenes
  CDS (1)..(2064)
atgaacaggttttttagaaatgcgatattttatgtcataatattccttgttattatcgggattgttgcttcatttaactcaaacaaagaggcagccaaagatattagctattcagaatttgtgagtaagttagaagatggtaaagttaaatccgtagaaatacagccagaccgtagtgtttatacaatcaatggggaatttaaatctagcgataaaagttccgacgataaaaaaacgggtcttggacaaagcaaaacaagcagcactgctttcacaacatacgctttaaacagcgatacttcactaggcgatttgcaaaaaacgcttgataaagaagacgtgaaaacaacaatagtacctgccaaacaaaacagcggttgggttacattcctaacttctattgtaccttttgtaattatcttcatcctcttcttcttcctaatgagccagtctcaaggtggcggcggtggtaaagtaatgagctttggtaaaagtaaagccaaactttacaacgacgacaagaagaaagttcgcttcacagatgtagctggagcagacgaggaaaaacaagaacttgttgaagtagtagaattcctaaaagatccgcgtaaatttgcggacctcggcgctcgtattccaaaaggtgtccttttagtaggtcctccgggtactggtaaaaccttgctagctcgtgcggttgccggtgaagcaggcgtgccattcttctctatctcaggttcagactttgtagaaatgtttgtcggtgtcggtgcaagccgtgtccgtgatttattcgaaaatgcgaagaaaaatgcaccatgtatcattttcattgatgaaattgatgcagtaggtcgtcaacgtggagcaggaatgggcggcggtcacgatgaacgtgaacaaaccctaaaccaattactagttgaaatggatggtttcggtggcaatgaaggtatcatcattattgcagcaactaaccgtgcagacgtacttgacccagcacttcttcgtccaggccgttttgaccgccaaatcatggttgatcgtccagacgtaaaaggccgtgaagcagtacttcgcgttcatgctcgtaacaaaccacttgctaaaagtgttgatttaaaagcaatcgctcaacgtacaccgggattctctggtgccgatttagaaaacttactgaatgaagcagcactcgttgccgcacgttccgataagaaagaaatagatatgagtgacctcgatgaagctagtgaccgcgtaattgccggaccagctaagaaaaatcgagttatctctgaaaaagaacgccgcacagtcgcatatcatgaaggtggtcacgttatcgtcggaatggtacttgatgaagcggaagttgtgcataaagttaccattgttcctcgtggacaagctggtggttatgccgtaatgttaccaaaagaagatcgcttcctaatgacgaaagctgagttaatggaccgtatcactggtttactcggtggacgcgtagccgaagaagttacttttggtgaagtaacaactggtgcaagtaatgactttgaacgtgcaaccgaacttgctcgccgcatggtaactgaatggggtatgagtgacaagattggaccacttcaattcacttctggtaacggtcaagtatttatgggccgcgatttcggtagcgacaaaggatattccgataaaatcgcctacgaaattgatacagaagttcagagcttaatccgctactgttatgaccgcgctaaaacaatcattacagaacaccaagaacaacacaaacttatcgcggaaacattactaaaagtagaaactttagatgctcgccaaattcgttccctatttgatgacggtgtaatgcctccagatatcgatacgattgacgtagaagcagaatatccttccgaaaaagacgaagaagtagcaggtaaatcttttgaagaagaaaaagaagagttaaaagaagaagaaaaaatcgaagaaccaaaagaagtaacttcggaagatgctccaaacattgagcaaacaccaaacgataaaaaagacgaataa

SEQ ID NO: 3781 - protein, 687 aa, Listeria monocytogenes
MNRFFRNAIFYVIIFLVIIGIVASFNSNKEAAKDISYSEFVSKLEDGKVKSVEIQPDRSVYTINGEFKSSDKSSDDKKTGLGQSKTSSTAFTTYALNSDTSLGDLQKTLDKEDVKTTIVPAKQNSGWVTFLTSIVPFVIIFILFFFLMSQSQGGGGGKVMSFGKSKAKLYNDDKKKVRFTDVAGADEEKQELVEVVEFLKDPRKFADLGARIPKGVLLVGPPGTGKTLLARAVAGEAGVPFFSISGSDFVEMFVGVGASRVRDLFENAKKNAPCIIFIDEIDAVGRQRGAGMGGGHDEREQTLNQLLVEMDGFGGNEGIIIIAATNRADVLDPALLRPGRFDRQIMVDRPDVKGREAVLRVHARNKPLAKSVDLKAIAQRTPGFSGADLENLLNEAALVAARSDKKEIDMSDLDEASDRVIAGPAKKNRVISEKERRTVAYHEGGHVIVGMVLDEAEVVHKVTIVPRGQAGGYAVMLPKEDRFLMTKAELMDRITGLLGGRVAEEVTFGEVTTGASNDFERATELARRMVTEWGMSDKIGPLQFTSGNGQVFMGRDFGSDKGYSDKIAYEIDTEVQSLIRYCYDRAKTIITEHQEQHKLIAETLLKVETLDARQIRSLFDDGVMPPDIDTIDVEAEYPSEKDEEVAGKSFEEEKEELKEEEKIEEPKEVTSEDAPNIEQTPNDKKDE

SEQ ID NO: 3782 - DNA, 2148 bp, Oryza sativa (japonica cultivar-group)
  CDS (1)..(2148)
atggcgtggcggcgcgtcctttcgcaggtcgcaaggaaccgatccgcatatgcaatctgcaatgaaataatatatgccaacccatcgaggattcttagaggtgacaccatagcaggtggaacacttagaaacttacatgagaggtatcagtcaagctatgttggtagctttgcacgcaggatgcgacagatggactcaccaagtgaagcctctctgctgaaagaaatatataggagtgatccagaacgtgtcatacagatatttgaaagccaaccttcattgcattccaatccttcagcacttgctgagtatgtaaaagctcttgtcagggttgataggttggaggatagcaccttgctgaaaacattgcagagaggaattgctgcttcagcaagggaggaagaaaaccttggtagtgtttcagaaaatcttggtagtgtttcagcatttagaagtgctggtcaagtgacaaaagatggaattcttggcactgcaaatgcacccattcacatggttacagcagaaacaggtcaatttaaggaacagctttggcgtacctttcgaagtatagcgctaacattcctcctgatttctggcattggagctcttattgaggatagaggaataagcaaaggccttggtctaaatgaagaggttcaaccaagcatggaatctaatacgaaattcagtgatgtaaagggtgtcgatgaagccaaagctgaacttgaggaaatagttcactacctccgagatcccaagcgttttacacgtcttggtggaaaactgccaaaaggtgtcttgctggttggtcctcctggcactggaaagaccatgttagcaagggctattgctggggaagctggtgttcctttcttctcatgcagtggtagtgaatttgaggagatgtttgtaggcgtaggagctagaagagtcagggacctttttgctgcagctaaaaaacgttctccctgtatcatattcatggatgaaattgatgcgatcggtgggagtagaaatccaaaggatcaacagtatatgaagatgacgttgaaccagttgcttgtcgagctggatggctttaagcagaatgaggggataattgttattgctgcaaccaactttcctgagtccctagataaagcactagtgagacctgggcgctttgaccggcatattgttgttccaaatccagatgttgaaggccggcggcaaatcctagagtcccatatgtcaaaggtcttgaagagtgatgatgtggatttgatgatcattgccaggggaacacctggattctcaggtgcagaccttgctaacttggttaatgtggctgctcttaaagctgccatggatggggcaaaagccgttacaatgaatgatcttgagtatgccaaggaccggatcatgatgggcagtgagcgcaagtcagcagttatttctgatgaatcccggaaattgacggcgtaccatgagggagggcacgcccttgttgccatccacactgaaggtgctcaccctgttcacaaagctaccatagttcccaggggaatggcccttggaatggtggcccaactcccggataaagatgagacaagcgtgtcacggaaacagatgctggcaaggctggatgtgtgcatgggagggcgggtggcggaggagcttatttttggggatagcgaggtgacatctggcgcttcatctgattttcagcaagcaactgcagtggcaagagcaatggtaaccaaatatggtatgagcaagcagcttggctttgtttcttacaattatgaggatgatggaaagagcatgagcaccgaaacgagactcctgattgagaaggaggtcaagtgtttcgtggagaatgcttacaacaatgcaaagaatattctcatcaaacacaacaaggagctccatgctctagccaatgcgctgcttgagcacgagacgctcaccggtgcccaaataaagaacatattggcccaagtaaacaacaagcagcagcaggagcatgctattgaagctccacagaagacaccagctgtaccatcatctccagctgcatcagctgcagcggcagcggcagctgcagcagccgcagcacagcaagctgcagcgaaagcgaagggtgaaatcgccggtatcggatcttag

SEQ ID NO: 3783 - protein, 715 aa, Oryza sativa (japonica cultivar-group)
MAWRRVLSQVARNRSAYAICNEIIYANPSRILRGDTIAGGTLRNLHERYQSSYVGSFARRMRQMDSPSEASLLKEIYRSDPERVIQIFESQPSLHSNPSALAEYVKALVRVDRLEDSTLLKTLQRGIAASAREEENLGSVSENLGSVSAFRSAGQVTKDGILGTANAPIHMVTAETGQFKEQLWRTFRSIALTFLLISGIGALIEDRGISKGLGLNEEVQPSMESNTKFSDVKGVDEAKAELEEIVHYLRDPKRFTRLGGKLPKGVLLVGPPGTGKTMLARAIAGEAGVPFFSCSGSEFEEMFVGVGARRVRDLFAAAKKRSPCIIFMDEIDAIGGSRNPKDQQYMKMTLNQLLVELDGFKQNEGIIVIAATNFPESLDKALVRPGRFDRHIVVPNPDVEGRRQILESHMSKVLKSDDVDLMIIARGTPGFSGADLANLVNVAALKAAMDGAKAVTMNDLEYAKDRIMMGSERKSAVISDESRKLTAYHEGGHALVAIHTEGAHPVHKATIVPRGMALGMVAQLPDKDETSVSRKQMLARLDVCMGGRVAEELIFGDSEVTSGASSDFQQATAVARAMVTKYGMSKQLGFVSYNYEDDGKSMSTETRLLIEKEVKCFVENAYNNAKNILIKHNKELHALANALLEHETLTGAQIKNILAQVNNKQQQEHAIEAPQKTPAVPSSPAASAAAAAAAAAAAAQQAAAKAKGEIAGIGS

SEQ ID NO: 3784 - DNA, 2130 bp, Oryza sativa (japonica cultivar-group)
  CDS (1)..(2130)
atggcgtggaggcgcgtcctttcgcagcttgcgaggagtcgaccagcatccacaatctacaatgaactgataacctccagaccttcgtggctgcttagaggtgacgtcaacggtggtggcacacttaaaaacttaaatgagaggtatcagtcaagctttgttggtagcttagcacgcagggtgcaaaacctcgacgttccaagtgaagcctctctgctgaaagaaatatataaaagtgacccagaacgtgtcatacaaatatttgaaagccagccatggttgcactccaatcgtttagcactttcagagtatgttaaagctcttgtcaaggttgataggctggatgatagcaccttgcttaaaacactacggagaggtatggctgtttcaggaggagagggagaaagagttggtagctcttctgcattaaagagtgctggacaagcgacaaaagatggaattcttggcactgcaaacgcacccattcacatggtgacatcagaaacaggccattttaaggatcagatttggcgtacctttcgaagccttgcactaactttccttgtaatttcgggcattggggctcttatagaggatagaggaataagcaaaggtcttggtctaagtcaagaagttcaaccaatcatggattctaaaacaaaattcagtgatgtaaagggtgttgatgaagccaaagctgaacttgaggaaatagttcactatcttcgagatcccaagcgttttactcatcttggtggaaaactgccaaaaggtgtcttgctggttggccctcctggcactgggaagaccatgttagcgagggctgttgctggggaagctggtgtccctttcttctcatgcagcggtagtgagtttgaggagatgtttgtaggtgtaggagctagaagagtcagggacctttttgctgcagctaaaaaacgttctccctgtatcatattcatggatgaaattgatgcaatcggtgggagcagaaatccaaaggatcaacagtacatgaggatgaccttgaaccagttgcttgtcgaactggatggctttaagcagaatgagggaataattgtcattgctgcgaccaactttcctcagtccctagataaagcactagtgagacctgggcgctttgaccggcatattgttgttccgaatcctgatgttgaaggccggcggcaaatcctagagtcccatatgttgaaggtcttgaagagtgatgatgtggatttgatgatcattgccaggggaacacctggattctcaggtgcagaccttgctaacttggtaaatgtggctgctcttaaggctgccatggatggggcaaaagccgttacaatgaatgaccttgagtatgccaaggaccggatcatgatgggcagtgagcgcaagtcagcagttatttctgatgaatcccggaaattgacggcgtaccatgagggagggcacgcccttgttgccatccacactgaaggtgctcgccctgtccacaaagccaccatagtgcccaggggaaggacccttgggatggtgtcccaactcccagaaaaagatgagacaagcttctcacggaaacagatgctggcatggctggatgtctccatggcaggacgggtggcggaggagcttatttttggggatagcgaggtaacatccggtgcatcgtctgatttccagaacgcgaccaaaatggcaagagcaatggttacgaaatatggcatgagcaagcagcttggctttgtctcttacaattatgaggatgatggaaagagcatgagcacagaaacaaggcttctgattgagcaggaggtgaagagcctgctggagaatgcctacaacaatgcaaagaccatcctcacaaaacacagcaaggagcaccatgttctagcccaagcacttcttgagcacgagactctcaccggagcccagataaagaagatcttggcccaggcaaatagcacacagcagcagcaggagcatgctgttgaagctccacggaagacgccagctgcgccgtcgtctccagctgcgtcggcggccgcagcggcggcggcgacggcggccgccgcagcaaaacaagctgcggcgaaagccaagggtgttgctggtattggatcttga

SEQ ID NO: 3785 - protein, 709 aa, Oryza sativa (japonica cultivar-group)
MAWRRVLSQLARSRPASTIYNELITSRPSWLLRGDVNGGGTLKNLNERYQSSFVGSLARRVQNLDVPSEASLLKEIYKSDPERVIQIFESQPWLHSNRLALSEYVKALVKVDRLDDSTLLKTLRRGMAVSGGEGERVGSSSALKSAGQATKDGILGTANAPIHMVTSETGHFKDQIWRTFRSLALTFLVISGIGALIEDRGISKGLGLSQEVQPIMDSKTKFSDVKGVDEAKAELEEIVHYLRDPKRFTHLGGKLPKGVLLVGPPGTGKTMLARAVAGEAGVPFFSCSGSEFEEMFVGVGARRVRDLFAAAKKRSPCIIFMDEIDAIGGSRNPKDQQYMRMTLNQLLVELDGFKQNEGIIVIAATNFPQSLDKALVRPGRFDRHIVVPNPDVEGRRQILESHMLKVLKSDDVDLMIIARGTPGFSGADLANLVNVAALKAAMDGAKAVTMNDLEYAKDRIMMGSERKSAVISDESRKLTAYHEGGHALVAIHTEGARPVHKATIVPRGRTLGMVSQLPEKDETSFSRKQMLAWLDVSMAGRVAEELIFGDSEVTSGASSDFQNATKMARAMVTKYGMSKQLGFVSYNYEDDGKSMSTETRLLIEQEVKSLLENAYNNAKTILTKHSKEHHVLAQALLEHETLTGAQIKKILAQANSTQQQQEHAVEAPRKTPAAPSSPAASAAAAAAATAAAAAKQAAAKAKGVAGIGS

SEQ ID NO: 3786 - DNA, 2211 bp, Drosophila melanogaster (Fruit fly)
  CDS (1)..(2211)
atgttttccaccaccacacactccgtgccctacctgtacctaggcaacttcagcagaaagccgcactactactccgttaatcgaaccaagctgcacgggagcgcgggagctgcccggttgtccaagtccacgtccacgtccagccggagtcatgacctagtgctcgacctgcggaacctgctgagccgttcgagcgccagtatacagggcatggtggagagggcggctcgactgaatggcattctcgaccggcggctggtcgatgatgtgctggccaaggtgacgagcatgctgccctccatgcgcgatgtccgagtcacgttggaggagtcggccacacagatcggtcgtgtccagctgcaaaattatcagttcgaagtttcgctaaccggtgcagcaggttccgtgcccacaggcgccaatgtcaaggtgattccaactattacaccaggtcttcttcgtccgctcttctcacaacaacagctaaatcagatacgtggctttaagacggatcgttccattgaggcggaacaaaagcgcaatcccacaatgacctcccgactaaagaatgctctggccaactcgccccagcgtctggatggggacacaccccttcaggctgaaaaactgagacggctgctggccaaatccgaagagcatggatttaataaagccgagagcctgaaaattgcctttgccgagggctacttggccgccgctaactcggaggactctccaaaatcaggaaaaactatgaaatatctgaagactatcgtcgttatcgtcgtgttcttgggcattttcctgagcttctttacaacctccaatggatccgtatttcgcatacaactgggcaaccaggttgaagtggaccctgaggagatcaacgtcacttttgaggatgtcaagggttgcgacgaagccaagcaggagctcaaggaggtcgttgaattcctgaagagtccggaaaagttctcaaatttgggcggaaagcttccaaagggagtgctcctggttggcccgccgggtactggcaaaacactgctggcccgtgccgtcgccggtgaagccaaagttcctttcttccatgctgccggaccggagttcgacgaggtgctcgtaggccaaggagccagacgagtgcgtgatctgttcaaggcagcaaaggcccgtgccccttgtgttatcttcattgacgaaatcgactcggtgggcgccaagcgaaccaactctgtgctgcatccttacgccaatcagaccatcaatcagctgctctccgagatggatggcttccatcagaacgctggcgtcattgttttgggagccaccaatcgtcgcgacgatttggatcaggctctgctgcgtcccggccgatttgatgtagaagtcatggtgtcgacgcccgatttcactggacgtaaggagatattgtctctgtatctgacgaagattttgcacgatgaaatagacttggacatgctggcgcgcggcacctctggttttactggagcggatctggaaaacatgattaaccaagcggcgttaagagctgccatcgatggagccgaaacggtcagcatgaagcatttggaaacggcacgagacaaagtacttatgggacccgagcgcaaggctcgtctaccggacgaggaggccaacaccataaccgcttaccacgagggcggccacgcgattgtggccttctacaccaaggagtcgcatccgctgcacaaggtgaccatcatgccccgcggaccctcccttggacacaccgcctacataccggagaaggagcgttaccatgtcacaaaggcacagctgctggccatgatggacaccatgatgggcggtcgtgctgctgaggaactggtcttcggcacggacaagattacgtcgggagccagcagtgatctcaagcaggcaacctcgatcgcgacgcatatggtcagggactggggcatgtcggacaaggtcggtcttcgcaccatcgaggcgtcaaagggtctgggcaccggtgacacccttggtcccaacaccattgaagccgtggacgcggagatcaagcgcatcctcagcgacagctacgagcgggcgaaggctatcctgcgaaaacacaccagggagcacaaagcgcttgcggaggcgcttctcaagtacgagactcttgacgccgacgacatcaaggcaatactgaatgaaagccagacgtag

SEQ ID NO: 3787 - protein, 736 aa, Drosophila melanogaster (Fruit fly)
MFSTTTHSVPYLYLGNFSRKPHYYSVNRTKLHGSAGAARLSKSTSTSSRSHDLVLDLRNLLSRSSASIQGMVERAARLNGILDRRLVDDVLAKVTSMLPSMRDVRVTLEESATQIGRVQLQNYQFEVSLTGAAGSVPTGANVKVIPTITPGLLRPLFSQQQLNQIRGFKTDRSIEAEQKRNPTMTSRLKNALANSPQRLDGDTPLQAEKLRRLLAKSEEHGFNKAESLKIAFAEGYLAAANSEDSPKSGKTMKYLKTIVVIVVFLGIFLSFFTTSNGSVFRIQLGNQVEVDPEEINVTFEDVKGCDEAKQELKEVVEFLKSPEKFSNLGGKLPKGVLLVGPPGTGKTLLARAVAGEAKVPFFHAAGPEFDEVLVGQGARRVRDLFKAAKARAPCVIFIDEIDSVGAKRTNSVLHPYANQTINQLLSEMDGFHQNAGVIVLGATNRRDDLDQALLRPGRFDVEVMVSTPDFTGRKEILSLYLTKILHDEIDLDMLARGTSGFTGADLENMINQAALRAAIDGAETVSMKHLETARDKVLMGPERKARLPDEEANTITAYHEGGHAIVAFYTKESHPLHKVTIMPRGPSLGHTAYIPEKERYHVTKAQLLAMMDTMMGGRAAEELVFGTDKITSGASSDLKQATSIATHMVRDWGMSDKVGLRTIEASKGLGTGDTLGPNTIEAVDAEIKRILSDSYERAKAILRKHTREHKALAEALLKYETLDADDIKAILNESQT

SEQ ID NO: 3788 - DNA, 1947 bp, Xanthomonas axonopodis (pv. citri)
  CDS (1)..(1947)
atgaggatgaacgacttgaccaagaatctgctgctgtgggtggtcgtcgcagttgtgctgatggttgtcttccagagcttctcgccgcggatggcgggcggcgtcggtgccgactcgatcacctacacccagttcctgaaggaagtggactccgggcgcgtcaaatcggtggattacaccgacgagaccaacctggccgtcaacgcgatccgcttcaagcgcaccgacggcagcgaggccaccgtctacggtccccgcgacgacaagctggtcgacgtgctgtacagcaagaacatcgaaatgacccgccagaagccctcgaccggccctggcttctggtcgctggtgctcaatttccttcccgtcatcctgatcatcggcttctggctgttcatcatgcgccagatgcaggggggtggtggcggcgcgaagggcgcgatgagcttcggcaagtcgcgcgccaaattgcagggcgaggaccagatcaagatcaccttcgccgacgtcgccggttgcgacgaggccaaggaagaagtgggcgaattggtggacttcctgcgcgacccgaccaagttcaccaagctgggcggcaagattccgcgaggcgtgttgatggtcggcccgccgggtaccggcaagaccctgctcgccaaggcgatcgccggcgaggccaaggtgccgttcttcagcatctccggttccgacttcgtcgaaatgttcgtcggcgtgggtgccagccgcgtgcgcgacatgttcgagcaggccaagaagcacgcgccatgcatcatcttcatcgacgaaatcgatgcggtgggccgtcatcgcggtgccggtctcggcggcgggcatgacgagcgcgagcagaccttgaaccagctgctggtcgaaatggacggtttcgagggtggcgaaggcgtgatcgtgattgcggcgaccaaccgtcccgacgtgctggatccggcgctgctgcgtccaggccgttttgaccgtcaggtcgtggtcggcctgccggacgtcaagggccgcgagcagatcctgcgcgtgcacatgcgcaagctgccgctggccgacgatgtcgtgccgatggtcatcgcccgcggtaccccgggtttctcgggcgccgacttggccaacctgtgcaacgaggcagcattgttcgcggcgcgtggcagcgagaaggaagtccgcatggaccacttcgaccgtgcccgcgacaagattctgatgggtgccgagcgccgctcgatggccatgagcgaggacgagaagacccttaccgcgtatcacgaggcgggccacgccatcgtcggccgtctggtgccggagcacgacccggtctacaaggtcaccatcattccgcgtggccgcgcgctcggcgtgacgatgtatctgccggaaggcgaccgctactcgatgaaccgtgtcgcgatcgagtcgcagctgtgctcgctgtacggtggtcgcgttgccgaagagctgatcttcggcggcgacaaggtcaccaccggtgcgtccaacgacatcgagcgggccaccaagatggcgcgcaacatggtcaccaagtggggcctgtccgacgagcttggcccggtggcctatggcgaggaagaggacgaggtgttcctgggccgttcggtgacccagcacaagaacgtttccgacgagaccgcgcgcaagatcgacgaagtggtgcgttcgatcctggacaaggcctacagcaagaccaagaccatcctcaccgagaacctggacaagctgcacgcgatgtcgcagttgttgctgcagtacgaaaccatcgacgtgccgcagatcgatgccatcatggaaggccgcgagccgccgccgccggctggttggggcaagtccgacaaggacggtggcaacaacaacgacaagggtagtccgcgtccattgccgcccatcgccggacccgccgagcaactctaa

SEQ ID NO: 3789 - protein, 648 aa, Xanthomonas axonopodis (pv. citri)
MRMNDLTKNLLLWVVVAVVLMVVFQSFSPRMAGGVGADSITYTQFLKEVDSGRVKSVDYTDETNLAVNAIRFKRTDGSEATVYGPRDDKLVDVLYSKNIEMTRQKPSTGPGFWSLVLNFLPVILIIGFWLFIMRQMQGGGGGAKGAMSFGKSRAKLQGEDQIKITFADVAGCDEAKEEVGELVDFLRDPTKFTKLGGKIPRGVLMVGPPGTGKTLLAKAIAGEAKVPFFSISGSDFVEMFVGVGASRVRDMFEQAKKHAPCIIFIDEIDAVGRHRGAGLGGGHDEREQTLNQLLVEMDGFEGGEGVIVIAATNRPDVLDPALLRPGRFDRQVVVGLPDVKGREQILRVHMRKLPLADDVVPMVIARGTPGFSGADLANLCNEAALFAARGSEKEVRMDHFDRARDKILMGAERRSMAMSEDEKTLTAYHEAGHAIVGRLVPEHDPVYKVTIIPRGRALGVTMYLPEGDRYSMNRVAIESQLCSLYGGRVAEELIFGGDKVTTGASNDIERATKMARNMVTKWGLSDELGPVAYGEEEDEVFLGRSVTQHKNVSDETARKIDEVVRSILDKAYSKTKTILTENLDKLHAMSQLLLQYETIDVPQIDAIMEGREPPPPAGWGKSDKDGGNNNDKGSPRPLPPIAGPAEQL

SEQ ID NO: 3790 - DNA, 2145 bp, Fusobacterium nucleatum (subsp. nucleatum)
  CDS (1)..(2145)
atgaacgataatcagtttgaaaatgaagatttaaaaaacaaagatgactctgatgttcacgagaagcaagaaaataaagaaaacgaaaaagaagaaccaaaacaagaaaaatctcaagaacaagatagtcacaatgaaaataaaaatgattctgaagataaaaaatcatctgatgaagataaaaaacaagatgataaatataatccttttaataataaaagagatgatgaaaaaagaagagttgttggaaaggctgtaaaagtaaattttaactttaaaggtttattaatgttaatctttataataactttggcagtggttgttcctagtataatggatgaaaataaaaatcaacaaatagttgatataagttattcagattttataaaaaatattgaaaataaaaaaattggtgtggttgaagaaaaagatggctatgtttacggttataaagcaagtgaagtaaaatatcttgaaacaaaatcaaatagtataaaatctaaattaggttttgatggtaaaaatgaagtacaaggacttaaagctagacttataacaaatagattaggtgaagatagtaacttaatggctgttattaataataataatgctataatccaatctgttgaacctcctgagccttcattattccttagtatagtattagcattcctaccttatatcataatgataggtttcttagtatttatgctaaacagaatgaatagaggtggaagtggtggtggaccacaaatatttaatatgggtaaatcaagagcaaaagaaaacggtgaaaatatttctaatgtaacttttgctgatgttgctggtattgatgaagctaaacaagagttaaaagaagttgttgatttcttaaaagagcctgaaaaatttagaaaaattggggctaaaattcctaagggtgttcttcttttaggagaacctggaactggtaaaactctacttgcaaaagcagttgctggagaagctaaagtacctttctttagtatgtctggttctgaatttgtggaaatgtttgttggagttggagcttcaagagttagagatttatttaataaagcaagaaaaaatgcaccttgtatagtatttatagatgaaatagatgctgttggtagaaaaagaggaactggacaaggtggaggaaatgatgaaagagaacaaactctaaaccaacttcttgttgaaatggatggttttggtactgacgaaactataattgttctagcagcgacaaacagagctgatgtattagataaagctttaagaagaccaggaagatttgatagacaagttgttgttgatatgcctgatgtcaaaggtagagaagaaatattaaaagttcatgccaaaggtaaaaaatttgccccagatgtagattttaaaattattgcaaagaaaacagctggaatggctggtgctgatttagctaatatcttaaacgaaggagctatcttagcagcaagagcaggaagaactgagataactatggctgacttagaagaagcatctgaaaaagttcaaatgggacctgaaagaaaatcaaaggttgttccagaagatgaaaaaaagatggtagcttatcatgaagttgggcatggtattgtaggatatataattggtggaggagacagagttcataagattactatgattccaagaggtcctgcaggaggatatacattatcacttccagaagaagagaaaagttttcattcaaaaaaatatatgttagatagaattgctagatattttggtggaagagcagctgaagaaattatttttggtaaagaaaatattactgatggtgcaggtagtgatatttattatgcaactttaattgctaaagatattgttacaaaatatggaatgacagaaaagtttggacctgtatttttagaggcaactgaagaagattatatgcttcaaagaaaatattattctgaacaaactggaaaagaagttgatgatgaaataagaaaaatcattactgaacaatattcaagagctaaaaatattttattagaaaatagagaaaaattggaagaagttacaactatactacttgaaaaagaaactattatgggacctgaatttgaagccataatgagaggtgaaaatatttaa

SEQ ID NO: 3791 - protein, 714 aa, Fusobacterium nucleatum (subsp. nucleatum)
MNDNQFENEDLKNKDDSDVHEKQENKENEKEEPKQEKSQEQDSHNENKNDSEDKKSSDEDKKQDDKYNPFNNKRDDEKRRVVGKAVKVNFNFKGLLMLIFIITLAVVVPSIMDENKNQQIVDISYSDFIKNIENKKIGVVEEKDGYVYGYKASEVKYLETKSNSIKSKLGFDGKNEVQGLKARLITNRLGEDSNLMAVINNNNAIIQSVEPPEPSLFLSIVLAFLPYIIMIGFLVFMLNRMNRGGSGGGPQIFNMGKSRAKENGENISNVTFADVAGIDEAKQELKEVVDFLKEPEKFRKIGAKIPKGVLLLGEPGTGKTLLAKAVAGEAKVPFFSMSGSEFVEMFVGVGASRVRDLFNKARKNAPCIVFIDEIDAVGRKRGTGQGGGNDEREQTLNQLLVEMDGFGTDETIIVLAATNRADVLDKALRRPGRFDRQVVVDMPDVKGREEILKVHAKGKKFAPDVDFKIIAKKTAGMAGADLANILNEGAILAARAGRTEITMADLEEASEKVQMGPERKSKVVPEDEKKMVAYHEVGHGIVGYIIGGGDRVHKITMIPRGPAGGYTLSLPEEEKSFHSKKYMLDRIARYFGGRAAEEIIFGKENITDGAGSDIYYATLIAKDIVTKYGMTEKFGPVFLEATEEDYMLQRKYYSEQTGKEVDDEIRKIITEQYSRAKNILLENREKLEEVTTILLEKETIMGPEFEAIMRGENI

SEQ ID NO: 3792 - DNA, 1836 bp, Thermoanaerobacter tengcongensis
  CDS (1)..(1836)
atgaaagataacaataaaattttcaggagcatggtactttatctcctcattttcatagctatatatgcgatggtacagctttattcccaagctacgcctcaggtaactaaaatagactacggagagctggtaaggtatataagtgcaaatcagataaaaagtattactctttcgggcaatcaggtgaaaggcgtattcaaaaacggcaccgagtttgaaagcagtgtgcctgatataaccaattttatgtcttttgtggacccgtatatattggaaggcaaactggattttaaatatgagccccaggtgggaccgccttggtgggttcagatgcttccttccctgttcttggtaggtgtgctcattctcttctggtatatatttatgcagcaagcacagggcgggggaggaagcagggtgatgtcttttggcaagagcagagctagaatggttacagataaggacaaaagagttacttttaatgatgtggcgggtgcagatgaagaaaaagaagaactccaagagattgtagagtttttgaaatatccaaaaaaatttattgaattaggggcgagaattcctaaaggagtgcttttagtaggtccaccgggcacggggaagactcttctggcaagagctgttgcaggagaggcaggggttccctttttcagcataagcggttctgactttgtggagatgtttgtgggtgtgggtgcagcgagagtaagagacctttttgagcaggcgaagaaaaacgcaccttgtatagtgtttatagatgagatagatgctgtaggtaggcagagaggggcaggtctgggcggagggcatgacgagagagagcaaacgttgaaccagttattggttgagatggacggatttagtgtaaatgaagggataatcgtaattgcagctacaaacaggcctgatatactggatcccgcccttttaaggcctgggaggtttgacaggcatattgtggtcaatattcctgacataaaagggagagaagaaattttgaaagtccatgctagaaataaacctctggcgcctgacgtgtcccttcaagttattgccaggaggacgccgggctttacaggggctgacctagaaaatgtgatgaatgaggcagctctgctggcggcaagaaagggtttaaagcagataaccatggcagaattggaggaagctatcaccagagtcgtagctgggcctgaaaaaaggagtagaatcatgtctgaaaaagacaaaaaattggtagcctatcacgaagcagggcatgctgttgttgcgaagcttttgcccacgactccgcctgttcacgaggttaccatcattccaagagggagagctggaggttacacgatgcttctccccgaagaagacaagtactacatgtcaaagtcagagatgatggatgaaatagttcaccttttgggagggcgcgctgctgagaagttggtgctaaatgatataagcactggcgctcagaatgatatagaaagagctaccaatattgccaggaaaatggtgacagagtatggaatgagcgacagattaggtcctatgacttttggcacaaaaagcgaagaagtgtttttaggaagggatttaggaaggacgagaaactacagtgaggaagtggctgcagagatagacagagagataaggagaataatagaggaagcttataagagagcggaaagccttctacaagagaatatagataaacttcacagagtggcgaaggcccttatggaaaaagagaagctcaatggagaagagtttgaaaaagtatttaatggagaagaaatagaaggggtttcttttgcctga

SEQ ID NO: 3793 - protein, 611 aa, Thermoanaerobacter tengcongensis
MKDNNKIFRSMVLYLLIFIAIYAMVQLYSQATPQVTKIDYGELVRYISANQIKSITLSGNQVKGVFKNGTEFESSVPDITNFMSFVDPYILEGKLDFKYEPQVGPPWWVQMLPSLFLVGVLILFWYIFMQQAQGGGGSRVMSFGKSRARMVTDKDKRVTFNDVAGADEEKEELQEIVEFLKYPKKFIELGARIPKGVLLVGPPGTGKTLLARAVAGEAGVPFFSISGSDFVEMFVGVGAARVRDLFEQAKKNAPCIVFIDEIDAVGRQRGAGLGGGHDEREQTLNQLLVEMDGFSVNEGIIVIAATNRPDILDPALLRPGRFDRHIVVNIPDIKGREEILKVHARNKPLAPDVSLQVIARRTPGFTGADLENVMNEAALLAARKGLKQITMAELEEAITRVVAGPEKRSRIMSEKDKKLVAYHEAGHAVVAKLLPTTPPVHEVTIIPRGRAGGYTMLLPEEDKYYMSKSEMMDEIVHLLGGRAAEKLVLNDISTGAQNDIERATNIARKMVTEYGMSDRLGPMTFGTKSEEVFLGRDLGRTRNYSEEVAAEIDREIRRIIEEAYKRAESLLQENIDKLHRVAKALMEKEKLNGEEFEKVFNGEEIEGVSFA

SEQ ID NO: 3794 - DNA, 2058 bp, Arabidopsis thaliana (Mouse-ear cress)
  CDS (1)..(2058)
atggctgcttcatcggcttgtcttctcggaaatggattatctgtctacacaaccaaacagaggttccaaaagcttgggcttgataggacatctaaagttacagttgtgaaggcttctttggatgagaagaaacatgaagggagaagaggtttctttaaactcttactaggaaacgctgctgctggagttggtttgcttgcaagtggaaacgctaatgcagacgaacaaggacaaggggtttcttcgtctagaatgtcttattctaggttcctagagtatttagacaagggaagggttgagaaagtagatttgtatgagaatgggactatagctattgtggaggccgtttctcctgagttgggtaaccggattcagcgtgtacgtgtgcagctacctggattgagtcaggagcttctccagaagttgagggctaagaatattgatttcgcagcacataatgctcaggaggaccaaggttctccaatactcaacttgattgggaatcttgcattccctgttattttgattggcggtttgttccttctctcgagaagatcctctggtggaatgggtggccctggtggtcctggcttcccactccaaattggtcagtcgaaagcaaagtttcagatggaaccaaacactggtgtaacttttgatgatgttgctggagtcgatgaagccaagcaagatttcatggaagtggtggagtttctgaagaagcctgagaggttcactgcggttggtgcccggatcccaaaaggtgttcttcttgttggtcctcctggtaccgggaaaaccctgttggcaaaagccattgctggtgaagctggtgtgcccttcttttccatctcgggttctgagtttgttgagatgtttgtcggtgttggtgcatcaagggtccgcgatcttttcaaaaaagccaaagaaaatgctccatgcattgttttcgtggatgaaatagatgctgttggtaggcaaagaggaactggaattggtggaggtaatgatgaaagagaacagacccttaatcagctcctgactgagatggatggttttgagggtaacactggtgttatcgtagttgctgcaaccaacagagcagacattcttgactccgctttgctaagaccagggcgttttgaccggcaggtatctgttgacgttccggacgttaagggaagaacagatatactcaaggttcactcggggaataagaaatttgaaagcggtgtttcacttgaagtaatagccatgagaacacctggatttagcggagctgatcttgcaaacctcttgaacgaggctgccatattggccggccgccgtggaaagactgcaatatcatcaaaagagattgatgactcaattgacagaattgtagctggcatggaaggaacagtcatgacagatgggaagagcaaaagcttggttgcttaccatgaagttggccatgccatatgtggaacattgactccagggcatgatgctgttcaaaaggtcacgttgataccacgaggccaggctagaggtctgacttggttcattccctcagatgacccaactctaatctccaaacagcaactctttgcaagaattgttggtggactcggtggtagagctgccgaagaagtcatctttggtgagtctgaggtgactactggtgcagttagtgacttgcaacagatcaccggtttggctaagcagatggtgacaacatttgggatgtctgaaatcggaccatggtcgctaatggattcatcggagcaaagcgatgtcattatgaggatgatggcaagaaactcaatgtctgagaagcttgcaaatgatattgatacagcggtgaagacattatcagacaaagcgtacgagatagctttgagccagattagaaacaatcgtgaagccatggacaagattgttgaaatacttcttgagaaagagactatgtcaggcgatgaattccgagcaatcctatctgaattcacagaaatcccacctgaaaaccgtgttgcttcttcaacatccacatcaacaccaacaccagcgtctgtctga

SEQ ID NO: 3795 - protein, 685 aa, Arabidopsis thaliana (Mouse-ear cress)
MAASSACLLGNGLSVYTTKQRFQKLGLDRTSKVTVVKASLDEKKHEGRRGFFKLLLGNAAAGVGLLASGNANADEQGQGVSSSRMSYSRFLEYLDKGRVEKVDLYENGTIAIVEAVSPELGNRIQRVRVQLPGLSQELLQKLRAKNIDFAAHNAQEDQGSPILNLIGNLAFPVILIGGLFLLSRRSSGGMGGPGGPGFPLQIGQSKAKFQMEPNTGVTFDDVAGVDEAKQDFMEVVEFLKKPERFTAVGARIPKGVLLVGPPGTGKTLLAKAIAGEAGVPFFSISGSEFVEMFVGVGASRVRDLFKKAKENAPCIVFVDEIDAVGRQRGTGIGGGNDEREQTLNQLLTEMDGFEGNTGVIVVAATNRADILDSALLRPGRFDRQVSVDVPDVKGRTDILKVHSGNKKFESGVSLEVIAMRTPGFSGADLANLLNEAAILAGRRGKTAISSKEIDDSIDRIVAGMEGTVMTDGKSKSLVAYHEVGHAICGTLTPGHDAVQKVTLIPRGQARGLTWFIPSDDPTLISKQQLFARIVGGLGGRAAEEVIFGESEVTTGAVSDLQQITGLAKQMVTTFGMSEIGPWSLMDSSEQSDVIMRMMARNSMSEKLANDIDTAVKTLSDKAYEIALSQIRNNREAMDKIVEILLEKETMSGDEFRAILSEFTEIPPENRVASSTSTSTPTPASV

SEQ ID NO: 3796 - DNA, 1806 bp, Clostridium perfringens
  CDS (1)..(1806)
atgaaaaaattacaaagtatgattacttatatagctatttttgctgtagtgcttatgtttgcatttgctttttatagaaatggaactcaaggaaaagtaatatcatatactgaatttaaagaagcatatgtagaaaataaaattgaaacaatgaccataaaagaagataaaatgtcagttgatggggtttttaaagatggtaagaggtttacttcatatgtttcaaataagatgttagacaatcttttacaagagactcagggggtagaaactgtaataaagtatactccacctaataatatgggtatttggattagtttccttccaacaatacttataataggtgtgatattctttggtttatttatgttcacacagcaagctcaaaacagtggtggaaatagaggggtaatgaatttcggtaaaagtaaagctaagatggctaatttagacggaaagaaagttacgttcaaagatgttgctggagctgatgaagaaaaaggtgaattagaagaaattgttgatttcttaaaacaacctaagagatatatagaaatgggagcaagaatacctaaaggagttcttttagtagggcctccaggaacaggtaagacacttcttgcaaaagctatagcaggagaagctggtgttcctttctttagtatatcaggttcagatttcgttgaaatgtttgttggagttggtgcttcaagagtaagagatttatttgagcaagctaagaaaaatgctccatgtattatatttatagacgaaatcgatgctgttggtagacaaagaggtgctggacttggtggcggtcatgatgaaagagaacaaacattaaaccaattactagttgagatggacggttttggagttaatgaaggaataattatgatagctgctacaaatagaccagatatcttagatccagcattattaagaccaggaagatttgatagaagaattttagtaggtgcacctgatgttaagggtagagaagaagtactaaaagttcatacaagaaataaacatctatcagaagatgtagatttaaaagttttagctaaaatgacaccaggatttagtggtgcagatcttgaaaacttaactaacgaagctgcattattagcggttagaggtggcaaaagtagcatagatatggcagacattgaagaggctataacaagagtgatagctgggccagagaagaagagtagagttgttagtgaatatgatagaagaatcactgcagttcacgaatctggtcacgctgttgtaagtaatgttctagagtatgcagatccagttcatgaaataagtataattcaaagaggaatggctgcaggatacacaatgaatttaccagaggaagatagaactcacacatctaagaaacaacttaaggataagatggttgaacttttaggtggaagagtggctgagaaattagttattggagatataagtgccggtgctaaaaatgatatagatagagctagtcacattgctagaagtatggttatggaatacggaatgagtgatgttattggacctatatcatttggtaatagcgatggtggcgaagtattcttaggtagagacattggaaagagtagtaacataagtgaagaaactagcgctaaaatagatgaagaaatcaagaagttaattgatgaagcttataatagagcagaatctatattaagagaaaatataagtaaattaaatgcagtaactgatgtgttacttcaaaaagaaaaaattgatggtgatgagtttagagaaatatttaaaaactcatag

SEQ ID NO: 3797 - protein, 601 aa, Clostridium perfringens
MKKLQSMITYIAIFAVVLMFAFAFYRNGTQGKVISYTEFKEAYVENKIETMTIKEDKMSVDGVFKDGKRFTSYVSNKMLDNLLQETQGVETVIKYTPPNNMGIWISFLPTILIIGVIFFGLFMFTQQAQNSGGNRGVMNFGKSKAKMANLDGKKVTFKDVAGADEEKGELEEIVDFLKQPKRYIEMGARIPKGVLLVGPPGTGKTLLAKAIAGEAGVPFFSISGSDFVEMFVGVGASRVRDLFEQAKKNAPCIIFIDEIDAVGRQRGAGLGGGHDEREQTLNQLLVEMDGFGVNEGIIMIAATNRPDILDPALLRPGRFDRRILVGAPDVKGREEVLKVHTRNKHLSEDVDLKVLAKMTPGFSGADLENLTNEAALLAVRGGKSSIDMADIEEAITRVIAGPEKKSRVVSEYDRRITAVHESGHAVVSNVLEYADPVHEISIIQRGMAAGYTMNLPEEDRTHTSKKQLKDKMVELLGGRVAEKLVIGDISAGAKNDIDRASHIARSMVMEYGMSDVIGPISFGNSDGGEVFLGRDIGKSSNISEETSAKIDEEIKKLIDEAYNRAESILRENISKLNAVTDVLLQKEKIDGDEFREIFKNS

SEQ ID NO: 3798 - DNA, 2154 bp, Clostridium perfringens
  CDS (1)..(2154)
atgtttaaagataaaaaaatgcttaaatatattgtcatatatagtattatagcgtttggtatattattaacctttaatatggttaaagatgaaatgctatatgaaaaagtagattatagcactttcatgcaaatgttagataaaaaagaagttaaatcagtaaacttttcaggaaatcaaattgagataacaccttcagatagcagtaatttaaaaggaaaaatcttatatacaactaatccagcagttgctggtattactcaaccagatttaattaaagatttaactgcagctggggtaggattcaatgtaactaaaccagaaaactatcaacttttaggtttattaatgtcatgggttttcccgttaatacttatattctttgttggtagaatgatgttctctaaaatgaataataaaatgggtggaggagtaatgtcatttggtaaaaataatgctaagctttatgctgaaaatgagactggaataacatttaaagatgttgcaggtcaagatgaagctaaagaatccttagtagaaattgtagactttttacatgatacaagaaaatacgtagaaataggagctaagcttccaaagggtgctttattagtagggcctccaggaacaggtaaaactttacttgctaaggctgttgcaggagaagcaaaagtaccatttttctctatgtcaggttcagacttcgttgaaatgtttgtaggtatgggagctgcgagagtaagagatttattcaagcaagcagaagaaaaagctccatgtatagttttcatagatgagattgatgctattggtaagagtagagatggtgctattcaaggaaatgatgaaagagaacaaactcttaaccaattattaactgagatggatggtttcgattcttcaaaaggggttgttattttagcagctacaaatagaccagaagttttagataaagctttattaagaccaggtagatttgatagaagaataattgttgatagaccagatttaataggtagagaggaaatattaaaggttcactctagagatgttaaattatcagatgatgtatctttagaagaaatagcaaaatctactccaggtgctgttggggcagacttagcaaacatagttaatgaagctgctttaagagctgtaaaacatggaagaaagtttgtaattcaagaagacttagacgaagctgttgaagttataatagcaggtcaagaaaagagagatagaatactttcaccaaaagaaaagaaaatagttgcatatcatgaagtaggtcacgcattagttgcagctttattaaataatactgacccagttcataagataacaatagttcctagaacaatgggagctttaggatacacaatgcaacttccagaggaagaaaaatacttagtatctaaggaagaaatgatagatcaaatatcagttatgcttggtggtagagcagcagaggaagtagtatttaatagtataactactggtgcatcaaatgatattgaaagagctactcaatcagctagaaatatgataactatttatggtatgagtgagaggtttgatatgatggctttagaagctatgagtaatagatacttagatggaagaccagttagaaactgttcagaaactactgctgccatagctgatgaagaagttttacaagttattaaaaaagctcatgaaaaatcaattaagattttaattgaaaatagagagttattagatgagataacaggtgttcttttagataaagaaactatcatgggtgacgaattcatggaaatagtttatagtaaatatccagaaaagagagaagctgatgaaaaggctaagaaggaaattcaaagtctaagagagcaagctttagctaagagaaaagaaaaagaagaagcaatcaaaaaagctagagaagaagcattaagattagaagaagagcaaagaaaacaagctgaattaaaagctatgatagaagctcaagaagaggctgcaaaattagcaagagctaataatgaagctaacaatgatgatttagactcatctaaagaaaatgaagaagttaaatctaatgttaatgatagagctacagaagaaaagaaagatgatagctctacaaataataaagttgacggtgaataa

SEQ ID NO: 3799 - protein, 717 aa, Clostridium perfringens
MFKDKKMLKYIVIYSIIAFGILLTFNMVKDEMLYEKVDYSTFMQMLDKKEVKSVNFSGNQIEITPSDSSNLKGKILYTTNPAVAGITQPDLIKDLTAAGVGFNVTKPENYQLLGLLMSWVFPLILIFFVGRMMFSKMNNKMGGGVMSFGKNNAKLYAENETGITFKDVAGQDEAKESLVEIVDFLHDTRKYVEIGAKLPKGALLVGPPGTGKTLLAKAVAGEAKVPFFSMSGSDFVEMFVGMGAARVRDLFKQAEEKAPCIVFIDEIDAIGKSRDGAIQGNDEREQTLNQLLTEMDGFDSSKGVVILAATNRPEVLDKALLRPGRFDRRIIVDRPDLIGREEILKVHSRDVKLSDDVSLEEIAKSTPGAVGADLANIVNEAALRAVKHGRKFVIQEDLDEAVEVIIAGQEKRDRILSPKEKKIVAYHEVGHALVAALLNNTDPVHKITIVPRTMGALGYTMQLPEEEKYLVSKEEMIDQISVMLGGRAAEEVVFNSITTGASNDIERATQSARNMITIYGMSERFDMMALEAMSNRYLDGRPVRNCSETTAAIADEEVLQVIKKAHEKSIKILIENRELLDEITGVLLDKETIMGDEFMEIVYSKYPEKREADEKAKKEIQSLREQALAKRKEKEEAIKKAREEALRLEEEQRKQAELKAMIEAQEEAAKLARANNEANNDDLDSSKENEEVKSNVNDRATEEKKDDSSTNNKVDGE

SEQ ID NO: 3800 - DNA, 1887 bp, Ralstonia solanacearum (Pseudomonas solanacearum)
  CDS (1)..(1887)
atgaataacaactggtttcagaaggcggccatctggctggtgattgccttggtgctgttcaccgtcttcaagcagttcgacaagccgcgcgcccaggaaggtgtgacgtactcgcaattcatggacgatgcgaaaggcggcaagatcaagcgcgtcgaagtgcagggccgtaacctgctggtgacgcccaacgagggcggcaagtacaccatcatttcgccgggcgacatctggatggtcggcgacctgatgaagtacggcgttcaggtgaccggcaaggcggaggaagagcaaggtgtgcttctttctgcgctttactacctcggcccgaccctgctgatcatcgtgttctggttctacatgatgcgacagatgcaaggcggcgggaaaggcggcgccttctcgttcggcaagtcgcgggcgcggctgatcgacgagaacaacaacagcgtcacgttcgccgatgtggcgggttgcgacgaatccaaggaggaagtggtcgagctggtcgacttcctcaaggatcctcaaaaattccagaagctgggtggccgcattccgcgcggcgtactgctggtcggccccccgggcaccggcaagacgctgctggcccgcgccatcgccggcgaagccaaggtgccgttcttcagcatctccggctcggacttcgttgaaatgttcgtcggcgtgggcgcggcccgcgtgcgcgacatgttcgagaacgccaagaagcaggcgccgtgcatcgtcttcatcgacgaaatcgacgctgtcggccgccatcgcggcgccggcatgggcggcggcaatgacgagcgcgagcagaccctcaaccagatgctggtcgagatggacggcttcgaggccaactcgggcgtgatcgtcatcgccgcgaccaaccgtgccgacgtgctggacaaggcgctgctgcgtccgggccgctttgaccgccaggtgtacgtgggcctgccggatatccgcggccgcgagcagatcctcaaggtccacatgcgcaaggtgccgatcggcaacgacgtggatgcttccgtgctggcgcgcggtacgccgggcttctccggcgcggacctggccaacctggtcaacgaggctgcgttgttcgccgcccgccgcaacaagcgcgtggtcgacatgcaggacttcgaagacgccaaggacaagatctacatgggtccggagcgcaagtcggccgtgatccgcgaagaggaacgccgcgccacggcgtatcacgagtcgggccacgccgtggtggccaagctgctgcccaaggccgatccggtgcacaaggtcacgatcatgccgcggggctgggccggcggcctgacctggcagttgccggagcacgacaagcactacgcctacaaggacacgatgctcgaagagatcgccatcctgttcggcggccgtgctgcggaagaggtgttcctgggcgcgatgagcaccggtgcctccaacgacttcgagcgtgccaccaagatggcacgcgacatggtgacgcgctacggcatgagcgattcgctcggcaccatggtctacgtggacaccgagcaggacggtttcttcggccgcatgtcgtccaagacggtgtccgaggcaacgcagcagaaggtcgattcggagatccgccgcatcgtcgacgagcagtacgcgctggccaagcgcctgctcgaagagaaccgcgagaaggtcgaggcgatgaccgctgcactgctggaatgggaaaccatcgacgccgaccaggtgaacgacatcatggccggcaagccgccgcgtccgccgcgctatggttcgagcggtggcggcagcacgccgccgaatggcggtacgcctgcgggtgtgacgccgggcaacgtgcctgccacggcttga

SEQ ID NO: 3801 - protein, 628 aa, Ralstonia solanacearum (Pseudomonas solanacearum)
MNNNWFQKAAIWLVIALVLFTVFKQFDKPRAQEGVTYSQFMDDAKGGKIKRVEVQGRNLLVTPNEGGKYTIISPGDIWMVGDLMKYGVQVTGKAEEEQGVLLSALYYLGPTLLIIVFWFYMMRQMQGGGKGGAFSFGKSRARLIDENNNSVTFADVAGCDESKEEVVELVDFLKDPQKFQKLGGRIPRGVLLVGPPGTGKTLLARAIAGEAKVPFFSISGSDFVEMFVGVGAARVRDMFENAKKQAPCIVFIDEIDAVGRHRGAGMGGGNDEREQTLNQMLVEMDGFEANSGVIVIAATNRADVLDKALLRPGRFDRQVYVGLPDIRGREQILKVHMRKVPIGNDVDASVLARGTPGFSGADLANLVNEAALFAARRNKRVVDMQDFEDAKDKIYMGPERKSAVIREEERRATAYHESGHAVVAKLLPKADPVHKVTIMPRGWAGGLTWQLPEHDKHYAYKDTMLEEIAILFGGRAAEEVFLGAMSTGASNDFERATKMARDMVTRYGMSDSLGTMVYVDTEQDGFFGRMSSKTVSEATQQKVDSEIRRIVDEQYALAKRLLEENREKVEAMTAALLEWETIDADQVNDIMAGKPPRPPRYGSSGGGSTPPNGGTPAGVTPGNVPATA

SEQ ID NO: 3802 - DNA, 1938 bp, Rhizobium meliloti (Sinorhizobium meliloti)
  CDS (1)..(1938)
atgaaccctaattttcgaaattttgccctttgggcaatcatagcgcttctcctgatagcgctattcagcatgttccagcagccgaccgaacgagcaggctcgcgtgaaattccattctcgcagttcctcaaggacgtcgacgcgagccgcgtgaaggacgtggtgatcaccggttcgaaggtgatcggcagctacaccgagagcggggcgaccttccagacctatgcgcccgccgtcgacacggcgctgacggagcggctggaagccaaggacgtcacggtcacggttcggccggagacggacggctcgtcgggcttcctcagctatatcggaacgctgttgccgatgctcctgatcctcggcgtctggctgttcttcatgcggcagatgcaaggcggctcgcgcggcgcgatgggtttcggaaagtccaaggcaaagcttttgacggaagcgcatggccgcgtgaccttcgacgacgtcgctggtgtcgacgaggcgaagcaggacctggaggaaatcgtcgaattcctgcgcgacccgcagaagttccagcgtctcggtggccgcatcccgcgcggcgtgctgctggtcggaccgcccggcaccggtaagacgctgcttgcccgctcggtggccggtgaggcgaacgtgcccttcttcacgatctcgggttcggacttcgtcgaaatgttcgtcggtgtcggcgcatcgcgcgtccgcgacatgttcgagcaggcgaagaagaacgcgccctgcatcatcttcatcgacgaaatcgatgcggttggccgtcatcgcggcgccggtcttggcggcggcaacgacgagcgcgagcagacgctgaaccagctgctggtcgagatggacggcttcgaggcgaacgagggcatcatcctcatcgccgcgacgaaccggccggacgtgctcgacccggcgctgctgcgtccgggccgcttcgaccgccaggtcgtcgtgccgaacccggacatcaacggccgcgagcggatcctgaaggtgcatgtccgcaacgtgccgctcgcaccgaacgtggacctcaaggtgctggcgcgcggcacgccgggcttctcgggcgccgatctcatgaatctcgtcaacgaatcggcgctgatggcggcgcggcgcaacaagcgtctcgttaccatgcaggagttcgaggacgccaaggacaagatcatgatgggcgccgagcgccgctcctcggccatgaccgaagccgagaagaagctgaccgcctatcacgaggcgggccatgcgatccttgcgctcaacgtcccctcggccgatccgttgcacaaggcgacgatcattccccggggccgtgcgctcggcatggtgatgcagctgcccgagggcgaccgctactcgatgagctacaagtggatgatctcgcgtctcgccatcatgatgggcggacgcgttgccgaggaactgaccttcggcaaggagaacatcacctcgggcgcatcctccgatatcgagcaggcgacgaagcttgcccgggcgatggtgacgcagtggggcttctccgaccagctcggacaggtcgcctatggcgagaatcagcaggaggttttcctcggccattccgtcgcgcagcagaagaacgtttcggaatcgaccgcgcagaaaatcgacaacgaaatccgccggctgatcgacgaggcctatgagacggcacgccgcatcctcgtcgaaaagaaccatgaattcgtggctctcgcggaaggcttgctcgaatacgagacgctgaccggcgacgagatcaaggctctgatccgcggcgagaagccggcgcgcgatcttggggacgatacaccgccgcatcgcggctccgcagtgccttcggccggtacgaagaaggaagccggcacgaagggcgaagagcctgaaggcgggttcgaaccgcagccgcagtag

SEQ ID NO: 3803 - protein, 645 aa, Rhizobium meliloti (Sinorhizobium meliloti)
MNPNFRNFALWAIIALLLIALFSMFQQPTERAGSREIPFSQFLKDVDASRVKDVVITGSKVIGSYTESGATFQTYAPAVDTALTERLEAKDVTVTVRPETDGSSGFLSYIGTLLPMLLILGVWLFFMRQMQGGSRGAMGFGKSKAKLLTEAHGRVTFDDVAGVDEAKQDLEEIVEFLRDPQKFQRLGGRIPRGVLLVGPPGTGKTLLARSVAGEANVPFFTISGSDFVEMFVGVGASRVRDMFEQAKKNAPCIIFIDEIDAVGRHRGAGLGGGNDEREQTLNQLLVEMDGFEANEGIILIAATNRPDVLDPALLRPGRFDRQVVVPNPDINGRERILKVHVRNVPLAPNVDLKVLARGTPGFSGADLMNLVNESALMAARRNKRLVTMQEFEDAKDKIMMGAERRSSAMTEAEKKLTAYHEAGHAILALNVPSADPLHKATIIPRGRALGMVMQLPEGDRYSMSYKWMISRLAIMMGGRVAEELTFGKENITSGASSDIEQATKLARAMVTQWGFSDQLGQVAYGENQQEVFLGHSVAQQKNVSESTAQKIDNEIRRLIDEAYETARRILVEKNHEFVALAEGLLEYETLTGDEIKALIRGEKPARDLGDDTPPHRGSAVPSAGTKKEAGTKGEEPEGGFEPQPQ

SEQ ID NO: 3804 - DNA, 1929 bp, Rhizobium loti (Mesorhizobium loti)
  CDS (1)..(1929)
atgaatccgaactatcgcaacctcgcgctctgggcgatcatagcggtcctgctcatcgctctcttcaatctgttccagacgccgcagacgcgcggggcttcgagcgatgtgccttattcgcaattcctgcaggatgtcgcggccggccgggtcaagacggtgaccattgcgggcgcccgcatcaccggcacctacaccgacaattccaccggcttccagacctattcgcccggcgatccccagctggtctcgcggctgcaggacaagaacgtcaccatcaatgcgcggcccgaggccgacggttccaattcgctgtttggctacctgatctcctggctgccgatgatcctgatcctcggcgtctggatattcttcatgcgccagatgcagtctggatccgggcgcgccatgggttttggcaagtcgaaggccaagcttctgacggaggcgcatggccgcgtcaccttccaggacgtcgccggcgtcgacgaagccaaggaagatttggaagagatcgtcgagttcctgcgcgatccccagaagttccagcggctcggcggcaagatcccgcgcggcgtgcttttggtcggccctcccggtaccggcaagacgctgcttgcccgctcggtcgccggcgaggccaacgtgccgttcttcaccatttcgggttcggacttcgtcgagatgttcgtcggcgtcggtgcatcccgcgtgcgtgacatgttcgaccaggccaagaagaacgcgccctgcatcatcttcatcgacgaaatcgacgcggtcgggcgccatcgtggcgccggcctcggcggtggcaatgacgagcgcgagcagacgctgaaccagctgctggtcgagatggacggcttcgaatccaacgaaagcatcatcttgatcgccgccaccaaccgtcccgacgtgctcgatccggcgctgctcagaccgggccgtttcgaccgccaggtcgtggtgccgaaccccgacatcgtcggccgcgagaagatcctcaaggtgcatgtgcgcaacgtgccgctggcgcccaatgtcgacctcaaggtggtcgcgcgcggcacgccgggcttctccggcgccgacctgatgaacctggtcaacgaatcggcgctgatggcggcgcggcgcaacaagcgcctcgtcaccatggccgagttcgaggacgccaaggacaagatcatgatgggtgccgagcgccgctcgtcggccatgacccaggccgagaaggagctgaccgcctatcacgaggccggtcacgccatactggcgctcaacgtgccgtcggccgacccgctgcacaaggccaccatcatcccgcgtggccgcgcgctcggcatggtgatgcagttgccggaaggcgaccgctattcgatgagctacaaatacatgatctcgcgcctcgccatcatgatgggcggccgcgtggccgaggagttcaagttcggcaaggagaacatcacctcgggcgcttcctcggatatcgaacaggcgaccaagctggcgcgtgccatggtcacgcgctggggcttctccgacaagctcggccatgtcgcctatggcgacaaccaggaggaagtgttcctcggtcattcggtggcgcgcacgcagaacatctcggaggagaccgcgcagatcatcgacgccgaagtgcgccgcctgatcgacgaggcttattcgacggcgaaatccatcttgaccaagaagaagaaggaatggatcgcgctggcgcaggggctgctcgaatacgagacgctgtcgggcgacgagatcaagcaattgatcgccggcgaaaagcccgcgcgcgacctcggcgacgacacgccgcccagccgcggctcggccgtgccgaagtccggcggccgccgcaagaaaggccccgagcccgaaggcggcatggagccacagccgtcgagttga

SEQ ID NO: 3805 - protein, 642 aa, Rhizobium loti (Mesorhizobium loti)
MNPNYRNLALWAIIAVLLIALFNLFQTPQTRGASSDVPYSQFLQDVAAGRVKTVTIAGARITGTYTDNSTGFQTYSPGDPQLVSRLQDKNVTINARPEADGSNSLFGYLISWLPMILILGVWIFFMRQMQSGSGRAMGFGKSKAKLLTEAHGRVTFQDVAGVDEAKEDLEEIVEFLRDPQKFQRLGGKIPRGVLLVGPPGTGKTLLARSVAGEANVPFFTISGSDFVEMFVGVGASRVRDMFDQAKKNAPCIIFIDEIDAVGRHRGAGLGGGNDEREQTLNQLLVEMDGFESNESIILIAATNRPDVLDPALLRPGRFDRQVVVPNPDIVGREKILKVHVRNVPLAPNVDLKVVARGTPGFSGADLMNLVNESALMAARRNKRLVTMAEFEDAKDKIMMGAERRSSAMTQAEKELTAYHEAGHAILALNVPSADPLHKATIIPRGRALGMVMQLPEGDRYSMSYKYMISRLAIMMGGRVAEEFKFGKENITSGASSDIEQATKLARAMVTRWGFSDKLGHVAYGDNQEEVFLGHSVARTQNISEETAQIIDAEVRRLIDEAYSTAKSILTKKKKEWIALAQGLLEYETLSGDEIKQLIAGEKPARDLGDDTPPSRGSAVPKSGGRRKKGPEPEGGMEPQPSS

SEQ ID NO: 3806 - DNA, 1980 bp, Streptococcus pyogenes
  CDS (1)..(1980)
atgaaaaataataaaaataatggttttgttaaaaattcttttatatatatattgatgattattgttgtcatcacaggatttcaattttatcttaagggaaccagcacacaaagccaacagattagttattccaaattaattaaacatcttaaggctggagatataaaatctttaagttatcagcctagcggtagtattattgaagttaaagggaaatatgagaaacctcaaaaagtgacagttaattcaggactatcatttttaggtggaagagcttcaacacaggtaacagagttctcatctttagtattacctagtgataccatcttgaaagaaatgacagcagcagctgataaaaatggaacagagcttacagttaagcaggaaagttcaagtggtacttggattaccttcttaatgagctttttacctattgttatttttgctgctttcatgatgatgatgatgaatcaaggtggtggaggagctcgtggtgctatgagtttcggcaaaaataaggcaaaatctcaatcaaaaggtaatgttaaagtgagatttacagacgttgctggtgccgaagaagaaaaacaagaattagtagaagttgttgattttttgaaaaatcctaaaaaatataaatcactaggagcacggattccagcgggagttcttctagaggggcctccaggtactggtaaaacattactagctaaagctgtagcaggtgaagctggagtgccatttttcagtatttcaggttcggattttgtcgaaatgtttgtcggtgtaggtgctagtcgtgttcgttctttatttgaggatgctaaaaaagctgagcgtgcgatcatctttatcgatgaaattgacgctgtaggtcgtcgtcgtggtgctggcatgggaggcggtaacgatgaacgagaacagacccttaaccaattactcattgaaatggatggttttgagggtaatgagaacattatcgttattgctgcaactaaccgtagtgatgttttagatccagctttactaagaccaggtcgttttgatcgtaaggttttagttggtcgccctgatgttaaaggacgtgaagccattttacgtgttcatgctaaaaataaaccacttgcaaatgacgttaatttgaaagtagtagcccaacagactccaggttttgtaggtgctgatcttgaaaatgttttaaatgaagctgcgttggttgctgctcgcagaaataaaattaaaattgatgctagtgatattgatgaagctgaagatcgtgttattgctggaccatcaaagaaagatcgcactatttcgcaaaaagagcgagaaatggttgcttatcacgaagctggtcatactattgttggtttagttttatctaatgcgcgtgtagttcacaaggtaactattgtacctcgtggacgagcaggtggttatatgatcgctcttccaaaagaagatcaaatgcttctttctaaagaagatctgaaagagcaattagcaggattgatgggtggtcgtgttgctgaagaaattgtttttaatgctcaaacatcaggtgcgtcaaatgactttgagcaagctactcagatagcaagggccatggttacggaatatggtatgagtgaaaagcttggaccagttcaatatgaaggtaaccatgcgatgatgccaggacagatctctcctgaaaaagcttactctgcccaaacagctcaaatgattgatgatgaggttcgtgaactcttaaatcaagctcgtaatcaagcagctgatatcatcaatgagaatcgagatactcataaattgattgctgaagctcttctcaaatatgaaactctagacgctgcacaaattaaatcaatttatgaaactggtaaaatgccagttgatttagaaactgatgataatgaagctcatgcgttatcttatgacgaaattaaaaataaaatgacagaatctgaatctgcagaatga

SEQ ID NO: 3807 - protein, 659 aa, Streptococcus pyogenes
MKNNKNNGFVKNSFIYILMIIVVITGFQFYLKGTSTQSQQISYSKLIKHLKAGDIKSLSYQPSGSIIEVKGKYEKPQKVTVNSGLSFLGGRASTQVTEFSSLVLPSDTILKEMTAAADKNGTELTVKQESSSGTWITFLMSFLPIVIFAAFMMMMMNQGGGGARGAMSFGKNKAKSQSKGNVKVRFTDVAGAEEEKQELVEVVDFLKNPKKYKSLGARIPAGVLLEGPPGTGKTLLAKAVAGEAGVPFFSISGSDFVEMFVGVGASRVRSLFEDAKKAERAIIFIDEIDAVGRRRGAGMGGGNDEREQTLNQLLIEMDGFEGNENIIVIAATNRSDVLDPALLRPGRFDRKVLVGRPDVKGREAILRVHAKNKPLANDVNLKVVAQQTPGFVGADLENVLNEAALVAARRNKIKIDASDIDEAEDRVIAGPSKKDRTISQKEREMVAYHEAGHTIVGLVLSNARVVHKVTIVPRGRAGGYMIALPKEDQMLLSKEDLKEQLAGLMGGRVAEEIVFNAQTSGASNDFEQATQIARAMVTEYGMSEKLGPVQYEGNHAMMPGQISPEKAYSAQTAQMIDDEVRELLNQARNQAADIINENRDTHKLIAEALLKYETLDAAQIKSIYETGKMPVDLETDDNEAHALSYDEIKNKMTESESAE

SEQ ID NO: 3808 - DNA, 1920 bp, Pasteurella multocida
  CDS (1)..(1920)
atggtaaaaaatttagtcctttggattgtggtagctgtggtaatgatgaccgcataccaaggctttaattcaagctcgtcaggaaataccactgactataccaccttcattacagatttaggtaacgatcaaattcgtcaagcccgttttgattacaatgaaatttttgttaccaaaaccgatggcagcaaatatacgacagtcatgccgttaaatgacgataaattactcaatgatttgctcaataagaaagttaaggtagaaggaaccttaccagaaaaacgggggttattctcacaaatcttaatttcttggttcccaatgcttttactcatcggggtttggttcttctttatgcgtcagatgcaaggcggtggcagtaaagccatgagctttggtaaaagccgtgctcgaatgatgacgcaagagcaaattaaaaccacgtttgctgatgttgcgggttgtgatgaagccaaagaagaagtgggcgaaattgttgatttcttacgtgatccaggtaagttccaaaaacttggcggtaaaatccctaaagggattttaatggtaggaccaccgggtacgggtaaaaccttattagctaaagcgatcgccggtgaagcgaaagtacctttctttactatttcaggttcagatttcgttgaaatgttcgtgggagtcggtgcgtcgcgtgtccgtgatatgtttgaacaagcgaagaaaaatgcaccttgtttaatttttatcgatgaaattgatgccgttggtcgtcaacgtggtgccggtttaggtggtggacacgatgaacgtgaacaaacgttaaaccaaatgttggtggaaatggatggctttgaggggaatgaaggcgttatcgtgattgcggcgacgaaccgtccagatgtgcttgacccagcattaacccgtccgggtcgttttgaccgtcaagtggtcgtgggcttgcctgatgtgcgtggtcgtgaacaaatcttaaaagtacatatgcgtcgtgttccgattgcacctgacgtcgatgcgatgacacttgcgcggggtacaccagggtattcgggggcggatttagccaacttagtcaacgaagccgcgttattcgcagcacgtactaataaacgtttggttactatgcttgaatttgaaaaagcaaaagacaaaatcaatatgggaccggagcgccgtaccatgatcatgacggagaagcagaaagaatcgacggcttatcatgaagcgggacacgccattgtcggttatctcgtgccagaacatgatcctgtacataaagtcacgattattccgcgtggacgtgcattaggggtgactttcttcttacctgaaggtgatcaagtcagtatcagccaaaaacagttagaaagtaaactttctacattgtatgcgggacgtttggcggaagatctgatttacggtgaagagaatatttcaaccggtgcctcaaacgatattaaagtggcaactaatattgcccgtaacatggtaacccaatggggattctcagaaaaattaggtccaattctttattcagaagatgatggtgaagtattcttagggcgttcaatggcgaaagcaaaacacatgtcagatgaaaccgcacatcttattgatgaggaagtccgtaccattgtgacacgtaactatgaacgtgcaagacagattctgattgataatatggatattttacatgccatgaaagatgcgttagtgaaatatgaaaccattgaagaagaacagattgagcagctgatgaagcgtcaacctgttacaccgccatcgggttgggatgaaaatgaaccgactacgcaaaacaatgcagggacaaaagcctctccagaaccgaaaagtgcggtagaaacggaacaagattccgatcatcaatcgccttcggataaataa

SEQ ID NO: 3809 - protein, 639 aa, Pasteurella multocida
MVKNLVLWIVVAVVMMTAYQGFNSSSSGNTTDYTTFITDLGNDQIRQARFDYNEIFVTKTDGSKYTTVMPLNDDKLLNDLLNKKVKVEGTLPEKRGLFSQILISWFPMLLLIGVWFFFMRQMQGGGSKAMSFGKSRARMMTQEQIKTTFADVAGCDEAKEEVGEIVDFLRDPGKFQKLGGKIPKGILMVGPPGTGKTLLAKAIAGEAKVPFFTISGSDFVEMFVGVGASRVRDMFEQAKKNAPCLIFIDEIDAVGRQRGAGLGGGHDEREQTLNQMLVEMDGFEGNEGVIVIAATNRPDVLDPALTRPGRFDRQVVVGLPDVRGREQILKVHMRRVPIAPDVDAMTLARGTPGYSGADLANLVNEAALFAARTNKRLVTMLEFEKAKDKINMGPERRTMIMTEKQKESTAYHEAGHAIVGYLVPEHDPVHKVTIIPRGRALGVTFFLPEGDQVSISQKQLESKLSTLYAGRLAEDLIYGEENISTGASNDIKVATNIARNMVTQWGFSEKLGPILYSEDDGEVFLGRSMAKAKHMSDETAHLIDEEVRTIVTRNYERARQILIDNMDILHAMKDALVKYETIEEEQIEQLMKRQPVTPPSGWDENEPTTQNNAGTKASPEPKSAVETEQDSDHQSPSDK

SEQ ID NO: 3810 - DNA, 2421 bp, Arabidopsis thaliana (Mouse-ear cress)
  CDS (1)..(2421)
atgtcttcttctactcttcaagcttctctttttcttcgtcctcctctccatacttcttcgtttaagctttacccttgtctattctcttcttcttcattgagtttttgtccacaatctctctcaagtttctaccgtctttcttcagttcttcacaactctcgatttcgtccccttccttgctcattgcgtcaagacaatgtcgcttccgattctgatttcattcccaaagactccgcttttgaggttacggattcagctgagagtaatagattggtttccgatacggaggtttcggaattagagacgaatgatagatttgtgggtggtgaggagacgaaaagtggaggagaagaagcggaggttagtaatggagtaacggaaggtaaggaggaagatcagaagaagagcaagtttaggattgtggtgttgatgatggcactatgggcggctataaagagagctatagagaaggtaatggagtgggaatggttaagctggtggcctttctctcgccaggagaagcggctcgagaaacttattgctgaggctgatgctaatccaaaggacgcagctttgcagggtgctttattggctgagctcaataagcatattcctgaggctgtagttcaacggtttgaacaaagggaacacacagtggatagtagaggagttgctgaatatattcgggctcttgtcattacaaatgctatctcggagtatcttcctgatgaacaaacggggaagccatctagtcttcccgcactgctgcaagagctgaagcatcgtgcatcaggcaatatggacgaatcatttgtgaaccctggtatatctgagaagcaaccactgcatgttaccatggttaatcctaaagtttcaaacaaatcaagatttgcgcaagagcttgtctctacgatcttgttcactgttgcggtgggattagtgtggattatgggtgcagctgctctgcaaaagtatattggaagtcttggaggaattggaacttcgggtgttggttcaagctcttcatattccccaaaagagctgaacaaagaaataacgccagaaaagaatgtcaaaacatttaaggacgtaaagggttgtgatgatgcaaaacaagagctcgaagaggtagttgaatatctcaaaaatccatcaaagtttacccgccttggaggaaagttgccaaagggaattcttctaaccggggcacctggtactggaaagacattgctggccaaagcaattgctggagaagctggagtacccttcttctatagagctggatctgaatttgaagagatgtttgttggggtaggagctcgccgtgtgagatccttgtttcaggcagccaagaagaaggcaccttgtattattttcattgacgaaattgatgctgttggatccacaagaaaacaatgggaagggcatacaaagaagacattgcatcaactacttgttgaaatggatggttttgagcagaatgagggaataatagttatggctgcaacaaacttgcctgatatacttgatccagctctgacaagaccgggtagatttgatagacatattgtcgtacccagtccggatgtccgtggacgcgaagagattttggaactctacctccaaggcaaacctatgtcagaagatgttgatgttaaagcaattgctcgtggaactcctggattcaatggtgctgatcttgcaaacctggtaaatattgctgccataaaagcagctgttgaaggtgctgagaagttatcttctgaacagttggaattcgcaaaggaccgaattgtcatgggcacagagaggaagacaatgttcgtatcagaggactcaaaaaagctcactgcataccatgagagtggtcatgctattgtcgctttaaatacgaaaggtgcgcacccgatccacaaagcgactataatgccacgtggatctgcattgggaatggttacacagttaccttcaaacgatgaaacatcagtgagcaagaggcagttattagctcgtctcgatgtatgtatgggaggaagagttgcagaggagctcatctttggcttggaccatattaccactggagcgagtagcgatctgtcacaggccactgaacttgcacaatacatggtatcgagttgtgggatgagtgaggcaataggaccagttcatataaaagaaagaccaagctctgatatgcaatcacgcattgatgccgaggttgtgaagcttcttagagaagcatatgagagagtgaaatctctcttgaaacggcatgagaagcagctacacacgttagcaaacgcacttctagagtatgaaacgctaaccgcagaggacataaagcgtattctccttccaaagcaggaaggcgagaaatttgaagagcaacaacaagaagaaggagacttggtattggcctga

SEQ ID NO: 3811 - protein, 806 aa, Arabidopsis thaliana (Mouse-ear cress)
MSSSTLQASLFLRPPLHTSSFKLYPCLFSSSSLSFCPQSLSSFYRLSSVLHNSRFRPLPCSLRQDNVASDSDFIPKDSAFEVTDSAESNRLVSDTEVSELETNDRFVGGEETKSGGEEAEVSNGVTEGKEEDQKKSKFRIVVLMMALWAAIKRAIEKVMEWEWLSWWPFSRQEKRLEKLIAEADANPKDAALQGALLAELNKHIPEAVVQRFEQREHTVDSRGVAEYIRALVITNAISEYLPDEQTGKPSSLPALLQELKHRASGNMDESFVNPGISEKQPLHVTMVNPKVSNKSRFAQELVSTILFTVAVGLVWIMGAAALQKYIGSLGGIGTSGVGSSSSYSPKELNKEITPEKNVKTFKDVKGCDDAKQELEEVVEYLKNPSKFTRLGGKLPKGILLTGAPGTGKTLLAKAIAGEAGVPFFYRAGSEFEEMFVGVGARRVRSLFQAAKKKAPCIIFIDEIDAVGSTRKQWEGHTKKTLHQLLVEMDGFEQNEGIIVMAATNLPDILDPALTRPGRFDRHIVVPSPDVRGREEILELYLQGKPMSEDVDVKAIARGTPGFNGADLANLVNIAAIKAAVEGAEKLSSEQLEFAKDRIVMGTERKTMFVSEDSKKLTAYHESGHAIVALNTKGAHPIHKATIMPRGSALGMVTQLPSNDETSVSKRQLLARLDVCMGGRVAEELIFGLDHITTGASSDLSQATELAQYMVSSCGMSEAIGPVHIKERPSSDMQSRIDAEVVKLLREAYERVKSLLKRHEKQLHTLANALLEYETLTAEDIKRILLPKQEGEKFEEQQQEEGDLVLA

SEQ ID NO: 3812 - DNA, 2217 bp, Neurospora crassa
  CDS (1)..(2217)
atgtcttcccgccagctcgccatggcgaaccccctcttccggcgctcgttttcggcgctcatgtcgaggcccctgggcactgtcaacacccttcggtccatgagcacccaccagcccggtcgcattccgtccttcttccgctcgccagtacactcttctctcggtttcactctccaggtccgcagctttggaaacggtggtctctcgcacaacctcctggctgctcgcgaggccgctgccaaccagttcccaaccagcgccggtgctcagtatgctttctaccaggctcttctcaaggcgaacatgcctgctatcattatcgaaaggtatcagtctggacgtttcgccacgaacgagcaggtagaccagatctaccagcaagcccttgccatgtctaccggtcaaccctacacgcctgcgaacaacaccgtcgataacaatggctatcacccctccggtttcaccgctagccagatccatgccgctggtactgccgctgctgctcagcatactggtggaaacatggccatggtcaagccgatcgctgctggtgccaagacgggtcctctgcatatcgtagttgacgaaagtttcggaagctccgctctcagatgggtcaagtttctcatgtggttcactctcttcacgtatctcagcatggtcgtcatcacaatggttttcgagggcttgagcagcatcaagcgccccggtggcaagcttgaggccagcgaggtcaagcctgagaaccagaaggctcgctttgctgatgtccacggctgtgatgaggccaaggaagagcttcaggaacttatcgactttttgcgcaaccctgagaagtactcgactcttggcggcaagctccccaagggcgtgttgctcgtgggaccccccggtactggtaaaactcttttggctcgtgctgtcgccggcgaagctggcgttcccttcttcaacatgtccggttccgagtttgaagaggtctacgttggcgttggcgcaaagcgtgttcgtgatctctttgccgccgccaaggccaaggctccctcaattgttttcatcgacgaacttgatgctattggtggccggcgtaactccagggacgctacctacgtacgtcagactctcaaccagcttcttaccgagttggacggtttcgagcaaaacagtggtgtaatcatcatcggcgccaccaacttccccgagtcccttgacaaggcgcttacccgccccggccgcttcgatcgcaatgttgttgtctctcttcccgatgtccgcggccgtatggccattctccagcaccacgccaagcgcatcaaggctgctgccgatgtcaacctggaggctattgcttccagaacttctggtctttctggtgccgagctggagaacattgtcaaccaggctgctattcacgccagcaagttgaaggctcaggctgttactcaaaaggatttcgaatgggcaaaggacaaggtcatcatgggtgctgagaagcgtagtatggttatcacagccaaggaaaaggagatgactgcctatcatgaggctggtcacgccctcgtcggatattacgccaaggacagcgcaagctcgctttacaaggtcaccattcttccacgtggccagactcttggccacactgcctacctccctgagatggacaagcactcgtttactgtcagggattacttgggtatgattgaccgtgccatgggcggcaaggtcgctgaggagattgtctatggtaacgagcttgtgactagcggtgttagcgctgatcttgacatggccaccagaaccgcctggcagatggttgctcagctcggcatgtctgagaagctcggccccgttgagtacctccgcaagtacaaccagctcagctccgagaccagggcgatggttgagtccgaggtgaagagagttctggacgaatcgtacgagcgtgcgcgtaacctgctcacctccaagaggaacgaactcgactacttggccaaggcgctcgtcgagtacgagacactggacaagaaggaagttgagagggtgattcggggagagaagttgaaggatcgcatctcggtgccgccagggcctatggctattcccaagcccagcgacaccctggagccgggcctgcccctaccacccctacctggcgacgtgccgcccccgggtgacagtggcccgggaccggccccgccgccgcctgtgcccgcgtga

SEQ ID NO: 3813 - protein, 738 aa, Neurospora crassa
MSSRQLAMANPLFRRSFSALMSRPLGTVNTLRSMSTHQPGRIPSFFRSPVHSSLGFTLQVRSFGNGGLSHNLLAAREAAANQFPTSAGAQYAFYQALLKANMPAIIIERYQSGRFATNEQVDQIYQQALAMSTGQPYTPANNTVDNNGYHPSGFTASQIHAAGTAAAAQHTGGNMAMVKPIAAGAKTGPLHIVVDESFGSSALRWVKFLMWFTLFTYLSMVVITMVFEGLSSIKRPGGKLEASEVKPENQKARFADVHGCDEAKEELQELIDFLRNPEKYSTLGGKLPKGVLLVGPPGTGKTLLARAVAGEAGVPFFNMSGSEFEEVYVGVGAKRVRDLFAAAKAKAPSIVFIDELDAIGGRRNSRDATYVRQTLNQLLTELDGFEQNSGVIIIGATNFPESLDKALTRPGRFDRNVVVSLPDVRGRMAILQHHAKRIKAAADVNLEAIASRTSGLSGAELENIVNQAAIHASKLKAQAVTQKDFEWAKDKVIMGAEKRSMVITAKEKEMTAYHEAGHALVGYYAKDSASSLYKVTILPRGQTLGHTAYLPEMDKHSFTVRDYLGMIDRAMGGKVAEEIVYGNELVTSGVSADLDMATRTAWQMVAQLGMSEKLGPVEYLRKYNQLSSETRAMVESEVKRVLDESYERARNLLTSKRNELDYLAKALVEYETLDKKEVERVIRGEKLKDRISVPPGPMAIPKPSDTLEPGLPLPPLPGDVPPPGDSGPGPAPPPPVPA

SEQ ID NO: 3814 - DNA, 2322 bp, Schizosaccharomyces pombe (Fission yeast)
  CDS (1)..(2322)
atgcgaaatccctttttgacgtttagggcacctactaggaaaacaggagattacctggtttctaaattcgtaaagaaggataatttttcttctttgcgtttggcaagggcttatactttttctacacgttccacagctgtttcacaattttctcttctctcactttctcagagatcttttcagtcccttaaaataaataaaggaataccggaaaaacataaaatccctctcatttcatctaaacaatttagcgtaacctcaaaaagatcgcaaaatgggtcttcaggatccaattctgatgctaatggtaggaaaaatggccagaaaaatgatgattcaaaaaagaagggattgaatggcaatgatccgaaaaaagtttttgaaatagccttaaatggcaacactattttaggtggaattttagttgcctatatcctttacaatgttctctcgcctaatgcaaatatgcaagaaattacttggcaagattttcgacaacagtttttagacaagggtttagttgaacggctagttgttgttaaccgcaatatggttagagttattttgagaggcggtgtagcttcaggttcagggcagtactatttttcaattggttccatcgactctttcgatcgaaaactagaggatgcacaacgtcaactgggtattccaccttctgaatttgtccctgtcgcttatcatgacgaagtctctgttcttgctactttattgtcttttgctcccaccttactgatcattggaagtgtcatttatttatcgcgacgggcttcgggtgccgcaggaggtggtcaaggtggcatttttggaattggtaagagccgagcgaagatgtttaatcatgaaactgatatcaaaataaaatttgctgatgtcgctggcgttgacgaggctaaagaagagattatggaattcgtcaaatttttaaaaaatcccaagttttatgaaaggttgggggctaaaattcctcgtggtgccattctttctggtcctcctggtaccggtaaaactcttcttgctaaagccaccgctggtgaagctaacgtcccttttttaagtgtgtcaggttctgagtttcttgaaatgtttgttggtgttggaccttcccgcgtaagagatctttttgctactgctcgcaagaacgctccttgtattattttcatagatgaaattgatgcaattggtaaagcaagaggacgtggaggacaatttggttccaatgatgaacgcgaaagcactcttaatcagctattagttgaaatggacggttttacgtctagcgaacatatcgtcgtattcgctggtactaatcgaccagacgtattggacccggcacttctacgtcctggtcgattcgatcgtcaaattacgattgatcgtcctgatattggcggtcgtgaacaaatatttaaggtccaccttaagcatattaaggcagccgataacatcgacttaattgccaagcgtcttgccgtcctaacttctggttttacaggagctgatataatgaatgtatgtaatgaaggagcgttaattgcagcacgatcaaatagtaatgaagtccaaatggtacattttgagcaagctattgaaagagtcacggcaggtttggaaaagaagagtagggtactaagtcctgaagaaaaaaacaccgttgctcatcatgaagctggacatgcggtagctggttggtttatggagtacgtcgatccactattgaaggtctcaatcattcctagagctcaagcccttggctatgctagttatttacccaaagatcagtatctgatgagtcgagggcagattttagatcaaatgggaatggctttggctgggcgtgtttctgaagaaatattttttggaccagaaaagattacttcgggagcttccgatgattttcaaaaagtaacgcgcatggctcaagcgtatgtgacccaatatggtatgtctccgactgttggtactatagcttatcccatcgacactcgggaaactgttcaaaaaccattttctgaggctacagctcaaatgattgatgaagaaattcgaaagcttgtaaagcatgcatacgaaagaactaagaaacttttgctagaacataagcaaggcttagaaaatattgctcaacgtctattacagaaagaagtcatcacttataacgaagttgagacgattcttggaccaaggccatatgcatacaaacatttaaatatttctgaacttatgcgtcagtctgagtataaaaatgatcacgatcctcgaaatccaccaatccccccatctcctcaacaaccttctgcctaa

SEQ ID NO: 3815 - protein, 773 aa, Schizosaccharomyces pombe (Fission yeast)
MRNPFLTFRAPTRKTGDYLVSKFVKKDNFSSLRLARAYTFSTRSTAVSQFSLLSLSQRSFQSLKINKGIPEKHKIPLISSKQFSVTSKRSQNGSSGSNSDANGRKNGQKNDDSKKKGLNGNDPKKVFEIALNGNTILGGILVAYILYNVLSPNANMQEITWQDFRQQFLDKGLVERLVVVNRNMVRVILRGGVASGSGQYYFSIGSIDSFDRKLEDAQRQLGIPPSEFVPVAYHDEVSVLATLLSFAPTLLIIGSVIYLSRRASGAAGGGQGGIFGIGKSRAKMFNHETDIKIKFADVAGVDEAKEEIMEFVKFLKNPKFYERLGAKIPRGAILSGPPGTGKTLLAKATAGEANVPFLSVSGSEFLEMFVGVGPSRVRDLFATARKNAPCIIFIDEIDAIGKARGRGGQFGSNDERESTLNQLLVEMDGFTSSEHIVVFAGTNRPDVLDPALLRPGRFDRQITIDRPDIGGREQIFKVHLKHIKAADNIDLIAKRLAVLTSGFTGADIMNVCNEGALIAARSNSNEVQMVHFEQAIERVTAGLEKKSRVLSPEEKNTVAHHEAGHAVAGWFMEYVDPLLKVSIIPRAQALGYASYLPKDQYLMSRGQILDQMGMALAGRVSEEIFFGPEKITSGASDDFQKVTRMAQAYVTQYGMSPTVGTIAYPIDTRETVQKPFSEATAQMIDEEIRKLVKHAYERTKKLLLEHKQGLENIAQRLLQKEVITYNEVETILGPRPYAYKHLNISELMRQSEYKNDHDPRNPPIPPSPQQPSA

SEQ ID NO: 3816 - DNA, 1875 bp, Thermus thermophilus
  CDS (1)..(1875)
atgcctcgagccccctttagccttctcgccctggtcctgggcctcgccttcctggcctggccttcagcctcgcggggcaccgtgggcgccccaagcgggacggtgaactacacgaccttcctggaggacctcaaggcgggccgggtcaaggaggtggtggtgcgcgccggggacacccggatccagggggtcctggaggacggctccgccttcaccacctacgcggcgagccctccggacaacgccaccctcgagggctggatggcccggggggtgagcgtccgggtggagcccccccagggccaaaacgccctcggcttcctctggcccctcctcctcgtgggcctcctcatcggcgccctctactacttctcccgcaacggccgggccgggccttcggactccgccttcagcttcaccaaaagccgggcccgggtcctcaccgaggcccccaaggtcaccttcaaggacgtggccggggcggaggaggccaaggaggaactcaaggagatcgtggagttcctcaaaaaccccagccgcttccacgagatgggcgcccgcatccccaagggtgtcctcctggtggggcccccgggggtgggcaagacccacctggcccgggccgtggccggggaggcccgggtgcccttcatcaccgcctcgggctccgacttcgtggagatgttcgtgggggtaggggcggcgagggtccgggacctctttgagaccgccaagcgccacgccccctgcatcgtcttcattgacgagattgacgccgtggggaggaagcggggaagcggggtggggggcgggaacgacgagcgggagcagaccctgaaccagctcctcgtggagatggacggctttgagaaggacacggccatcgtggtcatggccgccaccaaccgccccgacatcctggaccccgccctgctccgccccgggcgctttgaccggcagatcgccatagacgcccccgacgtcaagggccgggagcagatcctcaggatccacgcccggggcaagcccctggcggaggacgtggacctggccctcctcgccaagcgcaccccgggcttcgtgggggcggacctggagaacctcctgaacgaagccgccctcctcgccgcccgggaggggcggaggaagatcaccatgaaggacctggaggaggccgccgaccgggtgatgatgggcccggccaagaaaagcctcgtcctctccccccgcgaccgcaggatcaccgcctaccacgaggcggggcacgccctggcggcccacttcctggagcacgccgacggggtgcacaaggtgaccatcgtgccccggggaagggccttgggcttcatgatgcccaggcgggaggacatgctccactggtccagaaagcgccttttggaccagatcgccgtggccctggcggggcgggcggcggaggagatcgtctttgacgacgtgaccacgggggcggagaacgacttccgccaggccacggagctcgcccgccgcatgatcaccgagtgggggatgcaccccgagttcggccccgtggcctacgcggtgcgggaggacacctacctgggcggctacgacgtgcgccagtactcggaggagaccgccaagcgcattgacgaggcggtgcgccgcctcattgaggagcagtaccagagggtgaaggcccttctcctggaaaagcgggaggtcctggagcgggtggcggagaccctcctggagcgggagaccctcaccgccgaggagttccaacgggtggtggaggggctccccttggaggcccccgaggaggcccgggaggagcgggagcccccccgggtggtgcccaaggtgaagccggggggcgccctgggcggggcctga

SEQ ID NO: 3817 - protein, 624 aa, Thermus thermophilus
MPRAPFSLLALVLGLAFLAWPSASRGTVGAPSGTVNYTTFLEDLKAGRVKEVVVRAGDTRIQGVLEDGSAFTTYAASPPDNATLEGWMARGVSVRVEPPQGQNALGFLWPLLLVGLLIGALYYFSRNGRAGPSDSAFSFTKSRARVLTEAPKVTFKDVAGAEEAKEELKEIVEFLKNPSRFHEMGARIPKGVLLVGPPGVGKTHLARAVAGEARVPFITASGSDFVEMFVGVGAARVRDLFETAKRHAPCIVFIDEIDAVGRKRGSGVGGGNDEREQTLNQLLVEMDGFEKDTAIVVMAATNRPDILDPALLRPGRFDRQIAIDAPDVKGREQILRIHARGKPLAEDVDLALLAKRTPGFVGADLENLLNEAALLAAREGRRKITMKDLEEAADRVMMGPAKKSLVLSPRDRRITAYHEAGHALAAHFLEHADGVHKVTIVPRGRALGFMMPRREDMLHWSRKRLLDQIAVALAGRAAEEIVFDDVTTGAENDFRQATELARRMITEWGMHPEFGPVAYAVREDTYLGGYDVRQYSEETAKRIDEAVRRLIEEQYQRVKALLLEKREVLERVAETLLERETLTAEEFQRVVEGLPLEAPEEAREEREPPRVVPKVKPGGALGGA

SEQ ID NO: 3818 - DNA, 2151 bp, Homo sapiens (Human)
  CDS (1)..(2151)
atgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatga

SEQ ID NO: 3819 - protein, 716 aa, Homo sapiens (Human)
MFSLSSTVQPQVTVPLSHLINAFHTPKNTSVSLSGVSVSQNQHRDVVPEHEAPSSEPSLNLRDLGLSELKIGQIDQLVENLLPGFCKGKNISSHWHTSHVSAQSFFENKYGNLDIFSTLRSSCLYRHHSRALQSICSDLQYWPVFIQSRGFKTLKSRTRRLQSTSERLAETQNIAPSFVKGFLLRDRGSDVESLDKLMKTKNIPEAHQDAFKTGFAEGFLKAQALTQKTNDSLRRTRLILFVLLLFGIYGLLKNPFLSVRFRTTTGLDSAVDPVQMKNVTFEHVKGVEEAKQELQEVVEFLKNPQKFTILGGKLPKGILLVGPPGTGKTLLARAVAGEADVPFYYASGSEFDEMFVGVGASRIRNLFREAKANAPCVIFIDELDSVGGKRIESPMHPYSRQTINQLLAEMDGFKPNEGVIIIGATNFPEALDNALIRPGRFDMQVTVPRPDVKGRTEILKWYLNKIKFDQSVDPEIIARGTVGFSGAELENLVNQAALKAAVDGKEMVTMKELEFSKDKILMGPERRSVEIDNKNKTITAYHESGHAIIAYYTKDAMPINKATIMPRGPTLGHVSLLPENDRWNETRAQLLAQMDVSMGGRVAEELIFGTDHITTGASSDFDNATKIAKRMVTKFGMSEKLGVMTYSDTGKLSPETQSAIEQEIRILLRDSYERAKHILKTHAKEHKNLAEALLTYETLDAKEIQIVLEGKKLEVR

SEQ ID NO: 3820 - DNA, 1923 bp, Bradyrhizobium japonicum
  CDS (1)..(1923)
atgaacgccaatctgcgcaatttcgccctctgggtcatcattgtcttgctgctgttggcgttgttcacgctcttccaaaatccgggtcagcgcgcctcctcgcaggacatcgccttctcccagctcctgagcgaggttgaccgcggcaatgtgcgcgacgtcgtgatccaggggcctgatatccacggcaccttcaccaacggctccagcttccagacctatgcgccgaacgacccgacgctggtcaagcgcctctatgacagcaaggtccagatcaccgcgaagccgccgggcgacaacgtgccctggttcgtctcgctgctggtctcctggctgcccttcatcgcgctgatcggcgtgtggatcttcctgtcgcggcagatgcagggcggcgccggcaaggcgatgggctttggcaagtcgcgtgcgaagatgctcactgaagcgcatggccgcgtcaccttcgaggacgtcgccggcgtggacgaagccaagcaggacctgcaggagatcgtcgaattcctgcgcgaccccggcaaattccagcgcctcggcggccgcattccgcgcggcgtgctgctggttggccctcccggcaccggtaagaccctgatcgcgcgtgcggtcgcgggcgaagccaacgtgccgttcttcaccatttcgggttctgacttcgtcgagatgttcgtcggcgtcggcgcgagccgcgtccgcgacatgttcgagcaggccaagaagaacgccccctgcatcatcttcatcgacgaaatcgacgctgtcggtcgtcatcgtggcgccggtctcggcggcggcaatgacgagcgcgagcagacgctgaaccagctgctggtcgagatggacggcttcgaggcgaacgagggcgtgatcctgatcgccgccaccaaccgtcctgatgtgctcgatcccgcgctgctgcgtcccggccgcttcgaccgtcaggtcgtggtgccgaatccggacgttgtcggccgcgagcagatcctcaaggttcacgttcgcaaggtgccgctggcgccggatatcaacctcaagaccatcgcgcgcggcaccccgggcttctccggcgccgacctgatgaacctcgtcaacgaagctgcgctcaccgccgcccgccgcaacaagcggatggtgactcaggccgagttcgaggaggccaaggacaaggtgatgatgggcgccgagcgcaagtcgctcgtcatgaccgaggaagagaagctcttgacggcctatcacgagggcggccacgccatcgtcggcctcaacgtgcccgcgaccgatccgatccacaaggcgacgatcatcccgcgcggccgtgcgctgggtatggtcatgcagctgcccgagcgcgacaagctgtcgatgtcgctggagcagatgacctcgcgcctcgccatcatgatgggcggccgcgtcgccgaagagctgatcttcggccgcgagaaggtgacctcgggtgctgcctccgacatcgagcaggccacgcgccttgcccgcatgatggtgacgcgctggggcctgtcggaagagctcggcaccgtctcttacggcgagaaccaggacgaggtgttcctgggcatgtcggtgtcgcggacgcagaacgcgtccgaagcgaccgtccagaagatcgactccgagatccggcgtctggtcgaggaaggctacaaggaagccacccgcatcctcaccgagaagcacggtgatcttgaggcgctggccaagggcctgctcgagttcgagacgctctccggcgacgagatcgtcgatctgctcaagggcaagaagccgaaccgcgagtccgtgctcgagccgaccacgccgcgcgcctccgccgtgcccccggccggcaagtcgcgcccgcggcccgatccggatccgggcctggagccgcagccgcaggcgtaa

SEQ ID NO: 3821 - protein, 640 aa, Bradyrhizobium japonicum
MNANLRNFALWVIIVLLLLALFTLFQNPGQRASSQDIAFSQLLSEVDRGNVRDVVIQGPDIHGTFTNGSSFQTYAPNDPTLVKRLYDSKVQITAKPPGDNVPWFVSLLVSWLPFIALIGVWIFLSRQMQGGAGKAMGFGKSRAKMLTEAHGRVTFEDVAGVDEAKQDLQEIVEFLRDPGKFQRLGGRIPRGVLLVGPPGTGKTLIARAVAGEANVPFFTISGSDFVEMFVGVGASRVRDMFEQAKKNAPCIIFIDEIDAVGRHRGAGLGGGNDEREQTLNQLLVEMDGFEANEGVILIAATNRPDVLDPALLRPGRFDRQVVVPNPDVVGREQILKVHVRKVPLAPDINLKTIARGTPGFSGADLMNLVNEAALTAARRNKRMVTQAEFEEAKDKVMMGAERKSLVMTEEEKLLTAYHEGGHAIVGLNVPATDPIHKATIIPRGRALGMVMQLPERDKLSMSLEQMTSRLAIMMGGRVAEELIFGREKVTSGAASDIEQATRLARMMVTRWGLSEELGTVSYGENQDEVFLGMSVSRTQNASEATVQKIDSEIRRLVEEGYKEATRILTEKHGDLEALAKGLLEFETLSGDEIVDLLKGKKPNRESVLEPTTPRASAVPPAGKSRPRPDPDPGLEPQPQA

SEQ ID NO: 3822 - DNA, 2394 bp, Homo sapiens (Human)
  CDS (1)..(2394)
atggcgcaccgctgtttgcggctgtggggccggggcggctgctggccccgcggcctacagcagctcctcgtgcctggcggcgtgggcccgggcgagcagccctgcctccggacgctttaccgatttgttacaactcaagcaagggccagcagaaattctcttttgacagatataattgctgcttatcaaagattctgttctcgacccccaaaaggatttggaaaatactttcctaatggaaaaaatggaaaaaaagctagtgaacctaaagaagttatgggagagaaaaaagaatcaaagccagctgctaccacacgctcttctggaggaggaggtggtggcggtggaaaacgaggtggcaagaaagatgattctcactggtggtccaggtttcagaagggtgacattccatgggacgacaaggatttcaggatgttcttcctctggactgctctgttctggggtggagtcatgttttacttgctgctcaagagatccgggagagaaatcacttggaaggactttgtcaataactatctttcaaaaggagtagtagacagattggaagtcgtcaacaagcgttttgttcgagtgacctttacaccaggaaaaactcctgttgatgggcaatacgtttggtttaatattggcagtgtggacacctttgaacggaatctggaaactttacagcaggaattgggcatagaaggagaaaatcgggtgcctgttgtctacattgctgaaagtgatggctcttttctgctgagcatgctgcctacggtgctcatcatcgccttcttgctctacaccatcagaagagggcctgctggcattggccggacaggccgagggatgggcggactcttcagtgtcggagaaaccactgccaaggtcttaaaggatgaaattgatgtgaagttcaaagatgtggctggctgtgaggaggccaagctagagatcatggaatttgtgaatttcttgaaaaacccaaagcagtatcaagacctaggagcaaaaatcccaaagggtgccattctcactggtcctccaggcactgggaagacgctgctagctaaggccacagccggagaagccaatgtccccttcatcaccgttagtggatctgagtttttggagatgttcgttggtgtgggccctgctagagtccgagacttatttgcccttgctcggaagaatgccccttgcatcctcttcatcgatgaaatcgatgcggtgggaaggaagagaggaagaggcaactttggagggcagagtgagcaggagaacacactcaaccagctgctggtggagatggatggttttaatacaacaacaaatgtcgtcattttggccggcaccaatcgaccagatatcctggaccccgcgctacttaggccggggcgtttcgacaggcagatctttattggaccaccagacataaaaggaagagcttctattttcaaagttcatctccgaccgctaaaactggacagtaccctggagaaggataaattggcaagaaaactggcatctttaactccagggttttcaggtgctgatgttgctaatgtctgtaatgaagctgcgttgattgctgcaaggcatctgtcagattccataaatcagaaacactttgaacaggcaattgagcgagtgattggtggcttagagaagaaaacgcaggttctgcagcctgaggagaagaagactgtggcataccacgaagcaggccatgcggttgccggctggtatctggagcacgcagacccgcttttaaaggtatccatcatcccacgtggcaaaggactaggttatgctcagtatttaccaaaagaacaatacctctataccaaagagcagctcttggataggatgtgtatgactttaggtggtcgagcctctgaagaaatcttctttggaagaattacaactggtgctcaagatgacttgagaaaagtaactcagagtgcatatgcccaaattgttcagtttggcatgaatgaaaaggttgggcaaatctcctttgacctcccacgtcagggggacatggtattggagaaaccttacagtgaagccactgcaagattgatagatgatgaagtacgaatacttattaatgatgcttataaaagaacagtagctcttctcacagaaaagaaagctgacgtggagaaggttgctcttctgttgttagaaaaagaagtattagataagaatgatatggttgaacttttgggccccagaccatttgcggaaaaatctacctatgaagaatttgtggaaggcactggcagcttggatgaggacacctcacttccagaaggccttaaggactggaacaaggagcgggaaaaggagaaagaggagcccccgggtgagaaagttgccaactag

SEQ ID NO: 3823 - protein, 797 aa, Homo sapiens (Human)
MAHRCLRLWGRGGCWPRGLQQLLVPGGVGPGEQPCLRTLYRFVTTQARASRNSLLTDIIAAYQRFCSRPPKGFGKYFPNGKNGKKASEPKEVMGEKKESKPAATTRSSGGGGGGGGKRGGKKDDSHWWSRFQKGDIPWDDKDFRMFFLWTALFWGGVMFYLLLKRSGREITWKDFVNNYLSKGVVDRLEVVNKRFVRVTFTPGKTPVDGQYVWFNIGSVDTFERNLETLQQELGIEGENRVPVVYIAESDGSFLLSMLPTVLIIAFLLYTIRRGPAGIGRTGRGMGGLFSVGETTAKVLKDEIDVKFKDVAGCEEAKLEIMEFVNFLKNPKQYQDLGAKIPKGAILTGPPGTGKTLLAKATAGEANVPFITVSGSEFLEMFVGVGPARVRDLFALARKNAPCILFIDEIDAVGRKRGRGNFGGQSEQENTLNQLLVEMDGFNTTTNVVILAGTNRPDILDPALLRPGRFDRQIFIGPPDIKGRASIFKVHLRPLKLDSTLEKDKLARKLASLTPGFSGADVANVCNEAALIAARHLSDSINQKHFEQAIERVIGGLEKKTQVLQPEEKKTVAYHEAGHAVAGWYLEHADPLLKVSIIPRGKGLGYAQYLPKEQYLYTKEQLLDRMCMTLGGRASEEIFFGRITTGAQDDLRKVTQSAYAQIVQFGMNEKVGQISFDLPRQGDMVLEKPYSEATARLIDDEVRILINDAYKRTVALLTEKKADVEKVALLLLEKEVLDKNDMVELLGPRPFAEKSTYEEFVEGTGSLDEDTSLPEGLKDWNKEREKEKEEPPGEKVAN

SEQ ID NO: 3824 - DNA, 1908 bp, Haemophilus influenzae
  CDS (1)..(1908)
atggtcaaaaatctagtgctttgggtggtagtggcagtcattatgatgacagcataccaaagtttcaattcatcttcggtagaaaattctactgattatacaacctttgtttacgatgtaagcaacggacaagtgacagcggcacgttttgatgccaatgaaattacggtaacgaaaaccgatggttctaaatattcaaccgtaatgccaccacttgaagacaaaaaattgcttgatgatttattaagcaaaaaagtcaaagtggaaggcacgccatttgaaagacgtggttttttatcccaaattttaatttcttggttcccaatgttattccttgttggtgtatgggtattctttatgcgtcaaatgcaaggcggtggcggcaaagcgatgagctttggtaaaagccgagccaaaatgttgaatcaagatcagattaaggtgacttttgcggatgtggctggttgcgatgaagcaaaagaagaagtgggggaaatcgttgatttcttgcgtgatccgaataaattccaaaatttgggcggtaaaattccaaaaggtattttgatggtagggcctccaggtactggtaaaactttacttgctcgtgcgattgcgggagaggcaaaagttccattcttcactatttctggctctgatttcgtagaaatgtttgtaggtgttggcgcatcacgtgtacgtgatatgtttgaacaggctaagaaaaatgcaccttgcttaatcttcattgatgaaatcgatgcagtgggtcgccaacgtggtgcgggcttaggtggcggacacgatgagcgtgaacaaaccttaaaccaaatgctagttgaaatggatggctttagcggtaatgacggtgtaattgttattgcagcaactaaccgtccagatgtgcttgatccagctttaacccgtccaggccgttttgaccggcaagtagttgttggcttacctgatgtgaaaggtcgtgagcaaatcttaaaagtgcatatgcgtaaagtgtctgttgcgcaagatgttgatgcaatgacgttagcgcgtggtacgccgggctattctggtgcagatttagcaaatttagtcaatgaggcggctttgtttgctgctcgagtgaataaacgtacggtaaccatgcttgagtttgaaaaagcgaaagataaaatcaatatggggccagagcgtcgcactatgattatgacggataagcaaaaagaatccactgcttatcatgaagctggtcatgcgattgtggggtatttagtgcctgaacacgatcctgttcacaaagtgaccattattcctcgaggacgtgccttgggtgtgacattcttcttacctgagggcgatcaaattagtattagccaaaaacaattagaaagtaagctttctaccttgtatgcgggtcgtttagcggaagatttgatttacggcgaagaaaatatctcaacaggtgcatcaaatgatattaaagtcgcaactaatattgcgcgtaatatggtaacgcaatggggattctctgaaaagttaggtccgattctttatacggaagatgagggcgaggttttcttaggtcgttcaatggcgaaagcgaaacatatgtcagatgaaactgcgcattcgattgatgaagaagtgcgtgcaattgtaaatcgtaactatgcgagagcaagagagattttgatcgacaatatggatattcttcatgcgatgaaagatgcattagtcaaatatgaaactattgaagaagaacaaattaaacaattgatgaatcgcgaacctgtcacaccgccatcaggttggggagagccgaaaactcagcaggctgcttatgcaaattcaacaacgaatgatacaaagcccgaaagtgcggtagaaaataccgatgattttaatgtttaa

SEQ ID NO: 3825 - protein, 635 aa, Haemophilus influenzae
MVKNLVLWVVVAVIMMTAYQSFNSSSVENSTDYTTFVYDVSNGQVTAARFDANEITVTKTDGSKYSTVMPPLEDKKLLDDLLSKKVKVEGTPFERRGFLSQILISWFPMLFLVGVWVFFMRQMQGGGGKAMSFGKSRAKMLNQDQIKVTFADVAGCDEAKEEVGEIVDFLRDPNKFQNLGGKIPKGILMVGPPGTGKTLLARAIAGEAKVPFFTISGSDFVEMFVGVGASRVRDMFEQAKKNAPCLIFIDEIDAVGRQRGAGLGGGHDEREQTLNQMLVEMDGFSGNDGVIVIAATNRPDVLDPALTRPGRFDRQVVVGLPDVKGREQILKVHMRKVSVAQDVDAMTLARGTPGYSGADLANLVNEAALFAARVNKRTVTMLEFEKAKDKINMGPERRTMIMTDKQKESTAYHEAGHAIVGYLVPEHDPVHKVTIIPRGRALGVTFFLPEGDQISISQKQLESKLSTLYAGRLAEDLIYGEENISTGASNDIKVATNIARNMVTQWGFSEKLGPILYTEDEGEVFLGRSMAKAKHMSDETAHSIDEEVRAIVNRNYARAREILIDNMDILHAMKDALVKYETIEEEQIKQLMNREPVTPPSGWGEPKTQQAAYANSTTNDTKPESAVENTDDFNV

SEQ ID NO: 3826 - DNA, 2115 bp, Arabidopsis thaliana (Mouse-ear cress)
  CDS (1)..(2115)
atggcgaccacatcatcaaacccattactactttcttcaaatttcctcggttctcaaattataatctcagctccaacaccaaaaaccaccacaaagtctcttcctttctcagtaatctctcgaaaaagataccaaatttctcaatcggagaagctaatgaaatcgttaccatcacaagctgcgttagcagctctgttgttctcatcttcatctccacaagctttagcagttaacgaaccagttcaaccaccagcaccaaccattactgctgaagctcaatcaccaaatctgtcgacttttggtcaaaacgttttgatgacagcaccgaatccacaagctcaatcatcagatcttcctgatggaacacaatggcgatacagtgagtttctaaatgctgtgaagaaaggtaaagttgagagagtgaagtttagtaaagatggttctgttcttcagttaacagctgttgataatcgtcgtgctactgttattgttcctaatgatcctgatttgattgatatcttggcgatgaatggtgttgatatatctgtttctgaaggagaaggtggaaatgggttgtttgatttcattggtaatttgctttttcctttgttggcttttggagggttgttttatctctttagaggaggtcaaggaggtgctggtggtcctggaggtttaggaggtcctatggatttcggaagatcgaaatcgaagtttcaggaagtgcctgaaaccggtgtgacatttggtgatgttgctggagctgatcaagctaagcttgagttacaagaagttgttgatttcttgaagaatcctgataagtatactgcgttaggtgctaagattcctaaaggttgtttgttggttggtccaccgggtacggggaagacgcttttggctagagctgtggctggagaagctggagtgccgttcttttcgtgtgctgcttcggagtttgttgagctttttgttggtgtgggtgcttctagagttagggatttatttgagaaggcgaaatcgaaagctccttgtattgtgtttattgatgagattgatgctgttggtagacaaagaggagctgggatgggtggtggaaatgatgagagggaacagactattaatcagcttttgactgagatggatgggttttctggtaactctggtgtcattgtgttggctgccactaatagaccggatgttcttgactccgcgttgctgagacctggtagatttgaccggcaagtcacagtggataggcctgatgtagccggaagagttcagatccttaaggtgcattctagaggaaaagctattgggaaggatgttgattacgaaaaagttgcgaggagaactccgggtttcactggtgctgatttgcagaacctgatgaatgaagctgcgattcttgctgctagacgtgagcttaaggagataagcaaggatgaaatatctgatgctcttgagaggatcattgctggacctgaaaagaagaacgctgttgtctctgaggagaagaaaagacttgttgcttaccatgaggctgggcatgctttagttggtgcacttatgccggagtatgatccagtggccaagatatcgattattccacgtggccaagctggtgggctcacctttttcgctcctagcgaagagaggctagagtccggattgtatagcagaagctaccttgagaaccaaatggctgttgcacttggtggaagggttgcagaagaggtgatctttggagacgagaatgtgacaaccggagcatcaaatgatttcatgcaagtgtcgcgggtggctcgccaaatggttgagagattcgggttcagcaaaaagattggacaagttgcagttggtggagcaggaggaaaccctttcttgggtcaaagtatgtcatcgcagaaggattactcgatggcaacagcggatgtggttgatgcggaagtgagagagctcgttgagaaggcgtacgtgagagcgaaagagatcataacaacacaaattgatatcctacacaagcttgcacagctccttattgagaaagaaactgtggatggagaagagttcatgagtcttttcattgacggacaagccgagttatatgtttcttaa

SEQ ID NO: 3827 - protein, 704 aa, Arabidopsis thaliana (Mouse-ear cress)
MATTSSNPLLLSSNFLGSQIIISAPTPKTTTKSLPFSVISRKRYQISQSEKLMKSLPSQAALAALLFSSSSPQALAVNEPVQPPAPTITAEAQSPNLSTFGQNVLMTAPNPQAQSSDLPDGTQWRYSEFLNAVKKGKVERVKFSKDGSVLQLTAVDNRRATVIVPNDPDLIDILAMNGVDISVSEGEGGNGLFDFIGNLLFPLLAFGGLFYLFRGGQGGAGGPGGLGGPMDFGRSKSKFQEVPETGVTFGDVAGADQAKLELQEVVDFLKNPDKYTALGAKIPKGCLLVGPPGTGKTLLARAVAGEAGVPFFSCAASEFVELFVGVGASRVRDLFEKAKSKAPCIVFIDEIDAVGRQRGAGMGGGNDEREQTINQLLTEMDGFSGNSGVIVLAATNRPDVLDSALLRPGRFDRQVTVDRPDVAGRVQILKVHSRGKAIGKDVDYEKVARRTPGFTGADLQNLMNEAAILAARRELKEISKDEISDALERIIAGPEKKNAVVSEEKKRLVAYHEAGHALVGALMPEYDPVAKISIIPRGQAGGLTFFAPSEERLESGLYSRSYLENQMAVALGGRVAEEVIFGDENVTTGASNDFMQVSRVARQMVERFGFSKKIGQVAVGGAGGNPFLGQSMSSQKDYSMATADVVDAEVRELVEKAYVRAKEIITTQIDILHKLAQLLIEKETVDGEEFMSLFIDGQAELYVS

SEQ ID NO: 3828 - DNA, 2040 bp, Bacillus pseudofirmus
  CDS (1)..(2040)
atgaatcggatattccgtaatacgattttttatttactcattttcctagtcattgtcgggattgtgagtgtattcaactctgatcaaacagaaacagagaacgtatcgtttaatgaatttgctgaaaggcttgagaatggtcaggttcaagaattatcagtgaaacctgagagacaagtgtacttagtgcgcggtcaatttaatgatcaagctgaagatgagtttttccaaacgtatgctctacgcagcgagcagactgctgaacttttatttaatgcagaagacccaacaggaacaccatttaatttagaaattgagccggctgatgagacgagcgggtgggttcaatttttcacagggattattccgtttatcattatctttattctcttcttcttcttactaagtcaagctcaaggcggcggcagccgagtgatgaactttggtaaaagtaaggcgaaaatggttaatgaagataagaaaaaagcgaaatttaaagatgttgctggtgcagatgaggagaaacaagagcttgtagaagttgttgagttcttaaaagaccctcgtaaattctctgcaattggcgctcgtattccaaaaggggtgcttttagtaggacctccaggtacaggtaaaacattacttgctcgtgcagtagctggtgaagctggcgtaccgttcttctcaattagtggttcagacttcgttgagatgtttgtcggtgtcggtgcatcccgtgtacgtgatttatttgaaaatgcgaagaaaaacgccccatgtatcatctttattgatgagattgatgcagtaggtcgtcagcgtggagctggacttggcggcggacatgatgagcgtgaacaaacattaaaccaattacttgttgagatggatggcttcagcgcaaacgaaggaattatcattattgcggctacaaaccgtgcggatattctagatccagcccttcttcgcccaggccgttttgaccgtcaaattcaagttaaccgtccagatgtaaatggacgtgaggaagtattaaaggttcacgcaagaaacaaacctttaaatgatgatgtaaacttaaagaccattgctacaagaacacctggcttctcaggggctgatcttgaaaacctgctaaatgaagcagcgttagtggcagcaagacatgatcacacgaagatcagcatgattcatattgaagaagcgattgaccgggtaattgcagggccggctaaaaagagccgtgttatttcacctaaagaaaagaaaattgttgcatggcatgaagctggacataccgttgtaggtgtgaagcttgagaatgctgacatggttcataaagtaacgatcgtccctcgtggtatggcgggaggatatgcggttatgcttcctaaagaagaccgttatttcatgacacagccagagctacttgataagattatcggactcttaggtggccgtgtggcggaagaagtaacctttggagaagtaagtacgggtgctcataatgatttccaacgagctaccggtatagctagaaaaatggttacagaatacggaatgagtgaaaagctcggtccgatgcagtttatttctgggtctggcggtcaagtattccttggtcgcgatattcaaaatgagcagaactacagtgatgcgattgctcatgagattgacttagaagtacaacgtattattaaagaatgttacgcacgttgtaaacaaattcttcttgaaaataaagacagtcttgatcttgtagcgaaaacgttacttgatatggagacgttagatgcggagcaaattaaatcattggtgcatgaaggaaaacttcctgatgatcatcatttaaacgctcaccctgaaaaagagaaagcatcggagtcagatgtgaaagtgaacatcaactctaaaaaagaagaaacaccgcaagtagaggctgaacagccgcaggaaccaaacacagatgagccgattgaaaaagatccatcggtggaggataatcgttcgtttgaagatgatacaaataaaaaagaatga

SEQ ID NO: 3829 - protein, 679 aa, Bacillus pseudofirmus
MNRIFRNTIFYLLIFLVIVGIVSVFNSDQTETENVSFNEFAERLENGQVQELSVKPERQVYLVRGQFNDQAEDEFFQTYALRSEQTAELLFNAEDPTGTPFNLEIEPADETSGWVQFFTGIIPFIIIFILFFFLLSQAQGGGSRVMNFGKSKAKMVNEDKKKAKFKDVAGADEEKQELVEVVEFLKDPRKFSAIGARIPKGVLLVGPPGTGKTLLARAVAGEAGVPFFSISGSDFVEMFVGVGASRVRDLFENAKKNAPCIIFIDEIDAVGRQRGAGLGGGHDEREQTLNQLLVEMDGFSANEGIIIIAATNRADILDPALLRPGRFDRQIQVNRPDVNGREEVLKVHARNKPLNDDVNLKTIATRTPGFSGADLENLLNEAALVAARHDHTKISMIHIEEAIDRVIAGPAKKSRVISPKEKKIVAWHEAGHTVVGVKLENADMVHKVTIVPRGMAGGYAVMLPKEDRYFMTQPELLDKIIGLLGGRVAEEVTFGEVSTGAHNDFQRATGIARKMVTEYGMSEKLGPMQFISGSGGQVFLGRDIQNEQNYSDAIAHEIDLEVQRIIKECYARCKQILLENKDSLDLVAKTLLDMETLDAEQIKSLVHEGKLPDDHHLNAHPEKEKASESDVKVNINSKKEETPQVEAEQPQEPNTDEPIEKDPSVEDNRSFEDDTNKKE

SEQ ID NO: 3830 - DNA, 1842 bp, Buchnera aphidicola (subsp. Schizaphis graminum)
  CDS (1)..(1842)
atggttaaaaacctgatcttctggttagttattacagttgttttaatgtctgtttttcagaattttaattctagcgatactagtaatcatagagttgattattctacttttttatcagaagttaatcaagatcaagtccgtgaagcatatattaacggacggataattagtgttactaaaaaagatagtagtaaatatattacgtatattcctattaacgatcccaagttattagataatcttttaacaaaaaatgttaaaattgttggtgaaatacccgaagaaccgagtcttctaatctctatttttatttcttggttcccgatgttattgttaataggtgtttggatttttttcatgcgtcaaatgcaaatgggtggtggaaaaggagcaatgtcttttggtaagagcaaagcacgtatgctatcagaagatcaaattcagaccacttttgctgatgttgcaggatgtgatgaagcaaaagaagaggtcagtgaattagttgaatatttaaaagaacctagtcgttttcaaaaattaggagggaaaatacctaaaggtatacttatggtaggtcctcctggaactggtaaaacattgcttgcaaaagcaatagcaggtgaagcaaaggttccattttttacaatttctggttctgattttgttgaaatgtttgttggagtaggagcatctagagtaagagatatgtttgaacatgctaggaaatctgcaccttgtattatatttattgatgaaattgatgcggttggtcgtcaaagaggtgctggattaggtgggggtcatgacgaaagggagcaaacattaaatcaaatgctggtagagatggatggattcgatggcaatgaaggtgtaattttgatagctgctactaatagaccagatgttttagatcctgctctacttcgtcccggtcgttttgatcgtcaagtcattgtagcgcttccagatgttcgtggaagaaaacaaattttaaaagtacatatgcgtaaagttccgttatctgaagatgtagatccaatgataattgctcgtggtactccaggtttttcaggagcagatttagctaatttagttaatgaagctgcacttttcgctgctcgttttaataatcgagtagtatctatgatacattttgaaaaagcaaaagataagattatgatgggttctgaacgtagatccatggttatgagtgattttcaaaaagaatcaactgcatatcatgaagctggtcatgtaattatcggaagattggtacctgatcatgatcctgcacataaagtaacaattattcctagaggccaagcattaggaataaccttttttttgccagaatcagatatacttagcattagtcgtcaaaagctagaaagtcagatatctacactttatggaggtcgtttagcagaagaaattatttatggttctcaaaatgtttcaactggtgcatttaatgatattaaagttgctacaaatttagcacgaaatatggtaactcaatggggattttcagataagcttggtcctttattatatgctgaagaagaaggagaagtttttttaggtcgttctgttgctaaagcaaaacatatgtcagatgaaacagctagaattattgatgaagaagtaaaactattaattgaagttaattataatcgcgctagaaaaattttaaatgaaaatcttgatattttacatgctatgaaggatgctctaataaaatatgaaactattgattcgttgcaaattgatgatttaatggaaagacgcgaagtgcgcaaaccaaaaggatggttggaagttgatcaaaagaaagatatttaa

SEQ ID NO: 3831 - protein, 613 aa, Buchnera aphidicola (subsp. Schizaphis graminum)
MVKNLIFWLVITVVLMSVFQNFNSSDTSNHRVDYSTFLSEVNQDQVREAYINGRIISVTKKDSSKYITYIPINDPKLLDNLLTKNVKIVGEIPEEPSLLISIFISWFPMLLLIGVWIFFMRQMQMGGGKGAMSFGKSKARMLSEDQIQTTFADVAGCDEAKEEVSELVEYLKEPSRFQKLGGKIPKGILMVGPPGTGKTLLAKAIAGEAKVPFFTISGSDFVEMFVGVGASRVRDMFEHARKSAPCIIFIDEIDAVGRQRGAGLGGGHDEREQTLNQMLVEMDGFDGNEGVILIAATNRPDVLDPALLRPGRFDRQVIVALPDVRGRKQILKVHMRKVPLSEDVDPMIIARGTPGFSGADLANLVNEAALFAARFNNRVVSMIHFEKAKDKIMMGSERRSMVMSDFQKESTAYHEAGHVIIGRLVPDHDPAHKVTIIPRGQALGITFFLPESDILSISRQKLESQISTLYGGRLAEEIIYGSQNVSTGAFNDIKVATNLARNMVTQWGFSDKLGPLLYAEEEGEVFLGRSVAKAKHMSDETARIIDEEVKLLIEVNYNRARKILNENLDILHAMKDALIKYETIDSLQIDDLMERREVRKPKGWLEVDQKKDI

SEQ ID NO: 3832 - DNA, 1833 bp, Buchnera aphidicola (subsp. Baizongia pistaciae)
  CDS (1)..(1833)
atggctaaaaacctgatgctttggttagtaatcgcagtggtattaatgtccatttttcaaaattttagtgctaataatattaataatcgtaaaattgattattcaacttttttatcagatgtgaatcaggatcaggttcgcgaagttcatattagcggacgtgaaatgaatattattagaaaagataatggaagatatataacttatattccaatcagtgatccgaaactattagataatttattagtaaaaaacgtaaaaattattggtgctgcaccagaagaacaaagtttttttactgctatttttatttcatggtttcctatgctattattaattggagtatgggtcttttttatgcgacaaatgcaagttggtggtggaaaaggagctatgtcttttgggaagagtaaagctagaatgttacctgaagatcaagttaaaattactttttctgatgttgcaggatgtgatgaagctaaagaagaagttcaagagttagttgaatatcttaaagaacctagtagatttcaaaaactaggtggtaaaatacctaagggtattttaatggtaggtcctcctggaacaggaaaaacgttattagctaaagctattgctggagaggcaaaagttccattttttactatttcaggatctgattttgttgaaatgtttgtaggtgtcggcgcttctagagttcgcgatatgtttgaacattcgcgtaaagtagcaccttgtattatttttattgatgaaatagatgccgtaggtcgtcaaagaggtgctgggctaggaggagggcatgatgagcgagaacaaacattaaatcaaatgttagtagaaatggatggattcgatggtaatgaaggaattatattgattgcagcaactaatcgtccagatgtacttgatccagcattattaaggccagggcgttttgatcgtcaaatttttgtagcgttgcctgatattagaggaagagaaaaaattattcaagtacatatgaagaaagtgcctttaggaaataatgttgatcctatgattatagctcgaggaacgcctggattttctggagctgatttagctaatttagttaatgaagctgcattatttgctgctagaaataatagggatgttgttatgatgtctgattttgagagtgcgaaagataaaattactatgggttcagaacgaagatctatggtaatgacggagaagcagaaagaatctacagcttatcatgaagcagggcatgtcattgttggaagattagttccagaacatgatccagcgcataaagtaacaattattcctcggggtagagcgctaggagttacattttttttaccaaaagatgatgttttaagtatcaataaaaataagttggaaagccagatatcaacattatatggtggtcgtttagcagaagaaataatttatggtgtaaataacgtttctactggtgctcacaatgacattaaggtagctacaaatttggctaggaatatggtaacgcaatggggtttttcaaaaaaattgggaccgttattatattcggaagaagaaggagaaatatttttaggaagaactgttacgaaatctaagcatatgtctgatgaaactgctagaataatagatgaagaagtgaagttattagtagaaaaaaattataatagagctaaaaaaattttagaagaaaatttagatattttgcatgctatgaaagatgcgttaataaaatatgaaacaattaattctcgtcaaattgatgatttaatgaaaagaaaatctatacaaagttctaatatttgtacagatgatgacaataattaa

SEQ ID NO: 3833 - protein, 610 aa, Buchnera aphidicola (subsp. Baizongia pistaciae)
MAKNLMLWLVIAVVLMSIFQNFSANNINNRKIDYSTFLSDVNQDQVREVHISGREMNIIRKDNGRYITYIPISDPKLLDNLLVKNVKIIGAAPEEQSFFTAIFISWFPMLLLIGVWVFFMRQMQVGGGKGAMSFGKSKARMLPEDQVKITFSDVAGCDEAKEEVQELVEYLKEPSRFQKLGGKIPKGILMVGPPGTGKTLLAKAIAGEAKVPFFTISGSDFVEMFVGVGASRVRDMFEHSRKVAPCIIFIDEIDAVGRQRGAGLGGGHDEREQTLNQMLVEMDGFDGNEGIILIAATNRPDVLDPALLRPGRFDRQIFVALPDIRGREKIIQVHMKKVPLGNNVDPMIIARGTPGFSGADLANLVNEAALFAARNNRDVVMMSDFESAKDKITMGSERRSMVMTEKQKESTAYHEAGHVIVGRLVPEHDPAHKVTIIPRGRALGVTFFLPKDDVLSINKNKLESQISTLYGGRLAEEIIYGVNNVSTGAHNDIKVATNLARNMVTQWGFSKKLGPLLYSEEEGEIFLGRTVTKSKHMSDETARIIDEEVKLLVEKNYNRAKKILEENLDILHAMKDALIKYETINSRQIDDLMKRKSIQSSNICTDDDNN

SEQ ID NO: 3834 - DNA, 1896 bp, Guillardia theta (Cryptomonas phi)
  CDS (1)..(1896)
atgaaaatttcatggaaaaatatactattaaccttaattccattaggattaatttcatttttagtatggcaaggatttaataatacgactaatccacaatttactaaaaatattgcaagttcacgtatgacttatggtcgtttcttggaatacttagatttagggtgggtaaaaaaagtagatttatatgatgaaggtcacacggctattgtagaagcaataggacctgaattaggaaatagaattcaacgtatccgtgtcgaactaccagctacggctcccgaattaattacaaaactgcgtaaggcaaatgttgatttagatgctcatgcaactaatgattcgactccagcgtggagcttaataggtaacttaatttttccaattttattaatcgcaggtctagcgttcttattccgtagatcgagtaatctacctggtggacctggacaagcaatgaattttgggaaatcaaaagcacgttttcaaatggaggccaaaacaggggtaactttcaatgatgtcgctggtgtcgatgaagctaaagaagaattcgaagaagttgtttcttttttaaaaaaacctgaaagattcacagctgtaggtgcaaaaatacctaaaggcgttttactagttggtccaccaggaaccggaaaaacattattagctaaagcaatagcaggtgaagctggagtaccattttttagtatttctggttcagagtttgtagaaatgtttgttggagttggtgcgtcacgtgtaagagatttatttaagaaagcaaaagagaactctccgtgcattgtttttattgatgagatcgatgctgtgggtagacaacgtggtacaggtattggaggtggtaatgatgaacgtgaacaaacgttaaaccaactattgacagaaatggatggattcgaaggaaatacgggaattataatcatagctgctacaaatagagttgatgtattagatgcagccttattaagacctggtcgttttgatcgtcaagtaacagtagatgtacctgatgtaaaaggtagacttgaaattttaaatgttcacgcacgaaataaaaaattagatttaagtatatcgctagaattaatagcgaaacgtacacctggattttcaggtgcagatttggctaatttgttaaatgaagcagcaattttaacagcacgaagacgaaaaaaacaaattacaatatcagaaattgatgcttcgattgatcgggttatagctggtatggaaggaaaagcattagttgatagtaaaacaaagagattaattgcttatcatgaagttggtcatgctataataggtacgttattaaaacatcatgatcctgtccaaaaagttactttagtcccaagaggacaagcaaaaggcttaacatggtttacaccaagtgaagatcagtcattaatttctcgttctcaaattcttgctcgtataatgggtgctttgggtggacgagcagcagaagaagtagtttttggattaccagaagttacaaccggagcaggtaatgatttgcaacaagtcacttctatggctaggcaaatggtaacacgattcggaatgtcgaatattggaccattatctttagaaagccaaaatagtgatccgtttttagggagaaccatgggctcaagttctcaatactccgaggatatcgcttccagaattgatatgcaagttcgtgcaatcatccaacattgtcatacagaaacagtacaaattataaaagataatcgcgtagtaatagacaaattagtagatttgttaatagaaaaagaaactattgacggtgatgaattcagacaaattgtcggggactttacatcacttcctgagaagattgactataagagccaactaaaaagcacttag

SEQ ID NO: 3835 - protein, 631 aa, Guillardia theta (Cryptomonas phi)
MKISWKNILLTLIPLGLISFLVWQGFNNTTNPQFTKNIASSRMTYGRFLEYLDLGWVKKVDLYDEGHTAIVEAIGPELGNRIQRIRVELPATAPELITKLRKANVDLDAHATNDSTPAWSLIGNLIFPILLIAGLAFLFRRSSNLPGGPGQAMNFGKSKARFQMEAKTGVTFNDVAGVDEAKEEFEEVVSFLKKPERFTAVGAKIPKGVLLVGPPGTGKTLLAKAIAGEAGVPFFSISGSEFVEMFVGVGASRVRDLFKKAKENSPCIVFIDEIDAVGRQRGTGIGGGNDEREQTLNQLLTEMDGFEGNTGIIIIAATNRVDVLDAALLRPGRFDRQVTVDVPDVKGRLEILNVHARNKKLDLSISLELIAKRTPGFSGADLANLLNEAAILTARRRKKQITISEIDASIDRVIAGMEGKALVDSKTKRLIAYHEVGHAIIGTLLKHHDPVQKVTLVPRGQAKGLTWFTPSEDQSLISRSQILARIMGALGGRAAEEVVFGLPEVTTGAGNDLQQVTSMARQMVTRFGMSNIGPLSLESQNSDPFLGRTMGSSSQYSEDIASRIDMQVRAIIQHCHTETVQIIKDNRVVIDKLVDLLIEKETIDGDEFRQIVGDFTSLPEKIDYKSQLKST

SEQ ID NO: 3836 - DNA, 2121 bp, Medicago sativa (Alfalfa)
  CDS (1)..(2121)
atggccttctccacctcttctttactttctacaaacttcttaggagcaagaaacattccaacccccaaaacaaccaaaccttctatttcactaccattattcttcaaaactaaattcttcaactctcaaaatgacaacaacaacaataattcagaacctattaaatcagctgctgtatcagctcttatcttatcatctatgtttactccggcggcactcgccgccgacaacctcccaccaccaccaccacctgtactcgaagctcaaccaaaccaactaaaccccgcaaattcaacttcacctttctctcaaaacatttcactcacagcaccaaaaccacaagcacaatcctccactgatcttcccgatggtagccagtggcgttacagtgagtttttaaacgcagtaaaaaagggtaaagttgaacgagttaggttcagtaaagacggttctgtccttcaactaaccgccgttgatggccggagagccaacgttatcgttcccaacgaccctgaccttatcgatattctagcaatgaacggcgttgatatttccgtttccgaaggtgaacaaggtaacggtttgttcagtttcgttggtagtttattgttaccgttccttgcatttgcggggttgttcttgattttccgtagaggtcaaggaggacccggtgggcctggtgggcttggtgggcctatggatttcggtagatcgaaatcgaaattccaggaagtaccggagactggagtaacttttgcagatgtggccggtgctgatcaagcgaaattggagctacaagaagttgttgatttcttgaagaatcctgataagtacactgctttaggtgctaagattcctaaaggatgtcttttagtggggccacctggaactggaaagacattgttggcaagggcggtggctggtgaagccggtacaccgttcttttcgtgtgcagcttcggagtttgtggaactgtttgtgggagttggtgcttctagggttagggatttgtttgagaaggcgaagtcaaaggcgccttgcattgtgtttattgatgagattgatgctgttgggagacagagaggagctggtcttggtggtgggaatgatgagagggaacagactattaatcagcttttgaccgagatggatggattttcgggtaattctggtgttattgttttggctgctactaatagacctgatgttcttgattctgctttgcttagacctggaaggtttgatagacaagttactgttgatagacctgatgttgccggtagagttaaaatccttcaggtgcattctagaggaaaagcacttgcaaaggatgttgactttgacaaaattgccaggagaaccccagggttcacaggagttgatctgcagaatctgatgaacgaagcagctattcttgctgccaggcgtgacctcaaagaaataagtaaagatgagatagctgatgcgcttgaaaggatcattgctggaccagaaaagaaaaatgccgttgtctcagaagagaagaagaaattagtagcctatcatgaggctggccatgctttagtgggtgctttgatgcctgaatatgaccctgtagccaagatatctattatacctcgtggccaagctggtggtctcaccttttttgctcctagcgaagagaggcttgagtctggattgtacagtagaagctacttggagaatcagatggcggttgcacttggaggaagggttgccgaagaggtttttggccaggataatgtcaccactggggcgtcaaatgacttcatgcaagtttcacgagtggcaagacagatggttgagagatttgggttcagcaaaaaaattggacaggttgccatcggcgggggtggtggaaatccattcttgggacaacagatgtcttcacaaaaggattattccatggcaactgctgatatagtggataaggaagttagagaactggtagacaaagcatatgagagggcaacacaaattatcaacactcacattgacatccttcacaagcttgctcaacttctcatagagaaagaaacagttgatggtgaagagttcatgagtctattcattgatggaaaagctgaattgtatgtttcataa

SEQ ID NO: 3837 - protein, 706 aa, Medicago sativa (Alfalfa)
MAFSTSSLLSTNFLGARNIPTPKTTKPSISLPLFFKTKFFNSQNDNNNNNSEPIKSAAVSALILSSMFTPAALAADNLPPPPPPVLEAQPNQLNPANSTSPFSQNISLTAPKPQAQSSTDLPDGSQWRYSEFLNAVKKGKVERVRFSKDGSVLQLTAVDGRRANVIVPNDPDLIDILAMNGVDISVSEGEQGNGLFSFVGSLLLPFLAFAGLFLIFRRGQGGPGGPGGLGGPMDFGRSKSKFQEVPETGVTFADVAGADQAKLELQEVVDFLKNPDKYTALGAKIPKGCLLVGPPGTGKTLLARAVAGEAGTPFFSCAASEFVELFVGVGASRVRDLFEKAKSKAPCIVFIDEIDAVGRQRGAGLGGGNDEREQTINQLLTEMDGFSGNSGVIVLAATNRPDVLDSALLRPGRFDRQVTVDRPDVAGRVKILQVHSRGKALAKDVDFDKIARRTPGFTGVDLQNLMNEAAILAARRDLKEISKDEIADALERIIAGPEKKNAVVSEEKKKLVAYHEAGHALVGALMPEYDPVAKISIIPRGQAGGLTFFAPSEERLESGLYSRSYLENQMAVALGGRVAEEVFGQDNVTTGASNDFMQVSRVARQMVERFGFSKKIGQVAIGGGGGNPFLGQQMSSQKDYSMATADIVDKEVRELVDKAYERATQIINTHIDILHKLAQLLIEKETVDGEEFMSLFIDGKAELYVS

SEQ ID NO: 3838 - DNA, 2364 bp, Mycobacterium leprae
  CDS (1)..(2364)
atgaaccgaaaaaacgttatccgcatggttacggcgatcgctgtagtggtgctgctcggctggtcgtttttctacttcagcgacgacactcgtggttacaagttcgtcgacacctcggtggcgatgtcccagatcaacggccacaacgtcaagagcgcgcaaattgatgaccgggaacagcagctgcggttgaccttgaagaagggcaacaacgacaccgatggctctgacaaggtcataaccaaataccccaccgggtacgcggtcgatttgttcaacgcgctgagcgctaagaacacgaaggtcaccaccgccgtaaacgaaggcagcatcctgggcgagttgctcgtttatgtgctgccattgcttttgctggtgggcctgtttgtgatgttctctcgtatgcagggcggcgctcgaatgggctttggattcggcaaatcacgcgctaagcaactttccaaagacatgcccaagaccactttcgctgacgttgccggtgttgacgaggcggtcgaggagctctacgagatcaaggacttcttgcaaaacccctgtaggtaccagacgctcggcgcgaagatccccaagggcgtgctgctctacgggccgccgggcaccggtaaaacgttgctggcccgcgctgtggcgggagaggcaggcgttccgttcttcaccatctccggatccgacttcgtcgagatgttcgttggcgttggcgcttcacgcgtaagggacctgttcgaccaggctaagcagaacagcccgtgcatcatctttgtcgatgagatagacgcggtgggccgccagcgcggcaccgggctcggcggtggccacgacgagcgcgagcaaacactgaaccagttgctggtcgagatggacggttttggcgatcgggcgggcgtcatcttgatcgcggcaaccaaccggcctgacatcttggaccccgcgcttctaaggcccgggcgtttcgaccggcagatcccggtgtccaacccggacctggcaggtcgtcgcgcggtgctgcgcgtgcattcgaagggcaagccgattgccgacgatgctgacctcgacggactggccaaacgcactgtcggaatgaccggcgctgaccttgccaacgttgtcaacgaggcggcgctgctgaccgcccgagagaacggcctggtgattaccggacccgccttggaggaggcggtggaccgggtgatcggcgggccacgtcgcaagggccggatcatcagcgagcaggaaaagaaaatcacagcgtatcacgagggcgggcacaccttggcggcttgggctatgcctgatatcgagcctatctacaaggtgacgatcctggctcggggacgtaccggcgggcacgcggtggcggtgcccgaggaagacaagggcttgaggacccgctcggaaatgatcgcgcagctggtgttcgcgatgggtggacgtgccgccgaggagttggtgttccgcgagccgacgaccggtgcggtatcggatatcgagaaggccaccaaaatcgcgcgctcgatggttaccgaattcggtatgagctccaaacttggagcggtcagatatggttccgagcacggcgacccgttcctcggccggaccatgggcacccaggcggattactctcatgaggtcgcccgcgacatcgatgatgaggttcgcaagcttattgaagccgcgcacaccgaggcgtgggagattctcaccgaataccgcgacgtgcttgacaccctggccggcgagctgctggaaaaagaaactctgcaccgaccagagctggaggggatcttcgccagcgtcgaaaagcgaccccggctcaccatgttcgacgattttggtgggcggatcccgtcggacaagccgccgatcaagacacccggcgagctggcgatcgagcgcggcgagccctggccccagccagtccccgagccggcgttcaaggcagccatcgcccgtgcttcgcaggccgctgaggcctcgcaccaagcagcacaatcggataccgatgggccccccggccagggggccaatggttcacatgccggggaccgtcagcgccagcacggccctactcaacccgactatggcgctccgccgggttggcatgcgcctggatggccgccacaacagccgccggattactggtatccgcctgaacagcaaccctcacagtcgccctattggccgcagcccgcgcccagctatccgggccaagccccccctccgtatccgtcgtacccgccttgtccttcttacccgccgcctggtcaatccgccccggacgcgggtaagccccctgcacagttggacgagggcgtgagcccctccaacccaccggcgcacggctga

SEQ ID NO: 3839 - protein, 787 aa, Mycobacterium leprae
MNRKNVIRMVTAIAVVVLLGWSFFYFSDDTRGYKFVDTSVAMSQINGHNVKSAQIDDREQQLRLTLKKGNNDTDGSDKVITKYPTGYAVDLFNALSAKNTKVTTAVNEGSILGELLVYVLPLLLLVGLFVMFSRMQGGARMGFGFGKSRAKQLSKDMPKTTFADVAGVDEAVEELYEIKDFLQNPCRYQTLGAKIPKGVLLYGPPGTGKTLLARAVAGEAGVPFFTISGSDFVEMFVGVGASRVRDLFDQAKQNSPCIIFVDEIDAVGRQRGTGLGGGHDEREQTLNQLLVEMDGFGDRAGVILIAATNRPDILDPALLRPGRFDRQIPVSNPDLAGRRAVLRVHSKGKPIADDADLDGLAKRTVGMTGADLANVVNEAALLTARENGLVITGPALEEAVDRVIGGPRRKGRIISEQEKKITAYHEGGHTLAAWAMPDIEPIYKVTILARGRTGGHAVAVPEEDKGLRTRSEMIAQLVFAMGGRAAEELVFREPTTGAVSDIEKATKIARSMVTEFGMSSKLGAVRYGSEHGDPFLGRTMGTQADYSHEVARDIDDEVRKLIEAAHTEAWEILTEYRDVLDTLAGELLEKETLHRPELEGIFASVEKRPRLTMFDDFGGRIPSDKPPIKTPGELAIERGEPWPQPVPEPAFKAAIARASQAAEASHQAAQSDTDGPPGQGANGSHAGDRQRQHGPTQPDYGAPPGWHAPGWPPQQPPDYWYPPEQQPSQSPYWPQPAPSYPGQAPPPYPSYPPCPSYPPPGQSAPDAGKPPAQLDEGVSPSNPPAHG

SEQ ID NO: 3840 - DNA, 2145 bp, Nicotiana tabacum (Common tobacco)
  CDS (1)..(2145)
atggccaattctctcctctcttccaacttcatgggttctcaaatctttgtctctcctcccacccctaaaacaacaaagtatttccattttcactccaaaagaaagtctttaatccctcaatcaattctcaacaaaaaacccaattcagataattcaaagaatattccttcaaaagctgctttagctgctttactcttttcttcaatcactccacatgcctatgctcttgataatactacccctacagtgccaacccctcgagtgattcaagctgaagcagccaatcccaccacttcaaatccattctctcaaaatataatcttgaatgctccaaagcctcaagcacagaccaatcctgaacttccagaagtttctcaatggagatacagtgaattcttgaatgctgtgaaaaagggtaaagttgaaagggtccgattcagtaaagacggatctgccctccagcttactgctgttgatggccgtagagctactgtaactgtgcctaatgacccggatttaattgacattttggctatgaatggtgttgatatatcagtttctgaaggtgattctgctggtaatgggttgtttaatttaattggaaatttattcccttttattgcttttgctggattgttctatcttttccagagatctcaaggtgggcctggtgggccaggtgggcttggtggccccatggattttggtaggtcaaagtcaaagtttcaagaagttcctgaaactggagtgacttttgctgatgttgctggtgctgatcaagctaaattggagttacaagaagtggttgattttttaaagaatcctgataagtatactgctttaggtgctaaaataccaaaagggtgtcttttggtgggaccacctggtacaggaaagacacttttggctagagcagttgctggtgaagctggtgtaccatttttctcatgtgcagcatcagagtttgttgagttgtttgttggtgttggagcttctagagtgagggatttgttcgagaaggcgaagtcgaaagcgccttgcattgtgtttattgatgagattgatgctgtggggaggcagagaggtgcaggaatgggaggtgggaatgatgagagagagcagactattaatcaactcttgactgaaatggatgggttttctggaaatagtggagtcattgttttggctgcaactaataggcctgatgttcttgattctgcattgttgagacctgggaggttcgatcgacaagtgactgtcgataggcctgatgttgctggtagaatcaagattcttcaggtgcattctagaggaaaggcccttacaaaggatgtggactttgagaagattgccaggagaacaccgggttacactggtgcagatttgcaaaacttgatgaacgaagcagcaatccttgcagctaggcgtgaactaaaggaaataagtaaagatgagatatctgatgctctggagaggataattgccggcccagagaagaaaaatgctgttgtctcagatgagaagaagaagctggtagcttatcatgaggccggccatgccttggttggtgcacttatgcccgagtatgatcctgttgccaagatatctataattcctcgaggccaagctggtggtcttaccttctttgcccccagcgaagaaagacttgagtcgggcttgtacagcaggagctacctagagaatcaaatggcagttgcacttggtgaaagggttgctgaggaggttatttttggacaagataacgtaacaactggggcatctaacgatttcatgcaagtttcacgagtggcaaggcagatggttgagagattagggttcagcaaaaagattggacaagttgccattggaggaggtggaggaaatcctttcctaggtcaacagatgtcaacccagaaagactactccatggctacagccgatgtggttgatgctgaagtaagggaattggttgaaagagcatatgaaagggcaacagagattatcacaacacacattgacatcctacacaagcttgctcagctgttgatagagaaagaaactgttgatggtgaagagttcatgagccttttcatcgatggcaaggccgagctatacatttcttgggtctctaaggaggaggattag

SEQ ID NO: 3841 - protein, 714 aa, Nicotiana tabacum (Common tobacco)
MANSLLSSNFMGSQIFVSPPTPKTTKYFHFHSKRKSLIPQSILNKKPNSDNSKNIPSKAALAALLFSSITPHAYALDNTTPTVPTPRVIQAEAANPTTSNPFSQNIILNAPKPQAQTNPELPEVSQWRYSEFLNAVKKGKVERVRFSKDGSALQLTAVDGRRATVTVPNDPDLIDILAMNGVDISVSEGDSAGNGLFNLIGNLFPFIAFAGLFYLFQRSQGGPGGPGGLGGPMDFGRSKSKFQEVPETGVTFADVAGADQAKLELQEVVDFLKNPDKYTALGAKIPKGCLLVGPPGTGKTLLARAVAGEAGVPFFSCAASEFVELFVGVGASRVRDLFEKAKSKAPCIVFIDEIDAVGRQRGAGMGGGNDEREQTINQLLTEMDGFSGNSGVIVLAATNRPDVLDSALLRPGRFDRQVTVDRPDVAGRIKILQVHSRGKALTKDVDFEKIARRTPGYTGADLQNLMNEAAILAARRELKEISKDEISDALERIIAGPEKKNAVVSDEKKKLVAYHEAGHALVGALMPEYDPVAKISIIPRGQAGGLTFFAPSEERLESGLYSRSYLENQMAVALGERVAEEVIFGQDNVTTGASNDFMQVSRVARQMVERLGFSKKIGQVAIGGGGGNPFLGQQMSTQKDYSMATADVVDAEVRELVERAYERATEIITTHIDILHKLAQLLIEKETVDGEEFMSLFIDGKAELYISWVSKEED

SEQ ID NO: 3842 - DNA, 1854 bp, Geobacter sulfurreducens
  CDS (1)..(1854)
atggggcaatcggtctggaaaccgatactctggatgcttggtctgctggtgatattcaatctgatttacacctatgttgcccgccaatccgtcgatggtggcgcggtcgtatcctacagccggttccgggccgaactggcggccggtaacatcaagcgtataacgatcaagggcaccaccatcgccggcgattttcgcaataagataaccgttgaccagcctgcgggcgacaagaccgtggcccgcgagacggccaagttttctacggtaaagccagccatcgacgatccttctctcatggcggacctccaggcaaaaaatgtcgaggtgaccgcagtgacgacggagacgtcgccgattgtcagcgggcttctctatgtactgccgtggattttgatcatcggcgtctggtggctggccatgcggggaatgcgggggcagggacccacgtcggtcatgggaaatttctccaagtcaggtgccaagatgtacactcccagcgccaaggtcaaggtaaccttcgacgacgtggccggcatggagaacccgaagatggaactgaaagagatcgtcgattatttgcgtgatcctaaaaagttccagcgaatcggcggcaaagtgcccaagggagtgctcctggtcgggccaccgggcacgggaaagaccctcctggcccgggcagtggcgggtgaggcggacgttacctttctgagcatctcagcgtcccagtttatcgagatgttcgtcggcgtcggcgccggacgggtgcgtgatctctttgccacggccaagaagtcggctccgagcatcatcttcatcgacgagctggatgcggtggggcgcagccgtggcgccgggctcggcggggggcacgacgagcgggagcagaccctgaatcagcttctctccgaaatggatggattcgactcccatgacgaggtgatcgtcatggcagccactaaccggcccgacgtccttgatccggcgctccttcgccccgggaggttcgaccggcacgtggtcatcgaccgtcccgactggcgggatcgggagaaaatacttcatgttcacacccgcaagattcccctcgacaaggatgtggatctggccgtcattgcccggggaacgcccggcatggccggtgccgatctggaaaacctcgtcaacgaggcggccatcctggcggctcgggagaacgccgcgaccgttaccatggagcatatggagcgggccaaggacaaggttctcatggggggagagcggaagatgttcatcacggagcaggagaagcggattaccgcctatcacgaggcaggccatacgatcgtggccaagctcctgcccggaaccgacccggtccacaaggtgaccatcattccgcgggggcaggctcttggggtaactcagcaactacccgaagatgatcgctaccactacccgaagtcgtatctcatgaaccggctgtccgtggcacttggcggccggcaggcggagcgggccgtgttcggcgatctctccaccggggcccagaatgatctcaaaatggtcaacgatctggcggagaagatggtctgccagtggggcatgagcgacaagatcggcgccatgaccttcagccgtggagaggagcatccttttctcggacgaaagctggccgaggaaaaaaccttctccgagcagatggcgtggctcatcgatcaggaaatcgccgccatcattaaagaagcggagcagaaggccgataacgtcattgccaacaaccgcggcaagctcgatgcgctggtggatgctctcatggaagaggagaccctggacggcaaacgcatcgacgaggtcctggcctctgtgccgtga

SEQ ID NO: 3843 - protein, 617 aa, Geobacter sulfurreducens
MGQSVWKPILWMLGLLVIFNLIYTYVARQSVDGGAVVSYSRFRAELAAGNIKRITIKGTTIAGDFRNKITVDQPAGDKTVARETAKFSTVKPAIDDPSLMADLQAKNVEVTAVTTETSPIVSGLLYVLPWILIIGVWWLAMRGMRGQGPTSVMGNFSKSGAKMYTPSAKVKVTFDDVAGMENPKMELKEIVDYLRDPKKFQRIGGKVPKGVLLVGPPGTGKTLLARAVAGEADVTFLSISASQFIEMFVGVGAGRVRDLFATAKKSAPSIIFIDELDAVGRSRGAGLGGGHDEREQTLNQLLSEMDGFDSHDEVIVMAATNRPDVLDPALLRPGRFDRHVVIDRPDWRDREKILHVHTRKIPLDKDVDLAVIARGTPGMAGADLENLVNEAAILAARENAATVTMEHMERAKDKVLMGGERKMFITEQEKRITAYHEAGHTIVAKLLPGTDPVHKVTIIPRGQALGVTQQLPEDDRYHYPKSYLMNRLSVALGGRQAERAVFGDLSTGAQNDLKMVNDLAEKMVCQWGMSDKIGAMTFSRGEEHPFLGRKLAEEKTFSEQMAWLIDQEIAAIIKEAEQKADNVIANNRGKLDALVDALMEEETLDGKRIDEVLASVP

SEQ ID NO: 3844 - DNA, 1845 bp, Geobacter sulfurreducens
  CDS (1)..(1845)
atgggggtacccttgaaccagttctacaagaaccttgcgctctggctcgtcataagccttatgatgatcctcctcttcaacctcttcaacaagccgcgcaccacccaggaacggctcggctacagcgacttcattgctgcggttgatgcggggaaggtcagcacggttacggtccaggggaacgagatcatcggcaagtattccgacggcaaggaattccgcagctacaagccgacagatgccatgctctccgaaaagcttctggagaagaagatcaatgtctctgccaagcccgaggaagagaaggtctcgtggttctccatcttcatctcctggttcccgctcctttttctggtgggggtctggattttcttcatgcgccagatgcagggagggggtggcaaggccatggcattcggcaagagccgcgcgaagcttctgacagaagcccaggggcgcgtgaccttcgaagacgtggccggtgtagacgaagcaaaggaagaactggaagaaatcatccagtttctgaaggatcccaagaaattcaccaagctaggaggccgtatccccaaaggtgttctgctcgtgggccctcccggcacgggcaagacgctcctggcacgggccgtagccggagaggcgggagttcctttcttctccatttcgggatccgactttgtcgaaatgtttgttggggtcggcgcgagccgggtccgcgatcttttcgtgcagggaaagaagaatgcgccctgcattatcttcatcgatgagatcgatgcggttggacgccatcggggtgcgggactcggcggcggccatgacgagcgggaacagacactgaaccagctgctggttgagatggacggcttcgaatccaacgaaggggtcattcttatcgcggccacaaaccggcccgatgtcctcgatccggcactcctacggccgggacggttcgaccgccaggtggtcgttccccagcccgacgtgaaggggcgggagatgattctgaaggtccacaccaaaaagaccccgcttgcttccgatgtggacctgggagtaatcgcccgcggcacgcccggcttctcgggagcggacctgtccaacgtggtgaacgaggctgctctgctggcggcgcgtaaggacaagagctttgtcgaaatgaaggactttgacgacgccaaggacaaagtcctcatgggtgtcgagcgtcgcagtatggtgatttcggaggaagagaagaaaaataccgcctatcacgaagccggccatacccttgttgccaaactgatcccgggcaccgatccggtgcacaaggtttccattattccgcggggacgggcgcttggcgttaccatgcaactgcctatcgaggacaagcacagctataacaaggagtcgctcctgaaccggatcgcggtgctcatgggaggccgggctgccgaagagatcatcttcaatgagcttaccacgggcgccggtaacgacattgaacgtgcaacggagatcgcacgcaagatggtgtgcgaatggggtatgagcgaaaagatggggccggtcaccttcggtaagaaggaggagtcgatcttccttggccgtgacatgtccatgcacaagaactacagtgaagcgacggcggtggaaatcgacgaggagattcgtaaaatcatcgacggcagctactcgcgggtcaagcagctcctgaatgagaatctgagcgtgctccactgtctggcaacacagcttatcgagaaagagaacctgaccggcgacgaagttgaccggatcatcaaggatgactgcgcggccagccgcgctgcagtcgaagaggcccccgtggctccatga

SEQ ID NO: 3845 - protein, 614 aa, Geobacter sulfurreducens
MGVPLNQFYKNLALWLVISLMMILLFNLFNKPRTTQERLGYSDFIAAVDAGKVSTVTVQGNEIIGKYSDGKEFRSYKPTDAMLSEKLLEKKINVSAKPEEEKVSWFSIFISWFPLLFLVGVWIFFMRQMQGGGGKAMAFGKSRAKLLTEAQGRVTFEDVAGVDEAKEELEEIIQFLKDPKKFTKLGGRIPKGVLLVGPPGTGKTLLARAVAGEAGVPFFSISGSDFVEMFVGVGASRVRDLFVQGKKNAPCIIFIDEIDAVGRHRGAGLGGGHDEREQTLNQLLVEMDGFESNEGVILIAATNRPDVLDPALLRPGRFDRQVVVPQPDVKGREMILKVHTKKTPLASDVDLGVIARGTPGFSGADLSNVVNEAALLAARKDKSFVEMKDFDDAKDKVLMGVERRSMVISEEEKKNTAYHEAGHTLVAKLIPGTDPVHKVSIIPRGRALGVTMQLPIEDKHSYNKESLLNRIAVLMGGRAAEEIIFNELTTGAGNDIERATEIARKMVCEWGMSEKMGPVTFGKKEESIFLGRDMSMHKNYSEATAVEIDEEIRKIIDGSYSRVKQLLNENLSVLHCLATQLIEKENLTGDEVDRIIKDDCAASRAAVEEAPVAP

SEQ ID NO: 3846 - DNA, 1806 bp, uncultured bacterium 106
  CDS (1)..(1806)
atgaatacattcttacgtaatatcggcatctggcttgtgatcggccttgtaatgctgatgctctttaatctggttggaccaagagaatcaaacgagaatgaaatttctttttcagaatttatttctcaaatcgaatccggttctgtgttggaagttataatccgtggaagtcaaattcatggtgtcagcgatacaaatggttcttttcaaactcaagttccgaattaccctgcactgttcaaaatattggacagccatcaagtacgtgttaaagttgagccaaccgatgaaactaatttatttatggccatcctgagcagttggcttcctatgatcctgatcattggtatctggctcttctttatgcgtcaggtccagggtggaggaaaccgtgccatgggttttggaaaaatccgctcacgaataaccaacacggaagacaatccgataaaatttgaagatgttcagggaattgatgaatcacgggaagaattggaggaaattgtagattttctgaaagacccaggaaaatttgaaagacttggtggagaaatcccaagaggtgttttattaatgggagaacctggaaccggaaaaaccctgctggccaaagcaattgcaggtgaggctgcagtcccttttttcagtatcagcggttccgattttgtggaaatgttcgttggtgtcggtgccagccgtgtcagggacatgtttgcgcaaggtaaaaaacacgcaccgtgtatcattttcattgatgaaatcgatgcagtcggacgcagccgtggtgccggtcttgggggggggaacgatgaacgtgaacagactctgaaccagttactggttgagatggatggttttgaagtaaatgagggcattattgttgtagctgcaactaatcgaccggatgtgctggatcatgctttgctgcgcccagggcgttttgaccggcatgtagttgtaccttctccggatatcaaaggtcgtgaaaatattttgaaaacgcacagtaaaaagattgaactggataaaaaagtaagtttgaacaaaatagcacgtggaactcctggatttaccggcgcagacctggctaatcttgtcaatgaagcagcactttgggctgcgcgtcaggataaagaaactgtggataatgatgattttgaatatgcaagagatagagtgatgatgggtgcagagcggcgcagtctcttaattagtgatgaagaaaaagagactacagcctatcatgaggttggacatgctcttgttgcagccagtattgaagaagttgaccccgtgcataaggtgagtataattccgcgaggacgggctttaggagttacaatgctcctgccggaagaagatcgacacagtcataacaggcgttctttgctggggcaaataaccatgacgatgggaggacgtgcggcagaacatttagtatttaaacgcttcactacaggtgccagcgatgacctgaaaagagctacagaattagcccgaaaaatggtttgccagtggggaatgagtgagaaactgggaccactgacttatactgaagatgcggggcatgtttttctgggacgcgatttacaacagcatactgaattcagcaatgagtccatgcgtatgattgatgaagaagtgcttgaaatcctaaattcatcttatgagcgggcaaaatcgattttaaaaacttaccgtaaagcacttgaatcacttgccctgacattgctggaaaaagaaactattgatggagaaaatgtgctgcaggttatggaggagtttgcaccaaaaactaaaaaatag

SEQ ID NO: 3847 - protein, 601 aa, uncultured bacterium 106
MNTFLRNIGIWLVIGLVMLMLFNLVGPRESNENEISFSEFISQIESGSVLEVIIRGSQIHGVSDTNGSFQTQVPNYPALFKILDSHQVRVKVEPTDETNLFMAILSSWLPMILIIGIWLFFMRQVQGGGNRAMGFGKIRSRITNTEDNPIKFEDVQGIDESREELEEIVDFLKDPGKFERLGGEIPRGVLLMGEPGTGKTLLAKAIAGEAAVPFFSISGSDFVEMFVGVGASRVRDMFAQGKKHAPCIIFIDEIDAVGRSRGAGLGGGNDEREQTLNQLLVEMDGFEVNEGIIVVAATNRPDVLDHALLRPGRFDRHVVVPSPDIKGRENILKTHSKKIELDKKVSLNKIARGTPGFTGADLANLVNEAALWAARQDKETVDNDDFEYARDRVMMGAERRSLLISDEEKETTAYHEVGHALVAASIEEVDPVHKVSIIPRGRALGVTMLLPEEDRHSHNRRSLLGQITMTMGGRAAEHLVFKRFTTGASDDLKRATELARKMVCQWGMSEKLGPLTYTEDAGHVFLGRDLQQHTEFSNESMRMIDEEVLEILNSSYERAKSILKTYRKALESLALTLLEKETIDGENVLQVMEEFAPKTKK

SEQ ID NO: 3848 - DNA, 2400 bp, Mycobacterium paratuberculosis
  CDS (1)..(2400)
atgaaccggaaaaacgttattcgcaccatcacggcgattgctgtcgtggtgctgctcggctggtcgttcttctacttcagtgacgacacccgcggctataagcccgtcgacacctcggtggcgatggcccagatcaatggcgacaacgtcaagagcgcgcaaatcgacgaccgcgaacagcaactgcgcctgaccctgaagaagggcaacggcgacaccgacaactccgacaaggtcatcaccaaatatcccagcggctacgcggtcgacctgttcaacgcgctgagcgccaagaacgcgaaggtcagcacggtcgtcaaccagggcagcatcctgggcgagctgctggtgtacgtgctgcccctgctgctgctggtcgggttgttcgtgatgttctcgcgcatgcagggcggcgcccggatgggcttcgggttcggcaagtcgcgggccaaacagctgtccaaggacatgcccaagaccaccttcgccgacgtcgccggggtcgacgaggcggtcgaggagctctacgagatcaaggacttcctgcagaacccgggccgctatcaggcgctgggcgccaagatccccaagggcgtgctgctctacgggccacccggcaccggtaagacgctgctggcccgggcggtggccggcgaggccggggttccgttcttcaccatctccggatccgacttcgtcgagatgttcgtcggggtgggcgcgtcccgggttcgtgacctgttcgaccaggccaaacagaacaacccgtgcatcatcttcgtcgacgagatcgacgcggtgggacgccagcgcggcgccggcctgggcggcggtcacgacgagcgcgagcagacgctgaaccagttgctggtcgagatggacgggttcgacccgcgggccggcgtgatcctgatcgccgccaccaaccggcccgacatcctggacccggcgctgttgcggcccggccgcttcgaccgccagatcccggtgtccaacccggacctggccggccgtcgcgcggtgctggcggtgcattccaagggcaagccgatcgcccccgacgccgacctcgacggcctggccaagcgcaccgtcggcatgaccggcgccgacctggccaacgtgatcaacgaggcggcgctgctgaccgcccgggagaacggcaccgtcatcaccagcgccgctttggaggaagcggtcgaccgggtgatcggcgggccgcgccgcaagggccgcatcatcagcgagcaggaaaagaagatcaccgcctaccacgagggcggccacacgctggcggcctgggcgatgcccgacatcgaacccatctacaaggtgacgatcctggcgcgcggccgcaccggcgggcacgcggtcgcggtgcccgaggaggacaagggcctgcggacccgctcggagatgatcgcgcaactggtgttcgcgatgggtggccgcgccgccgaggagctggtcttccgcgagccgaccaccggcgcggtgtccgacatcgagcaggccaccaagatcgcccgcgcgatggtcaccgagttcggcatgagctccaaactcggtgcggtcaaatacggttcggaacacggcgacccgttcctcggccgcaccatgggcacccaggccgactactcgcacgaggtcgcccgtgacatcgacgacgagatccgcaagctgatcgaggccgcccacaccgaggcctgggagatcctcaccgaataccgcgacatcctcgacacgctggcgggccagctgctggagaaggaaacgctgcaccgcgccgagctggagagcatcttcgccggcgtcgaaaagcggccccggctcacgatgttcgacgatttcggtggccgcatcccgtcggacaagccgccgatcaagacacccggcgaactggccatcgagcgcggcgagccgtggcccccgcccgcccccgagccggccttcaaggcggccatcgccaaggccagcgaggccgccgcggccgcccggctggaggccgaccgaaacgccaacggcggcaacggttctcacgccaaccagggcggtaatcggcagggtcccacccaaccggactacggtgcgccggccggctggcgggcgccgggctggccgccgcagcagtcgcagcagcccaactactggcacccgcccgcccagccgccctactggcagcaaccggcgcacggctacccgggccagcagccttacccgggccagcagccctatcccggccagccgggcggaccggctcagtccggcccaccccaggcgcgtccgccgtacccgccgtacccgccgtaccccccgcccggtcagcccgcccccgagggtgggtcgccggaccggcaggatgacgacgtgagccggtccaacccgccggcccacggctga

SEQ ID NO: 3849 - protein, 799 aa, Mycobacterium paratuberculosis
MNRKNVIRTITAIAVVVLLGWSFFYFSDDTRGYKPVDTSVAMAQINGDNVKSAQIDDREQQLRLTLKKGNGDTDNSDKVITKYPSGYAVDLFNALSAKNAKVSTVVNQGSILGELLVYVLPLLLLVGLFVMFSRMQGGARMGFGFGKSRAKQLSKDMPKTTFADVAGVDEAVEELYEIKDFLQNPGRYQALGAKIPKGVLLYGPPGTGKTLLARAVAGEAGVPFFTISGSDFVEMFVGVGASRVRDLFDQAKQNNPCIIFVDEIDAVGRQRGAGLGGGHDEREQTLNQLLVEMDGFDPRAGVILIAATNRPDILDPALLRPGRFDRQIPVSNPDLAGRRAVLAVHSKGKPIAPDADLDGLAKRTVGMTGADLANVINEAALLTARENGTVITSAALEEAVDRVIGGPRRKGRIISEQEKKITAYHEGGHTLAAWAMPDIEPIYKVTILARGRTGGHAVAVPEEDKGLRTRSEMIAQLVFAMGGRAAEELVFREPTTGAVSDIEQATKIARAMVTEFGMSSKLGAVKYGSEHGDPFLGRTMGTQADYSHEVARDIDDEIRKLIEAAHTEAWEILTEYRDILDTLAGQLLEKETLHRAELESIFAGVEKRPRLTMFDDFGGRIPSDKPPIKTPGELAIERGEPWPPPAPEPAFKAAIAKASEAAAAARLEADRNANGGNGSHANQGGNRQGPTQPDYGAPAGWRAPGWPPQQSQQPNYWHPPAQPPYWQQPAHGYPGQQPYPGQQPYPGQPGGPAQSGPPQARPPYPPYPPYPPPGQPAPEGGSPDRQDDDVSRSNPPAHG

SEQ ID NO: 3850 - DNA, 2127 bp, Lactobacillus johnsonii
  CDS (1)..(2127)
atgaaaaatagaagaaatagactgctttctaacggtcttttctatatcatagtattcgtgatcctcttggctggaatcaattgggccgtgggaggctccggtagtaatggttccacagaaaatatccgttattctcaattagtaaaagatttaaaagcgggtaaagtcaagagtatcaatgtacaaccatctaatggtgtatatacggttactggatcttataagaaagctcaaaagtcaaataatcaaaataataatggatttggactaattccaagttcacaaagtagtaatgaagtaacccggttcagtactacgatgcttcaaaatgactcaatggttaagacaatttccgatcttgcccaaaagagtggggcatctatttctggacaaggtgaatctcaatctggaacctggatctctacgattgtgatgcttgtcccaactttgatttttattgtcatgctttggatgatgatgaatcaaggtggacaaggccgtggcggcggtatgatgaactttggtaagtcacatgttaagccacaagatccaagtaaaaacaaggttagattctcagatgtagctggcgaagaagaagaaaagcaagaattggttgaaattgttgaattcttaaagagtccagcaaaatatactaaattaggtgctcgaattccggctggtgttcttcttgagggtcctccaggtactggtaaaactttacttgcacgtgcagttgcaggtgaagccggtgtaccattttattcaatttctggttcagactttgtagaaatgtttgtcggtgttggtgcatctcgtgtacgtgatctgtttgaaacagctaagaaaaatgcaccaagtatcatctttattgatgaaattgatgctgttggacgtaaacgtggtaatggcgtaagtggtggccatgacgaaagagaacaaactttaaaccaattactggttgaaatggatggtttcgaaggtgatgaaggtgtcattgttatggcagctactaaccgttctgatgttcttgatcccgcacttcttcgtcctggtcgttttgaccgtaaggttttagttggtcgcccagatgttaaaggccgtgaagctattttaaaggttcatgctaagaataaacctttagcccctgatgttgatttaaagaaagtagcacgtcaaactcctggcttcgttggtgctgatcttgaaaatgttttgaacgaagctgctttagttgctgctcgtcgtaataagactgaaattacagcttctgatattgatgaagctgaagatagagttattgccggcccagctaagaaagatactgttatttctccagaagaaagaaaacgtgttgcctaccacgaagcaggacacgcaattgttggattggttcttagtgattcaagaactgttcgtaaggttacaattgttcctagaggccgtgctggtggatataacatcatgcttccaaaagaagatgaaaacatcatcactaagaagcagttgatggaacaagttgctggtttaatgggtggtcgtgctggtgaagaagtagttgtgggcgataagtctactggtgcttcaaatgactttgaacaagcaactaacatcgctcggggtatggttactcaatatggtatgactgatgttggtatgactgagcttgaatctccaagtatgcaatcaccttatggaactaagccatatagtgaagctacagctgctaagattgatgaagcagttaaagaaattcttgatgaaggtcataaacaagccgttgatatcattaagagtcaccgtgaaactcataagattattgctgaagccttactcaagtatgaaactttaaacgaaaaacaaattctttcattattcaagactggtaaaatgcctgaaaatgatgaaaatgaatttccaagtgagtctaaagcttcaacttatgaagaggcaaaagctgcaatggaaaagaaggatcaacaaagagaagaaactgaaaacaaggatgataaagaagatattcatccacttcctgatgatcataagaatattgataatattcctcttaatccaccatctgaaaagaatgaatctgatgatcatagttcagatgaaaacaaggatgattaa

SEQ ID NO: 3851 - protein, 708 aa, Lactobacillus johnsonii
MKNRRNRLLSNGLFYIIVFVILLAGINWAVGGSGSNGSTENIRYSQLVKDLKAGKVKSINVQPSNGVYTVTGSYKKAQKSNNQNNNGFGLIPSSQSSNEVTRFSTTMLQNDSMVKTISDLAQKSGASISGQGESQSGTWISTIVMLVPTLIFIVMLWMMMNQGGQGRGGGMMNFGKSHVKPQDPSKNKVRFSDVAGEEEEKQELVEIVEFLKSPAKYTKLGARIPAGVLLEGPPGTGKTLLARAVAGEAGVPFYSISGSDFVEMFVGVGASRVRDLFETAKKNAPSIIFIDEIDAVGRKRGNGVSGGHDEREQTLNQLLVEMDGFEGDEGVIVMAATNRSDVLDPALLRPGRFDRKVLVGRPDVKGREAILKVHAKNKPLAPDVDLKKVARQTPGFVGADLENVLNEAALVAARRNKTEITASDIDEAEDRVIAGPAKKDTVISPEERKRVAYHEAGHAIVGLVLSDSRTVRKVTIVPRGRAGGYNIMLPKEDENIITKKQLMEQVAGLMGGRAGEEVVVGDKSTGASNDFEQATNIARGMVTQYGMTDVGMTELESPSMQSPYGTKPYSEATAAKIDEAVKEILDEGHKQAVDIIKSHRETHKIIAEALLKYETLNEKQILSLFKTGKMPENDENEFPSESKASTYEEAKAAMEKKDQQREETENKDDKEDIHPLPDDHKNIDNIPLNPPSEKNESDDHSSDENKDD

SEQ ID NO: 3852 - DNA, 1977 bp, Treponema denticola ATCC 35405
  CDS (1)..(1977)
atgagtaaagataatgacgataaaaaccaaaacgatccctttaacttttttaatttcgggccggattccgatggagacgataaaaaatcacccaagaagccgtttttttctttatggcttttagcgccgcttgtagttatcatttttatcttaattaatcagttaatggtgctcaatagttccgccctgattcctttttcggaatttaaggatagaattacaacgggacagataaaaaaggttgttctcggtcctgtttattttaccggttataccagcatacaggatgatgattcttcaaatacctctttattttcatttttgtcggtacaaaaaaatactaatgaatatgtaacagtcgggatatacacctcggagtttttacagcttttagatgaccatcatgtggtttatcatgtaaagcctaaggaaagaagctatattgttgagcttcttttacagtgggtacttcccttccttttgatattccttgtttggcgtgccatcatgagacggatgaccaaggggatgggcggtttgggcggaagtattttttctcccgggcaggccagaagtgctgcaatagacgagggaaaggttgaaacccgctttaaggacgtcgcaggcgtcgatgaagctaaagaagaattaatggaagttgtagacttcttaaaatatcctcaaaaatataccgaaataggcggaaagattccgcgaggtgttcttttggtaggccctcccggaacgggaaaaacccttcttgcgcgagccgttgcaggtgaagcaggggttcccttctttagaataagcggctcggactttgtcgaaatgtttgtcggcgtaggagcttcccgtgtgcgtgacctattcaggcaggcccgtgaaaaagctccctgtattatctttatagacgaattggatgctatcggaaaatcgcgtcataattcttacagctcaaatgatgagcgggaacaaactttgaaccagcttttggttgaaatggacggctttgacaataagacgggcttgattcttttggctgccaccaaccgccctgatgttttggatccggccttgttaagacccggccgctttgacaggcaggttgtggttgaccgccccgatgtaaagggaagagagcagattctcaagcttcatgcagaaaatgtaaaactcgatgcttcggccgatttggcttcgatagcccgcattacagccggctgttcaggtgccgaccttgcaaatattataaatgaggccgctcttttggctgtcagaagtaaaagaaagaccgtcattatgactgacttggatgaagctgttgaaaaggcaatgataggcttacagaaaaaatcccgcgtaattcgtgaagaagaaagaaaagtaatagcctatcatgaaacaggtcatgccatcgtaggcagctttaccgatggagccgataaggtccataaggtaaccatagttccccgcggaacctcgactttgggctataccttccatattcccgaagacgataaacatatcgttaccgaaaaacagcttttggccgagatagatgttcttttaggaggccgagccgcagaacaggtaaaattcaatatggtttctaccggagctgcaaacgatttaacccgtgccaccgatattgcccgaagccttataaccgattacggtatgagctctaaatttaaaaacgtagccttgagcaagcgtggtgccggatatcttggcgataatgaacctaggttggtgcgtgaatatgccgaaacaacccagcaatacatcgatgaagaaatcgcaaagataatcaatacccgctatgagggtgttataaaaatgctgaacgaaaaaaagcatcttttggaaaagatagcaacaacccttttagaaaaggaaaccatagaaaacgaagaattcgatgcgataatcgctgaggagaaggctcctaaactttttgaaaaagagagtgaatag

SEQ ID NO: 3853 - protein, 658 aa, Treponema denticola ATCC 35405
MSKDNDDKNQNDPFNFFNFGPDSDGDDKKSPKKPFFSLWLLAPLVVIIFILINQLMVLNSSALIPFSEFKDRITTGQIKKVVLGPVYFTGYTSIQDDDSSNTSLFSFLSVQKNTNEYVTVGIYTSEFLQLLDDHHVVYHVKPKERSYIVELLLQWVLPFLLIFLVWRAIMRRMTKGMGGLGGSIFSPGQARSAAIDEGKVETRFKDVAGVDEAKEELMEVVDFLKYPQKYTEIGGKIPRGVLLVGPPGTGKTLLARAVAGEAGVPFFRISGSDFVEMFVGVGASRVRDLFRQAREKAPCIIFIDELDAIGKSRHNSYSSNDEREQTLNQLLVEMDGFDNKTGLILLAATNRPDVLDPALLRPGRFDRQVVVDRPDVKGREQILKLHAENVKLDASADLASIARITAGCSGADLANIINEAALLAVRSKRKTVIMTDLDEAVEKAMIGLQKKSRVIREEERKVIAYHETGHAIVGSFTDGADKVHKVTIVPRGTSTLGYTFHIPEDDKHIVTEKQLLAEIDVLLGGRAAEQVKFNMVSTGAANDLTRATDIARSLITDYGMSSKFKNVALSKRGAGYLGDNEPRLVREYAETTQQYIDEEIAKIINTRYEGVIKMLNEKKHLLEKIATTLLEKETIENEEFDAIIAEEKAPKLFEKESE

SEQ ID NO: 3854 - DNA, 1842 bp, Wolbachia endosymbiont of Drosophila melanogaster
  CDS (1)..(1842)
atgaaaaaatttttagaaggcttattgatctggttagtaattattgttcttatttcagttgcttgtattcaattcagcagaaatgtaggtaaaagtaaaacaattatacctttttcggaatttttaactagactagaagacaatgatgtagaaaatattgtcataaaaaaccagagcattgaaggcaagttcagggacggttcaagtttcaattcaagcggtgtcatatatagcgacctaataaaaaatttacatgatagaaaagtgagattctccttttcaactggagattctgccatgaacgtaattggtggattacttatctcatgggtcccaacatttatctttattggctttttgctattctttcttaaacaaacacaagcgggaggcaacagcactataagctttggcaagtcaagggctagactcatgactagtggaaaaaaagtaacatttgatgatgttgctggaattgatgaagcaaaagaagagctagtagagatcgttgatttccttaaacaaaggcaaaaatttcaaatattaggtggaaaaataccaaaagggtgccttttaattggctctcctggaactggtaaaactttacttgctcgtgcaattgcaggagaagctaatgtgccattctttagcatttctggatctgattttgttgaaatgtttgttggtgttggtgcgagccgtgttcgtgatatgtttgatcaaggcaagaaaaatgctccttgtataatttttatagatgagatagatgcggtgggtagacatcgtggcattggtcttggtggcagcaatgatgaaagagaacaaacattaaatcagttattagttgagatggatggctttgagtctaatgaaggtgtaataataattgctgcgactaaccgtccggatgtcttagatccagcactgcttagacctggtcgttttgaccgacagattactatttctttacccgatataaatgggcgtgaaaagatattaaatactcatataaagaaaatatcaatagcaccagatgtaaacgtgaaaacagttgcaagaggaacaccaggtttttcaggtgctgatctagcaaatttggtgaatgaatctgcacttatcgctgcaagaagaaacaagaaaattgttaccatggatgattttgaatatgcacgtgataaagtaatgatgggggtagaaagacgatccctaattatgacagaagaggaaaagagactgactgcataccatgaagctggtcatgcgataattgcggttaatatgcctgcttctgatcctatacacaaggcaacaatcattccaagaggtatggccttaggtttagttatgagactaccggaaacagatagagtgtcccacacaagagaaaagctgatagcagatataactgttgccatgggtggcagggcagcagaagagttaatttttggctacgataaagttacaagtggcgcgtcttctgatatacgacaagcatctaacatagcacgtgctatggtaaaaaaatgtggaatgaatgatgagatagggctagtgtatcacaatcgtgagcagcaagatccacaacatcctcatatgacatctgaagatacgctaaagctcatagatgaagaagtgaaaaaaatcatatcttcttgctatgaaaaagcaaaagacattttgaccaagcataagaaaggcttagagcttattgctgaaaatctactggagtttgaaactttaacaggagatgaaataaaggatatactaaacggaaaaaaaattgttagagaagaaaatgagaagaatgagaaagtaaaaaaatcctctctctatgagagttga

SEQ ID NO: 3855 - protein, 613 aa, Wolbachia endosymbiont of Drosophila melanogaster
MKKFLEGLLIWLVIIVLISVACIQFSRNVGKSKTIIPFSEFLTRLEDNDVENIVIKNQSIEGKFRDGSSFNSSGVIYSDLIKNLHDRKVRFSFSTGDSAMNVIGGLLISWVPTFIFIGFLLFFLKQTQAGGNSTISFGKSRARLMTSGKKVTFDDVAGIDEAKEELVEIVDFLKQRQKFQILGGKIPKGCLLIGSPGTGKTLLARAIAGEANVPFFSISGSDFVEMFVGVGASRVRDMFDQGKKNAPCIIFIDEIDAVGRHRGIGLGGSNDEREQTLNQLLVEMDGFESNEGVIIIAATNRPDVLDPALLRPGRFDRQITISLPDINGREKILNTHIKKISIAPDVNVKTVARGTPGFSGADLANLVNESALIAARRNKKIVTMDDFEYARDKVMMGVERRSLIMTEEEKRLTAYHEAGHAIIAVNMPASDPIHKATIIPRGMALGLVMRLPETDRVSHTREKLIADITVAMGGRAAEELIFGYDKVTSGASSDIRQASNIARAMVKKCGMNDEIGLVYHNREQQDPQHPHMTSEDTLKLIDEEVKKIISSCYEKAKDILTKHKKGLELIAENLLEFETLTGDEIKDILNGKKIVREENEKNEKVKKSSLYES

SEQ ID NO: 3856 - DNA, 2025 bp, Onion yellows phytoplasma
  CDS (1)..(2025)
atgtcattttttgataaaatttttaaaaaattccatatgggcgtcctttattttgctgtaattttaataggtgccacttttatttattgttattttactaagaatgcaaaaaaagataacaatacatttgatgaacttgcaaaagataacaaaattgaaaaaattatttatgaacctcactattttaattcatatttttgtaatgttgtagttactactacagacggcaaagtaattgatttttttaatattccttgtgaaaaagtatttgaccaaaaaccaaacggcaaatacaaatataaaattgattctgtagatcctagaccttggaatggttatgaacctgttgtttgggtatttagacaatgtttaacaatgttaattttttactgtttttttctcttttttgccgatactataaaacaaatgggacaagaaattttggcatcagcccctggtaaaaaaggttctaaaagtcgcaaagttattatcaatcaaaaaagatttactttttcagatgtagcaggagctgatgaagaaaaagaagaaatgtcagaattgattgactttttaaaaaacccgcgcaaatacgctgctatgggagcaagaattcctaaaggagttttgttgtatggacctccaggtacaggaaaaaccttacttgccaaagcagttgcaggtgaggcaggcgttcctttttttgctgcttcgggttctgattttgatgaagtttatgtaggtgttggtgcttcacgtgtcagagatctttttaaagaagctcaactggcagctccttgtatcgtttttatcgatgaaattgaggcagttgctagaaaaagaggctccaatattggtgggagtaacggttctgaacaaaccttaaaccaacttttagtagagatggacggctttaaccaaaaaatgggtgttattgttattgcagctactaacctacccgaagctcttgactcagctattttgcgtcctggacgttttgaccgtcactttaatattactttaccaaatgttaaagaccgtgaagctatcttaaaattacatgcaagtaataaaaaactttcagaagaaattagtttagaagaattagctaaacaaaccccaggttttagtggtgctcaattagaaggcaccttaaacgaagctgctttattagctgctagaagaaatgctacttttatcaataaaaaagatatcagcgaagctttagaccgtattttaattggacctgctaaaaaatctaaaaaatacaatgacaaagaaaaacgtatggtagcttatcacgaagcaggacatgctgttattggaattaaaattccttttgcccaaatagtgcaaaaaatcaccattattccccgcggaaacgcaggcggatacaacttaatgcttcctcaagaagaaactttcttttcttccaaaaaaaccctattagcccaaattacttcctttctgggcggacgtgttgccgaagaattaatgtttgacgacgtttctaacggcgcttacaacgattttaaacacgctacgcaaatagctaaactgatggtaactaaatacggcatgagtgatttaggaccagtgcaatattcaggaaatactttccaaaatgatttttctgatcctaaaggtttagaaattgaccaacaaattcaaaaaattattgctaattgttatcaacaagccaaacaaattattcaagaaaaccaagatttgcttgacacaatcgctaaatatttacttgaaattgaaactcttaataaaagagatattgatgaaattgtagctacaggaaaaattgcttggtgggaaaaagaaaaagaagaagccaacaacccaacccaaccaacttctcaaatgccttccaacaacgaaacaactagcactgatacaactcctttaaatgatgaattgaaaacaacaaccaatttagacaaccaagaatcaaacgaatcaaatccaaacaataaggaaacaacttctccagaagttgtgtcaacagattccgaataa

SEQ ID NO: 3857 - protein, 674 aa, Onion yellows phytoplasma
MSFFDKIFKKFHMGVLYFAVILIGATFIYCYFTKNAKKDNNTFDELAKDNKIEKIIYEPHYFNSYFCNVVVTTTDGKVIDFFNIPCEKVFDQKPNGKYKYKIDSVDPRPWNGYEPVVWVFRQCLTMLIFYCFFLFFADTIKQMGQEILASAPGKKGSKSRKVIINQKRFTFSDVAGADEEKEEMSELIDFLKNPRKYAAMGARIPKGVLLYGPPGTGKTLLAKAVAGEAGVPFFAASGSDFDEVYVGVGASRVRDLFKEAQLAAPCIVFIDEIEAVARKRGSNIGGSNGSEQTLNQLLVEMDGFNQKMGVIVIAATNLPEALDSAILRPGRFDRHFNITLPNVKDREAILKLHASNKKLSEEISLEELAKQTPGFSGAQLEGTLNEAALLAARRNATFINKKDISEALDRILIGPAKKSKKYNDKEKRMVAYHEAGHAVIGIKIPFAQIVQKITIIPRGNAGGYNLMLPQEETFFSSKKTLLAQITSFLGGRVAEELMFDDVSNGAYNDFKHATQIAKLMVTKYGMSDLGPVQYSGNTFQNDFSDPKGLEIDQQIQKIIANCYQQAKQIIQENQDLLDTIAKYLLEIETLNKRDIDEIVATGKIAWWEKEKEEANNPTQPTSQMPSNNETTSTDTTPLNDELKTTTNLDNQESNESNPNNKETTSPEVVSTDSE

SEQ ID NO: 3858 - DNA, 1947 bp, Mycoplasma mycoides
  CDS (1)..(1947)
atgaacaaaaagaagaaaaaatctacgttttggttttgaataattctaataataggttttataattttactgtcagttattagtataacttctagaggaactactcaaaatttaactattgaacaattatataacttatttgatcaatgtaaaccacttaataatgttgttttacagcgtaataatatccaaggtatagatataatcactggatgatataacaatggaagtggttgaactaaatttactgttaatacaaatccaaatgctattaacggttttagtgatgcttttaaaaattttgtatggcgttctaatactactcgttatactgagtcatcttgattctcactactttcatcattattaccaatgctaattttaattttattctacattggtttattttactttatggctaaaagcggagctgctggagctggggctagtggtttatttggtatgggtcaaaataaagcacgtagagagaaatctaatgttaaatttagtgatgttgctggtattgaagaagaaaaattagaattagtagaactagttgactatttaaaacaacctgctaaatatgcatcagctggtgctagagctccaaaaggagttttaatggaaggacctcctggaacaggtaaaactttactagcaaaagctgtagcaggtgaagctaatgtttctttcttttctatagctggttcagaatttgaagagatgtttgttggggttggtgcaagtagagttagagaaatgtttaatgaagctaaaaaagctgcccctgcaattatttttattgatgaaattgatgctgttggtagaaaacgtaattcagcaattggtacaggaacaaatgaacaaactctaaaccaattattagttgaattagatggatttgaaactaattcaggaattattgtaatggctgcaactaaccgtgttgatgtattagatcctgctttattaagacctggtcgttttgatagagttattcaagtttctctaccagatattaaagaacgtgagcaaatcttaaaactacacgcaagaaataaaaaaattgatccatcaattgattgacatagaattgctgaaagaactccaggattttcaggtgcacaacttgaaaacgttttaaacgaagctgctatattaatggttagagaaggtaaaactgtaattggtataaatgaaattgatgaagctattgatagagtagttggaggacctgctaaaaaatcacgtgctatgacaatgcatgataaagagattgtttcttatcatgaatctggtcatgctttaattggattaaaactagaaagtgcttcaaaagtacaaaaagttacaattattccacgtggtaatgctggtggttatactataatgactccaaaagatgaaacactattttcatcaaaaactgatctatatgctatgattgctggatatttaggtggtagagctgctgaagaaattaaatttggtaaagataatgtaactactggagctcatgatgactttgataaagccactgctattgctagaagaatggtaatgcaatttggtatgtctgaattaggtattactaaattcttaactatggctgatgaagcttatggaaaaactgaaggtagttattcagaaaaaacagctgctaaaattgatgctgaagttgaaagaattctagaagaatcatataaattagctattaaagtaattagtgaaaatatggaaactttagaattattagctgaatcattaagaatattagaaactattacagctgaacaaattgattacatcaacaaaaacaaaaaacttccagaagctgtaatttatgaaaaagaaaaatacaaacaagaacaagaaaagataaattctggaaaaattattgatttagatatcaatgatgttaaagaagataataaagaaaataattaa

SEQ ID NO: 3859 - protein, 648 aa, Mycoplasma mycoides
MNKKKKKSTFWFWIILIIGFIILLSVISITSRGTTQNLTIEQLYNLFDQCKPLNNVVLQRNNIQGIDIITGWYNNGSGWTKFTVNTNPNAINGFSDAFKNFVWRSNTTRYTESSWFSLLSSLLPMLILILFYIGLFYFMAKSGAAGAGASGLFGMGQNKARREKSNVKFSDVAGIEEEKLELVELVDYLKQPAKYASAGARAPKGVLMEGPPGTGKTLLAKAVAGEANVSFFSIAGSEFEEMFVGVGASRVREMFNEAKKAAPAIIFIDEIDAVGRKRNSAIGTGTNEQTLNQLLVELDGFETNSGIIVMAATNRVDVLDPALLRPGRFDRVIQVSLPDIKEREQILKLHARNKKIDPSIDWHRIAERTPGFSGAQLENVLNEAAILMVREGKTVIGINEIDEAIDRVVGGPAKKSRAMTMHDKEIVSYHESGHALIGLKLESASKVQKVTIIPRGNAGGYTIMTPKDETLFSSKTDLYAMIAGYLGGRAAEEIKFGKDNVTTGAHDDFDKATAIARRMVMQFGMSELGITKFLTMADEAYGKTEGSYSEKTAAKIDAEVERILEESYKLAIKVISENMETLELLAESLRILETITAEQIDYINKNKKLPEAVIYEKEKYKQEQEKINSGKIIDLDINDVKEDNKENN

SEQ ID NO: 3860 - DNA, 26 bp, Primer
atgaacgtttcaaaaatacttgtgtc

SEQ ID NO: 3861 - DNA, 27 bp, Primer
tcatgcatttaacattgtaggaatttt

SEQ ID NO: 3862 - DNA, 153 bp, Saccharomyces cerevisiae
  CDS (1)..(153)
atgtttggtctacctcaacaggaagtctccgaagaggagaaaagagctcatcaagaacaaactgagaaaaccttgaaacaggccgcttatgtggctgcgtttctttgggtttccccaatgatctggcatttggtgaaaaagcaatggaaataa

SEQ ID NO: 3863 - protein, 50 aa, Saccharomyces cerevisiae
MFGLPQQEVSEEEKRAHQEQTEKTLKQAAYVAAFLWVSPMIWHLVKKQWK

SEQ ID NO: 3864 - DNA, 24 bp, Primer
atgtttggtctacctcaacaggaa

SEQ ID NO: 3865 - DNA, 27 bp, Primer
ttatttccattgctttttcaccaaatg

SEQ ID NO: 3866 - DNA, 1470 bp, Saccharomyces cerevisiae
  CDS (1)..(1470)
atggctcggggtgacggacatctatggacagagacatatgatagttccacagtcgcttttatgattttaggtgccgccctggttttcttcatggtaccggggctgggctttctttattccggtttagcaagaagaaaatctgctctggctttgatttgggtagtgataatggctaccttagtaggtatactgcaatggtatttttggggctattctttagcattctctaagactgcgacgaacaacaaatttatcggcaacttggattcatttgggtttagaaacgtctatggcaaaatttcggatgattccacgtatcctgaactgatttatgccattttccaaatgatgttcatgtgtgtcgcattgagtattatagctggtgccactgcggaaagaggtaagctttttccacatatggtttttctttttgtttttgcgactttggtttactgtcccatcacttattggatttgggccccaggtggttgggcctaccaatggggggtattagactgggctggcggtgggaatattgaaatcctaagtgctgtggctggtttcgtttattcttattttctaggaagaagaaaagaaaacctcctgatcaactttagaccacataatgtttccatggtgactttgggtacttctatactttggtttggttggttgcttttcaatgctgcaagctcactgtcaccaaatatgaggtccgtatatgcgttcatgaacacttgtctcagcgccaccacgggtggaatgacgtggtgtttattagattatcgatctgaaaaaaaatggtccactgttgggttatgctccggcattatctgtggtttagttgctgccacgcctagctcgggttgtattactctatatggctctttgatccaaggtataatagcgggtgttgtttgtaattttgcaacaaaaataaagtattatttaaaagtggatgattccttagatctattagctgaacacggtatcgccggtgtggtgggattgatttttaacgctctatttgcagctgattgggttattggaatggacggcacaacaaagcataagggtggttggttgacgcataactggaaacaaatgtatattcaaattgcctatatcggtgcctctgccggctattgtgctgtggtcacggccatcatttgcttcgtattaggtaaaattccgggtgtccatctaagagtcactgaggaagccgaagcattggggttggatgaagatcaaataggcgaattcgcttacgattacgtggaggttaggagagattattaccagtggggtgtagatacagatgcacttcatactacatgcaatggcgctaattctgcgtctgagacaaatcctactgaggacagccaaaactcctcattgtcatcagctacagtaagcggccaaaacgaaaaaagtaataatcctaaattgcatcacgcaaaagaagcatga

SEQ ID NO: 3867 - protein, 489 aa, Saccharomyces cerevisiae
MARGDGHLWTETYDSSTVAFMILGAALVFFMVPGLGFLYSGLARRKSALALIWVVIMATLVGILQWYFWGYSLAFSKTATNNKFIGNLDSFGFRNVYGKISDDSTYPELIYAIFQMMFMCVALSIIAGATAERGKLFPHMVFLFVFATLVYCPITYWIWAPGGWAYQWGVLDWAGGGNIEILSAVAGFVYSYFLGRRKENLLINFRPHNVSMVTLGTSILWFGWLLFNAASSLSPNMRSVYAFMNTCLSATTGGMTWCLLDYRSEKKWSTVGLCSGIICGLVAATPSSGCITLYGSLIQGIIAGVVCNFATKIKYYLKVDDSLDLLAEHGIAGVVGLIFNALFAADWVIGMDGTTKHKGGWLTHNWKQMYIQIAYIGASAGYCAVVTAIICFVLGKIPGVHLRVTEEAEALGLDEDQIGEFAYDYVEVRRDYYQWGVDTDALHTTCNGANSASETNPTEDSQNSSLSSATVSGQNEKSNNPKLHHAKEA

SEQ ID NO: 3868 - DNA, 1215 bp, Bacillus subtilis
  CDS (1)..(1215)
atgcaaatgggcgatacagtttttatgttcttttgcgctttactcgtgtggctgatgaccccgggattagcgttattttatggaggaatggtaaagagcaaaaatgtgctgagcactgccatgcacagtttctcttccattgccatcgtttccatcgtttgggtgctgttcggatatacacttgccttcgcaccaggcaattcaatcatcggcgggctggagtgggcaggcctcaaaggggtcggatttgatccgggagattacagcgataccatcccccactcgttatttatgatgttccaaatgacgttcgccgttctgactacagcgattatttccggggctttcgcagagcggatgcgattcggcgcttttcttttattctcggttttatgggcctctttggtttacacacccgtagcgcactgggtatggggcggcggctggatcggccagcttggagcgctcgatttcgctggcggcaatgttgttcatatttcctccggggtggcaggacttgttcttgccattgtgctcggcaaacggaaagacggtacagcgtcttctccgcataacctcatttacaccttcttaggaggagctttgatttggttcggctggttcggctttaacgtcggcagcgcattgaccttagatggtgtggccatgtacgcgttcatcaacacaaacaccgcggctgcagccgggatcgccggctggatcttagtagaatggatcattaacaaaaaaccgacaatgctcggagcggtatctggggcaatcgccgggcttgtcgccattacgccggctgccggatttgtcacaccgttcgcttccattattatcggcatcatcggcggagctgtttgtttctggggagtattctcgcttaaaaagaaattcggatacgacgacgcgcttgacgcctttggcctgcacgggatcggcggcacatggggcggaatcgcaacaggattattcgcaacaacctctgttaactcagcgggcgcagatgggttattttacggtgatgcaagcttaatctggaaacaaatcgtcgccatcgccgccacttatgtttttgtatttattgtcactttcgttattattaaaattgtaagcctcttccttccccttcgcgcaactgaagaagaagagtcacttgggcttgacttaacgatgcacggggaaaaagcatatcaagattctatgtga

SEQ ID NO: 3869 - protein, 404 aa, Bacillus subtilis
MQMGDTVFMFFCALLVWLMTPGLALFYGGMVKSKNVLSTAMHSFSSIAIVSIVWVLFGYTLAFAPGNSIIGGLEWAGLKGVGFDPGDYSDTIPHSLFMMFQMTFAVLTTAIISGAFAERMRFGAFLLFSVLWASLVYTPVAHWVWGGGWIGQLGALDFAGGNVVHISSGVAGLVLAIVLGKRKDGTASSPHNLIYTFLGGALIWFGWFGFNVGSALTLDGVAMYAFINTNTAAAAGIAGWILVEWIINKKPTMLGAVSGAIAGLVAITPAAGFVTPFASIIIGIIGGAVCFWGVFSLKKKFGYDDALDAFGLHGIGGTWGGIATGLFATTSVNSAGADGLFYGDASLIWKQIVAIAATYVFVFIVTFVIIKIVSLFLPLRATEEEESLGLDLTMHGEKAYQDSM

SEQ ID NO: 3870 - DNA, 1224 bp, Methanobacterium thermoautotrophicum
  CDS (1)..(1224)
atgatgctaaattcaggtgatacagcatggatgttgatctcaactgcactcgtgatactaatgacggtgccaggggttgctatgttctattctggtttaacaaaacgtgagaatgttctgaacaccatctttctatcatttgtttcccttggcattgtgagtctgctctggtttctgtttggatatggtctaatattcggcggggatgtttcagggatcataggatcccatcaggtgggcatcagccttattaatttagggtctgcttcaaaatatgctccaacaatccccgaaggactctttgcaatttttcagatgacctttgctgcaataacagttgccctgatttctggcgctgtggtggaaaggatcaaattctcgtcatggatactgttcatccccctctggtttgcactcgtatatgtacccgtggcccactgggtatggggcggaggattcctgcagaaccttggtgttcatgatttcgcagggggaattgtggtgcacatcaccagtggcatagccgcccttgcccttgcccttgttactggtccaagatatgaccagaaactgatgccacatcaccttggatattctgttataggtaccggtcttctctggtttggctggtttggattcaacgccggttcagccctctctgccggatcccttgcagctaacgccatgatagtgacaaacacctctgcagcggcgggtatgataggatggatcctcatggatagacttaaaaccggaaaaccaacacttcttggcgctctttctggagcagttgcaggcctggcatcaataacacctgcagcaggttttgtggatataggtgcctccattgtcaccggacttgtggcagctgttatatgttatcttgcagtttcatggctgaagccagctgctggatatgatgatgcgcttgatgtatttgggattcacggtgtttcagggatcataggaacccttggagttggtttatttgcagttccagccctaaacccatctttgacctcaggaggtcttttaactggaagcacatcccttcttgtcagtcagctgattggtgttgtcaccgtcactgtctacaccttcgtcgttacatatatccttgcgatgctgctgatgaaatttaaggggctccgtgttgaaagggaagaggaaattcagggacttgacataaatctccatgaggaaacaggttacagactgacatga

SEQ ID NO: 3871 - protein, 407 aa, Methanobacterium thermoautotrophicum
MMLNSGDTAWMLISTALVILMTVPGVAMFYSGLTKRENVLNTIFLSFVSLGIVSLLWFLFGYGLIFGGDVSGIIGSHQVGISLINLGSASKYAPTIPEGLFAIFQMTFAAITVALISGAVVERIKFSSWILFIPLWFALVYVPVAHWVWGGGFLQNLGVHDFAGGIVVHITSGIAALALALVTGPRYDQKLMPHHLGYSVIGTGLLWFGWFGFNAGSALSAGSLAANAMIVTNTSAAAGMIGWILMDRLKTGKPTLLGALSGAVAGLASITPAAGFVDIGASIVTGLVAAVICYLAVSWLKPAAGYDDALDVFGIHGVSGIIGTLGVGLFAVPALNPSLTSGGLLTGSTSLLVSQLIGVVTVTVYTFVVTYILAMLLMKFKGLRVEREEEIQGLDINLHEETGYRLT

SEQ ID NO: 3872 - DNA, 1176 bp, Archaeoglobus fulgidus
  CDS (1)..(1176)
atgagtgacggaaatgtcgcatggatactcgcatccacggcccttgtaatgctgatggtgccgggagtggggttcttttacgcaggaatggtaaggagaaagaatgcagttaacatgattgcgctgagcttcatatcactcataatcacggttttgctgtggatattctacggctactcggtgagcttcggaaatgacatctctggaatcattggagggctgaattatgcactgctaagcggagttaagggggaggatttgctgttcatgatgtaccagatgatgttcgccgctgtcacaattgcaatcctcacctccgcaattgctgagagagcaaaagtttcatcgttcattctcctcagcgctctgtggcttacgttcgtttacgcccccttcgcacactggctttggggtggggggtggctggcaaagctcggcgccctcgactttgctggaggtatggttgttcacataagctcgggatttgctgcacttgcagtcgcgatgacgataggtaagagggcgggattcgaggagtactcgatagagccacacagcattccgctgacgctcattggcgctgccctgctttggtttgggtggttcggattcaacggcggaagtgcattggctgcaaacgatgtggccatcaacgccgtggtggtcacaaacacctcagcagcagtagcagggtttgtctggatggtaattggatggattaagggaaagccggggagtcttgggatagtgagcggtgcaattgctgggcttgccgccataacccccgcagcaggctttgtggatgtaaagggagcgattgtcataggtcttgtggctggaatagtatgctaccttgctatggacttcagaataaagaagaagatagacgagagccttgatgcttgggcgattcacggaataggcggtttatggggaagtgttgcagttggcattcttgcaaatccggaggttaacggatatgcaggcctactgttcggaaatccgcaactgctagtttcacaactgattgcggttgcatccacaacagcctacgccttcctcgtgacgctgatactggcaaaggctgttgatgccgctgtggggctgagggttagctcgcaggaggagtacgtcggtctcgacctgtcgcagcatgaggaggttgcctacacgtga

SEQ ID NO: 3873 - protein, 391 aa, Archaeoglobus fulgidus
MSDGNVAWILASTALVMLMVPGVGFFYAGMVRRKNAVNMIALSFISLIITVLLWIFYGYSVSFGNDISGIIGGLNYALLSGVKGEDLLFMMYQMMFAAVTIAILTSAIAERAKVSSFILLSALWLTFVYAPFAHWLWGGGWLAKLGALDFAGGMVVHISSGFAALAVAMTIGKRAGFEEYSIEPHSIPLTLIGAALLWFGWFGFNGGSALAANDVAINAVVVTNTSAAVAGFVWMVIGWIKGKPGSLGIVSGAIAGLAAITPAAGFVDVKGAIVIGLVAGIVCYLAMDFRIKKKIDESLDAWAIHGIGGLWGSVAVGILANPEVNGYAGLLFGNPQLLVSQLIAVASTTAYAFLVTLILAKAVDAAVGLRVSSQEEYVGLDLSQHEEVAYT

SEQ ID NO: 3874 - DNA, 1479 bp, Xylella fastidiosa
  CDS (1)..(1479)
atgcactctaactcttgccatcttagtgatatgaagaatggttttttcgcaatgttgaagagcctgttttatacgctctgtatattgatcgccttggctttgttggcaggtggcaatgcgatcggtcgtgcggaggctcaggtacaaaccaatcctttgcctagcgagcaagtcaccaccgaattgttgatgtctgaagcagccccttccgacgcggctgcaatacctaaaacgactccaacccccgtggtagacaagggggatgttgcttggatgctcacctcaacgctattagtgctactgatggtgttaccaggcttggcattgttttacggcggtatgttgcgctctaaaaacgtactatcgatcatggtacaaattggtgtggtgttttctctgatagccatcttgtgggtgctctacggctatagccttgcttttgctgatggtgacatgtttatcggtacattcaataaggcatttctttatggcgtagacactgcaacgttggccgataccttctctaaagggttcaaactgccggagtacctgtacgttgctttccagttgacttttgctggtatcaccggggtattgattgtcggtgcttttgcagaacgcgtgaaatttgctgcggtactgctgtttattttcatctggttttccttcggctacctgccactggcacacatggtgtggtcgacgccaggttttctgttgagcaagggggccttggattttgccggtggtactgttgtacatatcaatgctggtattgctggattggtcggtgcttactttgttggtaagcgttttggttttggccaggttgccgttaagccgcataacgtccccatgactttcactggtgctgcactgctatgggtcggttggttcggcttcaatgctggttcggcgttagaagccaatagcattgctgccttggctttcatcaacaccatgcttgcgactgctgctgcgatcctcgtttggtcgttgctcgaaaagatgaccaagggaaaattctcagccctgggtgttgcttcaggcatgattgctggtttagtaggcatcactccagcggcgggtacggttggtccgtttggtgcaattgcgattggtgctgttgccgccgtgtgctgtatctggggcatcactggactgaaaagattattgaaggtggacgataccttggacgtattcggcgtgcatggcattggtggcattgttggtgcgattttgactggggtttttaccgataaggcgctaggcggtcagggatatgctgaggggatgacaatgagcaatcaagtcatgattcaagccatgggtgtggggatcagcattgtgtggattggaatcgtttcgctggtaggtttcttaattgtcaaactgctgtttggcttgcgtgtgagcgaagaagctgaacgtgaaggattggacattacatcgcacggtgagtcggcgtacgagtcctga

SEQ ID NO: 3875 - protein, 492 aa, Xylella fastidiosa
MHSNSCHLSDMKNGFFAMLKSLFYTLCILIALALLAGGNAIGRAEAQVQTNPLPSEQVTTELLMSEAAPSDAAAIPKTTPTPVVDKGDVAWMLTSTLLVLLMVLPGLALFYGGMLRSKNVLSIMVQIGVVFSLIAILWVLYGYSLAFADGDMFIGTFNKAFLYGVDTATLADTFSKGFKLPEYLYVAFQLTFAGITGVLIVGAFAERVKFAAVLLFIFIWFSFGYLPLAHMVWSTPGFLLSKGALDFAGGTVVHINAGIAGLVGAYFVGKRFGFGQVAVKPHNVPMTFTGAALLWVGWFGFNAGSALEANSIAALAFINTMLATAAAILVWSLLEKMTKGKFSALGVASGMIAGLVGITPAAGTVGPFGAIAIGAVAAVCCIWGITGLKRLLKVDDTLDVFGVHGIGGIVGAILTGVFTDKALGGQGYAEGMTMSNQVMIQAMGVGISIVWIGIVSLVGFLIVKLLFGLRVSEEAEREGLDITSHGESAYES

SEQ ID NO: 3876 - DNA, 1545 bp, Arabidopsis thaliana (mouse-ear cress)
  CDS (1)..(1545)
atggacaccgcaaccaccacatgctctgccgtagatctatctgccctcctatcctcttcttctaactcaacatcttccctcgccgcggcaacctttttatgttcccaaatttcaaacatctccaacaaactctccgacacaacttatgccgtcgacaacacgtatctcctcttctccgcctaccttgtctttgccatgcagctcggtttcgctatgctttgtgctggatcagtccgagccaagaacactatgaacatcatgcttaccaatgtccttgatgctgccgctggagccatctcttactacctcttcggattcgcattcgcctttggtacaccttccaacggattcatcggtcgccaccatagcttcttcgctttaagctcttaccctgaacgccccggctccgacttcagctttttcctctaccaatgggcttttgccatagccgcggccggaatcactagcggttccatcgccgagcgaacgcaattcgttgcttaccttatctactctactttcttgaccggttttgtttacccgacagtctcgcactggttctggtcaagtgatggatgggctagcgcgtcccggtctgacaacaatctcttgtttggctcaggtgctattgatttcgcaggttcaggagttgttcacatggtaggtggaattgccggtttatgtggagcgttagttgaaggaccaagaataggtagatttgaccggtcaggccggtccgtggctttacgtggtcacagtgcatcccttgtcgtgcttggtaccttcttgttgtggtttggatggtatgggtttaaccctggttcctttttaaccattcttaaaggctacgacaagtctcggccatattatggtcaatggagcgctgtaggtcgcaccgcggtcaccacaacgctttctggctgcaccgctgcgttgactactctattcagtaaacggcttttagcaggtcattggaacgttattgacgtatgcaacggacttctaggcggctttgcagctataacctccggatgtgccgtggtggagccgtgggctgctatagtatgtggctttgtggcatcatgggttttaatcggatttaacttgcttgccaagaaacttaaatatgatgacccactcgaggctgctcagctccacggtggatgtggagcatggggattaatctttaccgggctgttcgcaaggaaagaatacgttaacgagatttactccggtgataggccttacggactgttcatgggcgggggaggaaaactgctcgccgcgcagatcgttcagattattgtgatcgttgggtgggtgacggtaactatgggaccgttgttttatgggttacataagatgaatcttttgaggatatcagcagaagatgagatggcaggaatggacatgacacgtcatggaggatttgcttacgcatacaatgacgaagacgacgtgtcgactaaaccatggggtcatttcgctggaagagtggagcctacaagccggagctcgactcctacaccgaccttgactgtttga

SEQ ID NO: 3877 - protein, 514 aa, Arabidopsis thaliana (mouse-ear cress)
MDTATTTCSAVDLSALLSSSSNSTSSLAAATFLCSQISNISNKLSDTTYAVDNTYLLFSAYLVFAMQLGFAMLCAGSVRAKNTMNIMLTNVLDAAAGAISYYLFGFAFAFGTPSNGFIGRHHSFFALSSYPERPGSDFSFFLYQWAFAIAAAGITSGSIAERTQFVAYLIYSTFLTGFVYPTVSHWFWSSDGWASASRSDNNLLFGSGAIDFAGSGVVHMVGGIAGLCGALVEGPRIGRFDRSGRSVALRGHSASLVVLGTFLLWFGWYGFNPGSFLTILKGYDKSRPYYGQWSAVGRTAVTTTLSGCTAALTTLFSKRLLAGHWNVIDVCNGLLGGFAAITSGCAVVEPWAAIVCGFVASWVLIGFNLLAKKLKYDDPLEAAQLHGGCGAWGLIFTGLFARKEYVNEIYSGDRPYGLFMGGGGKLLAAQIVQIIVIVGWVTVTMGPLFYGLHKMNLLRISAEDEMAGMDMTRHGGFAYAYNDEDDVSTKPWGHFAGRVEPTSRSSTPTPTLTV

SEQ ID NO: 3878 - DNA, 1287 bp, Salmonella enterica subsp. enterica serovar Typhi
  CDS (1)..(1287)
atgaagatagcgatgataaaaaccacactggcttcactggcgctgctgcctgggctaacgatagccgcgccggcggttgccgataaagcggatagtgcttttatgatgatttgcaccgcgctggtgctgttcatgacgataccgggtatcgcgctgttttacggcggattaattcgcgccaagaacgtgctgtcaatgttaacgcaagtgaccgtcacctttgcgctggtctgtattttatgggtggtgtacggctattcgctggcttttggcgaagggaatcattttttcggtaatgccgatggggcgatgttgaagaatatcgcgttgacggcggtaacgggtacgatttatcagtatattcatgtcgcgtttcagggatctttcgcctgtattaccgtcgggctgattgtcggcgcgctggcggagcgtattcgtttttcggcggtactgatttttgtcgtggtgtggttcacgctctcttatatcccgattgcgcacatggtgtggggcggcggcctgctggctgctcacggcgcgctggattttgctggtggtacagtggtgcatattaacgccgctatcgctgggctggtgggggcttatttaattggcaaacgcgtcggctttgggaaggaagcatttaaaccccataacctgccgatggtctttaccggtactgcgattctgtatatcggctggtttggatttaacgcgggttctgccggtagcgcaaacgagatagcagcgctggcctttgtgaacaccgtggtggcgaccgccgccgcgattctggggtggattatcggcgagtggacgctacgcggtaagccttccctgctgggagcgtgttccggcgcgattgccggtctggtcggcgtgacgccagcctgtggctatgttggcgttggcggcgcgctggttatcggcgttattgcgggtctggcgggattgtggggagtcaccatgcttaaacgtctgctacgggtagatgatccgtgcgacgtatttggcgttcacggcgtttgcggaatagtcggctgtatcctgaccggcgtttttgccgccagttcgctgggcggcgttggctttgtcgacggcgttacgatgggacatcaggtgatggtacagctggaaagtattgctattacggtcgtctggtccggcgttgtcgcgtttgttggttacaaactggcggatatccttgttggactgcgtgtaccggaagagcaggagcgcgaggggctggatgtgaacagtcacggcgagaatgcgtataacgcgtga

SEQ ID NO: 3879 - protein, 428 aa, Salmonella enterica subsp. enterica serovar Typhi
MKIAMIKTTLASLALLPGLTIAAPAVADKADSAFMMICTALVLFMTIPGIALFYGGLIRAKNVLSMLTQVTVTFALVCILWVVYGYSLAFGEGNHFFGNADGAMLKNIALTAVTGTIYQYIHVAFQGSFACITVGLIVGALAERIRFSAVLIFVVVWFTLSYIPIAHMVWGGGLLAAHGALDFAGGTVVHINAAIAGLVGAYLIGKRVGFGKEAFKPHNLPMVFTGTAILYIGWFGFNAGSAGSANEIAALAFVNTVVATAAAILGWIIGEWTLRGKPSLLGACSGAIAGLVGVTPACGYVGVGGALVIGVIAGLAGLWGVTMLKRLLRVDDPCDVFGVHGVCGIVGCILTGVFAASSLGGVGFVDGVTMGHQVMVQLESIAITVVWSGVVAFVGYKLADILVGLRVPEEQEREGLDVNSHGENAYNA

SEQ ID NO: 3880 - DNA, 1206 bp, Listeria monocytogenes
  CDS (1)..(1206)
atggaatcagtatttatgttcttttgtactttattggtttggttgatgacaccaggaatcgcattattttacggcggtatggttcgacgcaaaaatgtgttgagtactgcaatgtatagttttagttcgatggcaattatttctattctttgggtgattgttggttattcgttagctttcgcccctgggaacggctttataggtagttttgattggaccttccttcataatgtcggttttgcggcaaatgctacttactcagacgccattccacatgttctattcatgatgtttcaaatgacttttgctattttgactgtagctatcatttctggggcatttgcagaacggatgaatttctccgcttacttgattttcattatcttatggtcattacttgtttattcccctgtcgctcattgggtttggggtgatggcggttggttacgtaatcttggagcacttgattttgctggtggaaatgtggttcatattagttccggtgtaacaggattagtacttgcgattatgattggacgaagaaaagaagccgactctgcttctccgcacaatttaccacttgcgcttattggtgggattctagtttggtttggttggtatggttttaatgttggtagcgcccttacaattgataatgtggctatgacagcttttgttaatacgaatacggcagctgctgcaggtattatcggttggggtttggttgaatggttgacgaataaaaagccaactatgcttggaaccatttccggagcaattgctggtttagtatccattacccctgccgctggatttgttaccgttccaagttcacttatcattggtttcttcggcggagcactatgtttctgggctgtgttctggttgaaaggaaaagtaaaatatgatgatgcacttgatgcattcggtcttcacggaatcggaggtatttggggaggtattgcaactggactttttgctacaacaaaagtaaatgaagctggagcagatggattattttatgggaatgcttctctagtagtaaaacaattaattgcaatcggctcaacagtggcatatgtagctgtagtaacagctctaatcgtcgtaattatcaaactatttttaccaatccgtgtaaatgaagaacaagagtacaaaggacttgatttgacactgcacggcgaaaaagcatatcaagaataa

SEQ ID NO: 3881 - protein, 401 aa, Listeria monocytogenes
MESVFMFFCTLLVWLMTPGIALFYGGMVRRKNVLSTAMYSFSSMAIISILWVIVGYSLAFAPGNGFIGSFDWTFLHNVGFAANATYSDAIPHVLFMMFQMTFAILTVAIISGAFAERMNFSAYLIFIILWSLLVYSPVAHWVWGDGGWLRNLGALDFAGGNVVHISSGVTGLVLAIMIGRRKEADSASPHNLPLALIGGILVWFGWYGFNVGSALTIDNVAMTAFVNTNTAAAAGIIGWGLVEWLTNKKPTMLGTISGAIAGLVSITPAAGFVTVPSSLIIGFFGGALCFWAVFWLKGKVKYDDALDAFGLHGIGGIWGGIATGLFATTKVNEAGADGLFYGNASLVVKQLIAIGSTVAYVAVVTALIVVIIKLFLPIRVNEEQEYKGLDLTLHGEKAYQE

SEQ ID NO: 3882 - DNA, 1413 bp, Nostoc sp. PCC 7120
  CDS (1)..(1413)
atgtttcagaaaattttgataattggggtgagtaccctactactgctgacaagtcccatcatgggtaatgcttgggcgcaagtcccagggacgactccacctgctgatacgggagatacggcatttatgctgatttcagcagccctagtcttgctgatgacaccaggattagcatttttttatggtggtttcgtccgatcgcgcaatattctcaatacattgatgatgagctttgtattgatggcgattgtgggcgttacctgggttttatggggttatagtctgtcgtttgccccagggctgccatttattggtggtttacagtggtttgggttaaacggtgtggggctagaaaccacaggttatctgcaaggttccgagcctgcgaatgtggtttcctatgccgggacgattccccatcaggcatacatgatatatcaagccatgtttgccattatcaccccagctttaatttctggtgcgatcgccgaacgaatgagtttccgtgcctattgcctatttgtgctactgtggtcaacctttatttacacgcctctagcccacatggtttgggcaaaaggtggattcttaggtttgtatggcggcttaggtgcgctcgacttcgccggcggtacagtagttcatattagctctggggtttctgccctcgtcgccgcaatagtcctggggccaaggaaaacccatcccgatcgcctcagccctccccacaacgtaacatttattttgttgggtgctggcttgctatggtttggctggttcggttttaacgctgggagtgccttatcagttgctagcagcacttctggcagtttcatcactaatccagctacaactgcctttgttgccaccaacacctcagccgcagccggagctttaatgtggctaattctagaaggagtattacgcggtaaacccaccgccgtaggtgcagctacaggcgcagttgccggtttagtaggtataaccccagccgccggctttgtcacccctctagcgtcaattttgataggttttatcacagcttttgtttgcttttatgccgtaagtttcaaacacaagctaaatgttgatgatgccttagatacctacccggtgcatggtgttggtggaacagttggcgcaattctcacagctttctttgccaccgccgaagttaactcaggtggtaaaaacggcgtactcaagggtaattttggtgaactaggtgtggaactagccgccattgtcatcgcctatgtaattgcagcagttggtacttggataatcttgaagattattgatgctaccgttggcttacgggtgaaagaagaagcagaataccaaggtttggatatcagcgaacacggagaagaagcatataactccgagtttagcgatcgcatcgtaccgtaa

SEQ ID NO: 3883 - protein, 470 aa, Nostoc sp. PCC 7120
MFQKILIIGVSTLLLLTSPIMGNAWAQVPGTTPPADTGDTAFMLISAALVLLMTPGLAFFYGGFVRSRNILNTLMMSFVLMAIVGVTWVLWGYSLSFAPGLPFIGGLQWFGLNGVGLETTGYLQGSEPANVVSYAGTIPHQAYMIYQAMFAIITPALISGAIAERMSFRAYCLFVLLWSTFIYTPLAHMVWAKGGFLGLYGGLGALDFAGGTVVHISSGVSALVAAIVLGPRKTHPDRLSPPHNVTFILLGAGLLWFGWFGFNAGSALSVASSTSGSFITNPATTAFVATNTSAAAGALMWLILEGVLRGKPTAVGAATGAVAGLVGITPAAGFVTPLASILIGFITAFVCFYAVSFKHKLNVDDALDTYPVHGVGGTVGAILTAFFATAEVNSGGKNGVLKGNFGELGVELAAIVIAYVIAAVGTWIILKIIDATVGLRVKEEAEYQGLDISEHGEEAYNSEFSDRIVP

SEQ ID NO: 3884 - DNA, 1296 bp, Yersinia pestis
  CDS (1)..(1296)
atgatgatgaaaaaacttttatccgtgttgggcctgggtacggtagcgctgttaccttcttgggcaatggcggcggcaccggcagtcgctgacaaagcagataatgcttttatgatgatttgcactgcgttagtactgtttatgacgatacccggtattgccctgttctacggtggcctgttgcgctccaaaaacgtattgtcaatgatgactcaggtcatggtgagttttgcgctggtatgtgttttgtggattctctacggctacagcctggcgtttagtgcgggtaatgcgttcttcggcagttttgatatggccatgctgaaaggtattgagctgactagcctgagtggctcgttctatcaatatattcatgtcgtgttccaagcctcatttgcctgtatcaccgtcgctctgattgtgggttcattcgcagagcgtattcgtttctcagcagtattaattttcgccgcgctgtggttcaccttctcttacctaccaatagcgcacatggtatggggtggtggtttcctggcaatggacggagcgctggattttgctggtggtacagtggtgcacattaacgccgctgttgctggtttggtcggggcttatctgttgggtaaacgtgccggattcggtaaagaggccttcaaaccccataacttaccgatggtctttaccggtacggcgattctgtatattggctggtttggcttcaatgctggttcagccagtgctgcgaacgaaattgcagcgctagcgttcttgaataccgtcgttgcaacggcgggcgccatcctctcgtgggtatttgctgagtgggctttacgaggtaaaccttcgctgttgggggcatgttccggttgtatcgcaggcttggttgcgattactccggcagcaggtacggtaggggttggcggtgcattgattatcggtttggttggtggtgttgctggcctgtggggggtcgtgctactgaaaaaatggctgcgggtcgatgatacctgtgatgtcttcggtgttcatggtgtgtgtggcatcgtcggttgtattctgacgggtgtcttcacctcggcgtcgctgggcggcactggttatgctgctggcgtaaccatggggcatcaggtcggcgttcagttattcagtgttggtgtgactgttgtctggtcgggtgttgttgccttcgttgcctttaaaattgcgggcttgattgtgggcctacgggtacccgaagagcaagagcgtgaaggtctggatgttaacagtcacggtgaaaacgcatataatcaataa

SEQ ID NO: 3885 - protein, 431 aa, Yersinia pestis
MMMKKLLSVLGLGTVALLPSWAMAAAPAVADKADNAFMMICTALVLFMTIPGIALFYGGLLRSKNVLSMMTQVMVSFALVCVLWILYGYSLAFSAGNAFFGSFDMAMLKGIELTSLSGSFYQYIHVVFQASFACITVALIVGSFAERIRFSAVLIFAALWFTFSYLPIAHMVWGGGFLAMDGALDFAGGTVVHINAAVAGLVGAYLLGKRAGFGKEAFKPHNLPMVFTGTAILYIGWFGFNAGSASAANEIAALAFLNTVVATAGAILSWVFAEWALRGKPSLLGACSGCIAGLVAITPAAGTVGVGGALIIGLVGGVAGLWGVVLLKKWLRVDDTCDVFGVHGVCGIVGCILTGVFTSASLGGTGYAAGVTMGHQVGVQLFSVGVTVVWSGVVAFVAFKIAGLIVGLRVPEEQEREGLDVNSHGENAYNQ

SEQ ID NO: 3886 - DNA, 1206 bp, Listeria innocua
  CDS (1)..(1206)
atggaatcagtatttatgttcttttgtactttattggtttggttgatgacaccagggattgcattattttatggtggtatggttcgccgcaaaaacgtgttaagtacagcaatgtatagttttagctctatggcaattatttctattctttgggtgattgttggctactcgttagcttttgcacctggaaatggctttatcggcagtttcgactggactttccttcataatgtcggttttgcggcaaatgacacttactcagatgcaattccacacattctgtttatgatgttccaaatgactttcgctattttaacagtagctatcatttctggggcatttgctgaacggatgaacttctctgcttacttgatttttattattttatggtcgttactagtatattcccctgttgcacactgggtttggggcgacggtggttggttacgcgagctaggagcacttgatttcgctggtggaaatgttgttcatatcagttcaggtgtaacgggtcttgtcttagctataatgattggccgcagaaaagaagctgattctgcttcacctcataacctcccgcttgctcttattggtgggattctagtctggtttggttggtatgggtttaatgtcggtagcgccctcacgattgataatgtagcgatgactgcatttgttaatacgaatacagcggctgcagctggaattattggctggggattggttgaatggttaatcaataaaaaaccgactatgcttggaacaatttctggcgctatcgctggtttagtgtccattacacctgctgccggtttcgttacagtacctagctctttgattatcggctttcttggcggagcactttgcttctgggcagtattctggttgaaaggaaaagtgaaatatgatgatgcgcttgacgcgtttggcttacacggaattggcggaatttggggcggcatcgctactggactttttgccacaacgaaggtaaatgaagctggagcagatggtctcttttacggtaatgcttccttagttgtaaaacaattaatcgcaattggctctactgtcgcatatgttgcagtagtcacagctctaattgtcgtagtaatcaaactatttttaccaattcgcgtaaacgaagaacaagaatacaaaggacttgatttgacgctacacggcgaaaaagcatatcaagaataa

SEQ ID NO: 3887 - protein, 401 aa, Listeria innocua
MESVFMFFCTLLVWLMTPGIALFYGGMVRRKNVLSTAMYSFSSMAIISILWVIVGYSLAFAPGNGFIGSFDWTFLHNVGFAANDTYSDAIPHILFMMFQMTFAILTVAIISGAFAERMNFSAYLIFIILWSLLVYSPVAHWVWGDGGWLRELGALDFAGGNVVHISSGVTGLVLAIMIGRRKEADSASPHNLPLALIGGILVWFGWYGFNVGSALTIDNVAMTAFVNTNTAAAAGIIGWGLVEWLINKKPTMLGTISGAIAGLVSITPAAGFVTVPSSLIIGFLGGALCFWAVFWLKGKVKYDDALDAFGLHGIGGIWGGIATGLFATTKVNEAGADGLFYGNASLVVKQLIAIGSTVAYVAVVTALIVVVIKLFLPIRVNEEQEYKGLDLTLHGEKAYQE

SEQ ID NO: 3888 - DNA, 1320 bp, Deinococcus radiodurans
  CDS (1)..(1320)
atgaaacgcgccccctacactgccgctgctactactgccgccctgctgctcttgcccctgctctcgacggccttcgctgccgacgccaagccgcacctcgacaccggcgacaccgcctggatgctgatgtcggcggcgctggtgttcctgatgacgcccggcctcgccttcttttacggcggcctgacccgcgcccagagcgtgctgaacaccatgatgatgagcatggtcagcatcggcctggtcggggtgctgtggatgctcgccgggtactcgctcgccttcggggatggcggcgcgtggctgggggacttcgcgcacctcggtctgaatgggttggcggggcagctcaccggcaccattcccacttacgtcttcgcctcgtttcaggccatgttcgccatcatcgccgtcgcgctgatttcgggcgcggtggtcgagcggatgcgcttcggcgcctttatcctcttcgccgcgctgtggactctgatcatctactcgccgctcgcccactgggtctggggcgccaacggctggctgttcaaggatggcgcgctcgattttgcgggcggcaccgtcattcacatctccgccggggtgtccgcgctggtggcggcctggctgctggggccgcgcctgggctacccgcgcaacgcccacgtgccgcacaacgtcccgctggtgttgctcggcgccgggctgctgtggttcggctggatgggctttaacgcgggctcggcgctgggggccaatcagacggcggcccttgccttcatcaccaccctgattgcgcccgccgccgccatgctgacctggctgggctgggaaagcctgagcagcaagccgaccgccgtgggcgccgccaccgggctggtcgtggggctggtcgccatcaccccagcgtgcgccttcgtgtcgccctgggccgccgtgctgctgggcatcctgggtgccaccgcgagctactggaccgtgcaggccaagcaccgcctgatggccgacgacgcgctggacgtgttcgcctgccacggggtcgcgggcatcgtgggggcgctgctcaccggtctgctcgcctggaccaccggcagcggcaagccgattggcgcgcagttcatgactcagctcatcagcgtggtcgcctcgctgctctacgcgggggtcggcagcttcatcctgctcaagctggtgtcgctggttattccactgcgggtgccggcagggcaggaaatcgcaggcatcgacctcagcgcccaccaggagcagggctacagcgaaaacgaactcggcatcggggcgccagtgttcctgggcggtgactga

SEQ ID NO: 3889 - protein, 439 aa, Deinococcus radiodurans
MKRAPYTAAATTAALLLLPLLSTAFAADAKPHLDTGDTAWMLMSAALVFLMTPGLAFFYGGLTRAQSVLNTMMMSMVSIGLVGVLWMLAGYSLAFGDGGAWLGDFAHLGLNGLAGQLTGTIPTYVFASFQAMFAIIAVALISGAVVERMRFGAFILFAALWTLIIYSPLAHWVWGANGWLFKDGALDFAGGTVIHISAGVSALVAAWLLGPRLGYPRNAHVPHNVPLVLLGAGLLWFGWMGFNAGSALGANQTAALAFITTLIAPAAAMLTWLGWESLSSKPTAVGAATGLVVGLVAITPACAFVSPWAAVLLGILGATASYWTVQAKHRLMADDALDVFACHGVAGIVGALLTGLLAWTTGSGKPIGAQFMTQLISVVASLLYAGVGSFILLKLVSLVIPLRVPAGQEIAGIDLSAHQEQGYSENELGIGAPVFLGGD

SEQ ID NO: 3890 - DNA, 1266 bp, Bacillus halodurans
  CDS (1)..(1266)
atggattccattgctttaatggataacgtgtggattatgctatgtgccgttcttgttttgttaatgcaaggtggatttattttacttgaagctggctcaacaagaatgaagaacgctggtcatattgccggaaaaacgattttcacagttgggattgcatccctcgtttattgggcagtaggctgggggttcacttacggagaggggaacgcttttatcggtctttctgatttcttcttcggcgattactcaacggctgaagagggactagtcggctcggtcgatttctttttccaattaatgttcgctgccattgcgctcacgattgcgtttggtggatttgctgagcgtgcgaagctatcagtctatatcctgtttgcggttttgttttctgcattcgtttatccaattgtcgctcactggatttggggagatggctggcttgctgacttaggaaaacaagactttgcaggttcgaccgtcgttcacttaacgggtgcgatgggggctctagcagctacgatcttattaaagccgcgtttaggcaaatacaacaaagatggctcgatgaacgatattcaaggtcacaaccaagtgtatacagcattgggtgtattgcttctttgggtcggttggttcggcttcaacgcaggtagtacgctagaagtggccgacgcattcttcggttatgttgcgttaaatactcagcttgctgccgctgcaggtgcagtcgctgccatgttcattgcatgggctctatcaggaaaagcagatgtaccgacaaccttgaatggagcattagctggtcttgttgcgatcacagcgtcatgtgcgttcgttgcgccttgggccgcagttgtcatcggaattgttggtggacttatcgtttacttcagcatgaaatttttcgataaagcgaaaattgatgacccaatctttgctctctcggtccatggtgtggccggggtgtgggggacactttctacagggttctttgccactcctgagcttgcagagatgaacggtggtcaagcgggcttgttctacggcggtggttttgcacaattaggtgttcaaacgttgagcgttgtcgcttgtggtgtgttcgcttttatcgcttcatacgtactactccttgtatgtaagtctgtactcggtggtcttcgtgtaacagaagaagaagaaatcattggtcttgacttaagtgagcatggaagctacggatatcctgaaagcatgccaggttccgaaaaatcaggagcataa

SEQ ID NO: 3891 - protein, 421 aa, Bacillus halodurans
MDSIALMDNVWIMLCAVLVLLMQGGFILLEAGSTRMKNAGHIAGKTIFTVGIASLVYWAVGWGFTYGEGNAFIGLSDFFFGDYSTAEEGLVGSVDFFFQLMFAAIALTIAFGGFAERAKLSVYILFAVLFSAFVYPIVAHWIWGDGWLADLGKQDFAGSTVVHLTGAMGALAATILLKPRLGKYNKDGSMNDIQGHNQVYTALGVLLLWVGWFGFNAGSTLEVADAFFGYVALNTQLAAAAGAVAAMFIAWALSGKADVPTTLNGALAGLVAITASCAFVAPWAAVVIGIVGGLIVYFSMKFFDKAKIDDPIFALSVHGVAGVWGTLSTGFFATPELAEMNGGQAGLFYGGGFAQLGVQTLSVVACGVFAFIASYVLLLVCKSVLGGLRVTEEEEIIGLDLSEHGSYGYPESMPGSEKSGA

SEQ ID NO: 3892 - DNA, 1239 bp, Methanobacterium thermoautotrophicum
  CDS (1)..(1239)
atggagatgactctgatggatgcggtcttaaactccggtgacactgcctggatgctggtatcaacagccctggtaatgctgatgacggttccaggcgtggcactattctacgggggtttaacaaaaaaggaaaacgtgctgaacaccatgttcctatccctgatagccttcgcagtgacgagcataatatgggtactctacggctatcagttcgcctttggagctgacataatggggttcataggaagtccagtgaacctgctgatgaacggggtcggtgttaacactgctgctgcactggcaccaacaataccagacttcctctacatagcattccagttaacattcgcagcaataacggttgcactcatatccggtgccgtcgttgaaaggatgaagttctcagcctggctggcattcattgtgctctgggtgagcctggtctacgtgccggtggcccactgggtatggggcggaggattcctggcgcagctcggtgccctggacttcgcaggcggtactgtggttcacatcaactcaggtgttgcagcactcgcactcgtctacctcctcggtaagagaaaggacacgagacttctgccacacaacctgggatactcagtgataggtgcttcactgctctggttcggctggtttggattcaacgccggttcagcactcacggcaggtggacttgcagcatcagccttcctggtgaccaacactgcggcggctgctggtatggtatcatgggttataatggactacctcaaggtgggtaaacccacagtactcggcggaatatccggtgcagttgctggcctcgtcgccataacacctgcagcaggtttcgtaactgtacctgcagccctcatcataggccttgtcacgagcgtaatatcataccttgcagtatcatacctcaaaccaaggcttggatacgacgatgccctggacgtcttcggaatacacggcatgtcaggtatatggggctcagtggcaacaggcctctttgcagcgccattcatcaacgaactgggaacaggcctcatatacggaaaccctggacagctgacagcacaggtgatagccgtggcagttgtggctgcctactccttcgtggtgacactgatcatcggcaaactcctggacttcaccgttggtctgagggtgagcggtaaggaggagatggagggccttgacacccacctgcatgaggagacaggctacaggatctga

SEQ ID NO: 3893 - protein, 412 aa, Methanobacterium thermoautotrophicum
MEMTLMDAVLNSGDTAWMLVSTALVMLMTVPGVALFYGGLTKKENVLNTMFLSLIAFAVTSIIWVLYGYQFAFGADIMGFIGSPVNLLMNGVGVNTAAALAPTIPDFLYIAFQLTFAAITVALISGAVVERMKFSAWLAFIVLWVSLVYVPVAHWVWGGGFLAQLGALDFAGGTVVHINSGVAALALVYLLGKRKDTRLLPHNLGYSVIGASLLWFGWFGFNAGSALTAGGLAASAFLVTNTAAAAGMVSWVIMDYLKVGKPTVLGGISGAVAGLVAITPAAGFVTVPAALIIGLVTSVISYLAVSYLKPRLGYDDALDVFGIHGMSGIWGSVATGLFAAPFINELGTGLIYGNPGQLTAQVIAVAVVAAYSFVVTLIIGKLLDFTVGLRVSGKEEMEGLDTHLHEETGYRI

SEQ ID NO: 3894 - DNA, 1305 bp, Neisseria meningitidis
  CDS (1)..(1305)
atgaaaaaacacatatgggcggcatctttgctgccggcatccctatcggcagaacctttaaactggtggaagccttattccgccgtcaattcgggcgataccgcctgggtgatgactgcggctgccttggtactgttgatgacgcttcccgggctggctttattctacggcgggatggtgcggaaaaaaaacctgctctcgacgatgatgcacagcttttccatcgcgacattggtgggcatcctttgggtcgccgtcggctattctttagcgttcacgccgggaaatgcctttatcggcggtttggggcgcgtatttttaagcgggatgcagatagacgctgccgcacagatgctgaccgtgtcgcccaatgcgccgactgttcccgaaccggtatttatgttttttcagatgacgtttgccattatttcgaccgccattattaccggcgcgtttgccgaacggatgaaatattcggcaatgatgctgttttcgggcatatggtttttattggtttatgtgccgggagcgcattgggtgtggggcggcggctttatgagcaagggcggcgtattggattatgccggcggtacggtggtgcacatcaatgccggtatcgcgggactcgtcgccgccttggttttgggcaggcgcataggctacgggcgcgaggcgatgcctccgcacaatatggcgatgacactgatcggcgcggcaatgttgtggttcggctggttcggctttaacgccggatcggcgcttgcggcagacgcggcggcgggtatggcgatggcggtaacgcaggtgtcggccgtattcggcgcggcaggctggcttgcctgcgaaaaaatagcgggacacaaaccttccgctttggggctggcttccggcgcggtttccggtctggtcggcatcacccctgccgccggctttaccggcccgtcgggcgcggccgccatcggtatattgactgccgccgcgtgctttgtgtccgtcaccgtcgtcaaacacaaattgcgttacgatgattctttggacgctttcggcatacacggattcggcgggctggtgggcggaatattgaccggcatctttttcgacaaccgcattttcggcggggatgcggcagtttggcagcagttgtggatacaggtaaaagacgggttcgttatggcggcatacagcgggctgatgagttgggcgattttgaaggtcgtggggaaaatctgcggcggcctgcgcgtcggcaaggatgtcgaacgcgaaggtttggatctgaatatccacggcgaacgcgtggaataa

SEQ ID NO: 3895 - protein, 434 aa, Neisseria meningitidis
MKKHIWAASLLPASLSAEPLNWWKPYSAVNSGDTAWVMTAAALVLLMTLPGLALFYGGMVRKKNLLSTMMHSFSIATLVGILWVAVGYSLAFTPGNAFIGGLGRVFLSGMQIDAAAQMLTVSPNAPTVPEPVFMFFQMTFAIISTAIITGAFAERMKYSAMMLFSGIWFLLVYVPGAHWVWGGGFMSKGGVLDYAGGTVVHINAGIAGLVAALVLGRRIGYGREAMPPHNMAMTLIGAAMLWFGWFGFNAGSALAADAAAGMAMAVTQVSAVFGAAGWLACEKIAGHKPSALGLASGAVSGLVGITPAAGFTGPSGAAAIGILTAAACFVSVTVVKHKLRYDDSLDAFGIHGFGGLVGGILTGIFFDNRIFGGDAAVWQQLWIQVKDGFVMAAYSGLMSWAILKVVGKICGGLRVGKDVEREGLDLNIHGERVE

SEQ ID NO: 3896 - DNA, 1329 bp, Pseudomonas aeruginosa
  CDS (1)..(1329)
atgactctgcgtaagatcgcagggctaggagccctattgtccctcgctttgccgggcgtcgccctggccgccgaggagcccgtcctgaacagcggcgacaccgcctggatgctgatctccactgcgctcgtcctgctcatgaccatccccggcctggcgctgttctacggcggcatggtgcgagcgaagaacgtgctgtcgatcatgatgcagtgcttcgccatcaccggcctgatcaccattctctgggtggtctatggctacagcctggcgttcgataccgccgggatggagaagggcgtcctcaacttcaattccttcgtcggcggactggacaaggccttcctcagcggtctcaccgccgacggcctgacttccgccaccgcgctgttcccggaaagcgtgttcatcaccttccagatgaccttcgcgatcatcactccggcgctgatcgtcggcgccttcgccgagcgcatgaagttctcggcgatgctgatcttcatggcggtctggttcaccgtggtctacgcgccgatcgcgcacatggtctggagcggtgacggcgccctgatgtgggactggggcgtgctggacttcgccggcggcaccgtggtgcacatcaacgccggtatcgccggtctggtcgcctgcctggtgctgggcaagcgcaagggctacccgaccacgccgatggcgccgcacaacctcggctacaccttggtcggggcggccatgctgtggatcggctggttcggtttcaacgccggttccgccgccgccgccaacggcaccgccgggatggccatgctggtgacccagatcgccaccgccgccgcggccctggcctggatgttcgccgagtggatcacccacggcaagccgagcgccctgggcatcgcgtccggcgtggtcgccggtctggtggccatcaccccggccgccggcaccgccggtccgatgggcgcgctggtgatcggcctggcctccggggtgatctgtttcttcgccgccaccagtctcaagcgcgcgctgaaatacgacgattccctcgacgccttcggcgtacatgcggtcggcggtatcgtcggcgcgctgctcaccgggatcttcgcggcgccgtcgctgggcggcttcggcagcgtggaggacatcggcgcgcagttcttcgtgcagttcaagggcgtggccttcaccgtggtctacaccgccgtggtgaccttcgtgatcctcaaggtgctggacctggtcatgggcctgcgggtcaccgaggaagaggaagcggtcggcctcgacctggcgctgcacaacgagcgcggctacaacctgtaa

SEQ ID NO: 3897 - protein, 442 aa, Pseudomonas aeruginosa
MTLRKIAGLGALLSLALPGVALAAEEPVLNSGDTAWMLISTALVLLMTIPGLALFYGGMVRAKNVLSIMMQCFAITGLITILWVVYGYSLAFDTAGMEKGVLNFNSFVGGLDKAFLSGLTADGLTSATALFPESVFITFQMTFAIITPALIVGAFAERMKFSAMLIFMAVWFTVVYAPIAHMVWSGDGALMWDWGVLDFAGGTVVHINAGIAGLVACLVLGKRKGYPTTPMAPHNLGYTLVGAAMLWIGWFGFNAGSAAAANGTAGMAMLVTQIATAAAALAWMFAEWITHGKPSALGIASGVVAGLVAITPAAGTAGPMGALVIGLASGVICFFAATSLKRALKYDDSLDAFGVHAVGGIVGALLTGIFAAPSLGGFGSVEDIGAQFFVQFKGVAFTVVYTAVVTFVILKVLDLVMGLRVTEEEEAVGLDLALHNERGYNL

SEQ ID NO: 3898 - DNA, 1533 bp, Caulobacter crescentus
  CDS (1)..(1533)
atgaaactcaccttcaaaccgctggcggggcttatgctcgccgcgaccatcgcgggggctccgctgggggcgaccgccttcgcccaggaggccgcgcccgcgccggtcgccgccgcgcccgccgaggccgcgccggctccggccgccgcccctgctgaagccgcgcctgcgccggccgccgccccgaccatcgaagacaagatggacaagggcgacaacgcctggatgctcacctcggccctgctcgtcctgctgatgatcctgccgggtctggcgctgttctacggcggcctagtccgcgccaagaacatgctgtcggtgatgatgcaggtctcgaccgtcgccctgatcggcttcgtcgcctggatgctctggggctacagcttcgccttcacggacggcggcagctgggacaagttcgtcgggggtctgggtcgcgtgttcctgaacggcgtgacccctgcgagcaacgtggcgaccttctccacgggcgtggtaatcccggaactgaccttcatcgccttccagtcgaccttcgcggcgatcaccgccgccctcgtggtcggttcgctggtcgagcgcatgaagttcgccgccatcgtcgccttcgccatcctgtggccgctgctgtcgtactatccgatcgcgcacatggtctggtggtggccgggcccgaacgccatcgccctggcgcctgaagatacggtcaagtcgggcctgctctggggcttcggcgccctggacttcgccggcggcaccgtggtgcacatcaacgccggtatcgccgcgctcgtcggcgctctgatcctcggcaagcgccaaggctacggcaaggagccgatgcccccgcactcgctgaccctgaccctggtgggcgctggcctgctgtgggtgggctggttcggcttcaacgccggctcgaacctggagtcgaacggctacgcctcgctggccatggtcaacaccttcatcgccaccgccggcgcgggtctgtcgtggatcctcgttgagtgggtcacccgcaagaagccgtcggccctgggcctggcttcgggcatcgtggccggcctcgtcgccgtgaccccggccgccggcttcgccggcccgatgggcgcgctgatcctgggcctcgtcgtctcgccgatctgcatcatcttctgctcggtcgtgaagaacgccctgaagtacgacgacagcctggacgccttcggcatccacggcatcggcggcatcgtcggcgccatcggcaccggcctggtggtcaaccccgcctggggcggcgccggcgtcgtcgactacacgagctgcggcaaggacggcgacctgtcgacctgcgacaccgccgtgtacgacatgggcgtgcaactgatggcgcagctgaaagctgtgggcgtgaccatcctgtggtcggccatcgccacggccatcgtcttcttcatcatcaagctggtgatcggcctgcgggctgcgccggaagccgaagaagacggtctggatatctccgaacacggcgaacgcgcctaccacagctaa

SEQ ID NO: 3899 - protein, 510 aa, Caulobacter crescentus
MKLTFKPLAGLMLAATIAGAPLGATAFAQEAAPAPVAAAPAEAAPAPAAAPAEAAPAPAAAPTIEDKMDKGDNAWMLTSALLVLLMILPGLALFYGGLVRAKNMLSVMMQVSTVALIGFVAWMLWGYSFAFTDGGSWDKFVGGLGRVFLNGVTPASNVATFSTGVVIPELTFIAFQSTFAAITAALVVGSLVERMKFAAIVAFAILWPLLSYYPIAHMVWWWPGPNAIALAPEDTVKSGLLWGFGALDFAGGTVVHINAGIAALVGALILGKRQGYGKEPMPPHSLTLTLVGAGLLWVGWFGFNAGSNLESNGYASLAMVNTFIATAGAGLSWILVEWVTRKKPSALGLASGIVAGLVAVTPAAGFAGPMGALILGLVVSPICIIFCSVVKNALKYDDSLDAFGIHGIGGIVGAIGTGLVVNPAWGGAGVVDYTSCGKDGDLSTCDTAVYDMGVQLMAQLKAVGVTILWSAIATAIVFFIIKLVIGLRAAPEAEEDGLDISEHGERAYHS

SEQ ID NO: 3900 - DNA, 1167 bp, Archaeoglobus fulgidus
  CDS (1)..(1167)
atgcagagtggagatatatcttggttgctgatttcgacggccctggtcgttctgatgactccagcgctgggattgttttacggtggtatggtgcgagctaagaatgtcctttccacgataacgatgtgctttgtcgcactggcgattgtgagcgtacagtggatactccttggctacactattgcatttggtgacgatgtcagtggtttaactggcaacttagtgttcatcggactcaggaacgttagcatgtccgattacggatttgttgcttttcagatggcgtttgcagcgattacactggccataattgtatcagcacttgcagaaagggtaaagctgtcggcattcctgctgttcggcattctgtggacaaccttcgtttacgacccgatagctcactgggtgtggggaggcggctggctcgctggaataggggcgctggactttgcaggcggaacggtggtgcacataagctcgggtttcagtgctttagctctagcacttcttgtaggcaggagaaccggctacggggaatacaacattgaaccgcacaacattcctatgaccttgctcggtacagcactgctgtggttcggatggttcggtttcaacgctggtagtgcactggaagcgaacgatgtggctttgaacgcattcctagttacgaacacttcggcagcgatgggtgccttaagctggatgtttgcctcctggctaaagggaaaacccggaagtttgggagtggcaagcggtgctatagccgggcttgtggcaattactcctgcagctggctacgttgacccgctttctgcacttgtaataggaggtgttgcaggagtggtgtgctatgcagcgatgctcctcagagtcagagcaggagtagatgagagtcttgatgcctgggctgttcatggcgtcggaggcctgtggggagccattgccaccggcatcttcgcctctgttggtgctaccggcctggtggcagggaatgcacagcaactgctccttcagataattgcggccctagtcgcaacagcctacgccttcctcgtgacgctgatactggcaaaggctgttgatgccgctgtggggctgagggttagctcccaggaggagtacgtcggtctcgacctgtcgcagcatgaggaggttgcctacacgtga

SEQ ID NO: 3901 - protein, 388 aa, Archaeoglobus fulgidus
MQSGDISWLLISTALVVLMTPALGLFYGGMVRAKNVLSTITMCFVALAIVSVQWILLGYTIAFGDDVSGLTGNLVFIGLRNVSMSDYGFVAFQMAFAAITLAIIVSALAERVKLSAFLLFGILWTTFVYDPIAHWVWGGGWLAGIGALDFAGGTVVHISSGFSALALALLVGRRTGYGEYNIEPHNIPMTLLGTALLWFGWFGFNAGSALEANDVALNAFLVTNTSAAMGALSWMFASWLKGKPGSLGVASGAIAGLVAITPAAGYVDPLSALVIGGVAGVVCYAAMLLRVRAGVDESLDAWAVHGVGGLWGAIATGIFASVGATGLVAGNAQQLLLQIIAALVATAYAFLVTLILAKAVDAAVGLRVSSQEEYVGLDLSQHEEVAYT

SEQ ID NO: 3902 - DNA, 1533 bp, Ureaplasma urealyticum
  CDS (1)..(1533)
atgagaattgtgtcaacaattataactacatcttgaggagtagatccaaatatttacttttcaaagcatgagttaacatgagtgccagcaacagctgatgctaatacattagcattaactaattttaatccgactagcactttattagttgcattagcaattgcctttgtcttattgatgactccaggtttagcattattttatggtgggctaacacgtcgaaaatctacattaacgattattaatcaatgtgtagcttcacttggaatcacaacactgatttgaatttttggagggttctcacttgcttttggaccttctgttggtaaaggaataattggtgatatttcaacttattttgcatttagaaatctattatttgctgatggttgaagtggagatgtaggaattgtttttgcaaactttactaatggtgtaccattaattttattctttgcttatcaattagcttttgcaattattacaccaccattaatggttggtgcatttgcagatcgaatgaaatttaaaaattatctagtattcttagtactatgacaatatttaatttacattccttttgcacattgaatttgaggtcaaggattcttagctgctgctggagtaattgactttgctggtggtattgtaattcatacaactgctggttttggagcattagctgcttcattagtattaggtaaacgtgttttacttaagaatgataaaagtcgtccacacaatattccaatgactattattggagcaacattgttattctttggttgatttggatttaatgttggtggatcaggatttgtagctggtgggaatgctgctacttgatcagctgctacaagtgcttggattaatacaattattgctttagctattggaatggttggttgagcagttcttgaaacaatctttaataaaaatcataaagccacaggtgttggtttagtaacaggtgcaattgctggattagcaacaattactcctgcagcaggttatgttccaatttgagcatctgttcctattggtgtagctgctgtgctagtttgttatactagtgctaaaactttacatcatttccacaaaattgatgatactctagaagtatgaggcgtacatggaatgggtggtgttactggttcattattaattggtgcgtttgcatctaaatctgtaaacccatcaattatgtatgaagcaattggtccaacaacaactggtgttttatttggtgtccaattaggagcggttttattagctgcggtttatggatttgtatttactattttattagtatatattactcgtccaagattatcagcacgccaacaattaggtcatatagactatattaatcatggcgaagatgcatattcattcgatattgaaattccatctgaaaaagaaatggagcaatatgaattagcagatagtacatgacactcaagcacaggtgttaagtattcattgcttaataataaaaaccagcaaaatcataaagtagcaaacgaccattaa

SEQ ID NO: 3903 - protein, 510 aa, Ureaplasma urealyticum
MRIVSTIITTSWGVDPNIYFSKHELTWVPATADANTLALTNFNPTSTLLVALAIAFVLLMTPGLALFYGGLTRRKSTLTIINQCVASLGITTLIWIFGGFSLAFGPSVGKGIIGDISTYFAFRNLLFADGWSGDVGIVFANFTNGVPLILFFAYQLAFAIITPPLMVGAFADRMKFKNYLVFLVLWQYLIYIPFAHWIWGQGFLAAAGVIDFAGGIVIHTTAGFGALAASLVLGKRVLLKNDKSRPHNIPMTIIGATLLFFGWFGFNVGGSGFVAGGNAATWSAATSAWINTIIALAIGMVGWAVLETIFNKNHKATGVGLVTGAIAGLATITPAAGYVPIWASVPIGVAAVLVCYTSAKTLHHFHKIDDTLEVWGVHGMGGVTGSLLIGAFASKSVNPSIMYEAIGPTTTGVLFGVQLGAVLLAAVYGFVFTILLVYITRPRLSARQQLGHIDYINHGEDAYSFDIEIPSEKEMEQYELADSTWHSSTGVKYSLLNNKNQQNHKVANDH

SEQ ID NO: 3904 - DNA, 1566 bp, Ureaplasma urealyticum
  CDS (1)..(1566)
atgaaaattgtgtcaacttgaggcctaaataaagatatttatttctcaactcatgaattaacatgagtgcccgcagatgcaagtcaatcaacacttaatgcaataggttttaatcctactaatacactactagtagctttagcaattgcttttgttttactaatgacaccagggttagcattattttatggtggtttagtaagacgtaaatcagctttaacaattattaatcaatgtgtagcttcacttggaattacaacattgatttgaatttttggaggtttctcacttgcttttggaccttctgttggtaaaggaataattggtgatatttcaacttattttgcatttagaaatctactatttgctgatggttgaagtggaggagcagttttagtttttgctaattttactaacggcgtaccattaattttattctttgcttatcaattagcttttgcaattattacaccaccattaatggttggtgcatttgcagaccgaatgaaatttaaaaattatctagtattcttagtactatgacaatatttaatttatattccttttgcacattgaatttgaggtcaaggattcttagctgctgctggagtaattgactttgctggtggtattgtaattcatacaactgctggttttggagctttggctgcttcatttatgttaggaaaacgtacaacattaattacagataaaaagcgagctaataatttaccaatggttgtattaggtgcagcattactattttttggttgatttggatttaatgttggtggtgcaggttttgttaaagaaaatacaaatcacatttcacaagctatatcatcatgattaaatacaattattgccttagcaataggtatgataggttgagttacacttgaaactattgttaacaaaaaccacaaaccaacaacagtaggtttagtgactggtgcagtcgctggattagcaacaattactcccgcagcaggttttgttccagtttgagcctctgttcctattgccattatgggtgttttagtatgttattcagtttctagattattagattacttccgttttgatgattctttagaagttctaccagttcatggaatgggtggtgttataggttctttattaattggagcatttgctactaacacggttgcacatggaattaaatatgacgccgtcggattagataataatggaaatccaatttatggtattttatttggactacaattaggtgctgtattattagcagcaacatgggcatttgcctttacatgtttaatagtttatattactaaacctcgtttatcagtgcgtcaacaattaggccatatagactacatcaatcatggtgaagatgcatacaagtttgattttattattccttcagaaagtgaaatgtttgaatatgaaagttttgatcaaacttgagaatgtaaagctagtggttgtaaaaaaagcaacttagctgccaagaaaaaccctgtttttatagagaatgagaatgattgtacatgacaatctaaatctcgtgagtgtacaaaatag

SEQ ID NO: 3905 - protein, 521 aa, Ureaplasma urealyticum
MKIVSTWGLNKDIYFSTHELTWVPADASQSTLNAIGFNPTNTLLVALAIAFVLLMTPGLALFYGGLVRRKSALTIINQCVASLGITTLIWIFGGFSLAFGPSVGKGIIGDISTYFAFRNLLFADGWSGGAVLVFANFTNGVPLILFFAYQLAFAIITPPLMVGAFADRMKFKNYLVFLVLWQYLIYIPFAHWIWGQGFLAAAGVIDFAGGIVIHTTAGFGALAASFMLGKRTTLITDKKRANNLPMVVLGAALLFFGWFGFNVGGAGFVKENTNHISQAISSWLNTIIALAIGMIGWVTLETIVNKNHKPTTVGLVTGAVAGLATITPAAGFVPVWASVPIAIMGVLVCYSVSRLLDYFRFDDSLEVLPVHGMGGVIGSLLIGAFATNTVAHGIKYDAVGLDNNGNPIYGILFGLQLGAVLLAATWAFAFTCLIVYITKPRLSVRQQLGHIDYINHGEDAYKFDFIIPSESEMFEYESFDQTWECKASGCKKSNLAAKKNPVFIENENDCTWQSKSRECTK

SEQ ID NO: 3906 - DNA, 1530 bp, Sulfolobus solfataricus
  CDS (1)..(1530)
atgaaatcgtggaaattcaaggcactgttaattggccaagtaatattggtaatgcttttattttcaaatattttagcacattctcaaactacaacaaattcatctgcacttcaacaactaaatcaatcagtgcaatcaattcttaacagaacgtctagctatccagctgcagcagtaccatcttggcttgatactggaagtaatgcgtggatgttaactgcagcgacttttgtaggattgcaaagcgttcctggtgttgcgttatattatgctggattgtctaaaaagaaatatgcagtgaactctgcattaatgatattttatgcatttgcggcagtgttagttatatggataatagccggatacagttttggtttcggttatcccgcactggtttccattcacggttatggaatattcggatatcctattcccgcatggggagggctttttgaagcttcacaaaccacctatggtcctagtggtgctcacgctaatataccaaccgctacctttatattcttccaattcgtctttgctgcaataacgccaatattattagccggaggagtattagaaagaatgaactttaaagcttggatggtttttgtacctttctggtctctcctagtgtatagtccagttgcatactggttatttgcaggaggatggttaaatcaattaggtgctgtagacttctctggaggttatgtaatacatgtagatgcaggagtaggagctctagctgcagcgttggctataggtcctagattagcttctgaaagaaaattagaggcgcatagcttacctttagttttagttggagctggcttaatttggttggggtgggatgggttcaatggcggtgatccattaggagctacagtggatgctgcaatcgcagtgctgaatacgaatattgctaccgcagttagtgctgtagtatggatgttgatggatatgaaattctttggaaaaccaacattaattggagctactagtggcgctataactggcctagttgcaattactccagctgcaggttatgtaaacggatgggaagccgcattaattggaatattttctggaagtataccatggatggcattatattggttagagccaaagcttagagttgatgatactttaggtgtgttctctactcacggtatagctggaatagtaggtggtttattaactggagtttttgcaaatcccgcagtcacacagtttgtggctccgggattaacaggagctctctatgggaattggtatcaactaggaattcaagcacttgcagcagtaatagtattcgtatatgacttcgcaataacttttggccttctaaagtttataggattatttataccattacaagcgccacctcaagaactagcaataggagattacgctatgcacggagaggtagcatattcagaattattagctacaattccagaaagcgctaaatctaaggaacagtcagtcgttttacctaagaaagaaaaggaggagaatagtgaagaataa

SEQ ID NO: 3907 - protein, 509 aa, Sulfolobus solfataricus
MKSWKFKALLIGQVILVMLLFSNILAHSQTTTNSSALQQLNQSVQSILNRTSSYPAAAVPSWLDTGSNAWMLTAATFVGLQSVPGVALYYAGLSKKKYAVNSALMIFYAFAAVLVIWIIAGYSFGFGYPALVSIHGYGIFGYPIPAWGGLFEASQTTYGPSGAHANIPTATFIFFQFVFAAITPILLAGGVLERMNFKAWMVFVPFWSLLVYSPVAYWLFAGGWLNQLGAVDFSGGYVIHVDAGVGALAAALAIGPRLASERKLEAHSLPLVLVGAGLIWLGWDGFNGGDPLGATVDAAIAVLNTNIATAVSAVVWMLMDMKFFGKPTLIGATSGAITGLVAITPAAGYVNGWEAALIGIFSGSIPWMALYWLEPKLRVDDTLGVFSTHGIAGIVGGLLTGVFANPAVTQFVAPGLTGALYGNWYQLGIQALAAVIVFVYDFAITFGLLKFIGLFIPLQAPPQELAIGDYAMHGEVAYSELLATIPESAKSKEQSVVLPKKEKEENSEE

SEQ ID NO: 3908 - DNA, 1272 bp, Aquifex aeolicus
  CDS (1)..(1272)
atgagagcgctaggatttatagggattattctatcaattttttcctcttttgcgtatgcatctgaagccaagttagacactggtaacacagcttggatgctcgtagcttcagcccttgtggtgtttatgacagttcccgggctcgctcttttctatggaggtttagacaaatcaaagagcatcctaaacacgatagcgatgtccttttcagcctttgcggttgtaacactaacgtggatattcgtaggttactcagtagcctacggagacgatatttttggttttataggaaatccattccagtacgtattaggtaagggtataagcgggataaattccgataccggataccctgcacttctggatctgatgttccagctcactttcgcaacaataactaccgctttaatttcgggttccttcgtaggaaggatgaagttttcagcctggatattgtttgcaatactctggagcgtatttgtttatccgcctgtagcccactgggtatggggaggcggatttctggctaacgacggagcccttgactttgcaggaggaacggtagtccacattaacgcgggtatagcgggtttagtaggtgcgttgatcctcggaagaaggaaagacacatctcttattcccaacaacgttccactggtagccctcggtgcgggaatactgtggttcgggtggtttggattcaacgccggttctgctctcggagctaatgagagcgcagcttgggcaatgataaataccacggttgcaacttcaacggcagcactcgcatggatgtttaccgaatggcttcacgtcggtaaacctacagttgtgggaatatcttcaggtatcgttgcaggacttgtcgcaataactcccgcggcaggttttgtaaaccttatcggttcaatttttataggagctatagcatccgtgtgtgcttactttatggttgctcttgtaaaaccaaaattcggatacgacgatgcacttgacgtgttcggaattcacggagtacgcggaatagtgggagcagttttaacgggagtatttgcggatccgaacgtgggaggaactcctggactgctctacggcaatccaaaacaggttcttatacaaatagaaggcgttatcgctactatactctactccgctatcctcacagccgttatactgctggttctgaaagcagtagtaggtctaagagtttccgaagaagaggagctcgaactggacagctccctacacggtgaaaaggcttacaacctataa

SEQ ID NO: 3909 - protein, 423 aa, Aquifex aeolicus
MRALGFIGIILSIFSSFAYASEAKLDTGNTAWMLVASALVVFMTVPGLALFYGGLDKSKSILNTIAMSFSAFAVVTLTWIFVGYSVAYGDDIFGFIGNPFQYVLGKGISGINSDTGYPALLDLMFQLTFATITTALISGSFVGRMKFSAWILFAILWSVFVYPPVAHWVWGGGFLANDGALDFAGGTVVHINAGIAGLVGALILGRRKDTSLIPNNVPLVALGAGILWFGWFGFNAGSALGANESAAWAMINTTVATSTAALAWMFTEWLHVGKPTVVGISSGIVAGLVAITPAAGFVNLIGSIFIGAIASVCAYFMVALVKPKFGYDDALDVFGIHGVRGIVGAVLTGVFADPNVGGTPGLLYGNPKQVLIQIEGVIATILYSAILTAVILLVLKAVVGLRVSEEEELELDSSLHGEKAYNL

SEQ ID NO: 3910 - DNA, 1434 bp, Mycobacterium tuberculosis
  CDS (1)..(1434)
atggaccaattccccatcatgggcgttccggatggcggcgacaccgcctggatgctggtgagttccgcgctcgtgctgttgatgacgccgggtctggcatttttctacggcggcatggtgcgttccaagagcgtcctgaacatgatcatgatgagcatcagcgcgatgggtgtcgtgacggtgctctgggcgctttacggctactcgattgcgttcggtgatgacgttggcaacatcgccggcaacccgagccaatactggggtctcaaaggtctcatcggcgtcaatgctgttgctgccgatccgagcacgcagaccgccgcggtgaatattccgctggcgggtaccctgccggcgaccgtgtttgtggcattccagctgatgttcgcgatcatcacggttgcgctgatctccggggcggtggccgaccggttgaagttcggcgcctggctgttgttcgccggtttgtgggcgacgttcgtctatttcccggtcgcacactgggtcttcgcatttgacggtttcgccgctgagcacggcggctggatcgccaacaagctgcacgccatcgacttcgccggcggcaccgcggttcatatcaacgccggtgtggcggccttgatgctggcgatcgtgctgggcaaaagacgcggttggccggcgacgctgtttcgaccgcacaatctgccgtttgtgatgctcggggccgccctgctgtggttcggctggtacgggttcaacgcaggatcggcgacgaccgccaacggtgttgccggggcgacgtttgtcaccaccacgattgcgacggccgcggccatgcttggctggctgctcacggagcgcgtccgagatggcaaggctacgacgctgggcgcggcgtcgggcatcgtcgccggactggtcgccatcacgccgtcctgctcgtcggttaatgtcctgggtgccttggcggtaggcgtgtcggccggggtgctgtgcgcgctggcggtggggctgaaattcaaactgggcttcgatgattcgctcgacgtggtcggggtgcacctggttggtggtctggtgggcacactgctggtgggtctgctggcagctccggaggctccggcaattaatggtgtggccggggtatcgaaggggttgttttacggcggaggcttcgcccagctggaacgacaggcgctcggtgcctgcagtgttctcgtctactctggaatcatcaccctgatcttggcattgatcctgaaattcaccatcgggctcaggcttgacgcggagcaagagagcaccggcatcgacgaggctgagcacgcggaaagcggctacgatttcgccgtcgccagcggctcggttctccccccgcgggtcaccgtggaggatagccgcaacggcattcaggagcgtataggccagaaagtggaggcggagccgaaatga

SEQ ID NO: 3911 - protein, 477 aa, Mycobacterium tuberculosis
MDQFPIMGVPDGGDTAWMLVSSALVLLMTPGLAFFYGGMVRSKSVLNMIMMSISAMGVVTVLWALYGYSIAFGDDVGNIAGNPSQYWGLKGLIGVNAVAADPSTQTAAVNIPLAGTLPATVFVAFQLMFAIITVALISGAVADRLKFGAWLLFAGLWATFVYFPVAHWVFAFDGFAAEHGGWIANKLHAIDFAGGTAVHINAGVAALMLAIVLGKRRGWPATLFRPHNLPFVMLGAALLWFGWYGFNAGSATTANGVAGATFVTTTIATAAAMLGWLLTERVRDGKATTLGAASGIVAGLVAITPSCSSVNVLGALAVGVSAGVLCALAVGLKFKLGFDDSLDVVGVHLVGGLVGTLLVGLLAAPEAPAINGVAGVSKGLFYGGGFAQLERQALGACSVLVYSGIITLILALILKFTIGLRLDAEQESTGIDEAEHAESGYDFAVASGSVLPPRVTVEDSRNGIQERIGQKVEAEPK

SEQ ID NO: 3912 - DNA, 1308 bp, Thermotoga maritima
  CDS (1)..(1308)
atgcgaaagagagttttttccttgttgctagttcttgcttttctttctgtgggtttcgcccaggacggtgtcacagatgtcggctggtcactcgacatggtctggatcctcatttccgcagcgctggtcttcttcatgcaagcgggttttgccatggtagagtccggtttcacccgcgcaaagaacacggtgaatgtgctcatgaaaaacctcatggattttgcgatcggatctgtggtcttcttcatcttcggctactggatcatgttcgggaaacatcctctcacctttgatccctccacaaaagaaggtctctgggattttgccatgtggatgtttcagatggctttcgcaggtacggccgcgacgattgtgtccggagcgatggcagagcgcactaagtttcccgcgtacctcgcttacacaggtttcataacaggaatcatctattcggttgttggaaggtggatctggggaggaggatggcttgcacagaaaggttttatcgattttgcaggttccacagttgttcattctgttggtggatgggctgccatgataggtgcatcccttcttggtcccaggtttggaaagtacgacagtcaaggtaatcccaagcctattccagggcacaacattcctcttgctgctctcggaaccttcatcctatggtttggatggttcgggttcaatggaggaagcactcttgccggaacgaacggtgcgatagggatgatcatattgaacaccaacctcgctgctgccactggagcactcgctgcaatggtcaccgtatgggcaaaatatggaaagccggatgcgagtatgacgatgaacggtgctcttgctggccttgttgccatcaccgcaccgtgtgctgtggtgtctcctgtgagttctttgatcataggagcgatcggaggggtgatcgtagtgtttgcggttgagttcttcgacaaagttttgaaaatcgacgatcccgttggggccatatccgttcatggtgtcaacggtgcttgggggactctcgccgtgggactctttgcggagagcaagtacgctcttgcaagcgggatgggggatgtgaacggactcttcttcggaggaggagtgcatcaacttggagttcagtttctgggggtggtcagtgtgtttgcctggacggtagtgaccagtttccttgttttctggttcatcaaaaagacaattggtttgagggtagacagagacatagagttgaaggggctggatatagaggagcacggcatggaaggatacgctgattttgaaatcttcaccacaagatga

SEQ ID NO: 3913 - protein, 435 aa, Thermotoga maritima
MRKRVFSLLLVLAFLSVGFAQDGVTDVGWSLDMVWILISAALVFFMQAGFAMVESGFTRAKNTVNVLMKNLMDFAIGSVVFFIFGYWIMFGKHPLTFDPSTKEGLWDFAMWMFQMAFAGTAATIVSGAMAERTKFPAYLAYTGFITGIIYSVVGRWIWGGGWLAQKGFIDFAGSTVVHSVGGWAAMIGASLLGPRFGKYDSQGNPKPIPGHNIPLAALGTFILWFGWFGFNGGSTLAGTNGAIGMIILNTNLAAATGALAAMVTVWAKYGKPDASMTMNGALAGLVAITAPCAVVSPVSSLIIGAIGGVIVVFAVEFFDKVLKIDDPVGAISVHGVNGAWGTLAVGLFAESKYALASGMGDVNGLFFGGGVHQLGVQFLGVVSVFAWTVVTSFLVFWFIKKTIGLRVDRDIELKGLDIEEHGMEGYADFEIFTTR

SEQ ID NO: 3914 - DNA, 1242 bp, Lactococcus lactis subsp. lactis
  CDS (1)..(1242)
atggacacaggctcaattgcatttattttaatttgtgcggcattggtttttttgatgacgcctgcactagcatttttttatggagggcttggacgccgaaaaaatgtgttaaacacaatgatgatgtctctcgcaccaatggctctggcttctattttatggataattattggcttctcattttcattttcaggaagcaatagttggattggtgatttccaccatttgtttatgaatggtgtggatatggctaaaaattcacttttccctgctaatcatattccagatggccttttttctggttttcaaatgatgttctcgattatcacagtagctctaattacgggatctgttgttggaagaatgagatttacaccaattttgatttttatgactgcttggttaattttagtttattatcctttggctcatatggtttggggcggtggatttttggctcaaattcatgcgattgactttgcgggtggagatgttgttcatatttcaagtggggttacaggacttggacttgcgttagtacttggaaaacgtcgagattacgaacgtttagattatcgtccacataatattccttttgttgttttgggcgctggtctcctatggtttggttggttcggctttaatgctgggtcagcgcttgctgccaatggtgtggcaattaacgcttttatgacgactaatacagcggcagcagcagcaatgttttcatggatgattgttgaaaaaatattgattggtaaaccttcaattgttggtgcttgttctggtgcggtagttggtttggtggccatcactccaggcgctggttttgtttctttatggtcgtcattgattattggtcttttggtcagtcctttgtcatactttatgatttctgtagtaaaaaagaaattgggatatgatgatgctttagatgcttttggttgtcacggtattggcgggatgtttggcggaattatgacaggaatttttgcaacgccggctttggcaccagaaaaaggctacgctggtttaatctatggctctgggaaattacttttggctaatgtgtctgcggttgtcttcacagttattttcactgctcttgtgagttggatcattattaaagtaattgccttgtttatgccaattcgtgtatctgaccgtgctgaagctattggacttgacgacagtgagcacgaagaaactgcttatccaaccttcttaggtttggattcttaa

SEQ ID NO: 3915 - protein, 413 aa, Lactococcus lactis subsp. lactis
MDTGSIAFILICAALVFLMTPALAFFYGGLGRRKNVLNTMMMSLAPMALASILWIIIGFSFSFSGSNSWIGDFHHLFMNGVDMAKNSLFPANHIPDGLFSGFQMMFSIITVALITGSVVGRMRFTPILIFMTAWLILVYYPLAHMVWGGGFLAQIHAIDFAGGDVVHISSGVTGLGLALVLGKRRDYERLDYRPHNIPFVVLGAGLLWFGWFGFNAGSALAANGVAINAFMTTNTAAAAAMFSWMIVEKILIGKPSIVGACSGAVVGLVAITPGAGFVSLWSSLIIGLLVSPLSYFMISVVKKKLGYDDALDAFGCHGIGGMFGGIMTGIFATPALAPEKGYAGLIYGSGKLLLANVSAVVFTVIFTALVSWIIIKVIALFMPIRVSDRAEAIGLDDSEHEETAYPTFLGLDS

SEQ ID NO: 3916 - DNA, 1218 bp, Clostridium acetobutylicum
  CDS (1)..(1218)
atgaatttcgcagatactacttttgtatttctttctacagtcttagtaatgataatgacacctgctcttgcaatgttttacggaggtatggttaaaaccaagaacactttaggtactatgatgcacagttatgcctgtatgattatagtatcccttcaatggattttaataggatattctattgcatttggccctgatatttcaggccttataggaaatttccaatatgcacttttacatcatgtaggttttaaaccttttgcaccatattcaagcactattcctcatagcctatttatgatgttccaattaatgttcgcaattataactccaggattaattacaggtgcttttgctgaaagaataaaatttcccgcatttatactttttatacttctttggacaactataatatacgatccacttgcacactgggtatggggtaacggtggctggattaaaaatttaggtgctttagactttgctggaggaactgtagttcatataagttccggagcctctggtcttgttgctgcaataatgattggaaagagaaaatatataaaaacctctccaaacaatcttactttaacctttataggtggtacgcttttatggtttggttggtttggtttcaacgcaggaagtgccttagctataaacgatgtagctatgaatgcctttataactacaaataccgctgctgctgcggctgctgctgcttggattacctgtgaatggtttattacaaaacgtccaacggttttaggtgccctaacaggtactttagctggtctcgtttctataacacctgcctgcggttttgtaacagttggctcttcattagttataggtattattggcggaattatatgcttcttctcagttagcttccttaaaaagaaatttaactatgacgatgcattagatgcctttggctgtcatggtattggtggtacctggggtgctatagcaaccggaatatttgctacaaaagctgttaattcagctggtgcaaatggacttctttatggcaatgcttctcttgttttgaaacaacttgaagcaactgctgctacctatgcttattctataattgggacaataataattattaaagtggtgtctctaatattcaaaatacgttctactgacgaagaagaacttcaaggccttgatatctctatacatggagaaagagcttatcacatagattaa

SEQ ID NO: 3917 - protein, 405 aa, Clostridium acetobutylicum
MNFADTTFVFLSTVLVMIMTPALAMFYGGMVKTKNTLGTMMHSYACMIIVSLQWILIGYSIAFGPDISGLIGNFQYALLHHVGFKPFAPYSSTIPHSLFMMFQLMFAIITPGLITGAFAERIKFPAFILFILLWTTIIYDPLAHWVWGNGGWIKNLGALDFAGGTVVHISSGASGLVAAIMIGKRKYIKTSPNNLTLTFIGGTLLWFGWFGFNAGSALAINDVAMNAFITTNTAAAAAAAAWITCEWFITKRPTVLGALTGTLAGLVSITPACGFVTVGSSLVIGIIGGIICFFSVSFLKKKFNYDDALDAFGCHGIGGTWGAIATGIFATKAVNSAGANGLLYGNASLVLKQLEATAATYAYSIIGTIIIIKVVSLIFKIRSTDEEELQGLDISIHGERAYHID

SEQ ID NO: 3918 - DNA, 1350 bp, Agrobacterium tumefaciens
  CDS (1)..(1350)
atgcaactcaacaagtttttgacgctcggcaagctgggcgccgcagcaacggccctgatggccccggccatcgcctttgcccaggatgcagcgccagcagtagcggcagcggctcctgttccggaaaaagccgataccgccttcatgtatatcgcaacgatcctcgtgctgttcatgatcattcctggtctggcgctgttttacggcggtctggtccgcaccaagaacatgctctccgttctcatgcagtgcacggtcatcggcgcagtcatgatgctggtgtgggtcatctacggttactccttcgccttcggcggcggcaccggtccttatttcggcggcttcggcaagctgttcctgtcgggcgtttcgcttgacagcacgtctgccaccttctcgcagggtgtcgtgatctacgaatacaccttcatcgccttccagatgacttttgcggccatcacgccggcgctgatcatcggtgcttttgcagaacgcgtgaagttctccgccgttatccttttcaccatcctctgggccaccttcgtttatttcccgatcgcgcacatggtctgggacgcgaacggcctgatcttcggcatgggcgctctcgacttcgccggcggcaccgtcgttcacatcaatgccggtatcgctggcctgatcggcgctatcatggttggcaaacgcaccggcttcggcaaggacatgatggctccccactccatgacgctgacgctggttggcgccgccatgctgtggttcggctggttcggctttaacgccggctccaacctcgaggcatcgggcggtgcggttctcgcaaccatgaacaccttcctcgccactgctgcggccatcgtttcctggtcgctggttgagagcttcacccgcggcaaggcttccatgctgggtgctgcttcgggcatgatcgccggcctcgttgccgtcacgcctgctgccggctccgtcggcccgatgggtgcgatcgttctcggtctcatcgtttcgccgatctgctacttcttcgtctccgtggtgaagaacaagttcggttatgacgatactgccgacgtcttcggcgtccacggcatcggtggcatcattggcgccctcggcaccggcatcttcacctcgccgctgcttggcggcaccggcaaggccgatttctccatctcctcgcagctctggacccagttcgttgccgtcgccatcaccatcgtctggtgcgcggtcgtttcggctatcctctacaagatcgtcgacgtgatcgttggtcttcgggttccggtcgaagccgaacgcgaaggtctcgacctcgcgacccacggcgaagccgcttaccactcctga

SEQ ID NO: 3919 - protein, 449 aa, Agrobacterium tumefaciens
MQLNKFLTLGKLGAAATALMAPAIAFAQDAAPAVAAAAPVPEKADTAFMYIATILVLFMIIPGLALFYGGLVRTKNMLSVLMQCTVIGAVMMLVWVIYGYSFAFGGGTGPYFGGFGKLFLSGVSLDSTSATFSQGVVIYEYTFIAFQMTFAAITPALIIGAFAERVKFSAVILFTILWATFVYFPIAHMVWDANGLIFGMGALDFAGGTVVHINAGIAGLIGAIMVGKRTGFGKDMMAPHSMTLTLVGAAMLWFGWFGFNAGSNLEASGGAVLATMNTFLATAAAIVSWSLVESFTRGKASMLGAASGMIAGLVAVTPAAGSVGPMGAIVLGLIVSPICYFFVSVVKNKFGYDDTADVFGVHGIGGIIGALGTGIFTSPLLGGTGKADFSISSQLWTQFVAVAITIVWCAVVSAILYKIVDVIVGLRVPVEAEREGLDLATHGEAAYHS

SEQ ID NO: 3920 - DNA, 1479 bp, Saccharomyces cerevisiae
  CDS (1)..(1479)
atggagagtcgaactacagggcctttaacgactgaaacctacgatggccccactgtggccttcatgatattaggtgccgccctagtattttttatggtgcccggattgggattcttgtactccggattggcaagaaggaagtctgcactagcactaatctgggttgtattaatggcgactttggtcggtatactgcaatggtatttctggggttactctctagctttttcaaagtccgctccgaataataaattcattgggaatctagattcgtttggctttagaaacgtgtacggaaaaaaattcgatgaagatgcctaccctgagctcgcgtatgcaaccttccaaatgatgttttcgtgcgtcaacttaagtattatcgctggcgccactgccgaaagaggcaggctgctaccgcacatggtttttctctttattctagctaccattggatattgtccagtgacgtattggatttggtcaccaggtggttgggcataccaatggggagtcctcgattgggcaggcggcggcaacattgaaatattaagcgctgtttccgggtttgtttactcttggtttttgggcaaaagaaatgaaaagttactgataaatttcaggcctcataatgtttcattggtcactctaggcacatccatactgtggtttggctggctgctatttaattctgcatcctcattatccccaaatttgaggtcagtttatgcattcatgaatacatgtctcagtgccattactggtgggatgacgtggtgtcttctggattacagatcggagaagaaatggtcgacagttggtctgtgctccggtatcatttctgggctggtggctgcaacgccaagctcaggctgtataaccctttacggttcacttattcaaggcattgtggcgggggtagtgtgtaactttgcgacgaagttgaaatactacgctaaagtagatgatgccatggacattctagctgagcacggggttgcaggcgtaataggactaattttcaatgccctttttggagcagactgggtcattggtatggatggcactacagagcacgagggcggctgggtaactcacaattacaagcaaatgtataagcagatcgcttacattgccgcatccattgggtacactgctgctgtaactgcaataatctgctttgtgctcggctacatacccggtatgaggctaagaatatcagaagaggcagaggaggcgggtatggacgaagatcaaattggcgaatttgcgtacgattatgtggaagtgagaagagattactatctatggggtgtagacgaagattcacaacgctctgatgtaaatcaccgggtgaacaacgctcatttggccgctgaacgtagcagtagcggtactaatagttcctcggatgggaatggagaaatgattcaatccgaaaagatcctaccaattcatcaagaagatcctgccaataggtaa

SEQ ID NO: 3921 - protein, 492 aa, Saccharomyces cerevisiae
MESRTTGPLTTETYDGPTVAFMILGAALVFFMVPGLGFLYSGLARRKSALALIWVVLMATLVGILQWYFWGYSLAFSKSAPNNKFIGNLDSFGFRNVYGKKFDEDAYPELAYATFQMMFSCVNLSIIAGATAERGRLLPHMVFLFILATIGYCPVTYWIWSPGGWAYQWGVLDWAGGGNIEILSAVSGFVYSWFLGKRNEKLLINFRPHNVSLVTLGTSILWFGWLLFNSASSLSPNLRSVYAFMNTCLSAITGGMTWCLLDYRSEKKWSTVGLCSGIISGLVAATPSSGCITLYGSLIQGIVAGVVCNFATKLKYYAKVDDAMDILAEHGVAGVIGLIFNALFGADWVIGMDGTTEHEGGWVTHNYKQMYKQIAYIAASIGYTAAVTAIICFVLGYIPGMRLRISEEAEEAGMDEDQIGEFAYDYVEVRRDYYLWGVDEDSQRSDVNHRVNNAHLAAERSSSGTNSSSDGNGEMIQSEKILPIHQEDPANR

SEQ ID NO: 3922 - DNA, 1500 bp, Saccharomyces cerevisiae
  CDS (1)..(1500)
atgtcttacaattttacaggtacgcctacaggcgaaggaacgggtggtaactcgttgacaacagatttgaatacacaatttgacttggccaacatgggatggatcggtgtggcttcagcaggtgtgtggattatggtcccaggtatcggtttattatattctggtttatccaggaaaaagcatgctttatccttgctttgggcctcgatgatggcttccgccgtgtgtattttccaatggtttttctggggatactcattagctttctcacacaacactagaggtaacggttttattggtaccttggaattctttgggtttcgtaacgttttaggagccccatctagtgtcagttctcttcccgatatactgtttgccgtttaccaaggtatgtttgccgcagtcaccggtgccctaatgctaggtggtgcctgcgagagggcaaggttgtttcctatgatggtgttcttgtttttatggatgactattgtttattgtcctattgcatgctgggtctggaatgccgagggttggttggtcaaattgggtagcttggactatgcaggtggtttatgtgtccatttaacatctggacatggtggtctagtttacgctttgatactgggtaagcgtaatgaccctgttacacgtaaagggatgcccaagtacaaaccacattccgtcacctcggtggttttaggcacagtgttcttatggtttggttggatgttctttaacggaggctctgcaggtaatgcaactatacgagcatggtactctattatgtccacaaacttagctgctgcttgcggtggcttgacatggatggttatcgattatttcagatgcggaagaaagtggactacagttggtttgtgttcaggtatcatcgctggcctagtgggtatcaccccagccgccgggttcgtgccaatctggtcagccgttgtcattggtgtggttactggtgcaggatgtaaccttgctgttgacttaaagagtctattgcgcatcgatgatggtctagattgttactctatccatggtgtgggtggttgtattggttctgtattaactggtatctttgctgcagactatgtaaatgccactgcaggctcttacattagtccaattgatggtggctggatcaatcatcactataaacaagttggttatcaattagcaggtatatgcgctgcactagcctggactgttactgtcacatctatcttgcttctaactatgaatgccattccatttttaaaactaagattaagtgctgatgaggaagaattaggtaccgacgctgctcaaattggtgaatttacatacgaggaatccactgcttacatcccagaaccaatcagatctaaaacatcggcacaaatgccacctcctcatgaaaacattgatgataagattgtgggtaacacagacgcagaaaagaattctacgccttccgacgcttcttctactaagaacactgaccatatagtataa

SEQ ID NO: 3923 - protein, 499 aa, Saccharomyces cerevisiae
MSYNFTGTPTGEGTGGNSLTTDLNTQFDLANMGWIGVASAGVWIMVPGIGLLYSGLSRKKHALSLLWASMMASAVCIFQWFFWGYSLAFSHNTRGNGFIGTLEFFGFRNVLGAPSSVSSLPDILFAVYQGMFAAVTGALMLGGACERARLFPMMVFLFLWMTIVYCPIACWVWNAEGWLVKLGSLDYAGGLCVHLTSGHGGLVYALILGKRNDPVTRKGMPKYKPHSVTSVVLGTVFLWFGWMFFNGGSAGNATIRAWYSIMSTNLAAACGGLTWMVIDYFRCGRKWTTVGLCSGIIAGLVGITPAAGFVPIWSAVVIGVVTGAGCNLAVDLKSLLRIDDGLDCYSIHGVGGCIGSVLTGIFAADYVNATAGSYISPIDGGWINHHYKQVGYQLAGICAALAWTVTVTSILLLTMNAIPFLKLRLSADEEELGTDAAQIGEFTYEESTAYIPEPIRSKTSAQMPPPHENIDDKIVGNTDAEKNSTPSDASSTKNTDHIV

SEQ ID NO: 3924 - DNA, 1524 bp, Synechocystis sp.
  CDS (1)..(1524)
atgtctaattcgatattgtctaaactaaatgtgggtgagaggagtcctgttaatcggacacattcctcgcgtacggaggcagaaaagtcatccctttttcgctttgtacgccgtaaaattaattctccctggttggcctgtgttcccttaacagccctgattgtggcaatctggaacgccgcggcgatcgcccaagacacagaaattgtcaacatcaccgttgaaaccgttaacgaaaatgttgccactctccagggaacccttaatgccatctggattttgatagccgccattctggttatcttcatgaacgctggtttcgggatgttggaaaccggcctttgccggcaaaaaaatgccgttaacatcctgaccaaaaacctgatcgttttcgccttggccaccatagcttactgggcgatcggtttttccttgatgttcggcagcagtggcaatcccttcgtcggtttcgggggatttttcctgagcggcgaccacaccaactatggattaagcccatttccagaaggattgcccgtagcagtattcttcttgttccaggttgcgttctctgctaccgccgccaccattgtttccggtgctgtagctgagcggatcaagtttaatgagtttttgatcttcagtgttctgttggttggtattgcctatcccatcactggtcactgggtttgggatgccggcggctggctttacaccatgggctttatggactttgccggttccactgtggttcactccgttggtggttgggctgctttggctggagctttccttctcggtccccgcttaggtaaatttgttgatggccgacccggcgctatccccggccacaacatgggttttgccatgcttggttgtctaattctctggatcggctggttcggttttaaccccggttcccaattagccgccgatcaagcctgtgcctacattgccgttaccactaaccttgctgcctctgctggtggtctcaccgctacttttacctcctggctcaaagatggtaagcctgatttgaccatggtaatcaacggtgtactggctggactggtgggtattaccgctggttgtgctggagtatcctactgggggtctgtcatcattggtggtatcgctggaattttggtggtctactccgttgccttcttcgacaaaattaaaattgatgaccccgtgggtgccatttctgttcacttggtcaacggtgtttggggaaccctggcagtgggcttcttcaacatggagaagggcttgttttacggcggcggcatcaaccagttaatcattcaaatcgttggtattctggcgatcggtgctttcaccgctatcttcagcttcgttgtttgggctatcctcaagcaaactatgggcatccgggtgtccggcgaagaagaaatgatcggtttggacatcggcgagcatggcatggaagcttacactggctttgttaaggaaactgattcctttggtagtgctgtctccggtgccactgtccctgaataa

SEQ ID NO: 3925 - protein, 507 aa, Synechocystis sp.
MSNSILSKLNVGERSPVNRTHSSRTEAEKSSLFRFVRRKINSPWLACVPLTALIVAIWNAAAIAQDTEIVNITVETVNENVATLQGTLNAIWILIAAILVIFMNAGFGMLETGLCRQKNAVNILTKNLIVFALATIAYWAIGFSLMFGSSGNPFVGFGGFFLSGDHTNYGLSPFPEGLPVAVFFLFQVAFSATAATIVSGAVAERIKFNEFLIFSVLLVGIAYPITGHWVWDAGGWLYTMGFMDFAGSTVVHSVGGWAALAGAFLLGPRLGKFVDGRPGAIPGHNMGFAMLGCLILWIGWFGFNPGSQLAADQACAYIAVTTNLAASAGGLTATFTSWLKDGKPDLTMVINGVLAGLVGITAGCAGVSYWGSVIIGGIAGILVVYSVAFFDKIKIDDPVGAISVHLVNGVWGTLAVGFFNMEKGLFYGGGINQLIIQIVGILAIGAFTAIFSFVVWAILKQTMGIRVSGEEEMIGLDIGEHGMEAYTGFVKETDSFGSAVSGATVPE

SEQ ID NO: 3926 - DNA, 1602 bp, Oryza sativa (rice)
  CDS (1)..(1602)
atggcgacgtgcgcggcggacctggcgccgctgctggggccggtggcggcgaacgcgacggactacctgtgcaaccggttcgccgacacgacgtcggcggtggacgcgacgtacctgctcttctcggcgtacctcgtgttcgccatgcagctcgggttcgcgatgctctgcgccgggtcggtgcgggccaagaacacgatgaacatcatgctcaccaacgtgctcgacgccgcggccggggcgctcttctactacctcttcggcttcgcttcgcttcgcgattgccttcgcacgccgtccaacggcttcatcgggaagcagttcttcggcctcaagcacatgccggcaagaccgggttccgactacgacttcttcctcttccagtgggccttcgccatcgccgccgccgggatcacgtcgggctccatcgccgagaggacgcagttcgtcgcctacctcatctactccgccttcctcaccgggttcgtctacccggtggtgtcccactggatctggtccgccgatgggtgggcctctgcctcccgcacgtccggacctctgctgttcggctccggtgtcatcgacttcgccggctccggcgtcgtccacatggtcggcggtgtcgccgggctctggggcgcgctcatcgagggcccccgcatcggcaggttcgaccacgccggccgatcggtggcgctcaagggccacagcgcgtcgctcgtcgtgcttggcaccttcctgctgtggttcggctggtacggattcaaccccgggtcgttcaccaccatcctcaagacgtacggcccggccggcggcatcaacgggcagtggtccggagtcggccgcaccgccgtgacgacgaccctggccggcagcgtggcggcgctcaccacgctgttcgggaagcggctccagacggggcactggaacgttgtcgacgtctgcaacggcctcctcggcgggttcgccgccatcaccgccgggtgcggcgtcgtcgacccgtgggccgcgatcatctgcgggttcgtctcggcgtgggtgctcatcggcctcaacctcgccgcgcgcctcaagttcgacgacccgctcgaggcggcccagctccacggcgggtgcggcgcgtgggggatcctcttcaccgcgctcttcgcgaggcagaagtacgtcgagagatctacggcgccggccgcgtacggcctgttcatgggacgccgcaagctgctcgttggcgctgtcatccagatcctggtcatcttcgggtgggtcagctgcaccatgggacctctcttctacgggctcaagaagctcggcctgctccgcatctccggccgagacgagacgtccggcatggacctgacacggcacggcgggttcgcgtacgtctaccacgacgaggacgagcacgacaagtctggggttggtgggttcatgctccggtccgcgcagacccgcgtcgagccggcggcggccggctgcctccaacagcaacaaccaagtgtaaccaatccagaagcaagcacgtcacagcgaaggaagaaatcacgggtttctctccctctccgatctcgatcgtcacgtcataaatttgatccccatatttga

SEQ ID NO: 3927 - protein, 533 aa, Oryza sativa (rice)
MATCAADLAPLLGPVAANATDYLCNRFADTTSAVDATYLLFSAYLVFAMQLGFAMLCAGSVRAKNTMNIMLTNVLDAAAGALFYYLFGFASLRDCLRTPSNGFIGKQFFGLKHMPARPGSDYDFFLFQWAFAIAAAGITSGSIAERTQFVAYLIYSAFLTGFVYPVVSHWIWSADGWASASRTSGPLLFGSGVIDFAGSGVVHMVGGVAGLWGALIEGPRIGRFDHAGRSVALKGHSASLVVLGTFLLWFGWYGFNPGSFTTILKTYGPAGGINGQWSGVGRTAVTTTLAGSVAALTTLFGKRLQTGHWNVVDVCNGLLGGFAAITAGCGVVDPWAAIICGFVSAWVLIGLNLAARLKFDDPLEAAQLHGGCGAWGILFTALFARQKYVERSTAPAAYGLFMGRRKLLVGAVIQILVIFGWVSCTMGPLFYGLKKLGLLRISGRDETSGMDLTRHGGFAYVYHDEDEHDKSGVGGFMLRSAQTRVEPAAAGCLQQQQPSVTNPEASTSQRRKKSRVSLPLRSRSSRHKFDPHI

SEQ ID NO: 3928 - DNA, 1515 bp, Arabidopsis thaliana (mouse-ear cress)
  CDS (1)..(1515)
atggcgtcggctctctcttgctctgcctctgatctgattccattactatcaggtggagccaacgccaccgcagcagcagccgccgctgaatacatctgcgggagattcgacacagtcgccgggaaattcactgatgcggcttacgcaatcgacaacacttaccttctcttctctgcttacctcgttttcgcgatgcagctcggtttcgccatgctctgtgccggatccgtacgtgcaaaaaacacgatgaacattatgctcacgaacgtcatcgacgctgcagccggaggtctcttctattatctcttcggtttcgcttttgcttttggatctccttctaatggattcatcggaaaacatttctttggaatgtatgattttcctcaacctacgtttgattatccttattttctatatcaatggactttcgctatcgccgccgctggaatcacgagtggttcgatagcggagaggactcagttcgttgcgtatttgatctattcttctttcttgacgggtcttgtttacccgattgtgtcgcattggttttggtcttctgatggttgggcgtctccggctagatctgagaaccttctgtttcaatcaggtgtgattgatttcgctggctctggtgttgttcatatggttggtggtattgctggtttatggggagctttaattgaaggacctaggattggtcggtttggagttgggggtaaaccggttacgttgcgtggtcatagtgctacgttggttgttcttggaacgtttttgttatggttcggatggtacgggtttaacccgggctcgtttgcaactatttttaaggcgtatggggagactccagggagctcgttttacggacaatggagcgcagttgggagaaccgcggtaacaactacgttagctggttgcacggcggcgttaacgactctgtttgggaaaagacttattgatgggtattggaatgtaactgatgtttgcaatggtttgttaggcgggtttgcggctataactagcggatgttcggttgtggaaccgtgggctgcgcttgtatgtgggtttgtagccgcatgggtgctgatgggatgcaatagactagcggaaaagctccaatttgatgatccgttggaagcggctcagcttcacggtggttgtggtgcgtgggggattattttcaccgggttgttcgcggagaaaagatacattgccgagatctttggaggcgacccgaataggcctttcggattgctaatgggaggaggaggtaggttgcttgcggcgcacgtcgttcagattttggtgattacgggttgggttagtgtgacaatggggactctgttttttattttgcataagctgaaactgttgaggataccggcggaggatgagatagctggggtggatccgacgagtcacggagggttggcttatatgtacacagaagatgagattaggaatgggatcatggttaggagagtgggtggtgataatgatcccaatgtaggtgtttga

SEQ ID NO: 3929 - protein, 504 aa, Arabidopsis thaliana (mouse-ear cress)
MASALSCSASDLIPLLSGGANATAAAAAAEYICGRFDTVAGKFTDAAYAIDNTYLLFSAYLVFAMQLGFAMLCAGSVRAKNTMNIMLTNVIDAAAGGLFYYLFGFAFAFGSPSNGFIGKHFFGMYDFPQPTFDYPYFLYQWTFAIAAAGITSGSIAERTQFVAYLIYSSFLTGLVYPIVSHWFWSSDGWASPARSENLLFQSGVIDFAGSGVVHMVGGIAGLWGALIEGPRIGRFGVGGKPVTLRGHSATLVVLGTFLLWFGWYGFNPGSFATIFKAYGETPGSSFYGQWSAVGRTAVTTTLAGCTAALTTLFGKRLIDGYWNVTDVCNGLLGGFAAITSGCSVVEPWAALVCGFVAAWVLMGCNRLAEKLQFDDPLEAAQLHGGCGAWGIIFTGLFAEKRYIAEIFGGDPNRPFGLLMGGGGRLLAAHVVQILVITGWVSVTMGTLFFILHKLKLLRIPAEDEIAGVDPTSHGGLAYMYTEDEIRNGIMVRRVGGDNDPNVGV

SEQ ID NO: 3930 - DNA, 1545 bp, Lycopersicon esculentum (tomato)
  CDS (1)..(1545)
atggcctccgccatgacttgctcagctgccgagctcttccctcatctcggcagctcagcaaatgccacagcggccgcagaattcatctgcagccgcttctcagctgtctcagagtacctcacaaacaccacctacgcggtggacaccacatacctcctcttctcggcttacctcgtcttcgccatgcaattgggatttgccatgttgtgcgcgggctctgtccgcgccaaaaacacgatgaatataatgcttacaaacgtgcttgatgctgctgctggtggattttcttattatctctttggttttgcctttgcctttggagctccttctaatggtttcattggaaaacatttttttggattaaaagagtttccttcacaagcttttgactatagctattttctttatcaatgggcctttgcaatagctgcagcaggtatcacaagtgggtccatagctgaaagaacacaatttgtggcttatctcatttactcttcatttttgactggttttgtgtacccaattgtctcacattggttctggtccggtgatggttgggccagtgcatcaaaaaccgatggtaacttattattgcggttcggtgttatcgattttgccgggtccggtgttgttcatatggttggtggcattgccggtctatggggcgctttcatcgaaggaccacgaatcggtcggtttgatcggtccggtcggtctgttgccctaagaggccatagtgcctcattagttgtattaggtacttttttactatggttcggttggtacggatttaatcctggttcattcttaactattcttaaatcatacgatcataccataagaggtacttattatggtcagtggagcgcgatcggtagaacagctgtcacgactacattggctggttgtaccgccgctctgacaactttgttttgtaagaggcttttagtggcacattggaatgtagttgatgtatgtaacggtttactaggtggatttgcagcaatcacgtcaggttgtgcagttgttgagccatgggcagctatagtttgtggatttatcgcagcttgggttttaattggatttaacgcattggcagctaaattaaaatacgacgatccattagaagcagcacaacttcatggtggttgcggttcatgggggataatatttactggattattcgcgaaaaaagaatatgtcaacgaagtatatccaggatttcctaatagaccatatggattgtttatgggaggtggtggaaaactattaggtgcacaagtaattcaagttgttgtgattattggatgggtgagtgtcacaatgggaccattgttttatttgttacataagtttaagctattgaggatatcgcgagacgatgaaacagcagggatggatttaacaagacatggaggatttgcatatatatatcatgatgaagatgaaggttcatctatgcctggatttaaaatgacaagagttgaaccgactaatacttctacaccagatcatcaaaatagatctgttaatgtggttgtataa

SEQ ID NO: 3931 - protein, 514 aa, Lycopersicon esculentum (tomato)
MASAMTCSAAELFPHLGSSANATAAAEFICSRFSAVSEYLTNTTYAVDTTYLLFSAYLVFAMQLGFAMLCAGSVRAKNTMNIMLTNVLDAAAGGFSYYLFGFAFAFGAPSNGFIGKHFFGLKEFPSQAFDYSYFLYQWAFAIAAAGITSGSIAERTQFVAYLIYSSFLTGFVYPIVSHWFWSGDGWASASKTDGNLLLRFGVIDFAGSGVVHMVGGIAGLWGAFIEGPRIGRFDRSGRSVALRGHSASLVVLGTFLLWFGWYGFNPGSFLTILKSYDHTIRGTYYGQWSAIGRTAVTTTLAGCTAALTTLFCKRLLVAHWNVVDVCNGLLGGFAAITSGCAVVEPWAAIVCGFIAAWVLIGFNALAAKLKYDDPLEAAQLHGGCGSWGIIFTGLFAKKEYVNEVYPGFPNRPYGLFMGGGGKLLGAQVIQVVVIIGWVSVTMGPLFYLLHKFKLLRISRDDETAGMDLTRHGGFAYIYHDEDEGSSMPGFKMTRVEPTNTSTPDHQNRSVNVVV

SEQ ID NO: 3932 - DNA, 1506 bp, Arabidopsis thaliana (mouse-ear cress)
  CDS (1)..(1506)
atgtcttgctcggccaccgatctcgctgtcctgttgggtcctaatgccacggcggcggccaactacatctgtggccagttaggcgacgtcaacaacaaatttatcgacaccgctttcgctatagacaacacttaccttctcttctccgcctaccttgtcttctctatgcagcttggcttcgctatgctctgtgccggttccgtgagagccaagaatactatgaacatcatgcttaccaacgtccttgacgctgcagccggtggtctcttctattatctgtttggctacgcctttgcctttggatctccgtccaatggtttcatcggtaaacactactttggtctcaaagacatccccacggcctctgctgactactccaactttctctaccaatgggcctttgcaatcgctgcggctggaatcacaagtggctcgatcgctgaacggacacagttcgtggcttacctaatctattcctctttcttaaccgggtttgtttacccggtcgtctctcactggttctggtcagttgatggatgggccagcccgttccgtaccgatggagatttgcttttcagcaccggagcgatagatttcgctgggtccggtgttgttcatatggtcggaggtatcgctggactctggggtgcgctcatcgaaggtccacgacttggccggttcgataacggaggccgtgccatcgctcttcgtggccactcggcgtcacttgttgtccttggaacattcctcctctggtttggatggtacggatttaaccccggttccttcaacaagatcctagtcacgtacgagacaggcacatacaacggccagtggagcgcggtcggacggacagctgtcacaacaacgttagctggctgcaccgcggcgctgacaaccctatttgggaaacgtctactctcgggacattggaacgtcactgatgtatgcaacggcctcctcggagggtttgcagccataactggtggctgctctgtcgttgagccatgggctgcgatcatctgcgggttcgtggcggccctagtcctcctcggatgcaacaagctcgctgagaagctcaaatacgacgaccctcttgaggcagcacaactacacggtggttgcggtgcgtggggactaatattcacggctctcttcgctcaagaaaagtacttgaaccagatttacggcaacaaacccggaaggccacacggtttgtttatgggcggtggaggaaaactacttggagctcagctgattcagatcattgtgatcacgggttgggtaagtgcgaccatggggacacttttcttcatcctcaagaaaatgaaattgttgcggatatcgtccgaggatgagatggccggtatggatatgaccaggcacggtggttttgcttatatgtactttgatgatgatgagtctcacaaagccattcagcttaggagagttgagccacgatctccttctccttctggtgctaatactacacctactccggtttga

SEQ ID NO: 3933 - protein, 501 aa, Arabidopsis thaliana (mouse-ear cress)
MSCSATDLAVLLGPNATAAANYICGQLGDVNNKFIDTAFAIDNTYLLFSAYLVFSMQLGFAMLCAGSVRAKNTMNIMLTNVLDAAAGGLFYYLFGYAFAFGSPSNGFIGKHYFGLKDIPTASADYSNFLYQWAFAIAAAGITSGSIAERTQFVAYLIYSSFLTGFVYPVVSHWFWSVDGWASPFRTDGDLLFSTGAIDFAGSGVVHMVGGIAGLWGALIEGPRLGRFDNGGRAIALRGHSASLVVLGTFLLWFGWYGFNPGSFNKILVTYETGTYNGQWSAVGRTAVTTTLAGCTAALTTLFGKRLLSGHWNVTDVCNGLLGGFAAITGGCSVVEPWAAIICGFVAALVLLGCNKLAEKLKYDDPLEAAQLHGGCGAWGLIFTALFAQEKYLNQIYGNKPGRPHGLFMGGGGKLLGAQLIQIIVITGWVSATMGTLFFILKKMKLLRISSEDEMAGMDMTRHGGFAYMYFDDDESHKAIQLRRVEPRSPSPSGANTTPTPV

SEQ ID NO: 3934 - DNA, 1605 bp, Caenorhabditis elegans
  CDS (1)..(1605)
atgacgacgccgacaaatttcacaacagaaattgacaagcttcatgctgaaattaccagacttgagacgggtttctatgagaatgtcaactcgttcttcctctgttccatggctctcatcattttcttcatgcaatgcgggttcgcatatcttgaagcaggagccgtacgtagtaagaacacaacaaacattctgataaaaaatcttcttgactcttgtatttgcatcatcgggtattgggctatcggatgggcactagcatacggagattcaggagagggtgtcaacctttttgttggtcactctcagtttttcctctccggtttttcggattatccccgattcttcttccaatacgtattctctgcaactgccgctactattgtttccggtgccgttgctgaaagatgcgaattcataacctatgtgacttactgcacggtcatttcaacatttatttatccggttctcactcactggggttggacagagaatggatggatggcaaaaggtattacaagtggaattattgacaccaaatacgacgatttcgccggatctggactagttcatctctgcgggggatccatttcattcctggccgcatggatcatgggaccccgaatcggtaaattccctgatgatgaggatgacgaatcggatgaaattcttggtcactctgttccctttactgctttgggaggattcattctgatgttcggtttcctggcgttcaacggaggatcggtggctagtatctcgcatgctggcgacggtcacactgtcgcacttgccatgattaacactattctgagcggagcttttgccgctcttatctaccttggcgttcattactatcaacacggaaaatggacacttcttctaacaattaatgcctgcttgagtggaatggtcgctgcatgtgctggatgtaacaaaatggaaccatgggcttgtatttgggttggacttggagccggactcatctaccttgcgttctcaaaacttatgataaggctgaaaatcgacgatcctcttgacgctttcgccgtgcacgctggtggtggcttctggggattaatgtcatcgtcaattatttctcacggaggagttgcgtacgctttggctgatgcagtttctggtgcaaaaaattcgggtgatcatctcacacaagctttcgcgcaacttggatggcaaatgatctgcgcgctggcaatcatagcttggtcacttggagtcatgttaccaatattctggattctcaaaaaaactggaaagcttcgcgtctcagaagaagtggagatcaatgggctggatgtatttaagcatggagagatggcatacccactccgagcatatggtcatggatggcacgactttgaacgggcgaataagatccaagcatttagcgcaaaaattacagtaggagagggaaaaaatacgaggatcatgaagattcatcctgaaatgtccattgaacaattggcgtcagtgtacgatagaagtggaaacatcatacctatgcccaaaaagtccaggacactgttcacaaattcagctgagcgaaaaatgtcgcaaatgatgtatgatgagaataaaatgtga

SEQ ID NO: 3935 - protein, 534 aa, Caenorhabditis elegans
MTTPTNFTTEIDKLHAEITRLETGFYENVNSFFLCSMALIIFFMQCGFAYLEAGAVRSKNTTNILIKNLLDSCICIIGYWAIGWALAYGDSGEGVNLFVGHSQFFLSGFSDYPRFFFQYVFSATAATIVSGAVAERCEFITYVTYCTVISTFIYPVLTHWGWTENGWMAKGITSGIIDTKYDDFAGSGLVHLCGGSISFLAAWIMGPRIGKFPDDEDDESDEILGHSVPFTALGGFILMFGFLAFNGGSVASISHAGDGHTVALAMINTILSGAFAALIYLGVHYYQHGKWTLLLTINACLSGMVAACAGCNKMEPWACIWVGLGAGLIYLAFSKLMIRLKIDDPLDAFAVHAGGGFWGLMSSSIISHGGVAYALADAVSGAKNSGDHLTQAFAQLGWQMICALAIIAWSLGVMLPIFWILKKTGKLRVSEEVEINGLDVFKHGEMAYPLRAYGHGWHDFERANKIQAFSAKITVGEGKNTRIMKIHPEMSIEQLASVYDRSGNIIPMPKKSRTLFTNSAERKMSQMMYDENKM

SEQ ID NO: 3936 - DNA, 1347 bp, Streptomyces coelicolor
  CDS (1)..(1347)
atggctccagccatcacgctcgccgcagagacggagctctctgccgccaacacgggcttcatgctcatctgctccgccctggtgatgctcatgaccccggccctggccttcttctacggaggcatggtccgcgtcaagagcaccctgaacatgctgatgatgagcttcatcagcctcggcatcgtcaccgtcctgtgggtgctctacggcttttccatggcgttcggcaccgactccggcagcgtcgtcggctggaactccgactgggtgggcctgagcgacatcggcctgaccgagctgtgggacggctacaccatccccgtcttcgtcttcctggtcttccagctgatgttcgccgtcctcacccccgccctgatcagcggggccctcgcggaccgggtgaagttcacggcctgggcgctgttcatcgccctgtgggccacgatcgtctacttcccggtggcccactgggtctggggcgccggcggctgggccttcgagctgggcgtcatcgacttcgccggcggcacggccgtgcacatcaacgccggtgccgccgcgctcggcgtgatcctcgtcatcggcaagcgggtcggcttcaagaaggacccgatgcgcccgcacagcctcccgctggtcatgctcggcgccggcctgctctggttcggctggttcggcttcaacgccgggtcgtggctcggcaacgacgacggcgtcggcgcgctgatgttcgtcaacacccaggtcgccaccggcgccgccgtcctcggctggctcgcctacgagaagatccgccacggcgccttcaccaccctgggcgcggcctccggcgccgtctccgggctggtcgccatcaccccggcaggcggcgccgtctccccgctcggcgcgatcgccgtcggcctcgtcgccggcgtggtgtgcgccatggccgtcggcctgaagtacaggttcggctacgacgactccctcgacgtggtcggcgtccacctcgtcggcggcatcctcggctcgctgctcatcggcttcttcgccagcggcaagggccagtccgacgtcgagggcctcttctacggcggcggcctcgaccagttctggaagcagtgcgcgggcgtcttcggcgtcctcgcctactccctggtcgtctccgcggtcctcgccttcctgctggacaagacgatcggcatgcgggtgtcggaggacgtcgaggtggccggcatcgaccaggccgagcacgccgagaccgcatacgacttcagcggcgccggcggcggtgccgcccggacgaccgccacgccggccgcctccacggccgggtcggccccgagcaagaaggtggacgcatga

SEQ ID NO: 3937 - protein, 448 aa, Streptomyces coelicolor
MAPAITLAAETELSAANTGFMLICSALVMLMTPALAFFYGGMVRVKSTLNMLMMSFISLGIVTVLWVLYGFSMAFGTDSGSVVGWNSDWVGLSDIGLTELWDGYTIPVFVFLVFQLMFAVLTPALISGALADRVKFTAWALFIALWATIVYFPVAHWVWGAGGWAFELGVIDFAGGTAVHINAGAAALGVILVIGKRVGFKKDPMRPHSLPLVMLGAGLLWFGWFGFNAGSWLGNDDGVGALMFVNTQVATGAAVLGWLAYEKIRHGAFTTLGAASGAVSGLVAITPAGGAVSPLGAIAVGLVAGVVCAMAVGLKYRFGYDDSLDVVGVHLVGGILGSLLIGFFASGKGQSDVEGLFYGGGLDQFWKQCAGVFGVLAYSLVVSAVLAFLLDKTIGMRVSEDVEVAGIDQAEHAETAYDFSGAGGGAARTTATPAASTAGSAPSKKVDA

SEQ ID NO: 3938 - DNA, 1539 bp, Schizosaccharomyces pombe
  CDS (1)..(1539)
atgtcgtcagtgaattcaattcccacagcaacttctactgtttatatttcagtactgccagctacagctacacctagtggtggtagtggtggaaatgttttgcacgaagatcttaataaattttatgattatggaaacactagttggattttagcttgtactccattgtgtcttattatggtgcctggtgtggcttttttctactctggcttagcaagaaggaaaaatacattggctcttatcatgctctctatgcttggtttatgtgttagttttttccaatggtatttctggggttattctcttgctttttctcaaactggaacctctggttatattggcaatcttcgtcattttgcctttattcgcacacttgccgattactctcctggtagcaataatattcccgagcttgtatttgcaaattttcaaggaatgttcgccgcaattactgtagccctcttcactggtgccgccgctgaaagaggtcgtattggtccaatgctcatcatcacatttgtgtggctcactgtcgtttattgtcccatagcgtgttggatttggaatccaaatggttgggcttttaaatttggtgtatacgatttcgctggcggaggacctgtagaagttggatcaggatttgcagctttggcgtatacggtttgtttaggacgtcgatccaaatttgttgaggaacaatttcgccctcattctgtgctcaatgttgtattgggaacatctctgctatggtttggttggcttggtttcaacggtggtagtgcttacggctccaatctgcgagccgctatggcaatcaccaacacaaacttagcaggtgctgtagctggtttagtatgggttatttacgactacatttttcgcactaggaaatggtcaaccataggtttttgttccggggttgttgccggtttggtggctgcaacgccttgtgctggttttgtgagtcctcatgcctctttggcaattggtgctattactggcttatgttgcaattgggccattaagttaaagtcacatatgcgcattgatgatgcgatggatattttcgctatccacggtgttgcgggttttgtgggtacctttttgaatggtttgtttgccgttgattatatcgcagcaatggatggtatttatgttggtgaaaacaaaatcagaggtggttggtttgatcaccattggcgccaactaggcttgcaaatggcctatatttgtgctgttggtgcatacgactttgttgtcacgtttatcattttattcattacggacaaaattccctaccttcaacttcgagtgagccctgatgctgaagaaattggtgtggatgctgatcaaataggtgaatacgcgtttgattatattgaagaacgtcgtgaatataagcattggaagatttcccctgccggtgtacctgaagaaatcattatttccaatggcgttgctcaacctactggaaatgtggctgctcccggcaagattctagaatcaacaaacccattggagcttggacttacgatctaa

SEQ ID NO: 3939 - protein, 512 aa, Schizosaccharomyces pombe
MSSVNSIPTATSTVYISVLPATATPSGGSGGNVLHEDLNKFYDYGNTSWILACTPLCLIMVPGVAFFYSGLARRKNTLALIMLSMLGLCVSFFQWYFWGYSLAFSQTGTSGYIGNLRHFAFIRTLADYSPGSNNIPELVFANFQGMFAAITVALFTGAAAERGRIGPMLIITFVWLTVVYCPIACWIWNPNGWAFKFGVYDFAGGGPVEVGSGFAALAYTVCLGRRSKFVEEQFRPHSVLNVVLGTSLLWFGWLGFNGGSAYGSNLRAAMAITNTNLAGAVAGLVWVIYDYIFRTRKWSTIGFCSGVVAGLVAATPCAGFVSPHASLAIGAITGLCCNWAIKLKSHMRIDDAMDIFAIHGVAGFVGTFLNGLFAVDYIAAMDGIYVGENKIRGGWFDHHWRQLGLQMAYICAVGAYDFVVTFIILFITDKIPYLQLRVSPDAEEIGVDADQIGEYAFDYIEERREYKHWKISPAGVPEEIIISNGVAQPTGNVAAPGKILESTNPLELGLTI

SEQ ID NO: 3940 - DNA, 1425 bp, Rhizobium etli
  CDS (1)..(1425)
atgtcaatctcgaagttttcttccacctttgcgcgggtcggcgcagcattggccgcgcttcttgcgccggccgtcgcttttgcgcaggagaccgctgcgccagccgctcgtccgcgtctgcctcgtttcaccatggacaagggtgacaatacctggatgctcgtctcctcggcgctcgtcctgctgatgaccatccccggccttgcgcttttctacggcggtctcgtgcgcgccaaaaacatgctctccgtgctgatgcaggtgttcatgatcacggccgtcgtgtcgctgatctgggtgacctacggctattcgctcgcctttaccgacgggggctcgctgaacagcttcatcggcggcttctccaaagctttccttgccggcgtcaacacatcgtcgctcgccgagacattctcgaagggcgtcgccattccggaatacaccttcatcgtcttccagatgaccttgccctgcatcacgcccggcctgatcgtcggcgccttcgccgaacgcgtgaagttctcggccgtcatgctcttcgtcgtcctgtgggtcaccttcatctacttcccgatggcgcacatggtctggttctggggcggcccgagctcctacagcgcgccggccggcctgatcttctcttacggggcaatcgattttcctggcgcgacggtcgttcacatcaatgccggtaatcgcggccttgtcgcggccatcatgctcggcaagcgcacgggctataagaaggaaatcatgcgcccgcattccatgacgctgaccatggtcggtgcctcgctgctctgggtcggctggttcggcttcaacgctggttccaacctcgaagccaatggctacgcatcgcttgcgatgatcaacaccttcgtcgcagctgccgccgccgtgtcctggtgcatcgtcgaaagcctggcccgtggcaaggcatcgatgctgggtggtgcttccggtgctgtcgccggtctcgtcgccatcaccgcggcggcaggttttgccgcgcgatgggcctcgatcgttctcggtctcgtcgtctcgccgatctgctacttcttcgtcgacgtcgtgaagaacaagttcaactatgacgacagcctcgacgtcttcggcgtccattgcatcggcggcatcatcggcgctctcggcaccggcatcctcgtcaatccggcgctgggcggtgcaggcatcgtcgactattcgacggctgatttcgccgctacctatcgcggaacggcaacccaggtcctgaaccaggcgaagggcgttctcacgaccctcctgtggtcgggcatcggttcggcgatcctctacaagatcgtcgacgtcgtcatcggcctgcgcgtgagcgtcgaagccgagcgcgaaggtctcgacctttcgacccacggcgaacccgcctaccacgcctcctga

SEQ ID NO: 3941 - protein, 474 aa, Rhizobium etli
MSISKFSSTFARVGAALAALLAPAVAFAQETAAPAARPRLPRFTMDKGDNTWMLVSSALVLLMTIPGLALFYGGLVRAKNMLSVLMQVFMITAVVSLIWVTYGYSLAFTDGGSLNSFIGGFSKAFLAGVNTSSLAETFSKGVAIPEYTFIVFQMTLPCITPGLIVGAFAERVKFSAVMLFVVLWVTFIYFPMAHMVWFWGGPSSYSAPAGLIFSYGAIDFPGATVVHINAGNRGLVAAIMLGKRTGYKKEIMRPHSMTLTMVGASLLWVGWFGFNAGSNLEANGYASLAMINTFVAAAAAVSWCIVESLARGKASMLGGASGAVAGLVAITAAAGFAARWASIVLGLVVSPICYFFVDVVKNKFNYDDSLDVFGVHCIGGIIGALGTGILVNPALGGAGIVDYSTADFAATYRGTATQVLNQAKGVLTTLLWSGIGSAILYKIVDVVIGLRVSVEAEREGLDLSTHGEPAYHAS

SEQ ID NO: 3942 - DNA, 1311 bp, Azotobacter vinelandii
  CDS (1)..(1311)
atgacgctgcgcaaaggcgcagggtcttgctgccctttcttccctcttcctgccccgtcatggccagccgcccaggaggctacgctggattcgggcgataccgcctggatgctgaccgccacggcgctggtgctgttcatgaccattcccggcctggcgctgttctacggcggcatggtgcgttcgaagaacctgctctcggtgatgatgcaatgcttcgccatcaccggcctgatcagcgtgctctgggtcctgttcggttatagcttggccttcgacaccgccggcatggaggagggggtgctcaacttcagttccttcgtcggcggtctggacaaggccttcctcagtggcctgaccaccgacagcctggtcggcacctttcccgaaagcgtcttcatcaccttccagatgaccttcgccatcatcactccggcgctgatcaccggtgccttcgccgagcgcatgaagttctcgtcgatgctggtgttcatgtcggcctggttcctgctggtctacgcaccgatcgcccatatggtctggagcggcaacggcgcgctgatgtgggattggggcgtgctcgacttcgccggcggcaccgtggtgcacatcaacgccggtgtcgccggcctggtcgcctgcctggtgctgggcaagcgcaagggctaccccggagtcgccatgaccccgcacaacctcggctacaccctggtcggcgcggccatgctctgggtcggctggttcggcttcaacgccggctcgcgatcgcgcaacggcaccgccggcatggccatgctggtgacccagatcgccaccgccgccgccgcgctggcctggatccccgccgagtggctgacccacggcaagccgagccctgggcatcgcctccggcgtggtcgcgcctggtggcatcaccccggccgcggtaccgtcggcccgatgggcgccctggtgatcggcctggcttccggctcgatctgtttctactgcgccactgccgtgaagcgccgcttcggctatgacgattctctcgacgccttcggcgtgcacggtgtcggcggcatcgtcggcgcggtgctgaccggcctgttcgcggctccggccctgggcggtttcggcgaaatcgacagtatcgccagccaactgtggatccagatcaagggcgtgctcttcaccgtgatctacaccggcgtcgccaccttcgtgatcctcaaggcgatcgagcgggtgataggcctgcgcatcagcgaagaggaagaaaccatgggtctcgacctctccctgcacaacgagcgcggttacaacctctga

SEQ ID NO: 3943 - protein, 436 aa, Azotobacter vinelandii
MTLRKGAGSCCPFFPLPAPSWPAAQEATLDSGDTAWMLTATALVLFMTIPGLALFYGGMVRSKNLLSVMMQCFAITGLISVLWVLFGYSLAFDTAGMEEGVLNFSSFVGGLDKAFLSGLTTDSLVGTFPESVFITFQMTFAIITPALITGAFAERMKFSSMLVFMSAWFLLVYAPIAHMVWSGNGALMWDWGVLDFAGGTVVHINAGVAGLVACLVLGKRKGYPGVAMTPHNLGYTLVGAAMLWVGWFGFNAGSRSRNGTAGMAMLVTQIATAAAALAWIPAEWLTHGKPSPGHRLRRGRAWWHHPGRGTVGPMGALVIGLASGSICFYCATAVKRRFGYDDSLDAFGVHGVGGIVGAVLTGLFAAPALGGFGEIDSIASQLWIQIKGVLFTVIYTGVATFVILKAIERVIGLRISEEEETMGLDLSLHNERGYNL

SEQ ID NO: 3944 - DNA, 1482 bp, Azorhizobium caulinodans
  CDS (1)..(1482)
atgaacgtcaagacgtggtcccgcgtgggtcttcccacgctccttgcggcctcggcactcgccctgccggtgctggcccagacggcggcgcccgccgcggacgcgcccgcggcagccgcggccatcccgatcaataagggcgataccgcctggatgctggtctcggccgccctcgtgctgatgatgtcggtccccggcctcgccctgttctacggcggcctcgtgcgcaccaagaacatgctctcggtgctgatgcaggtgttctacaccgtgtccgtcgtcggcatcctgtgggtgctctacggctattcgctggccttcaccggcggctccgacttcgtcggcggcttctccaaggccttcctcgccggcatcacgccggacagcggcaccggcaccttctcggtgggcgtcaacattccggaattcgcgttcatcgcgttccagatgaccttcgccatgatcacgccggccctcatcttcggcgccttcgcggagcgcgtgaagttctcggccatcgtgctgttcgtgccgctgtgggtcaccttcatctatttcccgatggcccacatggtgtggtactgggccggcccggacgcggtggatgccgctgccaaggcgctcgccgccgctgacgctggcggcaaggctgccgcccagtccgcgctcgacgcggtgctcgcggatgccggctacatctacaagctcggcgccatcgacttcgctggcggcaccgtggtgcacatcaatgccggtatcgccgccttcgtcggctgcctgatcgtcggcaagcgcaccggctacggcaaggaggccttccagcctcactcgctcaccctcacgctggtcggcgccggcctgctgtgggtcggctggttcggcttcaacgccggctccaacctcgaagccaatggcctcaccgccctggccatgatgaacaccttcatcgccacctgcgccgccgccctctcctggatggtggtggaatggctggccaagggtaagccctccatgctcggcgtcgtctccggcgctgtggcgggcctcgtggccgtcaccccgatggccggcttcgccggcatcatgggctcgctggtctccggccttatcgtcggcgtgctgtgcttcttcttctgcaccaccgtgaagaacgccttcggctatgacgactcgctcgacgtgttcggcgtgcactgcatcggcggcatcttcggcgccattgccacgggcatcgtggtgagcccggcgctcggcggcaccggcatcttcgactacaccaccggcaaggtggccgactacgacatggccacccaggtcatcgcgcaggtgaaggccgtggttgtcacgctggtgtggtcgggcgtcggctcggcggtcctctactacatcgtgcacgccgtcgtcggcctgcgcgccacggtggagcgcgagcgcgaaggtctcgacatcaccgagcacggcgagcgcgcctaccacagctga

SEQ ID NO: 3945 - protein, 493 aa, Azorhizobium caulinodans
MNVKTWSRVGLPTLLAASALALPVLAQTAAPAADAPAAAAAIPINKGDTAWMLVSAALVLMMSVPGLALFYGGLVRTKNMLSVLMQVFYTVSVVGILWVLYGYSLAFTGGSDFVGGFSKAFLAGITPDSGTGTFSVGVNIPEFAFIAFQMTFAMITPALIFGAFAERVKFSAIVLFVPLWVTFIYFPMAHMVWYWAGPDAVDAAAKALAAADAGGKAAAQSALDAVLADAGYIYKLGAIDFAGGTVVHINAGIAAFVGCLIVGKRTGYGKEAFQPHSLTLTLVGAGLLWVGWFGFNAGSNLEANGLTALAMMNTFIATCAAALSWMVVEWLAKGKPSMLGVVSGAVAGLVAVTPMAGFAGIMGSLVSGLIVGVLCFFFCTTVKNAFGYDDSLDVFGVHCIGGIFGAIATGIVVSPALGGTGIFDYTTGKVADYDMATQVIAQVKAVVVTLVWSGVGSAVLYYIVHAVVGLRATVEREREGLDITEHGERAYHS

SEQ ID NO: 3946 - DNA, 1317 bp, Azospirillum brasilense
  CDS (1)..(1317)
atgagccgtctcttcaccctcgccgcgccgacgatggcggcgattctgggcttggccggtctgcctgccgccgccctcgcccaggaaagcgccgccgccgcggccgaacccaccctgagcagcggcgacacggcttggatgctggtcgccacggcgctggttctgttcatgaccatcccgggtctggctctgttctacggcggcatggtccgcaagatgaacgtgctgtcggtcgtgatgcagagctttgcgatctgctgcctggtcagcatcctgtggttcttcgccggttacagcatcgcctttaccgaaggcaccccgtatttcggcagcctgtccaagttcatgctggccggcatcaccaaggacagcctgacgggcgtcattcccgagacgatcttcgtcgtctttcagatgaccttcgccatcatcaccccggccctgatcaccggcgccttcgccgaccgcatgaagttctcctcgatgctggtcttcacgggcctgtggtcgctgatcgtctacgcgccgatcacccactgggtctggggtccgggcggctatctggcgggtgacggcgtgctcgactacgccggcggcaccgtggtgcacatcaacgcgggcgtggccggtctggtcgccgccatcgtgctgggcaagcgcaagggctatccgaacgagaacttcgctccgcacaacctggtgctcagcctgatcggcgcctcgatgctgtgggtcggctggttcggcttcaacgcgggttccgccgtggccgccgacggccgtgcgggcatggccatgctggtcacgcagatcgccgccgccaccgccgccatgtcctggctgctggtcgagtgggccaccaagggcaagggttcggttctcggcatcatctccggcgccatcgccggtctggtcgccatcaccccggcctcgggcttcgtcggtccgaccggcgccctggtcatcggtctggccgccggcgtgatctgctactggggcgccaccggcctgaagcgcgccctcggctatgacgactcgctggacgccttcggggtgcacggcgtgggcggcatcgtcggcgccatcctgaccggcgtcttcgcccaggaagccatcggcggcaccgccggcgccctggaaggcaacgtcggccagatctggacgcaggtctacggcattctcgccaccatcgtctactcggcggtcggctccttcatcatcctgaaggtcatcgacgtggtgatgggcctgcgcgtcgacgaggacgtcgagcgcgacggcctggacctcgccctgcacggcgagaccatccactaa

SEQ ID NO: 3947 - protein, 438 aa, Azospirillum brasilense
MSRLFTLAAPTMAAILGLAGLPAAALAQESAAAAAEPTLSSGDTAWMLVATALVLFMTIPGLALFYGGMVRKMNVLSVVMQSFAICCLVSILWFFAGYSIAFTEGTPYFGSLSKFMLAGITKDSLTGVIPETIFVVFQMTFAIITPALITGAFADRMKFSSMLVFTGLWSLIVYAPITHWVWGPGGYLAGDGVLDYAGGTVVHINAGVAGLVAAIVLGKRKGYPNENFAPHNLVLSLIGASMLWVGWFGFNAGSAVAADGRAGMAMLVTQIAAATAAMSWLLVEWATKGKGSVLGIISGAIAGLVAITPASGFVGPTGALVIGLAAGVICYWGATGLKRALGYDDSLDAFGVHGVGGIVGAILTGVFAQEAIGGTAGALEGNVGQIWTQVYGILATIVYSAVGSFIILKVIDVVMGLRVDEDVERDGLDLALHGETIH

SEQ ID NO: 3948 - DNA, 1314 bp, Wolinella succinogenes
  CDS (1)..(1314)
atgaaaatcgttaaacttttgatcttggccctgctaccggttctgcttttcggagacgaagccgcagcggaggcagcagagaccgctttggaattggacgccgcgaacacggcttggatgttagtggccacagcctttgtcatgctcatgacacccgctggcttggctctcttttatggaggcatgacgcgctctaagaatatgctcaacaccatcggcatgagcgtggtgggctacattctcgcctctcttgtttgggtgggctggggttatggcctagcctttggtgaagacattggcggatttgtgggcgctttggatggattcttcctcagcaatgttaaggtgactgatatttgggaaggcggaaatattcccgtgctcctattcgctgctttccaaatgacttttgcgggtattaccgtagccttggcaagtggatcagtcattgagcgactcaaattctccacatggattctctttgtggtgctttgggtcaccgtggtttacgctcctgtagcacactgggtgtggggcggaggcttcttggctaatgagggtgttcttgattttgccggaggaaccgttgttcatatcaacgctggggttgcaggtctagtcatggcctatatgcttggcaaacgaagcgacaaagataaggcaatcttcccttcatctgtgactttgaccatgctaggggctattcttctatggtttggatggtttggtttcaacgccggaagcgagcttgctgctgatggaatcgccgctagtgctttcatggtgaccaacactgccgcagcggcagcggctttggcttggatgctcattgaatacgccgtctacaagaagttcaccctcatcggtatcgcctcagggattgtggcgggtctcgtggccatcactcctgcagcgggctttgtagacactcctgcctcagtgatcattggtcttgtagcgggtcttgtggccttctttggtatccatgggctcaaaaaagccttgggggcagacgactctctagatgcctttggaatccatggagttgcgggtatctggggagctttggcgacaggactctttgccaaccccgaagtcaacgagctaggcacgggtcttttctatggaaatgcaggtcaattcctcatccagcttgagggcgtagtggtcactatggtctttaccgccatcgccactgccatcgtcttcaagatcgtctgcttgattactggaggaggaagagtggatgcccaagaagagaccatgggtctggatgagtccacccacggcgaaaaaagctttcacttaaagtaa

SEQ ID NO: 3949 - protein, 437 aa, Wolinella succinogenes
MKIVKLLILALLPVLLFGDEAAAEAAETALELDAANTAWMLVATAFVMLMTPAGLALFYGGMTRSKNMLNTIGMSVVGYILASLVWVGWGYGLAFGEDIGGFVGALDGFFLSNVKVTDIWEGGNIPVLLFAAFQMTFAGITVALASGSVIERLKFSTWILFVVLWVTVVYAPVAHWVWGGGFLANEGVLDFAGGTVVHINAGVAGLVMAYMLGKRSDKDKAIFPSSVTLTMLGAILLWFGWFGFNAGSELAADGIAASAFMVTNTAAAAAALAWMLIEYAVYKKFTLIGIASGIVAGLVAITPAAGFVDTPASVIIGLVAGLVAFFGIHGLKKALGADDSLDAFGIHGVAGIWGALATGLFANPEVNELGTGLFYGNAGQFLIQLEGVVVTMVFTAIATAIVFKIVCLITGGGRVDAQEETMGLDESTHGEKSFHLK

SEQ ID NO: 3950 - DNA, 1320 bp, Photorhabdus luminescens (subsp. laumondii)
  CDS (1)..(1320)
atgcggcactgtaactcactgatagagaagatagatatgaaaaggcaattctcagtggctgccagtgttgtggccagttgtgtaccatcattatctcaggctgcggaaggcgttgttgataaagcggataatgcttttatgatgatttgtacagtgcttgttctgtttatgaccattccgggaattgctctgttttatggtggattgctacggagtaaaaacgttttatcgctaatggctcaggtcatggtgagctttgctttagtatgtgtgttgtgggtgatttatggttatagcctggcttttgagccagggaatggttttttcggtggttttagtcaagtgatgctaaagaatttggcattcactgacttaagtggcaatttttatcagctaattcatgtggcatttcagggctctttcgcttgtatcactgttgctttgattattggcgcgttaggggagcgtattcgctttccggctttgttagtttttactgtgttgtggctgacattttcttacttgcctatggcgcacatggtttgggggggaggtgtgctttcacaagatggagcattggattttgctggtggtacggttgttcatattaatgctgctgtagctggattggttggtgcttacttactgggaaaacgtactggctttgggaaagaagcatttaaaccgcataacttgccgatggtcttcacgggcactactgtgctctatattggttggtttggttttaatgctggttctgctagtgctgctaatgagatagctgctttggcatttttaaataccattgtggcgactgccgccgctatcctgtcatgggtttttgcagagtggcttttccgtaataaaccgtctcttttaggggcatgttcaggctgtattgctgggctggttggtattacacctgcggcaggaatggttggtgttggtggtgcattaatcattggcctgattgcgggttttaccggactttggggggtggtggccttaaaacggtggttacgtgttgacgatgtgtgtgatgtattcggcatacacggcgtatgtgggatcgtaggttgccttctaacaggggtttttacggctaaatctttgggagggatcggttatgcagagggtataaccatgttgggacaagttggtattcaggcttttagtatactggtttgtgtgatttggtcagtcgttgttgcctttattgcttttaaaatagcagatctgttggtagggctgcgggttacggttgaaattgaaagggaagggttggacattaattctcacggagagagtgcttataattaa

SEQ ID NO: 3951 - protein, 439 aa, Photorhabdus luminescens (subsp. laumondii)
MRHCNSLIEKIDMKRQFSVAASVVASCVPSLSQAAEGVVDKADNAFMMICTVLVLFMTIPGIALFYGGLLRSKNVLSLMAQVMVSFALVCVLWVIYGYSLAFEPGNGFFGGFSQVMLKNLAFTDLSGNFYQLIHVAFQGSFACITVALIIGALGERIRFPALLVFTVLWLTFSYLPMAHMVWGGGVLSQDGALDFAGGTVVHINAAVAGLVGAYLLGKRTGFGKEAFKPHNLPMVFTGTTVLYIGWFGFNAGSASAANEIAALAFLNTIVATAAAILSWVFAEWLFRNKPSLLGACSGCIAGLVGITPAAGMVGVGGALIIGLIAGFTGLWGVVALKRWLRVDDVCDVFGIHGVCGIVGCLLTGVFTAKSLGGIGYAEGITMLGQVGIQAFSILVCVIWSVVVAFIAFKIADLLVGLRVTVEIEREGLDINSHGESAYN

SEQ ID NO: 3952 - DNA, 1437 bp, Gloeobacter violaceus
  CDS (1)..(1437)
atgttaatgaaatgtaaatggaaatggggattgggcacgctggcagcggctctcgccactgccgccccggcgtttgcccaggacgcgccgaagatcgacaccggcgacaccgcctgggtgctggtttcggccgcgctggtgctgctgatgacccccggcctggcctttttctacggcgggctggtgcgaggcaagaacgcactgaacactttgatgatgagttttgttgccctcggggtgatcgcgctcgtttggacgctggtgggctactcgatcgcttttggacccggtaacggttactttggcagcttcgcctggctcggcctcaacggggtcgggcaggatccaaacaccgcccaggctgccaccgtgccgcacctggcgttcatgatttttcagatgatgtttgcggtgattaccccggcgctgatttccggtgccatcgtcgatcgcatgaagttcaagacctacgtcgtgttcatcatgatctggtcggtcgtggtctactcgccggtggcccactgggtctggtcgctgggtaaccccgacccgaccgatgcggccaagatgctgcctggctggctcggggctatcggggcgctcgactttgccggcggtacggtggtgcacctgacggccggtatctcggctttggtggcggcgatcattcttggtccgcgcaaaggctttcccaaccagccgatgactccccacaacgtgccttttgtgctgttgggagcggggctgttgtggttcggctggttcggcttcaacgccggttcggcgctcgccgccaatggcctcgcttcgctggcttttgtgacgacgaatgtcgccacggcggcggctctatccacctggcttttgcttgacacgtttatcggcggcaaaccgacggcggtgggtgcagccaccggtgcggtcgtcggtctggtggcaatcaccccggcggcgggttttgtcagcccgctttcgtcgattgcgatcggcggtatcgccgcgatcatctccttcgccgccattcaactgaagaaaaagctcaactacgacgattcgctcgacgtgtttgcctgccacggcatgggcggtctgaccggcgccattctcactggggtgtttgccgacaaatcgctcaattccctgggtgataacggcttgctcctgggcaacggggcgcagcttattgagcaattgattggtgtcggtgccgttgccgtctacgcagcggtctgcacgacggtcattttgctggcgctcaagttcaccctgggactgcgcccgagcgaggaagccgagcaggagggcctcgacaccgccgagcacggcgaggaagcctacaccggcagcatcggcggccttggcgccatggaagaagcgatgtcctccacttcccagggccagggttttacccgaccggcgacccagcagcaagaatag

SEQ ID NO: 3953 - protein, 478 aa, Gloeobacter violaceus
MLMKCKWKWGLGTLAAALATAAPAFAQDAPKIDTGDTAWVLVSAALVLLMTPGLAFFYGGLVRGKNALNTLMMSFVALGVIALVWTLVGYSIAFGPGNGYFGSFAWLGLNGVGQDPNTAQAATVPHLAFMIFQMMFAVITPALISGAIVDRMKFKTYVVFIMIWSVVVYSPVAHWVWSLGNPDPTDAAKMLPGWLGAIGALDFAGGTVVHLTAGISALVAAIILGPRKGFPNQPMTPHNVPFVLLGAGLLWFGWFGFNAGSALAANGLASLAFVTTNVATAAALSTWLLLDTFIGGKPTAVGAATGAVVGLVAITPAAGFVSPLSSIAIGGIAAIISFAAIQLKKKLNYDDSLDVFACHGMGGLTGAILTGVFADKSLNSLGDNGLLLGNGAQLIEQLIGVGAVAVYAAVCTTVILLALKFTLGLRPSEEAEQEGLDTAEHGEEAYTGSIGGLGAMEEAMSSTSQGQGFTRPATQQQE

SEQ ID NO: 3954 - DNA, 1311 bp, Chromobacterium violaceum
  CDS (1)..(1311)
atgaaaaagatactcgctgcaatggcttccgggctcgccgccctctccctgcccgcgctggccgatgcgccggccggcccggcggtggccgccgccaaggtgatcaactccggcgacaccgcctggatgctgacctccaccgccctggtgctgttcatgaccattcccggcctggcgctgttctatggcggcatggtccgcaagaagaacgtgctggccacgctgatgcagagcttcgccatcaccgcgctggtgaccgtgctgtgggccgtcgtcggctacagcctggccttcaccgtcggcaccccctatatcggcgacctgtcccgcgtgctgctggacggcatggtgtacatgaaggacgccggcaagctggcggtgcatccgctggccggcaccatcccggaatcggtgttcatgaccttccagatgaccttcgccatcatcaccccggcgctgatcaccggcgccttcgccgagcggatgaagttctctgcgatgctggtcttcatggcgctgtggtctctgctggtctatgtgccggtcgcccactgggtatgggcgccgggcggctggatgggcgacaagggcgtgctggacttcgccggcggcaccgtggtgcacatcaatgccggcgtggccggcctggtgaccgcgctggtgctgggcaagcgcgtcggcttcggccgcgaggcgatgccgccccacaacctggtgctgaccctggtgggcgcgtcgatgctgtgggtgggctggttcggcttcaacgccggctcggcgggcgccgccgacggccgcgccggcatggcgatggtcaccacccaggtcgccaccgcgatggccgcgctggcctggatgttcgccgaatggatcgccaagaaaaagccttcggtactgggcatcgcctccggcgcggtggccggcctggtggccatcaccccggccgccggcttcgtcgacgtcaagggcgcgctggccatcggcctggccgccggcgtgatctgcttctggggcgccaccggcctgaaacacatgatgggctacgacgactcgctggacgctttcggcgtgcacggcgtgggcggcatcctgggcgcgctgctgaccggcgtgttcgcggtcaaggacatcggcggcgccgacggcagcctggccacccaggcgctgggcgtgggcgtgaccatcgtctactgcggcgtggtcaccttcatcctgctgaagctggtggacatcgtgctcggcctgcgcgtcgcggaggacgaggaacgcgaaggcctggatctggtgctgcacggcgagcgggtggaataa

SEQ ID NO: 3955 - protein, 436 aa, Chromobacterium violaceum
MKKILAAMASGLAALSLPALADAPAGPAVAAAKVINSGDTAWMLTSTALVLFMTIPGLALFYGGMVRKKNVLATLMQSFAITALVTVLWAVVGYSLAFTVGTPYIGDLSRVLLDGMVYMKDAGKLAVHPLAGTIPESVFMTFQMTFAIITPALITGAFAERMKFSAMLVFMALWSLLVYVPVAHWVWAPGGWMGDKGVLDFAGGTVVHINAGVAGLVTALVLGKRVGFGREAMPPHNLVLTLVGASMLWVGWFGFNAGSAGAADGRAGMAMVTTQVATAMAALAWMFAEWIAKKKPSVLGIASGAVAGLVAITPAAGFVDVKGALAIGLAAGVICFWGATGLKHMMGYDDSLDAFGVHGVGGILGALLTGVFAVKDIGGADGSLATQALGVGVTIVYCGVVTFILLKLVDIVLGLRVAEDEEREGLDLVLHGERVE

SEQ ID NO: 3956 - DNA, 1479 bp, Neurospora crassa
  CDS (1)..(1479)
atggccgagccagaaattgtgcctgtcaccgagtggccggactggcatgccaatcccaacggaggtgatcccttcacgcagaacctgaactcaccctatgacaagggcgacctatgctggatgctcgtgtgcactgccctatgctggcaaatcaccccggccattggcttcctctatgccggaatgcaccgcaggaaggcggctctgaccatggtcctccaaagtctcttctgtgcttgcgcttgcggaatccagttctggatatacggttactcactgtaccaggcacgaacaacaaaccccatcctcggagacttgtctttggccgtgttccgaaatgtgcttgctcagccatccatggccaactcggatattcctgatattctgtatgctgcctttggctttaccttcgtttcttgcactgccatgatcttggccggagccatgcttgaacgcggcaggctattgcccagtatgcttttcctcctctgctggactacttttgtttactacttcattgcatattgggagtggaaccctagcggatggttatacaaactcggtgtctacgatttcgccggctccggtcctgttcacatcgccagcggcttcggtgcccttgcctggtctctgatgctcggtccgcgtgtcgccgactcggacgtcgttgaccgtaagaaactcgttcaccacaagccccacagtccgctgttgatgtgcctcggaactgtcttcatctggtttggctggttcgccttcaatggcggcagtacacccaacctgagcctgcggtccatctacgccattgtcaacacgaatctggcaggatgcggaggtggcgtcggttgggtcttgatcgactatctctacaagagaaagttcagcttggttggcttttgctcgggtattattgcgggcttggtcggaattacccctgcagcgggttatgtccccgtctacgtagcctcgctcatcggcttcctcacctccgccacctgctactacgccgccaagtacaagcatctcctctctgttgacgacggtctcgacatttttgccattcacggcgtgggcggttacgtcggtgatcttttgacgggcatctttgccgacaactttgttcccgctctcgatggctattcaggcagctcctatgcagggggctggtggaaccgcaacttccgccagcttggacttcagttcgccggcgcaaccactgccgcggcctggtcctttgtggtgtcgtgtatcttgctgttcatcatcaacaagattcctggcttgcatctgcgcgcgagtgaggactcggaaatcaggggtctggatatcaagtacttggaggatgtggatgaggagggattttatatgaacgagtgtatactgcacgggcgtacgccgccgaggtgttctgggtcgttgaaggctcctacgtcggttacggagccggttggtgttgaaggaggtgaaaaaagggattag

SEQ ID NO: 3957 - protein, 492 aa, Neurospora crassa
MAEPEIVPVTEWPDWHANPNGGDPFTQNLNSPYDKGDLCWMLVCTALCWQITPAIGFLYAGMHRRKAALTMVLQSLFCACACGIQFWIYGYSLYQARTTNPILGDLSLAVFRNVLAQPSMANSDIPDILYAAFGFTFVSCTAMILAGAMLERGRLLPSMLFLLCWTTFVYYFIAYWEWNPSGWLYKLGVYDFAGSGPVHIASGFGALAWSLMLGPRVADSDVVDRKKLVHHKPHSPLLMCLGTVFIWFGWFAFNGGSTPNLSLRSIYAIVNTNLAGCGGGVGWVLIDYLYKRKFSLVGFCSGIIAGLVGITPAAGYVPVYVASLIGFLTSATCYYAAKYKHLLSVDDGLDIFAIHGVGGYVGDLLTGIFADNFVPALDGYSGSSYAGGWWNRNFRQLGLQFAGATTAAAWSFVVSCILLFIINKIPGLHLRASEDSEIRGLDIKYLEDVDEEGFYMNECILHGRTPPRCSGSLKAPTSVTEPVGVEGGEKRD

SEQ ID NO: 3958 - DNA, 1365 bp, Neurospora crassa
  CDS (1)..(1365)
atgacggtgtcacccgttcttgcagcctgggaggcttgcgacaagacagacactctcttcgtcctcatctgcaccgtcatctgctggaccattgtaccaactgtcggcatagcctactcaggatacacatggaagcgcaacgccctacacgccgccatgcccgccatcctcaccattgcgacttgctcgatccagtggttcattgttggatacacactagcctacggcgagggcggctggttctttggttccctcaagcacttctttcataaggatgtgctttccgagccggtaggaagaataccggccattttattcagcgagtttcagttggtttttgaggcaacggtttgtgcaattgctgtgggcggattctgcgagagggggaggctgttgccggttattccgttcatctttctgtgggcgacatttatctactgcccgctggcacatatggtctggggcggaggcttgcttggagagaatttaggcgtgctggactttgcaggaggaactcccgtccacgtctgctccggcgccaccgcgaccgccatcagcatctacctctcctacccgctcttccgctcgcgcaagtccgacgtgcgtacgcccacccacatccgcatccaccgaccgggtaactctttcttccagcttctgtccttaatcatcatctggggctcctggctcgccttcgatgcgggaaccaccctggccctcaacttccagtccgtcatggccctctgcgtcaccaacttgtgcgccgcctcgggcgcactgacctggaacctcatcaccttctacgagacgggcaagtggtccgtcgattcgaccttcatgggcgccatttccggtcttgtcatgatcaccccctcggctgggttcatcgacatgccgaccgcctgtttctttggtatttttggggctgtgctctgtcgtcaggcgttgaggatcaagttcaccaagtttgcgcatcattggaggtgggttgacaatggtgatacgtttgcgacgcactgcattggtggtgtggctgcaaccattatgacgggactgtttgcgcagaaggagctcgctgcgtatggtggtgtggaggttgcgggtggtgtcatcttcgatggcaatattcgtcaactttgggtgcagatggttgaggctgttgttggtttcacatgggcgttttgcgggtcgtatatcattattgctttgattgattgcgttcctgggcttgaggttttggctgttgataaacacattagccaaggccttgatatgaacgaggttgaagagtttttgggtaacttggagtatcctgatgaagttgactatgcaccaactgcaaggggaaccatttctctggaataa

SEQ ID NO: 3959 - protein, 454 aa, Neurospora crassa
MTVSPVLAAWEACDKTDTLFVLICTVICWTIVPTVGIAYSGYTWKRNALHAAMPAILTIATCSIQWFIVGYTLAYGEGGWFFGSLKHFFHKDVLSEPVGRIPAILFSEFQLVFEATVCAIAVGGFCERGRLLPVIPFIFLWATFIYCPLAHMVWGGGLLGENLGVLDFAGGTPVHVCSGATATAISIYLSYPLFRSRKSDVRTPTHIRIHRPGNSFFQLLSLIIIWGSWLAFDAGTTLALNFQSVMALCVTNLCAASGALTWNLITFYETGKWSVDSTFMGAISGLVMITPSAGFIDMPTACFFGIFGAVLCRQALRIKFTKFAHHWRWVDNGDTFATHCIGGVAATIMTGLFAQKELAAYGGVEVAGGVIFDGNIRQLWVQMVEAVVGFTWAFCGSYIIIALIDCVPGLEVLAVDKHISQGLDMNEVEEFLGNLEYPDEVDYAPTARGTISLE

SEQ ID NO: 3960 - DNA, 1533 bp, Neurospora crassa
  CDS (1)..(1533)
atgtcgtattcatggttcggggcccctacccctttcaatggcacgacgcccaacggcggtgattccgcctccgaaaacctcaaccaatggtaccagtcaggcgaccaggcttttattctagttgcatcatgcatggtcctcatcatgattcccggcatcgccttcctctactccggccttgcccgtagaaagtcagctctatcactcatttgggtgtgcatgatgtcttccagtgttgtcatgtttcaatggtacttctggggctactcattggcgctcagcagcacagcgaccaacggctttattggcaacctgcgacactttggtctcatgaacacactcggtgcaccttctcccggctctaatctcattcctgagctactctatgctttctaccagatgcaattcgtcggcgtcaccgcagcccttgttgttggggccaccgccgaacgcggtcgcgttgtcccagcaatggtcttcatctttatctgggcaacactggtctactgccctctctgttgctgggcttggaacgtcaacggttgggccttcaagtacggagtgatggattatgctggtggtggtcccgtcgaaattggatccggtgtctcggctctggcttattcttgggttctcggccgacgtaacgagaagatgatgctcaactttcgcccacacaacatctccctgatcaccattggtacggtcttcctttggttcggctggctcggcttcaacggcggatctgcttttggcgccaaccttcgcgccgccatggcgtgctggaattcgtgtctcacagccatgttcgcggccatgacctggacccttctcgattaccgtctggccaagaagtggtcgctcgtcggctggtgttccggtaccatttcgggtctcgtcgccgctactcctgcttccggttatatccctccttgggccagcatcattctcggagttgttactggaattgtttgtaacttcggcactaagatcaagttcatgattggcatcgacgacgctctcgatatattcgctgaacacgctcttggaggcgttgtgggtctgatcttcaacggtttctttgctgccgattacatcattggcttggatggcgtcaaccaggaaatccccggcggcttcctcaaccacaactataagcagttgtacattcagatcgcctatgtttgcgccacaatgggatattctttcgtcatgtctgctatcctcgccaagggcgtcgacatgatcccaggtctacacctccgcgcttccgaagaagccgagctcctcggcatggatgatgaccagcatggcgagtttgcttacgactacgttgaggttcgccgcgattacctggcatggacaccagcagagaaagagcagaggcaagacggcgacatcatcgtccctcagcacggcatcgaagggcatcaggagctgttgagcagctctcgccacggacccaccatgtccgaactcccacaccatgaagaggaggatccgcgagagaagaggggctcgacctcagaataa

SEQ ID NO: 3961 - protein, 510 aa, Neurospora crassa
MSYSWFGAPTPFNGTTPNGGDSASENLNQWYQSGDQAFILVASCMVLIMIPGIAFLYSGLARRKSALSLIWVCMMSSSVVMFQWYFWGYSLALSSTATNGFIGNLRHFGLMNTLGAPSPGSNLIPELLYAFYQMQFVGVTAALVVGATAERGRVVPAMVFIFIWATLVYCPLCCWAWNVNGWAFKYGVMDYAGGGPVEIGSGVSALAYSWVLGRRNEKMMLNFRPHNISLITIGTVFLWFGWLGFNGGSAFGANLRAAMACWNSCLTAMFAAMTWTLLDYRLAKKWSLVGWCSGTISGLVAATPASGYIPPWASIILGVVTGIVCNFGTKIKFMIGIDDALDIFAEHALGGVVGLIFNGFFAADYIIGLDGVNQEIPGGFLNHNYKQLYIQIAYVCATMGYSFVMSAILAKGVDMIPGLHLRASEEAELLGMDDDQHGEFAYDYVEVRRDYLAWTPAEKEQRQDGDIIVPQHGIEGHQELLSSSRHGPTMSELPHHEEEDPREKRGSTSE

SEQ ID NO: 3962 - DNA, 1473 bp, Synechococcus sp. (strain WH8102)
  CDS (1)..(1473)
atgacaactgcattccactcgcctaccagtaggcgccgaaaaacattgcaggaggccaacctcctcgaaggtccgttgatgctgattaagagcatccggggcttcagctccaaccgtgccatgacctggctcgcctgcgctccactggcgctgatgggtctcggcattttcactctctcagcaaaagccgaagagctgccagatctcaatgcagccttcctcgccaacaacctctggctgctggtggccaccatcctggtgatcttcatgaacgccggcttcgccatggtggaagccggcatgtgccgccaaaaaaatgccgtcaatattctcgccaagaacctgttcgtcttcgccctggcggtaaccgcctactggtttgttggctattccttcatgtacggagacgccgccatcgatggctggctgtatttcggggggctcttcttcgatccaaccgtcaccgctgaaaccatcagcgacgctggcctggttcccactgttgatttcctcttccaggctgctttcgccgggacagcagccacgattgtttccggtcttgtggctgagcggatcaagttcggcgaattcgtggtcttcgccctgatcctcactgcctttatttaccctgttgcaggcagctgggaatggaatggcggctggctcaacagcgtcggcaatgccgaattcattgactttgccggttcttcgatcgtgcactccgtcggtgcctgggctggccttgtgggtgctgcactgcttggaccccgcatcggcaaatacgtcggcggcaatgtgcaggccatccctggccacaacatgtccatcgcaaccctcggcgcgctgatcctctggatcggctggtacggcttcaaccccggctcccaactggccatggatcagtgggtcccctacgtggctgtcaccaccaccctcggcgctgccggcggtgccatcggcgccacggtgatctccacgatcacctccaaaaagcctgacctcaccatgatcatcaacggcatcttggccggcctggtgagcgtgaccgccggttgcggcaacctcaccctgactgggtcctgggttgccggcttggtgggcggcatcatcgtcgtcttctcggtgtctgctcttgactctgcgggcatcgatgatcccgtcggcgccttctccgtccatggagtctgcggcgtctggggcaccctggtgatcggtctttggggtttcgacgttcagggtgatggatcccccctcggccttctggtcggcggtggtattgaacaactcggcatccaagctttgggtaccgctgcttacgccatctggaccgttgtgacctgcttcatcgcctggcaaatcatcggtgctctcttcggtggcatccgcgttaccgagcaggaagagaccgaaggtctggacatcggcgagcacggcatggaggcctacgccggcttctccaccaccaataactga

SEQ ID NO: 3963 - protein, 490 aa, Synechococcus sp. (strain WH8102)
MTTAFHSPTSRRRKTLQEANLLEGPLMLIKSIRGFSSNRAMTWLACAPLALMGLGIFTLSAKAEELPDLNAAFLANNLWLLVATILVIFMNAGFAMVEAGMCRQKNAVNILAKNLFVFALAVTAYWFVGYSFMYGDAAIDGWLYFGGLFFDPTVTAETISDAGLVPTVDFLFQAAFAGTAATIVSGLVAERIKFGEFVVFALILTAFIYPVAGSWEWNGGWLNSVGNAEFIDFAGSSIVHSVGAWAGLVGAALLGPRIGKYVGGNVQAIPGHNMSIATLGALILWIGWYGFNPGSQLAMDQWVPYVAVTTTLGAAGGAIGATVISTITSKKPDLTMIINGILAGLVSVTAGCGNLTLTGSWVAGLVGGIIVVFSVSALDSAGIDDPVGAFSVHGVCGVWGTLVIGLWGFDVQGDGSPLGLLVGGGIEQLGIQALGTAAYAIWTVVTCFIAWQIIGALFGGIRVTEQEETEGLDIGEHGMEAYAGFSTTNN

SEQ ID NO: 3964 - DNA, 1590 bp, Rhodopirellula baltica
  CDS (1)..(1590)
atggcggaaattacgcttcatccaccatcatccccatcgacttttcactggagcctgcccggaatgttgtcacgcgtgttggttgtcgtttgtttgctcacgtgcattctcggtgtgcccctggtcggcctgccggttgccagtgtgggggctcaggacgaggtcgcaaatacctcggcggctgagactgcaccggccgaaccgtcggcttcggcggaggaaattgccccggcggaggaaaacgaagcagccgaggagccggccgctccgacattggaaagcctgcaagcgggagtcgatgaggctttgctggccggacacaacggttggatgctggtttgttgtgctttggtgttgttcatgaccgcaccaggcctggcgatgttctacggtggtttggtgcgtcgcaaaaatgttctcagcgtgatgatgcagtgcatcttcttgatgggaatgatgacggtgctttgggcactctacggttactcgtttgccttcggtggatcaggcggttggttcggcaacacggactacttgttcatggaaggtgtccagcggtactgggacgatgacttgggcaaagccatcacgccgatggaaggcgcgatgacgcgaatgactcacatgttgttccaaggcatgttcttcatcatcacgcccgctctgatctgcggtgcattcgcggaacggatgaagtttagcgcgatggtggttttctcgatcctttggggaacattcatctattgcccactgacccactgggtttgggacgaaggacctttgtcgtactttgccggtgacaaagccttggccgggggagcactcgactttgcgggtgggacggttgttcacatcagcagcgggatctcggctttggtcgcggcgttgctgatcggtcctcgaatggggtacccacgcgaacctttgcaaccgcacaacttgacctacacggcacttggtgccgcgatgttatgggtgggatggttcggcttcaacgccggcagtgaacttgcatcggatgatttgacagccagtgctttcgccgtgactcacttttcggccgccgccggggcggttgcttgggtgacacttgaatggctggtccttggcaagccgaccgttctgggcgccagcagtggtgcggtcgccggattggtttgcatcacaccggccgctggatttgttcagcccatgccagctttgatcatgggagcgatggcgggcggagtttgttattgggcgtgttcgacgctgaagcacaaacttcgttatgacgatgctttggatgcgtttggcgtccacggagtcggcggcacactcggcgcaattctgaccggcgttttcgcgactcgtgcggcctgggatgtcagcgatggtgtgccaatcggattgatcgaatcgggcggtgacttcaccttggtcatcgggcaggttgtcgccgtgctggtcacctacgtgttcgccggagtcggaagtctgatcctgctgaagctgatcgacatctgcatcggactgcgagttcctgccgaaagcgaacagcgtggtttggacatttcagatcacggcgaagaaggttatcagttcgcctga

SEQ ID NO: 3965 - protein, 529 aa, Rhodopirellula baltica
MAEITLHPPSSPSTFHWSLPGMLSRVLVVVCLLTCILGVPLVGLPVASVGAQDEVANTSAAETAPAEPSASAEEIAPAEENEAAEEPAAPTLESLQAGVDEALLAGHNGWMLVCCALVLFMTAPGLAMFYGGLVRRKNVLSVMMQCIFLMGMMTVLWALYGYSFAFGGSGGWFGNTDYLFMEGVQRYWDDDLGKAITPMEGAMTRMTHMLFQGMFFIITPALICGAFAERMKFSAMVVFSILWGTFIYCPLTHWVWDEGPLSYFAGDKALAGGALDFAGGTVVHISSGISALVAALLIGPRMGYPREPLQPHNLTYTALGAAMLWVGWFGFNAGSELASDDLTASAFAVTHFSAAAGAVAWVTLEWLVLGKPTVLGASSGAVAGLVCITPAAGFVQPMPALIMGAMAGGVCYWACSTLKHKLRYDDALDAFGVHGVGGTLGAILTGVFATRAAWDVSDGVPIGLIESGGDFTLVIGQVVAVLVTYVFAGVGSLILLKLIDICIGLRVPAESEQRGLDISDHGEEGYQFA

SEQ ID NO: 3966 - DNA, 1479 bp, Prochlorococcus marinus (strain MIT 9313)
  CDS (1)..(1479)
atgacaactgctccgcttccgcgctccaggcggcgcacggtacgcctccaggaggccagcctcctggaggggccaatgctcctcctgcgcagcatccgtggcttcagctccaatcgctcactgacgtggctggcttgcgtgcccttggctctcttcggcctaggactcttcaacctctcggcccatgccgccgagatgccagaactgaatgctgccttcctagccaacaatctctggcttctggttgcaacgattctggtgatcttcatgaatgccggcttcgcgatggtcgaagcaggaatgtgtcgtcaaaaaaacgcggtcaacattctcgccaaaaacctatttgtctttgccctagcggtatcgtcgtactggttcatcggctattcgctgatgtacggcgatcctgtttcggcaggatggctctatttcaacggcctgttctttgatcctgctgtaacccctgaactgatcagcgaagcaggtcttgtcccaagcgtcgacttcctcttccaagcagcctttgcaggcacagctgcaactatcgtctcaggactcgtggcagagcgcgtcaagttcggcgagttcgtggtgttctccctagtgctaactggtttcatttacccaatcgctggcagctgggaatggaacgggggctggctcaacactgcctttggcgaaggcgttgaattcattgatttcgcaggctcctcgatcgttcactctgtcggtgcctgggcaggtctggtgggagcaatgctgctcggtccgcgcatcggcaaatttgtcggtggcaaggcccaagcgattccaggacacaacatgtccatcgccacccttggcgctctaatcctctggatcggctggtatggctttaatcccggttcccagctcgccatggatcaatgggtcccctacgtggctgtaacaaccacactcgcagctgcaggtggcgccatcggcgcaacgatcatttccaccctctgctccggcaagcctgatctaacgatgatcatcaacggcatccttgccggcctagtgagcattacagctggttgtggcaatctcacgctggtaggggcctgggttgcaggcctaatcggtggtttcattgtggtgttctcggtctcagcccttgactctttaggcatcgacgatccagttggagctttctctgtccacggcatctgtggcatctggggaaccctcgtgatcggcctatggggctttgacatccaaggtgatggttccgcccttgggctattcgttgggggtggcgcaagtcagctttgggctcaatttgtaggctgcgctgcctacgccatctggaccgtggtgacctgttggattgcctggtctgtcatcggagcactgtttggcggtatccgcgtaacagaggctgaggaaatcgaaggtcttgatatcggtgagcacggtatggaggcttatcccgacttcgcctcagccggcaactaa

SEQ ID NO: 3967 - protein, 492 aa, Prochlorococcus marinus (strain MIT 9313)
MTTAPLPRSRRRTVRLQEASLLEGPMLLLRSIRGFSSNRSLTWLACVPLALFGLGLFNLSAHAAEMPELNAAFLANNLWLLVATILVIFMNAGFAMVEAGMCRQKNAVNILAKNLFVFALAVSSYWFIGYSLMYGDPVSAGWLYFNGLFFDPAVTPELISEAGLVPSVDFLFQAAFAGTAATIVSGLVAERVKFGEFVVFSLVLTGFIYPIAGSWEWNGGWLNTAFGEGVEFIDFAGSSIVHSVGAWAGLVGAMLLGPRIGKFVGGKAQAIPGHNMSIATLGALILWIGWYGFNPGSQLAMDQWVPYVAVTTTLAAAGGAIGATIISTLCSGKPDLTMIINGILAGLVSITAGCGNLTLVGAWVAGLIGGFIVVFSVSALDSLGIDDPVGAFSVHGICGIWGTLVIGLWGFDIQGDGSALGLFVGGGASQLWAQFVGCAAYAIWTVVTCWIAWSVIGALFGGIRVTEAEEIEGLDIGEHGMEAYPDFASAGN

SEQ ID NO: 3968 - DNA, 1509 bp, Prochlorococcus marinus
  CDS (1)..(1509)
atgaccactgctttgcaatcgccgccaaggcgtcgcattgcccgccttcaagaagtcagtcttcttgaagggccaatgcttctcctccgtagcattcgtggatttcgatccaatcaatccttgatttggttggcaacagttccattggcacttttaggcttaggggtttttgggtttgctgctcgtgcaggcgtaggactatctgatttatcaggcgctcaagctgcgagcttcttggcagataacctatggctttttatagcaacgatccttgtaatttttatgaatgctggcttcgcaatggttgaagctgggatgtgtcgtcaaaagaatgcagtgaacattttggccaaaaacctttttgtttttgctcttgctgtaactgcttattggttcattggttattccataatgtatggaggaactccaattattggtggagtaattttttctaatggctttttcttcaaccctgatccgtcagatgcacttagttgtgccgctggattaggagctgatggatgtagtcaattagtccctgcagtagacttcctctttcaggctgcttttgcaggtacagcagcaactattgtttctggtcttgtagcagagagagtgaagtttggagaatttgttgttttctcgctagtccttactgctttcatatatccaattgctggtagttggcagtggaatggcgcaggttggttatcgcagttaggtttcattgattttgcgggctcttcaattgtccactcagttgggggatgggctggtcttgtaggagcaatgcttcttggaccaagaattggcaaatttgttgatgggaagccccaagcaatgccagggcacaacatggcaatcgcaactcttggtgctctgatcctttggattggttggtatggctttaacccaggttcagagttggctatggatgaatatgtagcttacgttgcagttacaacaactcttgcagcagctggtggagctattgcagctacattgctttctactcttacttccggcaagccagatctaacaatgatcattaatggaatattggctggtcttgtaagcattactgctggctgtggaaacatgacactttctggatcttggcttgcaggatttgttggaggcttaatagttgttttcgcagtttctgctttggattcagctggaatagatgacccagttggagctttctcagttcacggtgtatgcggcgtttggggaacagttgttattggtctctggggcgttgatggaatggatccaggagcagctgggattggcttgtttaatgggggaggactaaacactttgcttattcaggcacttggagcaggtgcttatgcaatatggacagtagtaacctgttggctagcttggactgttattggtggtttcttcggtggcattcgtgttagtgaggaggaagagattcaaggtcttgatataggtgaacatggtatggaggcatatccagacttcgcttcatctaattaa

SEQ ID NO: 3969 - protein, 502 aa, Prochlorococcus marinus
MTTALQSPPRRRIARLQEVSLLEGPMLLLRSIRGFRSNQSLIWLATVPLALLGLGVFGFAARAGVGLSDLSGAQAASFLADNLWLFIATILVIFMNAGFAMVEAGMCRQKNAVNILAKNLFVFALAVTAYWFIGYSIMYGGTPIIGGVIFSNGFFFNPDPSDALSCAAGLGADGCSQLVPAVDFLFQAAFAGTAATIVSGLVAERVKFGEFVVFSLVLTAFIYPIAGSWQWNGAGWLSQLGFIDFAGSSIVHSVGGWAGLVGAMLLGPRIGKFVDGKPQAMPGHNMAIATLGALILWIGWYGFNPGSELAMDEYVAYVAVTTTLAAAGGAIAATLLSTLTSGKPDLTMIINGILAGLVSITAGCGNMTLSGSWLAGFVGGLIVVFAVSALDSAGIDDPVGAFSVHGVCGVWGTVVIGLWGVDGMDPGAAGIGLFNGGGLNTLLIQALGAGAYAIWTVVTCWLAWTVIGGFFGGIRVSEEEEIQGLDIGEHGMEAYPDFASSN

SEQ ID NO: 3970 - DNA, 1497 bp, Oryza sativa (Rice)
  CDS (1)..(1497)
atggcgacgtgcgcggcggacctggcgccgctgctggggccggtggcggcgaacgcgacggactacctgtgcaaccggttcgccgacacgacgtcggcggtggacgcgacgtacctgctcttctcggcgtacctcgtgttcgccatgcagctcgggttcgcgatgctctgcgccgggtcggtgcgggccaagaacacgatgaacatcatgctcaccaacgtgctcgacgccgcggccggggcgctcttctactacctcttcggcttcgccttcgccttcggcacgccgtccaacggcttcatcgggaagcagttcttcggcctcaagcacatgccgcagaccgggttcgactacgacttcttcctcttccagtgggccttcgccatcgccgccgccgggatcacgtcgggctccatcgccgagaggacgcagttcgtcgcctacctcatctactccgccttcctcaccgggttcgtctacccggtggtgtcccactggatctggtccgccgatgggtgggcctctgcctcccgcacgtccggacctctgctgttcggctccggtgtcatcgacttcgccggctccggcgtcgtccacatggtcggcggtgtcgccgggctctggggcgcgctcatcgagggcccccgcatcgggaggttcgaccacgccggccgatcggtggcgctcaagggccacagcgcgtcgctcgtcgtgcttggcaccttcctgctgtggttcggctggtacggattcaaccccgggtcgttcaccaccatcctcaagacgtacggcccggccggcggcatcaacgggcagtggtccggagtcggccgcaccgccgtgacgacgaccctggccggcagcgtggcggcgctcaccacgctgttcgggaagcggctccagacggggcactggaacgtggtcgacgtctgcaacggcctcctcggcgggttcgccgccatcaccgccgggtgcagcgtcgtcgacccgtgggccgcgatcatctgcgggttcgtctcggcgtgggtgctcatcggcctcaacgcgctcgccgcgcgcctcaagttcgacgacccgctcgaggccgcccagctccacggcgggtgcggcgcgtgggggatcctcttcaccgcgctcttcgcgaggcagaagtacgtcgaggagatctacggcgccggccggccgtacggcctgttcatgggcggcggcggcaagctgctcgccgcgcacgtcatccagatcctggtcatcttcgggtgggtcagctgcaccatgggacctctcttctacgggctcaagaagctcggcctgctccgcatctccgccgaggacgagacgtccggcatggacctgacacggcacggcgggttcgcgtacgtctaccacgacgaggacgagcacgacaagtctggggttggtgggttcatgctccggtccgcgcagacccgcgtcgagccggcggcggcggctgcctccaacagcaacaaccaagtgtag

SEQ ID NO: 3971 - protein, 498 aa, Oryza sativa (Rice)
MATCAADLAPLLGPVAANATDYLCNRFADTTSAVDATYLLFSAYLVFAMQLGFAMLCAGSVRAKNTMNIMLTNVLDAAAGALFYYLFGFAFAFGTPSNGFIGKQFFGLKHMPQTGFDYDFFLFQWAFAIAAAGITSGSIAERTQFVAYLIYSAFLTGFVYPVVSHWIWSADGWASASRTSGPLLFGSGVIDFAGSGVVHMVGGVAGLWGALIEGPRIGRFDHAGRSVALKGHSASLVVLGTFLLWFGWYGFNPGSFTTILKTYGPAGGINGQWSGVGRTAVTTTLAGSVAALTTLFGKRLQTGHWNVVDVCNGLLGGFAAITAGCSVVDPWAAIICGFVSAWVLIGLNALAARLKFDDPLEAAQLHGGCGAWGILFTALFARQKYVEEIYGAGRPYGLFMGGGGKLLAAHVIQILVIFGWVSCTMGPLFYGLKKLGLLRISAEDETSGMDLTRHGGFAYVYHDEDEHDKSGVGGFMLRSAQTRVEPAAAAASNSNNQV

SEQ ID NO: 3972 - DNA, 1557 bp, Lotus japonicus
  CDS (1)..(1557)
atggcttctctctcttgctcagccacagacctcgctccactcttaaccgccacaaccaacgcaaccgcaaccgccgccgccacctacctctgcaaccagctcgatacaatctccaggaagctcagcgacaccacctatgccgttgacaacacctacctcctcttctcagcttatctagtcttcgccatgcagctcggttttgccatgctctgcgccggctccgtccgagccaaaaacaccatgaacatcatgctaaccaatgttcttgatgcagcagccggcggcctatcctactacctcttcggcttcgcgttcgccttcggagccccctccaacggcttcatcggccgccacttcttcggcctcaaacactacccttcgcccacctacgactacagcttcttcctctaccagtgggccttcgccatcgccgctgccggaatcaccagcggctccatcgccgagaggacacaattcgtcgcctacctcatctactcctctttcctaaccggctttgtctacccggtcgtctcgcactggctctggtcctcggacggctgggccagccccacccgcaccactggcagcttactattcggatccggcgcgattgatttcgctggatccggagtagtccacatggtcggtggcatagcaggactatggggcgcgttcatcgaaggccctagaatcggccggttcgaccgaaccggccgatccgtagccttacgtggacacagtgcgtccctagttgtcctcggttcgtttctactatggttcggttggtacgggttcaaccccggttcatttctcaccatagcaaaagcctacggtaacaacggcgaaaacggtaattactacggtcagtggagcgcgatagggagaacagcggtcacaaccacattggctggatgcactgcggcactcaccacgcttttcagcaaacggttattggagggccactggaaagtgcttgacgtgtgtaacggcctgctcggcggtttcgccgccatcacctccggttgctccgtcgtcgagccgtggccggcgattgtctgcggttttgtggcagcgtgggtgctgatcgggctcaatttggttgcggcgaaaatgaagtacgacgatcctctggaggcggcgcagcttcacggcgggtgcggcgcgtggggggttttattcacggggctgtttgcgaagggggagtacgtggcggaggtttacggcagcgctgggaggccgtacgggttgttaatgggtggcggagggaagttgctggcggcgcaggtgattgagatattggtggtgtgtgggtgggttacggcgacgatggggccgttgttctatgggcttcataagacgaaacttttgaggatttctgaagatgatgagactgcggggatggatttgacgaggcatggtgggtttgcttatgcttaccatgatgatgatgatgtgtccaccaagagaggggtcatgatgagtaggattgggcctggtagtagttctccctccaccatgaacacgccggcggcgagcgccgccgccaatgactgttga

SEQ ID NO: 3973 - protein, 518 aa, Lotus japonicus
MASLSCSATDLAPLLTATTNATATAAATYLCNQLDTISRKLSDTTYAVDNTYLLFSAYLVFAMQLGFAMLCAGSVRAKNTMNIMLTNVLDAAAGGLSYYLFGFAFAFGAPSNGFIGRHFFGLKHYPSPTYDYSFFLYQWAFAIAAAGITSGSIAERTQFVAYLIYSSFLTGFVYPVVSHWLWSSDGWASPTRTTGSLLFGSGAIDFAGSGVVHMVGGIAGLWGAFIEGPRIGRFDRTGRSVALRGHSASLVVLGSFLLWFGWYGFNPGSFLTIAKAYGNNGENGNYYGQWSAIGRTAVTTTLAGCTAALTTLFSKRLLEGHWKVLDVCNGLLGGFAAITSGCSVVEPWPAIVCGFVAAWVLIGLNLVAAKMKYDDPLEAAQLHGGCGAWGVLFTGLFAKGEYVAEVYGSAGRPYGLLMGGGGKLLAAQVIEILVVCGWVTATMGPLFYGLHKTKLLRISEDDETAGMDLTRHGGFAYAYHDDDDVSTKRGVMMSRIGPGSSSPSTMNTPAASAAANDC

SEQ ID NO: 3974 - DNA, 1233 bp, Bacillus cereus (strain ATCC 14579 / DSM 31)
  CDS (1)..(1233)
atgaatatgggagatacagtttttatgtttgtgacgacagtaatggtcatgttgatgacaccaggattggcacttttttatggaggtatggttcgcagcaaaaatgtactcagtacaacgatgcatagttatagtgcaatggctatcgtttcgattcaatggattgttatcggctattctttatcattcggaccagattggcacgggcttattggtacacttgattggttcggtctaaacggagttacctacgcaccaaatccagactactcatctactattcctcacaatttattcatgatgtttcaactcatgttcgccattttaactccagctttaatttcaggtgcatttgctgaaagaatgcgattttctgcctttcttatttttatccttttatggacaacgattgtttacaatcctgtcgctcattgggtatggggcgtcggcgggtggctaagggaatttggtgcactagacttcgctggcggaaacgtcgttcacatcacttccggagttgctggtcttgtattagctattttcctcggaaaacgaaaaaacataaatggttcttctcctcaccatttgccatttacaatgttaggcgcaggcttattatggtttggctggttcggttttaacgtcggcagcgcattatccttaaacgacgtagctttaactgcatttattaatacaaatatagccgctgctgcctcagcattaacttggatgctttcagagtggttcttccaatcaaaaccgactgcgatgggagctgcttgtggcgccgtttccggtctagtcgctattacaccagcttgcgggttcgttacacctttctcagctcttcttatcggagcaattggcggcgtattatgcttcggagcggtctttttcttaaaaacaaaattcggatacgacgatacactcgatgcattcggatgtcacggcatcggtggaacttggggcggtattgcgacaggattatttgcaactactgccgtaaacggcgatggcgctaacggattattttacggaaacgcctcgctgctgttgaaacaacttgtagcgatcggcgcaacatatgcgttcacaattataatgacgtatgccattattaaagcaatcaacttcttcctccctgtccgggtagatgagcacgaggaacatatgggacttgatatttcgatgcacggggagaaagcttatgagtatactgagcgagtgaactaa

SEQ ID NO: 3975 - protein, 410 aa, Bacillus cereus (strain ATCC 14579 / DSM 31)
MNMGDTVFMFVTTVMVMLMTPGLALFYGGMVRSKNVLSTTMHSYSAMAIVSIQWIVIGYSLSFGPDWHGLIGTLDWFGLNGVTYAPNPDYSSTIPHNLFMMFQLMFAILTPALISGAFAERMRFSAFLIFILLWTTIVYNPVAHWVWGVGGWLREFGALDFAGGNVVHITSGVAGLVLAIFLGKRKNINGSSPHHLPFTMLGAGLLWFGWFGFNVGSALSLNDVALTAFINTNIAAAASALTWMLSEWFFQSKPTAMGAACGAVSGLVAITPACGFVTPFSALLIGAIGGVLCFGAVFFLKTKFGYDDTLDAFGCHGIGGTWGGIATGLFATTAVNGDGANGLFYGNASLLLKQLVAIGATYAFTIIMTYAIIKAINFFLPVRVDEHEEHMGLDISMHGEKAYEYTERVN

SEQ ID NO: 3976 - DNA, 1311 bp, Streptomyces avermitilis
  CDS (1)..(1311)
atgaccctggccgccgcccggatcgacaccggcgacaccgcatggctgctcgccgccaccgcgctcgttctcctgatgacccccggcctggccctgttctacggcggcatggtccgcacgaagagcgtcctcaacatgctgatgatgagcttcgtgtcgatcgccctggtcacggtcgtgtggctggccgccggctactcgctcgcgttcggcgacgacctcgcgggcggactcatcggcggcctggaccacgccggcctggcggacctcggtcccgccgacgtccacggcacggtccccaccctcctcttcgccaccttccagctcaccttcgcgatcatcaccgccgccctcatcagcggcgccatcgcggaccgggcgaaattcgcggcctggctggtcttcgtccccctctgggcgctgctcgtatacgttcccgtcgcccactgggtgtggggccccggcggctggatcctcgaccgcctcggcgccctcgatttcgcgggcggactccccgtcgagatcacgtcgggcgcctcgggcctggccctgtgcctggtcctcgggccgcgcctcggcttcaagaaggacgccatgcgcccgcacaacctgccgatggtgatgctgggcgccggtctgctgtggttcggctggttcggcttcaacgcgggttcggcgctcggcgccaacggactggccgccgcggccttcctcaacacgctcgccgccggctgcaccggcctgctcggctggctcttcgtggagcagaagcgcgacggccacccgaccacgctgggcgccgcctccggcgcggtcgcgggcctggtcgccatcaccccgtcctgcggcgcggtctccctgctcggcgcgctggtcgtggggctcgccgccggtgtcgtctgctcgtacgccgtgggctggaagttcaagctgaactacgacgactcgctggacgtcgtcggcgtccacctggtcggcgggatcatcggcaccctgctgatcggggtcttcgcggccaaggagatgacgggcggcaccgagggcctgctctacggcggcgggctcggacagctcggcaagcagctggtggcggtcgtggccgtgggggcgtacgccttcgccgtcacctacggcctcgggaagctgatcgacaaggtcatgggcctgcgggcggccgaggacgacgagcaccagggcctggaccttacggtgcacgccgagaccgcttacgatcacgggattctggggcacggcgccccaagctccgcgtccgtcgtccccaccgcgcagaaggtcaagagccaggcatga

SEQ ID NO: 3977 - protein, 436 aa, Streptomyces avermitilis
MTLAAARIDTGDTAWLLAATALVLLMTPGLALFYGGMVRTKSVLNMLMMSFVSIALVTVVWLAAGYSLAFGDDLAGGLIGGLDHAGLADLGPADVHGTVPTLLFATFQLTFAIITAALISGAIADRAKFAAWLVFVPLWALLVYVPVAHWVWGPGGWILDRLGALDFAGGLPVEITSGASGLALCLVLGPRLGFKKDAMRPHNLPMVMLGAGLLWFGWFGFNAGSALGANGLAAAAFLNTLAAGCTGLLGWLFVEQKRDGHPTTLGAASGAVAGLVAITPSCGAVSLLGALVVGLAAGVVCSYAVGWKFKLNYDDSLDVVGVHLVGGIIGTLLIGVFAAKEMTGGTEGLLYGGGLGQLGKQLVAVVAVGAYAFAVTYGLGKLIDKVMGLRAAEDDEHQGLDLTVHAETAYDHGILGHGAPSSASVVPTAQKVKSQA

SEQ ID NO: 3978 - DNA, 1341 bp, Streptomyces avermitilis
  CDS (1)..(1341)
atggcaccagccatcacgcttgccgcagaggctcccaagctgtctgccgccaacacaggcttcatgctcatctgttccgccttggtactgatcatgaccccgggcctggccttcttctacggaggcatggtccgcgtcaagagcactctgaacatgctcatgatgagcttcatcagcatgggcatcgtcaccatcctgtgggtgctgtacggcttctcgctcgccttcggtaccgacaagggttcgctcatcggctggacgtccgacttcgtcggcttcaccgggatcggcaaggtggagctctggcccggttacaccattccggtctatgtcttcgccaccttccagctgatgttcgcgatcatcacgcccgccctgataagcggagccctggccgaccgcgtcaagttcaccgcctggtccctgttcgtcgccctgtgggccacggtcgtgtacttcccggtcgcgcactgggtgtggggcaccggtggctgggccttcgacctcggcgtgatcgacttcgccggtggtacggcggtccacatcaacgcgggtgccgcggcgctcggcgtcatcctggtcatcggcaaacgcgtcggcttcaagaaggacccgatgcgcccgcacagcctgccgctggtcatgctcggctgcggcctgctgtggttcggctggttcggattcaacgcaggctcgtggctcggcaacgacgacggtgtcggcgcgctgatgttcatcaacacgcagatcgccaccgccgctgcgatgctcgcctggctcgcgtacgagaagatccgccacggcgcgttcaccaccctcggtgccgcctccggcgcggtcgcgggcctggtcgccatcaccccgtccggtggcgcggtctccccgctcggcgcgatcgccgtcggcgccatcgccggtgtcctgtgcgccatggccgtgggcctgaagtacaagttcggctacgacgactccctcgacgtcgtcggcgtccacctcgtcggcggtgtcgcgggctccctgctcatcggcttcttcgccagcggcggcggccagtccgacgcgacgggcgtcttctacggcgaccactccttcgaccagctgtggaagcagtgcgccggagtcttcgcggtcctcgcctactccctggtcgtctccgcgatcctcgccttcctgatcgacaagacgatcgggatgcgggtttccgaggacgaggagatcgccggcatcgaccaggcggagcacgccgagaccgcatacgacttcagcggagcgggcggcggcgcggcccggatcctccccgcccctctcgcggacacggcgaccaagaaggtggacgcatga

SEQ ID NO: 3979 - protein, 446 aa, Streptomyces avermitilis
MAPAITLAAEAPKLSAANTGFMLICSALVLIMTPGLAFFYGGMVRVKSTLNMLMMSFISMGIVTILWVLYGFSLAFGTDKGSLIGWTSDFVGFTGIGKVELWPGYTIPVYVFATFQLMFAIITPALISGALADRVKFTAWSLFVALWATVVYFPVAHWVWGTGGWAFDLGVIDFAGGTAVHINAGAAALGVILVIGKRVGFKKDPMRPHSLPLVMLGCGLLWFGWFGFNAGSWLGNDDGVGALMFINTQIATAAAMLAWLAYEKIRHGAFTTLGAASGAVAGLVAITPSGGAVSPLGAIAVGAIAGVLCAMAVGLKYKFGYDDSLDVVGVHLVGGVAGSLLIGFFASGGGQSDATGVFYGDHSFDQLWKQCAGVFAVLAYSLVVSAILAFLIDKTIGMRVSEDEEIAGIDQAEHAETAYDFSGAGGGAARILPAPLADTATKKVDA

SEQ ID NO: 3980 - DNA, 1461 bp, Oryza sativa (japonica cultivar-group)
  CDS (1)..(1461)
atggcggcggcgggggcgtactcggcgagcctaccggcggtgccggactggctgaacaagggggacaacgcgtggcagctgacggcgtcgacgctggtggggatccagtcgatgcccgggctggtggtgctgtacggcagcatcgtgaagaagaagtgggcggtgaactcggcgttcatggcgctctacgcctacgcgtcgtcgctgctggtgtgggtgctggtcggcttccgcatggcgttcggcgaccagctgctgccgttctggggcaaggccggcgtggcgctgacccagagctacctcgtcggccgcgccacgctgccggccaccgcgcacggcgccatcccgcgcaccgagcccttctacccggaggccacgctggtgctcttccagttcgagttcgccgccatcacgctcgtcctcctcgccggctccgtcctcggccgcatgaacatcaaggcctggatggccttcaccccgctctggctcctcctctcctacaccgtcggcgccttcagcctctggggcggcggcttcctctaccgctggggcgtcatcgactactccggcggctacgtcatccacctctcctccggcatcgccggcttcaccgccgcctactgggtggggccaaggctgaagagcgaccgtgagcggttctcaccgaacaacatcctgctgatgatcgcgggcggcgggctgctgtggatggggtgggccgggttcaacggcggcgcgccgtacgccgccaacatcgcggcgtcggtcgccgtgctcaacaccaacgtctgcgccgccaccagcctcctcatgtggacctgcctcgacgtcatcttcttccgcaagccgtccgtcatcggcgccgtgcagggcatgatgaccggcctcgtctgcatcacccccggcgcagggctggtgcagacctgggcggccgtggtaatgggcatcttcgccggcagcgtgccgtggttcaccatgatgatcctgcacaagaagtcagcgctgctgatgaaggtggacgacacgctcgccgtgttccacacccacgccgtggcggggctcctcggcggcatcctcacgggcctcctggccaccccggagctcttctccctcgagtccacggtgccgggactccgcggcgcgttctacggcggcggtatcaagcagatcggcaagcagctcggcggcgccgcgttcgtgatcgcgtggaacctcgtggtcaccacggccatcctcctcggcatcggcctgttcatcccgctgcggatgcccgacgagcagctcatgatcggcgacgacgcggcgcacggcgaggaggcctacgcgctgtggggcgacggcgagaagttcgacgcgacgcggcacgacctgtcgaggggcggcggaggcggcgacagggacggccccgccggcgagcgcctctccgccctaggcgccaggggcgtcaccatccagctctag

SEQ ID NO: 3981 - protein, 486 aa, Oryza sativa (japonica cultivar-group)
MAAAGAYSASLPAVPDWLNKGDNAWQLTASTLVGIQSMPGLVVLYGSIVKKKWAVNSAFMALYAYASSLLVWVLVGFRMAFGDQLLPFWGKAGVALTQSYLVGRATLPATAHGAIPRTEPFYPEATLVLFQFEFAAITLVLLAGSVLGRMNIKAWMAFTPLWLLLSYTVGAFSLWGGGFLYRWGVIDYSGGYVIHLSSGIAGFTAAYWVGPRLKSDRERFSPNNILLMIAGGGLLWMGWAGFNGGAPYAANIAASVAVLNTNVCAATSLLMWTCLDVIFFRKPSVIGAVQGMMTGLVCITPGAGLVQTWAAVVMGIFAGSVPWFTMMILHKKSALLMKVDDTLAVFHTHAVAGLLGGILTGLLATPELFSLESTVPGLRGAFYGGGIKQIGKQLGGAAFVIAWNLVVTTAILLGIGLFIPLRMPDEQLMIGDDAAHGEEAYALWGDGEKFDATRHDLSRGGGGGDRDGPAGERLSALGARGVTIQL

SEQ ID NO: 3982 - DNA, 1440 bp, Oryza sativa (japonica cultivar-group)
  CDS (1)..(1440)
atgtcgtcgtcggcgacggtggtgccgctggcgtaccaggggaacacgtcggcgtcggtggcggactggctgaacaagggcgacaacgcgtggcagctggtggcggcgacggtggtggggctgcagagcgtgccgggcttggtggtgctgtacggcggcgtggtgaagaagaagtgggcggtgaactcggcgttcatggcgctctacgccttcgccgccgtgtggatctgctgggtcacctgggcgtacaacatgtcgttcggggagaagctcctcccgatctgggggaaggcgcggccggcgctggaccagggcctcctcgtcggccgcgccgcgctgccggcgacggtccactaccgcgccgacggcagcgtggagacggcggcggtggagccgctgtacccgatggcgacggtggtgtacttccagtgcgtgttcgccgccatcaccctcatcctcgtcgccggctccctcctcggccgcatgagcttcctcgcctggatgatcttcgtcccgctctggctcaccttctcctacaccgtcggcgccttctccctctggggcggcggcttcctcttccactggggcgtcatcgactactgcggcggctacgtcatccacgtctccgccggcatcgccggcttcaccgccgcctactgggtggggccaagggcacagaaggacagggagaggttcccgccgaacaacatactgttcacgctgacgggggcagggttactatggatggggtgggcagggttcaacggcggtggtccgtacgccgccaactccgtcgcctccatggccgtcctcaacaccaacatctgcaccgccatgagcctcatcgtctggacatgcctcgacgtcatcttcttcaagaagccctccgtcgtcggcgccgtccagggcatgatcaccggcctcgtctgcatcacccccgctgcaggggtggtgcaggggtgggcggcgctggtgatgggggtgctcgccggcagcatcccgtggtacaccatgatgatcctccacaagcgctccaagatcctgcagcgcgtcgacgacaccctcggcgtcttccacacccacggcgtcgccggcctcctcggcggcctcctcaccggcctcttcgccgagcccaccctctgcaacctcttcctccccgtcgccgactcccggggcgccttctacggcggcgccggcggcgcccagttcggcaagcagatcgccggtggcctcttcgtcgtcgcctggaacgtcgccgtcacctccctcatctgcctcgccatcaacctcctcgtcccgctccgcatgcccgacgacaagctcgaggtcggcgacgacgccgtccacggcgaggaggcctacgcgctctggggcgacggcgagatgtacgacgtcaccaagcacggctccgacgccgccgttgcgcccgtcgtcgtatag

SEQ ID NO: 3983 - protein, 479 aa, Oryza sativa (japonica cultivar-group)
MSSSATVVPLAYQGNTSASVADWLNKGDNAWQLVAATVVGLQSVPGLVVLYGGVVKKKWAVNSAFMALYAFAAVWICWVTWAYNMSFGEKLLPIWGKARPALDQGLLVGRAALPATVHYRADGSVETAAVEPLYPMATVVYFQCVFAAITLILVAGSLLGRMSFLAWMIFVPLWLTFSYTVGAFSLWGGGFLFHWGVIDYCGGYVIHVSAGIAGFTAAYWVGPRAQKDRERFPPNNILFTLTGAGLLWMGWAGFNGGGPYAANSVASMAVLNTNICTAMSLIVWTCLDVIFFKKPSVVGAVQGMITGLVCITPAAGVVQGWAALVMGVLAGSIPWYTMMILHKRSKILQRVDDTLGVFHTHGVAGLLGGLLTGLFAEPTLCNLFLPVADSRGAFYGGAGGAQFGKQIAGGLFVVAWNVAVTSLICLAINLLVPLRMPDDKLEVGDDAVHGEEAYALWGDGEMYDVTKHGSDAAVAPVVV

SEQ ID NO: 3984 - DNA, 1455 bp, Xylella fastidiosa (strain Temecula1 / ATCC 700964)
  CDS (1)..(1455)
atgcactctaactcttgccattttagtgatatgaagaatggttttttcgcaatctgtatatttatcgcgttggctttgttggcaggtggcaatgccatcggtcgtgcggaggctcaggtacaaaccaatcctttgcctagcgagcaagtcaccaccgaattgttgatgtctgaagcaaccccttccgacgcggttgcaatacctaaaacgacttcaccccccgtggtagacaagggggacgttgcttggatgctcacctcaacgctattagtgctactgatggtgttaccaggcttggcactgttttacggcggcatgttgcgttctaaaaacgtactatcaatgatggtacaaattggtgtggtgttttctctgatagccatcttgtgggtgctatacggctatagccttgcttttgctgatggtgacatgtttattggtacattcaataaggcatttctttatggcgtagacactgcaacgttggtagataccttctctaaagggttcaaactgcccgagtacgtgtacgttgctttccaattgacttttgcaggtatcaccgctgcattgattgtcggtgcttttgcagaacgcgtgaaatttgctgcggtactgctgtttattttcatttggttttccttcggctacctgccactggcacacatggtgtggtcgacgccaggttttctgttgagcaagggggccttggattttgccggtgggacagttgtacatatcaatgctggtattgctggattgatcggtgcttactttgttggtaagcgtattggttttggccaggttgccgtcaagccgcataacgtccccatgactttcactggtgctgcactgctatgggtcggttggttcggcttcaatgctggttcggcgttagaagccaatagcattgctgccttggctttcatcaacaccatgcttgcgactgctgctgcgattctcgtttggtcgttgctcgaaaagatgaccaagggaaaattctcagctctgggtgttgcttcaggcatgattgctggtttagtaggcgtcactccagcggcgggtacggttggtccatttggtgcaattgcgattggtgctgttgccgccgtgtgctgtatctggggcatcactggactgaaaagattattgaaggtagacgataccttggacgtattcggcgtgcatggcattggcggcattgttggtgcgattttgactggggtttttaccgataaggcgctaggcggtcagggatatgctgaggggatgacaatgagcaatcaagtcatgattcaagccatgagtgtggggatcagcatcgtgtggattggaatcgtttcgctggtaggtttcttaattgtcaaactgctgtttggtttgcgtgtaagcgaagaagctgaacgtgaaggattggacattacatcgcacggtgagtcggcgtacgagtcctga

SEQ ID NO: 3985 - protein, 484 aa, Xylella fastidiosa (strain Temecula1 / ATCC 700964)
MHSNSCHFSDMKNGFFAICIFIALALLAGGNAIGRAEAQVQTNPLPSEQVTTELLMSEATPSDAVAIPKTTSPPVVDKGDVAWMLTSTLLVLLMVLPGLALFYGGMLRSKNVLSMMVQIGVVFSLIAILWVLYGYSLAFADGDMFIGTFNKAFLYGVDTATLVDTFSKGFKLPEYVYVAFQLTFAGITAALIVGAFAERVKFAAVLLFIFIWFSFGYLPLAHMVWSTPGFLLSKGALDFAGGTVVHINAGIAGLIGAYFVGKRIGFGQVAVKPHNVPMTFTGAALLWVGWFGFNAGSALEANSIAALAFINTMLATAAAILVWSLLEKMTKGKFSALGVASGMIAGLVGVTPAAGTVGPFGAIAIGAVAAVCCIWGITGLKRLLKVDDTLDVFGVHGIGGIVGAILTGVFTDKALGGQGYAEGMTMSNQVMIQAMSVGISIVWIGIVSLVGFLIVKLLFGLRVSEEAEREGLDITSHGESAYES

SEQ ID NO: 3986 - DNA, 1326 bp, Pseudomonas syringae (pv. tomato)
  CDS (1)..(1326)
atggtcaatcgtctacacggcaaatccctactggctttactgactctcagtgccttggcgccctgggcgcaggcggccgaaacgccagtcctgaacaccggcagcaccgcatggatgatcaccgcagcagtcctggtgctgttcatgtgccttccggggctggcactgttctacggcggactggtgcgggccaaaaacatgctctcgctgttcacgcagtgttttggcatcgccggtgtagtcggcgtgctatgggtgatctacggctacagcatggtggttgacaccagcaacatggtcgaagggcaggtaacgttcaacagcttcgtcggtggcctgagtcgcgcctttctggcgggcatgacccccgatagcctggtcggtgaaatcccggaaggcgtgttcgtgaccttccagatgaccttcgccatcatcacgcctgcactgattgccggagcctttgccgagcgcatgaaattctctgccgcgctgctgttcatggcgctctggttcaccttggtgtatgcgccggtcgcgcacatggtctggggcggggcgggtgcgttgatgcacaactggggcgtgctggattttgccggtggcactgcggtgcacatcaatgccggtgttgcagcattggcagcctgtctggtgctgggcaaacgcaagggttatcagaacacacccatgccggctcataatctgagcctgaccatggccggcgcggcgatgctctgggtcggctggttcggcttcaacatcggctctggcggcggcctgagcggcacttccggcatcgtcatgcttaacacccaagtgggtgcctgcgccgggattctcggctggatgttcaccgaatggttcaaggtcggcaaaccgagtgcactgggcctggccagtggtgcgctggccggtctggtcggcatcacgcctgcctgtgcttacgtcggcgtcggcggcgcgttggcgattggtgtcctgtgcggagtgttctgctacctgagcgtgaccgtcctgaaaaaacgcctgggctacgacgacagcctcgatgtcttcggcctgcacggcatcggcggcatgatcggcgcggtactcaccggcgtcttctgcgtaccggcactgggcgggctggtgccagaggtgaccatgggtgcgcaagtcattgcacaggtcaaaggcgtgctcttcaccaccgtgtattgctttgcggtcagctggatcatcctcaaagcagtcaacgcactgatcggcctgcgggctcacgagtcagtagaagagatgggcctggacctggccgagcataatgagcgggcttacaaccactga

SEQ ID NO: 3987 - protein, 441 aa, Pseudomonas syringae (pv. tomato)
MVNRLHGKSLLALLTLSALAPWAQAAETPVLNTGSTAWMITAAVLVLFMCLPGLALFYGGLVRAKNMLSLFTQCFGIAGVVGVLWVIYGYSMVVDTSNMVEGQVTFNSFVGGLSRAFLAGMTPDSLVGEIPEGVFVTFQMTFAIITPALIAGAFAERMKFSAALLFMALWFTLVYAPVAHMVWGGAGALMHNWGVLDFAGGTAVHINAGVAALAACLVLGKRKGYQNTPMPAHNLSLTMAGAAMLWVGWFGFNIGSGGGLSGTSGIVMLNTQVGACAGILGWMFTEWFKVGKPSALGLASGALAGLVGITPACAYVGVGGALAIGVLCGVFCYLSVTVLKKRLGYDDSLDVFGLHGIGGMIGAVLTGVFCVPALGGLVPEVTMGAQVIAQVKGVLFTTVYCFAVSWIILKAVNALIGLRAHESVEEMGLDLAEHNERAYNH

SEQ ID NO: 3988 - DNA, 1338 bp, Pseudomonas syringae (pv. tomato)
  CDS (1)..(1338)
atgactctgcgtcaattcgcagggctcggtgccctgttgtccctcgcaatacctggtcttgccctggcggctgacccagtggccgagccggtgctgaactctggcgacaccgcatggatgctgaccgcgaccgctctggtcctgttcatgaccattcccggtctcgcgctgttctacggcggcatggtccgttcaaaaaacatcctgtccgtgatgatgcagtgtttcgccatcaccggcctgatcagcatcctgtgggtcgtttacggttacagcatcgcgtttgacacaaccggtatggaagctggcgtcgtcaacttcaattccttctttggcggtatgggtaaagcgttcctggcgggtatcacgcctgcaagccttaccggtcctgctgcattgttccctgaggcggtgttcgtcacctttcagatgacctttgcgatcatcactccagccctgatcgtcggtgctttcgcagaacgcatgaagttctccgcgatgctgattttcatgggtatctggttcacgctggtctacgcgccaattgcccatatggtctggggcggcgtcggtggcttgatgtgggactggggcgttctggacttcgcaggtggcaccgtggtgcacatcaacgccggtgtagccggtctggtggcttgcctggtactgggcaagcgcaaaggcttcccgaccaccccgatggctccgcacaatctgggttacaccctgatcggcgcagcgatgctctgggttggctggttcggtttcaacgccggttccgccgctgcggccaacggcactgccggtatggcgatgctggtgacgcaaatcgctaccgctgccgccgcgctgggctggatgttcgccgagtggctgacgcacggtaagccaagtgcgctgggcatcgcttcgggtgtggttgccggtctggttgccatcaccccggcggccggtacagttggcccgatgggcgcgctgatcatcggtctggcggcaggcgtgatctgcttcttctgcgccaccagcctcaagcgcaagcttggctacgatgactccctggatgcgttcggcgttcacggtatcggcggtatcgtcggcgcgatcctgaccggtgtgttcgcagcacctgcactgggcggcttcggcacggtgactgacatcggtgctcaagtctggattcagttcaagggcgtcgcgttcaccgtcgtctacaccgcgatcgtgaccttcatcatcctcaaggtactggatgcagtgatgggtctgcgggttaccgacgaggaagagtctgtcggtctggaccttgcgcaacacaacgagcgtggctacaacttgtaa

SEQ ID NO: 3989 - protein, 445 aa, Pseudomonas syringae (pv. tomato)
MTLRQFAGLGALLSLAIPGLALAADPVAEPVLNSGDTAWMLTATALVLFMTIPGLALFYGGMVRSKNILSVMMQCFAITGLISILWVVYGYSIAFDTTGMEAGVVNFNSFFGGMGKAFLAGITPASLTGPAALFPEAVFVTFQMTFAIITPALIVGAFAERMKFSAMLIFMGIWFTLVYAPIAHMVWGGVGGLMWDWGVLDFAGGTVVHINAGVAGLVACLVLGKRKGFPTTPMAPHNLGYTLIGAAMLWVGWFGFNAGSAAAANGTAGMAMLVTQIATAAAALGWMFAEWLTHGKPSALGIASGVVAGLVAITPAAGTVGPMGALIIGLAAGVICFFCATSLKRKLGYDDSLDAFGVHGIGGIVGAILTGVFAAPALGGFGTVTDIGAQVWIQFKGVAFTVVYTAIVTFIILKVLDAVMGLRVTDEEESVGLDLAQHNERGYNL

SEQ ID NO: 3990 - DNA, 1332 bp, Pseudomonas putida (strain KT2440)
  CDS (1)..(1332)
atgactctgcgtaagatcgcagggctaggagccctattgtccctcgtaatgcccgggcttgccctggcagaggaagctgccccagcgcttaattccggcgacaccgcctggatgctgaccgcaacggcgctggtgctgttcatgactattccgggcttggccctgttctatggcggcatggtgcgatccaagaacgtgctgtcggtgatgatgcagtgctttgcaatcaccggcctgatgagcattctctgggtcgtctacggctacagcatggccttcgataccgccggtatggaaaagggcgtgctcaacttcaactccttcgttggcggcttctccaaggccttcctcagcggtgtcacgcccgacagcctgacctcggccaccgcgctgttccctgaagcggtgttcatcaccttccagatgacgttcgccatcatcaccccggcgttgatcgtcggtgcctttgccgagcgcatgaagttctcggcgatgctcgtattcatgggtatctggttcaccctggtgtatgcgccgatcgcacacatggtgtggagcggtgacggtgccctgatgtgggactggggcgtactggacttcgctggcggcaccgtggtgcacatcaacgccggtatcgcaggcctggtctgctgcctggtactgggcaagcgcaagggctacccgaccacgccgatggccccgcacaacctcggctataccctgatgggcgcagcgatgctgtggatcggctggttcggtttcaacgcaggctctgctgctgccgccaacggtactgccggcatggccatgctggtcactcagatcgctaccgccgccgccgccctgggctggatgttcgccgagtgggtcggtcacggtaagccaagtgctctgggcatcgcttcgggcgtggttgctggcctggtcgccatcaccccggctgcgggcaccgtcgggccgattggcgcgctgatcatcggcctggtttcgggtgtgctctgctacttctgcgccaccacgctcaagcgcaaactcggctatgacgattcgctggatgccttcggcgtgcacggtgttggcggcatcatcggtgccatcctcacgggtgtattcgcggctccggcgctgggcggcttcggtaccgtcaccgacatcggcatgcaagtctggatccaggccaaaggtgtgattttcaccgtggtctacaccgccatcgtcacctacgtgattctcaaggtgctggatgtggtgatgggcctgcgggtcaacgaagaagaagagtcggtcggcctcgacctggctcagcacaacgagcgcggctacaacctgtaa

SEQ ID NO: 3991 - protein, 443 aa, Pseudomonas putida (strain KT2440)
MTLRKIAGLGALLSLVMPGLALAEEAAPALNSGDTAWMLTATALVLFMTIPGLALFYGGMVRSKNVLSVMMQCFAITGLMSILWVVYGYSMAFDTAGMEKGVLNFNSFVGGFSKAFLSGVTPDSLTSATALFPEAVFITFQMTFAIITPALIVGAFAERMKFSAMLVFMGIWFTLVYAPIAHMVWSGDGALMWDWGVLDFAGGTVVHINAGIAGLVCCLVLGKRKGYPTTPMAPHNLGYTLMGAAMLWIGWFGFNAGSAAAANGTAGMAMLVTQIATAAAALGWMFAEWVGHGKPSALGIASGVVAGLVAITPAAGTVGPIGALIIGLVSGVLCYFCATTLKRKLGYDDSLDAFGVHGVGGIIGAILTGVFAAPALGGFGTVTDIGMQVWIQAKGVIFTVVYTAIVTYVILKVLDVVMGLRVNEEEESVGLDLAQHNERGYNL

SEQ ID NO: 3992 - DNA, 1317 bp, Lactobacillus plantarum
  CDS (1)..(1317)
atgaacgctgcaaattcaacgtttttagtgttatctagtatattggtattattcatgacgcccggattagcatttttctacggtggcttagtttccaaacggaatgtcgttaacaccatgttatccgtcttcatgatttgtggcttagcaatcttgttatggctcgcattcggttattcactatctttttccggtgatttaggtggctttgtcggtaatctcaaagccacttggttgcatggtgtggacttgaccgcgcttaccgcgacaaagattcccaacggtttatatctcatctttcaaatgatgtttgccattatcacgccagcactatttgttggcgcggtggtcggccgtatccgttttaaattcttattaaccttcatcatcttctggtcactcctcatctactatccaatggttcatatggtttgggataacggtttattagctaaacttggcgtcatcgacttcgctggtggcaccgtcgtccacatcaatgccggcatcaccgctttagtcttatcagccttcttaggtgcccgccacaagtatggcaaggatatgacccagcactataacatcttatgggtattgctggggaccgctattttatggatcggctggtacggtttcaatgccggttcggcgcttgccatgaacgacatcgccatccaagccttcttaaccacgaccgttgccaccgccacttccatgatgacgtggatggtcgttgatatgctaaccaagggcaaaccaaccctagtcggtgtctgcaccggtaccctttgtggtctcgttgcgattacacctgcttgtggctacgtcaccatttctggcgccttttggattggccttatcgccacattaaccagttacggcttcattacgttcatcaaaccacgcttaggtatcgatgatgcactcgatgcctttggatgccacggtgtttccggcatggtcggcagtatcatgactgggctattcgctagcaaagccgttaatcgcacaatttctctaaacggtcttttctatggtggcggctttaaattattcggattacaactattagcaacgatctttaccattggctttactaccatcgtttgcatcgtcattatcgtactattgaaacgagtcatcagaatgcgcgttgacgagcgagaggaagaactcggactcgatcaaggcgaacacggcgaagtcgctgactacaccgttcaaatgagtcacgacttgacgaacattcaacaccatagcgatgaatttcgtggtcagttagcgcaactgctagataagcaacaacgattccgataa

SEQ ID NO: 3993 - protein, 438 aa, Lactobacillus plantarum
MNAANSTFLVLSSILVLFMTPGLAFFYGGLVSKRNVVNTMLSVFMICGLAILLWLAFGYSLSFSGDLGGFVGNLKATWLHGVDLTALTATKIPNGLYLIFQMMFAIITPALFVGAVVGRIRFKFLLTFIIFWSLLIYYPMVHMVWDNGLLAKLGVIDFAGGTVVHINAGITALVLSAFLGARHKYGKDMTQHYNILWVLLGTAILWIGWYGFNAGSALAMNDIAIQAFLTTTVATATSMMTWMVVDMLTKGKPTLVGVCTGTLCGLVAITPACGYVTISGAFWIGLIATLTSYGFITFIKPRLGIDDALDAFGCHGVSGMVGSIMTGLFASKAVNRTISLNGLFYGGGFKLFGLQLLATIFTIGFTTIVCIVIIVLLKRVIRMRVDEREEELGLDQGEHGEVADYTVQMSHDLTNIQHHSDEFRGQLAQLLDKQQRFR

SEQ ID NO: 3994 - DNA, 1533 bp, Bradyrhizobium japonicum
  CDS (1)..(1533)
atgcggttcgtatccgcaccggcgaggccgatgccgcggccctttgatttcgcgctcaaccttatccaatcaggagtaaataatatgacgttcaagcgtccctatggcgcgggattggcggctctcgcagtcggcctgttcgctgcgaccgcagcctatgccgagccaacggtcaataagggagacaacgcctggatgctgacatcgacagtcctcgtgctgttgatgacgatcccgggtcttgcgctgttctacggcggtctcgtccgttccaagaacatgctctcggtcttgatgcaggtcttctacaccgtctgcgtcgtcaccgtgatctgggccgtgtacggctacagcctcgccttcaccggcggttccgacttcatcggcggcttctccaaggccttcatgatgggcgtcaccaccgactcgaaggccgcgaccttctcggtcgacgccaacatctcggagctcatctatatgtgcttccagatgaccttcgcggcgatcacgccggccctcatcgtcggcgccttcgccgagcgcatgaagttctcggcgatcgctctcttcatcccgctctgggtcacgctgatctacttcccgatcgcgcacatggtctggtactggcccggcccggacgcgatccaggacgctgccaaggctctggctgcggcgactgatgcggcggcgaagaccgcggcgcaggccaagctcgacgagatcaacgccgacgccggctggatcttcaagaagggcgcgatcgacttcgcgggcggcaccgtggtgcacatcaacgccggcatcgcaggtctcgtcggcgctctcctgatcggcaagcgcaccggctacggcaaggagctgatggctccgcactcgctgaccatgtcgatgatcggcgcctcgctgctctgggtcggctggttcggcttcaacgccggctccaacctcgaagccaacggcggcgctgccctcgccatgaccaactccttcgtcgccaccgcagccgccgcgctgtcgtggatgttcgcggagtggatcgtgaagggtcacccgtcggtgctcggcgtcatctccggcgctgtcgcgggtctcgtggccgtcacgcccgccgccggcttctccggcgtcatgggtgcgatcgtcctcggtctcgtggtcggcgtggtctgcctgttcttctgcaccgtcgtgaagaacgcgatcggctacgacgactccctcgacgtgttcggcgtgcactgcatcggcggcatcgtcggtgctctcggtaccggcatcctggtgaaccccgccctcggcggcgccggcatcatcgactacaccgcgatcccgccgaaggttgccgattacgacttcgcggcgcagatggtgtcccagttctggggcgtctgcaccacgctggtgtggtcgggcatcggttcggcgatcctctacaaggtcgtcgatgtgatcgttggcctccgcgccaatgtcgagagcgagcgtgaaggcctcgacatcaccgagcacaccgagcgcgcctacaacatgtaa

SEQ ID NO: 3995 - protein, 510 aa, Bradyrhizobium japonicum
MRFVSAPARPMPRPFDFALNLIQSGVNNMTFKRPYGAGLAALAVGLFAATAAYAEPTVNKGDNAWMLTSTVLVLLMTIPGLALFYGGLVRSKNMLSVLMQVFYTVCVVTVIWAVYGYSLAFTGGSDFIGGFSKAFMMGVTTDSKAATFSVDANISELIYMCFQMTFAAITPALIVGAFAERMKFSAIALFIPLWVTLIYFPIAHMVWYWPGPDAIQDAAKALAAATDAAAKTAAQAKLDEINADAGWIFKKGAIDFAGGTVVHINAGIAGLVGALLIGKRTGYGKELMAPHSLTMSMIGASLLWVGWFGFNAGSNLEANGGAALAMTNSFVATAAAALSWMFAEWIVKGHPSVLGVISGAVAGLVAVTPAAGFSGVMGAIVLGLVVGVVCLFFCTVVKNAIGYDDSLDVFGVHCIGGIVGALGTGILVNPALGGAGIIDYTAIPPKVADYDFAAQMVSQFWGVCTTLVWSGIGSAILYKVVDVIVGLRANVESEREGLDITEHTERAYNM

SEQ ID NO: 3996 - DNA, 1251 bp, Staphylococcus epidermidis
  CDS (1)..(1251)
atgaatatgaatgatacaatatttctatttttatgtactctattagtatggttaatgacaccaggtttgagccttttttatgggggactcgtacaatcaaaaaatgctttaaatactgtaatgcaaagtatggttgccattgtcattgtcacatttatatggataatgattggtttctctttaagttttgatggaggtaatcaatggataggtggtttgaaatttttgggtcttcatcatgttggttttgaaacttcaaaaactttgagtcctcatatacctctctcattatttatgttgtttcaaatgatgttttgtacaattgcggtatctattttatcaggttcgatagccgagaaaatgagattcattccttatctgatttttgtgagtttatgggttctattaatttatagccctgttgcccactgggtatggggtggtggttggattagtaaaattggagcaatagattatgcgggtggaacagtagttcatataacatcaggtgtatctggtttggttcttgggataatgataggtataggtaaaaagaaagaaaaacatactccccataatctattaattacacttataggtggtatattagtatggttaggatggtatggatttaatgtgggcagtgcatttacattcgatcacatagccatgatatcgtttgtaaatacagttattggtgcaagtgcaggtgctttcggttggttaatctttgaatatatcttgaaaaagactacaagtttactaggtcttttatctggagcgctctctggtcttgtcgctattacaccagcagcaggatacgtcagctatatgagtgccatgattattgcaataatgggtggcataggttgctatatcgttataaatttaattaaagtaaaactccaatataatgatgcactagatgcatttggtattcatggtgtaggtggtatcttaggagctgtgtttacaggagtttttcaatcacatcaaattaatagtgcggtggagaatggttttatctatacaggtgattttaaaatagtagtgattcaacttggagcggcaattgcgactgtcgtttttagcgcaatagtcacttttttgattgctagatttattaaaatttttactcctttagctacaactcaagaagaagataaaacaggactcgatgttatagtacacggtgagaaagcgtatttctatggagagctaaataagtttaatcgtcatattaagttttaa

SEQ ID NO: 3997 - protein, 416 aa, Staphylococcus epidermidis
MNMNDTIFLFLCTLLVWLMTPGLSLFYGGLVQSKNALNTVMQSMVAIVIVTFIWIMIGFSLSFDGGNQWIGGLKFLGLHHVGFETSKTLSPHIPLSLFMLFQMMFCTIAVSILSGSIAEKMRFIPYLIFVSLWVLLIYSPVAHWVWGGGWISKIGAIDYAGGTVVHITSGVSGLVLGIMIGIGKKKEKHTPHNLLITLIGGILVWLGWYGFNVGSAFTFDHIAMISFVNTVIGASAGAFGWLIFEYILKKTTSLLGLLSGALSGLVAITPAAGYVSYMSAMIIAIMGGIGCYIVINLIKVKLQYNDALDAFGIHGVGGILGAVFTGVFQSHQINSAVENGFIYTGDFKIVVIQLGAAIATVVFSAIVTFLIARFIKIFTPLATTQEEDKTGLDVIVHGEKAYFYGELNKFNRHIKF

SEQ ID NO: 3998 - DNA, 1236 bp, Streptococcus mutans
  CDS (1)..(1236)
atggattcaggatctatagcatttattatcatttgttctgcgcttgtttttttaatgacaccgggtttagcctttttctatggaggcttgggacgccgcaagaatgtcatcaatacaatgatgatggcagttgtgccacttgctttggcctcgcttttgtgggtagttgtaggttattccttatcttttagtggtgttggaaaagtatttggtgatttttcacatgtctttttgaatggtgtgaaggaaggagcaagtagtagagggttaacaataccagataccttattttctggttttcaaatgatgttttctatcattacagtagctattttgacaggtgctgttgcaggaaggatgcgtttcactcctttagttatttttattatcttttggttacttttagtctattatccttttgcacacatggtttgggatgatggtctattagcaaaatgggggacgcttgattttgccggtggtgatgttgtccacattacatcaggcgtttcggggctggtattagccttggtagtcggtaaacgtcgcgattatgaccgtctggaatatcgtccacataatattccctttgttcttttgggagcaggcctactctggtttggttggtttgggtttaatgcaggttccgctttagctgctaatggtttggctgttcatgctttgttgacaactcatatttcagctgccgctgctatgttctcatggctgctacttgaaaaatatttaaatggtaaaccttccttagtaggcggttcaactggtttagtcgcaggcttagttgccattacaccaggtgcaggctttgtacccttatggagctctttgttgataggactcatggttagtcctctatgttattttgctatcgctgtgttgaaaagtaaatttggttatgatgatgccttggatgcttttggctgtcatggtataggtggtattttcggagggattgtaacaggactttttacaacacctcatctggctttagataaatccaatattggtcttatttatggtaatgcaagattatttttagttattctggcagctattctttttacgattatttggtcagctctgattagttttttaattataaaagttatttcccttttcatgccaattcgtgtcagtgatagagaagaagctactggacttgacgacaaagagcatggagaaactgcgtatccaacctttatgggacttgattcttag

SEQ ID NO: 3999 - protein, 411 aa, Streptococcus mutans
MDSGSIAFIIICSALVFLMTPGLAFFYGGLGRRKNVINTMMMAVVPLALASLLWVVVGYSLSFSGVGKVFGDFSHVFLNGVKEGASSRGLTIPDTLFSGFQMMFSIITVAILTGAVAGRMRFTPLVIFIIFWLLLVYYPFAHMVWDDGLLAKWGTLDFAGGDVVHITSGVSGLVLALVVGKRRDYDRLEYRPHNIPFVLLGAGLLWFGWFGFNAGSALAANGLAVHALLTTHISAAAAMFSWLLLEKYLNGKPSLVGGSTGLVAGLVAITPGAGFVPLWSSLLIGLMVSPLCYFAIAVLKSKFGYDDALDAFGCHGIGGIFGGIVTGLFTTPHLALDKSNIGLIYGNARLFLVILAAILFTIIWSALISFLIIKVISLFMPIRVSDREEATGLDDKEHGETAYPTFMGLDS

SEQ ID NO: 4000 - DNA, 1371 bp, Oceanobacillus iheyensis
  CDS (1)..(1371)
atgttgaagaaaagttttcttatatttacagcactgttacttttagctactccagtttacgcagcgacacctacacctgaatcgttagagctttctgttaacctaatttgggtaatgcttggtgcgtttttagtattttttatgcatgcaggatttgctatggtagagtctggctttactagatccaaaaataccttaaatatcttgatgaagaatttcttaacaataagtgttgcatctatattatttttcttagtaggttatggtattatgttcggttcttctgccggatccattataggtagtgacggatttttactaagcgaaattagcgaaatagactttttcgtatttcaagctatgtttgttgccacttgtgcaacaattatatctggagctgtagcagaacgaattaaattaggtagttatatccttattgttgcggcaatgaccacaatcatatatccagttgttggacattgggtgtggcaaggtgatggatggttaacctcactaggatttagtgacttcgcagggtctactgtagttcacctaacaggtgctgtgggagctttcgtagtagtactaatactcggtcctcgtatcggaaaatacaaagggaagaaagttaatgttatccaaggccataatttacctttaggagctctaggtgtttttatcctttggttaggttggttcggctttaacggtggcagtactttagctgctgacccatcactagtaccatatgtaattggaacaaccttattatctacttctgccgcattagtgtcatcctctttatatacaaaattacgatttaagaaagtagatgcatcattatccatgaatggtgtactgggtggattagtaggtattactgcaggtgccgcagaaatttctcttgggggatcaattattgtcggtctaatttctggtgtagtacttgtagaaggaattcgattcttagatacaaaattacgtatagacgacccagttggagctattgcagtacatggaatttgtggtatatggggaacattagccataggattgttctctgttaataccggacttttctacggaaatggtatttctcaattggggattcaagccatcggtgtacttgctgtagttgcttgggttgctattacagctggtgggttcacttatgtgataaataaaatatctcaaattcgcgtttcagaagaagaagaaatttctggacttgattttgcagaacacggatctagtgcatataattttaaagagagtttacttgaaggaacggacaataattcatcaagtggtcttgcagaacgtttaaataataatattccgattggtaaaacaagtaaccaaagttcttaa

SEQ ID NO: 4001 - protein, 456 aa, Oceanobacillus iheyensis
MLKKSFLIFTALLLLATPVYAATPTPESLELSVNLIWVMLGAFLVFFMHAGFAMVESGFTRSKNTLNILMKNFLTISVASILFFLVGYGIMFGSSAGSIIGSDGFLLSEISEIDFFVFQAMFVATCATIISGAVAERIKLGSYILIVAAMTTIIYPVVGHWVWQGDGWLTSLGFSDFAGSTVVHLTGAVGAFVVVLILGPRIGKYKGKKVNVIQGHNLPLGALGVFILWLGWFGFNGGSTLAADPSLVPYVIGTTLLSTSAALVSSSLYTKLRFKKVDASLSMNGVLGGLVGITAGAAEISLGGSIIVGLISGVVLVEGIRFLDTKLRIDDPVGAIAVHGICGIWGTLAIGLFSVNTGLFYGNGISQLGIQAIGVLAVVAWVAITAGGFTYVINKISQIRVSEEEEISGLDFAEHGSSAYNFKESLLEGTDNNSSSGLAERLNNNIPIGKTSNQSS

SEQ ID NO: 4002 - DNA, 1293 bp, Leptospira interrogans
  CDS (1)..(1293)
atggggataggaatgattatgaaatggaccaagagactgctcttattgctcaccctacttcttccatttgttttatttgggcaagaagctagcactcccgtagcggacaaaggagatacggtctggatgattgtagcatccgccctcgtattttttatgatacctgggcttgcattgttttatggaggtcttgtaagatctaaaaacgttctttcgactatgatgcatagttttgtagcaatcttagttttgaccctgcagtggaccatctttggatatagtttcgctttttccggaaccaatccttatttcggaaactttgatcttgcctttctaaatggaatcgatgaaaacactttagaattaacaattcctaaatatattcactttctttttcaaggtatgttcgcattaatcacacccgccttaatttctggagcaattgcagaaagagtaaaattcggcggttatataatttttattcttctttggtccactcttgtttatgatccagttgcacattgggtttgggcggcagacggttggctttttaaaatgagcgctttagattttgctggtggaaccgtagttcatcttatctcaggaattgcaggtcttgcagccgcaatcgttctgggtaaaagaaaaggagaaggacccgctctgatcgctcccaacaatcttacttatactttaatcggagccggtttactttggttcggttggttcggttttaacgctgggtccggacttgcggtaaacggaattaccgccagagcatttttagttactttaatcgcacctgcagccgcaggagttgcttggcttgtaatcgaatatttccatactaaaaaagcaaccgccctcggagccgcttcgggtattgtggccggtttggttgtaattactcccgcttctggttttgtaggagttcaaggagcaatcatcatgggacttcttgtaagtccggtatgctacgcagcgattcttttaaaaggaaaactaggatacgatgatagtttggacgcatttggaattcacggcgtaggtggtgcgttaggcgcggttcttacaggagttttcactcttacactcggcgcaggtgttgcgagtaaaggagatcaaattttggttcaactcattagcgtcgctgcaaccggagcttattcttttatcgtttctatgattctagtatttttgatcgataaaacaatcggctttcgtatttccgaagaaaaagaaattactggactggattcggaaattcacggagaaaaaggttatatcctttaa

SEQ ID NO: 4003 - protein, 430 aa, Leptospira interrogans
MGIGMIMKWTKRLLLLLTLLLPFVLFGQEASTPVADKGDTVWMIVASALVFFMIPGLALFYGGLVRSKNVLSTMMHSFVAILVLTLQWTIFGYSFAFSGTNPYFGNFDLAFLNGIDENTLELTIPKYIHFLFQGMFALITPALISGAIAERVKFGGYIIFILLWSTLVYDPVAHWVWAADGWLFKMSALDFAGGTVVHLISGIAGLAAAIVLGKRKGEGPALIAPNNLTYTLIGAGLLWFGWFGFNAGSGLAVNGITARAFLVTLIAPAAAGVAWLVIEYFHTKKATALGAASGIVAGLVVITPASGFVGVQGAIIMGLLVSPVCYAAILLKGKLGYDDSLDAFGIHGVGGALGAVLTGVFTLTLGAGVASKGDQILVQLISVAATGAYSFIVSMILVFLIDKTIGFRISEEKEITGLDSEIHGEKGYIL

SEQ ID NO: 4004 - DNA, 1287 bp, Escherichia coli O6
  CDS (1)..(1287)
atgaagatagcaacgataaaaactgggcttacttcactggcgatgctgccgggactggtaatggctgcacctgcggtggccgataaagccgacaatgcgtttatgatgatttgtactgcgctggtgctgtttatgaccgttccggggattgccctgttttatggagggctgattcgtggcaaaaacgtgctgtcgatgctgacgcaggtgaccgtgacgtttgcactggtctgtattctctgggtggtttacggctactcgctggcgtttggcgaaggcaacaacttcttcggcaacattaacgggttgatgctgaaaaacattgaactgacggcggtgatgggcagcatttatcagtatatccacgtggcgtttcagggatcgtttgcctgcattaccgtaggcttgatagttggggcgctggcggaacgaatccgcttctcagctgtgttgatttttgtggtggtatggctgacgctctcttacattccgattgcgcatatggtctggggcggcggtttgctggcttctcacggggcactggatttcgcgggtggcacggtggtgcatattaacgccgcaatcgccggtctggtgggcgcgtatctgataggcaaacgcgtgggcttcggtaaagaggcgtttaaaccgcacaacctgccgatggtcttcaccgggactgctattctctatatcggttggtttggctttaacgccgggtcagcgggcacggcgaatgaaatcgcggcactggcatttgtgaatactgtggtcgcaactgcggcggcaattcttggctggatcttcggtgaatgggcgctgcgtggtaagccttcactgctgggagcgtgttctggcgcgattgccggtctggtcggcgtgacgccagcctgtggttacattggggttggcggcgcgttgattatcggcgtggtagctggtctggcgggcttgtggggcgttaccatgctcaaacgcttgctgcgggtggatgatccctgcgatgtcttcggtgtgcacggcgtttgtggtattgtcggctgtatcatgaccgggatttttgccgccagctcgctgggcggtgtgggcttcgctgaaggtgtgacgatgggccatcagttgctggtacagctggaaagcatcgccattacgattgtctggtctggtgtggtggcatttatcggctacaaactggcggatctgacggttggtctgcgtgtaccggaagagcaggagcgagaagggctggacgtcaacagccacggcgagaatgcctataacgcgtaa

SEQ ID NO: 4005 - protein, 428 aa, Escherichia coli O6
MKIATIKTGLTSLAMLPGLVMAAPAVADKADNAFMMICTALVLFMTVPGIALFYGGLIRGKNVLSMLTQVTVTFALVCILWVVYGYSLAFGEGNNFFGNINGLMLKNIELTAVMGSIYQYIHVAFQGSFACITVGLIVGALAERIRFSAVLIFVVVWLTLSYIPIAHMVWGGGLLASHGALDFAGGTVVHINAAIAGLVGAYLIGKRVGFGKEAFKPHNLPMVFTGTAILYIGWFGFNAGSAGTANEIAALAFVNTVVATAAAILGWIFGEWALRGKPSLLGACSGAIAGLVGVTPACGYIGVGGALIIGVVAGLAGLWGVTMLKRLLRVDDPCDVFGVHGVCGIVGCIMTGIFAASSLGGVGFAEGVTMGHQLLVQLESIAITIVWSGVVAFIGYKLADLTVGLRVPEEQEREGLDVNSHGENAYNA

SEQ ID NO: 4006 - DNA, 1326 bp, Corynebacterium efficiens
  CDS (1)..(1326)
atgcccagcatgaccgctgatcagatcgtggccacatcaggccacgccgcctggatgctcatatccgcatccctcgtcctgctcatgaccccggcgctcgccctgttctacggaggcatgtcccgacagaaatccgtcctcaacatgatgatgatgtcgttcggcaccctcggtgtcgtctccgtcatctacgtgctgtggggatggtcgatgtcctatggcacccagtcctggggtggcatcgtggccaacccactggagttcttcggcctgcgcaactctatcactgacgccgggggaaactacctcgagggggcctccggatatgcgaacatcatcgacatcgggttccagctcaccttcgcggtcatctccaccgcactgatctcgggtgcgctggcagagcgcgtgaagttctccacctggctcaccttcaccgccctgtggtccaccttcgtctacttccccctggcgcacatggtctggggtgggggactgctcgcccacggtgagacaggattcgccgcctggctcttcggtgtcaccgacggggaggccaccatcgcgcccatcgacttcgccggtggcaccgtggtgcacatctccgcgggtaccgccgcactggtgctggcactgatcatcggtgcccgccgtaccttccccatggtggcggcacgtccccacaatctcccgctggtcatgctcggtgccgcactgctgtggttcggatggttcggattcaacggcggttccgccttcgccgccgatggactggccggtctggcctggctgaacaccaccgccgccaccgcggccgcgatactcggctggctggccaccgaacggctgcgcgacggacatgccacctccctcggtgccgcctccggtgtggtggcaggactggtcaccgtcaccccggccgcaggggccctcaccccgctgaccgcgctcatcctcggcgtgatcggtggcatcctggcctgcctgggggtggggctgaaataccgcttcggtttcgatgactccctcgatgtggtcggcgtgcacctggtcgccggcctgtggggcaccgtcggtgtgggcctgctggccacagatgcgggctggttcaccggcgggggcatggatggttttagactctttatcatccagatcgtcatcgcggtggtggccatgatcttcgccgccgtgatcaccgcggtcatcgcctacctcctcaaggcgaccatgggttggaggatcgacgaggacaaggagcagcacgggatcgacaccgccgaacacggtgaatccgcctacgacaccgcagggcccgagattcgttag

SEQ ID NO: 4007 - protein, 441 aa, Corynebacterium efficiens
MPSMTADQIVATSGHAAWMLISASLVLLMTPALALFYGGMSRQKSVLNMMMMSFGTLGVVSVIYVLWGWSMSYGTQSWGGIVANPLEFFGLRNSITDAGGNYLEGASGYANIIDIGFQLTFAVISTALISGALAERVKFSTWLTFTALWSTFVYFPLAHMVWGGGLLAHGETGFAAWLFGVTDGEATIAPIDFAGGTVVHISAGTAALVLALIIGARRTFPMVAARPHNLPLVMLGAALLWFGWFGFNGGSAFAADGLAGLAWLNTTAATAAAILGWLATERLRDGHATSLGAASGVVAGLVTVTPAAGALTPLTALILGVIGGILACLGVGLKYRFGFDDSLDVVGVHLVAGLWGTVGVGLLATDAGWFTGGGMDGFRLFIIQIVIAVVAMIFAAVITAVIAYLLKATMGWRIDEDKEQHGIDTAEHGESAYDTAGPEIR

SEQ ID NO: 4008 - DNA, 1320 bp, Corynebacterium efficiens
  CDS (1)..(1320)
atggacccctcagatctcgcttggattctcgcagctttcgcattggtcagcctcatgttccccgggttggccctgctctacggtggaatgctcggcggacaccaggtgctcaacaccctcatgatggtcatgggtgccctcgcggtgacctgcctcgtgtacgtcacctacggccacggcctggtgatgggcaactcgatcggtggcctcggcatcatcggtaatcccctcgaccacctcggcttccacgacatcatggctgacgacggggccggtggactgatgtgggctggtttctacgtcctcttcgccgccatctcactggctctggtggcctcgggtgcggcgggccgcatgaagttcggggcctggatggtcttcggtgccatctggctcaccctcgtctacgccccgctcgcacactgggtcttcggcggcggttggatgatcaccgcactcggcttccatgacttcgccggcggcaccgccatccacatgaacgccggcgcctcgggcctggcactggctctggtgctcggacgtcgccacagcatggcggtgcgaccccacagcctgccgatgacactgctcggcgccgggatgatcatggtcggctggttcggtttcaacggcggcaccgccgggggagcgaacttcctggccagctatgtggtcgtcaccacgctcctggccaccggtggaggcatgctcggcttcatcctcatcgaacgcatccgggagggacgctccaccctgctgggcctggccaccggcatcatcgccgggctggtcgccatcaccccggcagccgacgcggtcagcccggtgggtgccctgatcaccgggttcctcggatccgccgtggccgcctgggtcatctcctggaaacgcacccaccgcatcgacgacaccctcgatgtcttcgccgtccacggcatggccggcgtggccggagcactgttcgtcatgctcctgggctcacccgatgctccggcgggactggccggcgtgctccgtggcggggagctgtccctgctctggcgtgaaccactggccatcatcatcaccctcggctacgccttcggcatgacctggctcatcgccaccgtgatgaaccggatcaccccgatccgtatcgcgtccgaggacgagtacaccggcatcgacacagccatccacgccgaatctgcctacagcctcaccccggtgggcatggccagccgcaccaacccggagacccgcatccccgaggagaccgcacccgctgaccgggcgggcgtcgcaaagcgcaacacagaccagaaagaagacgcacgatga

SEQ ID NO: 4009 - protein, 439 aa, Corynebacterium efficiens
MDPSDLAWILAAFALVSLMFPGLALLYGGMLGGHQVLNTLMMVMGALAVTCLVYVTYGHGLVMGNSIGGLGIIGNPLDHLGFHDIMADDGAGGLMWAGFYVLFAAISLALVASGAAGRMKFGAWMVFGAIWLTLVYAPLAHWVFGGGWMITALGFHDFAGGTAIHMNAGASGLALALVLGRRHSMAVRPHSLPMTLLGAGMIMVGWFGFNGGTAGGANFLASYVVVTTLLATGGGMLGFILIERIREGRSTLLGLATGIIAGLVAITPAADAVSPVGALITGFLGSAVAAWVISWKRTHRIDDTLDVFAVHGMAGVAGALFVMLLGSPDAPAGLAGVLRGGELSLLWREPLAIIITLGYAFGMTWLIATVMNRITPIRIASEDEYTGIDTAIHAESAYSLTPVGMASRTNPETRIPEETAPADRAGVAKRNTDQKEDAR

SEQ ID NO: 4010 - DNA, 1302 bp, Brucella suis
  CDS (1)..(1302)
atgctcataacaggaagaaacaagcaaacggccctcgtggccagcctgcccgcacttttcgccctggcggggacggcaatggcgcaggacaccgcaccggcaccaaccctcgatacgggcgatacggcctggatgctgacttcaaccgcgcttgtgttgatgatgaccatacccggtctggcgctgttttatggcggcatggtgcgcaagaagaacgtgctgtccacggtgatgcaaagctttgccatcacctgcctcatgtccatcctgtggatgatcgcaggctattcgctggcctttaccgatggcggctcgctccattcctatattggcggcttctcgaaggttttcttctccggagtgacgatggaatcgctcaccggaaccatccctgaatatctcttcatcaccttccagatgacgtttgcgatcatcacgcccgcgctgattaccggctcgtttgcagagcgcatgaagttttcctccatgctggttttcctgacgctgtggctgttcatcgtttatgttccggttgcccattgggtctggggcgggggcttcatggcttccgatggcgtgcttgattttgccggtggcacggtcgttcatatcaatgccggtgttgccggtctggtggcagccctcgttatcggcaagcgcgatggttatggccacaccaacatggcgccgcacaatctcgtgctctcggtcatcggtgctgcccttctgtgggtgggctggttcggcttcaatgccggttctgccgccggtgccaatgcgcttgccggtgtcgccatgctcaacacgcaggtcgcaaccgccggtgctgctcttgcgtggatgtttgtggaatgggctatttccggcaagccaagtgtgctcggcattatttccggcgctgttgcgggccttgtcgcggtcacgcccgctgccggttttgtcaatccgaccggcgcgcttatcatcggcatcgttgccggtgcggtctgctatgtggcggctgtgaagatcaagcatgtgctgggctatgacgattcgctcgatgcgttcggcgtccatggcgtcggtggttttgtcggcgcggtgctgaccggcttttttgccgatgctacgatcaatccggccagcgaaggggcaaccatcggcaagcagttcttcggcgccgccatcacgatcatttatacggcgattgccaccgtgatcatcctttacgtggtcaaggccatcatgggcttgcggcccggcaagcaggccgagatcgaggggctggatatcgccttgcatggggaggcggtgcagtga

SEQ ID NO: 4011 - protein, 433 aa, Brucella suis
MLITGRNKQTALVASLPALFALAGTAMAQDTAPAPTLDTGDTAWMLTSTALVLMMTIPGLALFYGGMVRKKNVLSTVMQSFAITCLMSILWMIAGYSLAFTDGGSLHSYIGGFSKVFFSGVTMESLTGTIPEYLFITFQMTFAIITPALITGSFAERMKFSSMLVFLTLWLFIVYVPVAHWVWGGGFMASDGVLDFAGGTVVHINAGVAGLVAALVIGKRDGYGHTNMAPHNLVLSVIGAALLWVGWFGFNAGSAAGANALAGVAMLNTQVATAGAALAWMFVEWAISGKPSVLGIISGAVAGLVAVTPAAGFVNPTGALIIGIVAGAVCYVAAVKIKHVLGYDDSLDAFGVHGVGGFVGAVLTGFFADATINPASEGATIGKQFFGAAITIIYTAIATVIILYVVKAIMGLRPGKQAEIEGLDIALHGEAVQ

SEQ ID NO: 4012 - DNA, 1296 bp, Bifidobacterium longum
  CDS (1)..(1296)
atgggagcgattgattccggtaacaccgcatggatcctgacatccgcgtccttggttttcctcatgacgcctggtgtggcgttcttctacggcggtatggttcgtgccaaggccgtcctgaacatgctgatgcttgaggcggccgccctgtcggtcaccatgattgtctggaccctgtggggttggtcgattgcttacgccggttccgacatcggaggcatcttcggcgacccggccagcggcttcctgctgaaggactccatggtcgcccaggacggcgtgttcaccgccaccggtctgaacggcaacaactacccggtttccgtggacgtcgccttccaggtcgctttcgcgatgattaccgtcggcctgatctgcggcgccattgccgagcgtgtgaagtacagcacctggatgattttcgtggcgctgtgggtcaccttcgactacgctcctatggcccacatggtctggaacggtggtctgctgtctgctgacggcgccatctccaaggccatcggcgcggccgcccacgatttcgcaggtggtactgtcgtccacatcaacgccgcagtcgccgccctgatcatcgtgctcatcatcggcaagcgtaagggcttcggcacgcagccgttccgcccgcacaacgtgccgttcgtgatgctcggcgccttcctgctgtggttcggctggttcggcttcaacgctggttccgccttcgccgccaacggtactgctggttacgcttgggtttccacctccgccgccaccgcagccgcaatgctctcttggggcttcaccgagaagattcgctccggtcactacaccgccatgggtgccgcctcgggtatggtcgccggcctggtcgccatcaccccggccgccgatgtggtttccccgctgtgggccatcgtgatgggtgccatcgctggtgtcctgacctgcctggcctgcggtctcaagttcaagttcggctacgatgactccctcgacgttgtcggcgtgcatggcgttggtggtttcaccggcaccatcctcatcggcttcttcggtgaaggcaccggtctgctggctggtggcgactggaagcagctcgtcgttcagctggtcatcgctctcgtcgccatcctctactccgcagtgatcaccgcgatcatcgccttcgctctggagaagaccatcggttggcgcgtcaccgaagctcaggaagtcggcggcatcgatcttgccgaccagggcgaacgtgcttacgattttgctggtactgccagctccgttctcaaggaggtgaagtga

SEQ ID NO: 4013 - protein, 431 aa, Bifidobacterium longum
MGAIDSGNTAWILTSASLVFLMTPGVAFFYGGMVRAKAVLNMLMLEAAALSVTMIVWTLWGWSIAYAGSDIGGIFGDPASGFLLKDSMVAQDGVFTATGLNGNNYPVSVDVAFQVAFAMITVGLICGAIAERVKYSTWMIFVALWVTFDYAPMAHMVWNGGLLSADGAISKAIGAAAHDFAGGTVVHINAAVAALIIVLIIGKRKGFGTQPFRPHNVPFVMLGAFLLWFGWFGFNAGSAFAANGTAGYAWVSTSAATAAAMLSWGFTEKIRSGHYTAMGAASGMVAGLVAITPAADVVSPLWAIVMGAIAGVLTCLACGLKFKFGYDDSLDVVGVHGVGGFTGTILIGFFGEGTGLLAGGDWKQLVVQLVIALVAILYSAVITAIIAFALEKTIGWRVTEAQEVGGIDLADQGERAYDFAGTASSVLKEVK

SEQ ID NO: 4014 - DNA, 1392 bp, Acetobacter diazotrophicus (Gluconacetobacter diazotrophicus)
  CDS (1)..(1392)
atgagtctcccccgcactattcggactttctcacctcgcggcaccaccatcgccctggccacgctggccggggcggcgctgccggccatggccgcgcccgccatggccgccgatccggccccgcccgccatcaacaccggcgataccgcctggatgctggtcagcaccgcgctggtgctgatgatgaccgtaccgggcctggccctgttctatggcggcatggtccgcaagaagaacgtgctggccacgctgatgcagtccttcgccatctgctgcatcgtcacgattgtctggatggtcgcgggctacagcctggcgttcggcaccgggtcgccctacatcggcgatctgtcccgcttcatgctgaacggcatcggcgcgcagatttccaaggggtccgatgtcggcttcacgctggggctggggtcggccaacgccacggtgatgacgatccccgagagcgtcttcatgatgttccagatgacgttcgcgatcatcaccccggcgctgatcaccggcgccttcgccgagcgcatgaagttcagcgcgctgtgcgtgttcaccatcctgtggtcgctgctggtctatgcgccggtcgcccactgggtctggagcccgcttggctgggtcgcggggttcggcgccatcgatttcgccggcggcaccgtggtgcacatcaatgccggcgtcgccggcctggtcacggcgctggtggtgggcaagcggcagggctacggccaggacgatatgtcgcccttcaacctgacctatgccgtcatcggcgcgtcgctgctgtgggtcggctggttcggcttcaatgccgggtcggcggtaggggccaacggccgcgccggcatggcgatggcgacgacgcagatcgccagcgccgccgccggggtggcctggatgctggccgaatgggcccgcaccggcaagccgacggtgctgggcatcatttccggcgccgtcggcggactggtcgcgatcacgcccgccgccggcttcgtgctgccgggcggggccctgatcatcggcctgctggccggcgcggtctgccactggaccgccaccaccatgaagcacatgctgggctatgacgacagcctggacgccttcggcgtgcatggcatcggcggcatcctgggcgcgctgctgaccggcgtgctggcctatggcccgctttcggccaccgacgccaatcccgccggggtcgtgggatccttcgcgcagctcgtcacccaggccaaggccgtgggcgtcaccatcgtctggtgcgcggtcgtcaccttcgtcctgctgaagatcgtcgacctcgccatcggcctgcgcgtccggagcgaggacgaaatcgaggggctggacatgacccagcacggcgaacgcatcaactga

SEQ ID NO: 4015 - protein, 463 aa, Acetobacter diazotrophicus (Gluconacetobacter diazotrophicus)
MSLPRTIRTFSPRGTTIALATLAGAALPAMAAPAMAADPAPPAINTGDTAWMLVSTALVLMMTVPGLALFYGGMVRKKNVLATLMQSFAICCIVTIVWMVAGYSLAFGTGSPYIGDLSRFMLNGIGAQISKGSDVGFTLGLGSANATVMTIPESVFMMFQMTFAIITPALITGAFAERMKFSALCVFTILWSLLVYAPVAHWVWSPLGWVAGFGAIDFAGGTVVHINAGVAGLVTALVVGKRQGYGQDDMSPFNLTYAVIGASLLWVGWFGFNAGSAVGANGRAGMAMATTQIASAAAGVAWMLAEWARTGKPTVLGIISGAVGGLVAITPAAGFVLPGGALIIGLLAGAVCHWTATTMKHMLGYDDSLDAFGVHGIGGILGALLTGVLAYGPLSATDANPAGVVGSFAQLVTQAKAVGVTIVWCAVVTFVLLKIVDLAIGLRVRSEDEIEGLDMTQHGERIN

SEQ ID NO: 4016 - DNA, 1818 bp, Medicago truncatula (Barrel medic)
  CDS (47)..(1531)
aaatttcatcaaaacttgaagaacaagacttgaacaaagaactaccatggcagcatcaccagcataccaagcacatcttccaacatcaccagaatggttaaacaaaggagacaacgcatggcaaatgacagcagcaacactagttggtttacaaagcatgccaggactagtaattctctatgcaagcatagtgaaaaagaaatgggcagtgaattcagctttcatggcactatatgcttttgcagcagtattaatctgttgggttcttgttgcttatagaatggcttttggtgatgaacttttacctttctggggtaaaggtgcaccggctttaggacaaaaatttcttgttgctagagcaaaagtacctgcaagtactcactattacaagaatggtgttgatattgaaacacctatggaagaacctttttttcctatggcttcacttgtttattttcagtttacttttgctgctattactatgattttgttggctggttctgttcttggaagaatgaatattaaagcttggatggcttttgttcctctttggcttattttttcttatactgttggtgcttttagtctttggggtggtggatttctttatcattggggtgtgattgattattctggtggttatgttattcatctttcttctggaattgctggtttcactgctgcttattgggttggaccaaggataaagagtgatagggaaaggtttccaccaaacaatgtgttgctgatgcttgcaggtgctggattgttatggatgggttggtcagggtttaatggtggagcaccatatgcagcaaatgttgcatcttcaattgctgtattgaacacaaacatttgtgcagcaactagtcttcttgtgtggacctctcttgatgttgttttctttggcaaaccttctgtgattggagctgttcagggtatgatgactggacttgtatgtatcacaccaggagcagggcttgtgcaatcgtgggcggctattgtgatgggaattctatctggtagcattccttgggtctccatgatgatcttgcataaaaagtcgagtcttctacaaaaggttgatgacactcttggagtatttcacacacatgctgtggcaggcctattgggtggcctactaacaggactctttgcagagccagccctatgtagattactattgccagtgacaaattcaagaggtgcattctatggtggaagtggtggtatgcaattgctaaagcaattagtggcagcaatgtttgttattggatggaacatagtctccaccacaatcattctccttgttatacaactattcatacccttgaggatgcccgacgagcagctcgaaatcggtgacgatgcggctcacggagaggaggcttatgccctttggggtgatggagaaaaatatgatccaactaggcatggttcgttgaatactggtaacactggagtgtcaccttatgttaatggtgcaagaaggtgtgactataaatttatgagtcacaacttgcaagtataggtgttttgtgtatggaaggtgtgaggagaattttgatttttcccatggaagaaaagttctcaagttttgagatcaaattggttgtgtgtatttagttcttctagtcaccttgatttttgacattttgtagttgaaaattattgtaaagaaaatattgatgtagctatgaagttagatttgtcaattttttattgacctgaaagcttcagaaaatttcttgtagaattggaactaaaacgtctagtgattaattgttacttgtaaaaaaaaaaaaaaaaaaaaaaaaa

SEQ ID NO: 4017 - protein, 494 aa, Medicago truncatula (Barrel medic)
MAASPAYQAHLPTSPEWLNKGDNAWQMTAATLVGLQSMPGLVILYASIVKKKWAVNSAFMALYAFAAVLICWVLVAYRMAFGDELLPFWGKGAPALGQKFLVARAKVPASTHYYKNGVDIETPMEEPFFPMASLVYFQFTFAAITMILLAGSVLGRMNIKAWMAFVPLWLIFSYTVGAFSLWGGGFLYHWGVIDYSGGYVIHLSSGIAGFTAAYWVGPRIKSDRERFPPNNVLLMLAGAGLLWMGWSGFNGGAPYAANVASSIAVLNTNICAATSLLVWTSLDVVFFGKPSVIGAVQGMMTGLVCITPGAGLVQSWAAIVMGILSGSIPWVSMMILHKKSSLLQKVDDTLGVFHTHAVAGLLGGLLTGLFAEPALCRLLLPVTNSRGAFYGGSGGMQLLKQLVAAMFVIGWNIVSTTIILLVIQLFIPLRMPDEQLEIGDDAAHGEEAYALWGDGEKYDPTRHGSLNTGNTGVSPYVNGARRCDYKFMSHNLQV

SEQ ID NO: 4018 - DNA, 1654 bp, Phytophthora infestans (Potato late blight fungus)
  CDS (16)..(1572)
cacggcctcatctaaatgatgctcggagataattcgccactcactcggctcgccgttgcggcaactgcagctgtcgcattcagtgcatttgtagtgtccgcccaagaatcgaccgtcacctgcgaagtttcccagtaccttgactccgccaccaatgagtgtgtcgactactcttcgcgaggtgcaaaggctggtaacgcgtatgacacgacaattgactccggcaacacggcgtggatgctaatgtcaagtgcattggtgatgctcatgaccccgggtgttgccttcttctacgccggtttggctggcgaagacatggcgtcgaataccatgatgatgtcgttcgtgagcatggcgatggtgtcgatccagttcttcgccttcggttactcagcgtgcttcagttccgacggtatattcgcctgggcggggtacaacaatgttggcgccgtcgctagtggaacgtatggtggcagtatccctcacattctcttcgccttctttcagacgcagtttgccacaatcacaccagcgctgatcagcggcggaattgtcggccgcatgaagtttggtagctacctgcttttcatcctgctgtggacgtccatcgtatacgaccctctggctcgttggatgtggtcgctcaagctcgatgaaatctgggagatcactgcaatgggctgggaaggcaagatgggtgcgctcgatttcgctggtggtacagtcattcacgtctccagtgggtttggtgcccttgtggccgccattgtggtggggaagcgatacaaccacggcgagcctgtgaagccgcacaacgtacccttggtgatgatcggtgccacgctgctatggttcggctggtttggattcaacgccggatctcagggggcggctgacggcgttgctgcgattgctgctatcaacacgcatctagcgccatgtgctggatttttgacctggtcagctcttgagttcgctttccacaagaactttgatccttgcggtgccatcagtggagcagttgctggacttgtggccatcaccccaggctgtgcctttgtgtacccgtgggctgctgtcatctttggcgtcgtcggttctgcgactggtttcggtgctgtccacctcaagaacgttctgcgttatgatgatactctcgactccttcggtatccacggctgcggcggtttcatgggcggtctgcttacgggtctattcgccacctccgagataaacccgtctattgaaggcggtgcattttacggccacggaatgcagttcgtacaccaactcgtttcacagtgtgtggcagctgcgtactcggcagtggtgacgttcctcatcctaatggcgcttaagtacacggtgggtcttcgcgtctcggaggagaaagaagtaaacggcatggatatttcgtaccacggtggccaggcttacgactacagtgcacatggcgggcttagctctcctactgttaaggcggctaaccctcccgttggcgacttcatgagcatgatgacttctggccagcccagtggaaatggagctaaccatattgcgaatgaactttaaactggttttatcggcagtgagacgcgctggattgcccctccaacctggaatgatacctgaatatatttcaaccccatattaa

SEQ ID NO: 4019 - protein, 518 aa, Phytophthora infestans (Potato late blight fungus)
MMLGDNSPLTRLAVAATAAVAFSAFVVSAQESTVTCEVSQYLDSATNECVDYSSRGAKAGNAYDTTIDSGNTAWMLMSSALVMLMTPGVAFFYAGLAGEDMASNTMMMSFVSMAMVSIQFFAFGYSACFSSDGIFAWAGYNNVGAVASGTYGGSIPHILFAFFQTQFATITPALISGGIVGRMKFGSYLLFILLWTSIVYDPLARWMWSLKLDEIWEITAMGWEGKMGALDFAGGTVIHVSSGFGALVAAIVVGKRYNHGEPVKPHNVPLVMIGATLLWFGWFGFNAGSQGAADGVAAIAAINTHLAPCAGFLTWSALEFAFHKNFDPCGAISGAVAGLVAITPGCAFVYPWAAVIFGVVGSATGFGAVHLKNVLRYDDTLDSFGIHGCGGFMGGLLTGLFATSEINPSIEGGAFYGHGMQFVHQLVSQCVAAAYSAVVTFLILMALKYTVGLRVSEEKEVNGMDISYHGGQAYDYSAHGGLSSPTVKAANPPVGDFMSMMTSGQPSGNGANHIANEL

SEQ ID NO: 4020 - DNA, 1332 bp, Chlorobium tepidum
  CDS (1)..(1332)
atggcgaaaaaaatcagtgcggcggtgatgctgttttttgcagtgatgatggcgcatggcaccgtttgggcaggcgagccggtgagcatcgataccggcacgacatcctggatgctgacctccacggcgctcgtgttgctcatggtgccagggttggcgatgttctatggcggcctggtcaggacgaagaatgttatcggcacgatgatgcacagctttggcgctatggtcatcattggcgtcttgtggccactggtcggatactcgctcagctttggccacggtattctcggcggcctggttggatgggatccgaaatatttcatgttgcaggggattgatgataccatcatggcgagtcatatccctgaatatgtctttgccatgttccagggcaaattcgccatcatcactcctgcgctgattgctggtgcttttgccgagcgggtcaatttcaaggggtatctgttgtttattgccttgtggagcattttcgtgtacagcccgatctgccactgggtctgggctggcgacggttttctgttcaatctcggcgcgatgggcgctatcgattttgctggtggcacggtcgtgcacatctcttccggcgtgaccggccttgtcgcggcgctcttccttggctcgcgtcgcggatatccgagcaacgtcacctcgccgaacaacctggtcatgaccctcgtgggtgcgggcctgctctgggtgggatggttcggtttcaatgctggcagcgccatcgccagcgatcttgccacggctcgcgcactgaccgtgacccaggttgccgcggcgtcgggcgcattcacctggctcatcatcgaactggtgcatcacaataaggcaaccagccttggcgtggcatcgggtattctggctggtctggtggcgatcacccctgccgcgggcgtcgtgcagccatcgggcgcgttcgcgcttggcgctattgccgccattgtctgctacctcggcctcatgctgaagagcaagctcggctacgatgacagcctcgatgctttcggcgtgcacggtgttggcggtattgtcggcgctctctgcctgattttcttcattcgcccgtcgtggatggccgacgccgctgtcaaggctggcggaagctggacggtctggcagcagcttggcgttcaggctacggctgtcgggattacggtcgtctatgcggcagttgtttcactggtgatcctgttcatcgtcgagaaaaccatcggcctgcgtgccaaagagaatgatgaaatgtccggtctcgatcacagtatgcacagtgaacagggatatggccttatcaatcctaactaa

SEQ ID NO: 4021 - protein, 443 aa, Chlorobium tepidum
MAKKISAAVMLFFAVMMAHGTVWAGEPVSIDTGTTSWMLTSTALVLLMVPGLAMFYGGLVRTKNVIGTMMHSFGAMVIIGVLWPLVGYSLSFGHGILGGLVGWDPKYFMLQGIDDTIMASHIPEYVFAMFQGKFAIITPALIAGAFAERVNFKGYLLFIALWSIFVYSPICHWVWAGDGFLFNLGAMGAIDFAGGTVVHISSGVTGLVAALFLGSRRGYPSNVTSPNNLVMTLVGAGLLWVGWFGFNAGSAIASDLATARALTVTQVAAASGAFTWLIIELVHHNKATSLGVASGILAGLVAITPAAGVVQPSGAFALGAIAAIVCYLGLMLKSKLGYDDSLDAFGVHGVGGIVGALCLIFFIRPSWMADAAVKAGGSWTVWQQLGVQATAVGITVVYAAVVSLVILFIVEKTIGLRAKENDEMSGLDHSMHSEQGYGLINPN

SEQ ID NO: 4022 - DNA, 2716 bp, Chlamydomonas reinhardtii
  CDS (26)..(1654)
gaggttcgctggctagagcacaacaatgagcgaagcttgtctcctcgctgcaaagtcggctttggtcggcgtcgccaatggcgatagcctcgcgtccgcaatttgcgcggcgatggaggctgccgcaccagtggctcgccacctgcaagagacaacggtggatctaactacgctccaagagacggtcgacactattgggctgaacttgcaaggcacaatggacggcctgaacacgctgctgctgctctacggaggcgcgctggtgttcctgatgcacggaggctccgctatgctcgaggccggtgccatccgctccaagaacgcgatgaacatcctgctgcagaccgtcctcgacgcctcttgcagcgcgctcatgtggtacttcgtcgggttcgccttcgccttcggcattggcgacaagcccaacaagtttatcggcaacgccatgtttgcgctggtggacattgatacgcacaacaccggctcgggcaccggcaagtggatcgactggttcttccagtgggccttcgccgcaaccgccgtcaccattcccgccggcgctgtggctgagcgtttcaacttcaacgcctacctgggctattccatgttcatcggtggctgggtctaccccatcattgcccactgggtgtggtgcattgagggctggctgggctatggcgtgatcaagcccttcatcaacgccggcatgattgacttcgccggatccggcgtcatccacatgactggcggcctggccggcctcatcggcgccatcatggtgggcccccgcctgggccgcttcgacgccgacggcaagcccgtcgacatgcccggccactccgccatcctggtggtgctgggaaccgtactgctgtggttcggctggtacggattcaaccccgcctccgtgctgctcatcaactccagcacctacgccatcgtgtgcggccgcgcggccgtgtgcaccacgctggccggcgccgcgggcggcgtgagctgcctcatcttcggctttgcgcgccaccgcggctgggacctggtcggcctctgcaacggcatcctgtgcggcttcgtcgcagtcaccgcctgcccccacgtgatctacccctgggccgcaatcatctgcggcctggtcgcgggcctgtggtttgagttcctgtgctggctgttgctcaagctcaagatcgacgacccgttgtcagctgggccgatgcacttcggctgcggcatgtggggcgtcttcttcaccggcctcttcgcgcgccagcaatacatccaggagtactacgtgcacggcccttccgcggccggcgagctgtccaagccctacccctggggcgccttctacaagggctacaatgccgacggcgagctggtcatgtccgatggcaagctgctcgcgtcgcagatcgtgggcatcctggttatcatcggctgggtgattggcatgatggttccgttcttcggcattttccagttctttggcgcgcttcgcattccgcccgaggaggaggagatgggcctggaccgctccaagcacggcggctcggcctacaatggcaccggtgccaacacgctcggcggcctgtcgcccggcaacgacgtgatgcgaaacaactcgcctttgggcaaggttctgcctgtgaccgcgtaaggaccggcggcgttatgcggcacgacggcgtcaggggatcaggagggaacgcagaaccggagctgtggctgcggccatggcagcggcggcggctggtgaccgacgttcttgtgaggatggtaaagggcgagcattcaaatgcgtgaagcgtgaagaactgcagtgtgtggattggggagggggggccagattccactagcacgttgtgtgctgctggcagcagcacgatgattgacgattggaaaacgcttgctcgtgagcggctcgtgtgacgtgactaggggcgcattttttgacagagcgatccgaatgtatgcctatgatcagtaagggcatacgttgctgctgcttgggcgcgggggcctgctgcgccagttgcattgctgcctgcgtgtcaggcccgttgggcgcccattcgagtttggcgttccgcattcatatcacacctacttaagcgccacacattcacgcatcccagccccttacccggatctgaaccatactatgatgcatcatgtttgacaagtgtctgtgtgtgactgtcgtgacttaaaccatgagcgcgctgccgggtgctgattgcgagaaggctggacggcttcgcaggtgactggaccgcaggacagcgtgcttttactttctggtacggtacgaattgcttgacacctccttgcacaatgaattgtcgtgtgtgcgcgcgtaacttcgtagatttgaaagtagtcttgttgtgcgctcgcgtgtgatttgcgcccccctgagtgatttcctgcgaacagttcggaccttgaagttacttgtatgggcatatgggtaaacagcggtcttcagaggaccaacttcagtcaggggacggaaggcatggtgtgcatcaggtgcgtgtgtgcgtgcgtgcatgtggtggacggagattgggccgaggggaaagaaagcccccgcgccatgactgtgacggcggcactgcaaagtgggcgcacgtccagagccaaacaacggctgtaacgatattccgaatgcaaaaaaaaaaaaaaaaaaaaaaaaaaaaaaaaaaaaaaaaaaaaa

SEQ ID NO: 4023 - protein, 542 aa, Chlamydomonas reinhardtii
MSEACLLAAKSALVGVANGDSLASAICAAMEAAAPVARHLQETTVDLTTLQETVDTIGLNLQGTMDGLNTLLLLYGGALVFLMHGGSAMLEAGAIRSKNAMNILLQTVLDASCSALMWYFVGFAFAFGIGDKPNKFIGNAMFALVDIDTHNTGSGTGKWIDWFFQWAFAATAVTIPAGAVAERFNFNAYLGYSMFIGGWVYPIIAHWVWCIEGWLGYGVIKPFINAGMIDFAGSGVIHMTGGLAGLIGAIMVGPRLGRFDADGKPVDMPGHSAILVVLGTVLLWFGWYGFNPASVLLINSSTYAIVCGRAAVCTTLAGAAGGVSCLIFGFARHRGWDLVGLCNGILCGFVAVTACPHVIYPWAAIICGLVAGLWFEFLCWLLLKLKIDDPLSAGPMHFGCGMWGVFFTGLFARQQYIQEYYVHGPSAAGELSKPYPWGAFYKGYNADGELVMSDGKLLASQIVGILVIIGWVIGMMVPFFGIFQFFGALRIPPEEEEMGLDRSKHGGSAYNGTGANTLGGLSPGNDVMRNNSPLGKVLPVTA

SEQ ID NO: 4024 - DNA, 2568 bp, Chlamydomonas reinhardtii
  CDS (106)..(1845)
cacacgcccagttactgctagatattagcgagggcgacaatggagccacggccagtgtctttgaccagcatttaacccttgcaatttgttggcgaacaaagcaaaatggcttcacctgcgccgagcggctctccgccgctcgttatctatagctgcactgatgagcaaatgctagaagtgaccgagctagtgggcgactccgcgacagcggccatagtttgtagccaatatgactgcagtttcacggcagtcagctgtgtgcttaagtatcttgccgcgcaacaagcggacttgagcgagcaaatggacggcacagccaaagcggaggtcgccttgtcgctagacgtggcgttcctcctattcagcgcataccttgtgtttggaccgatgcaattaggctttgcgctgctctgcgcgggcgccatccgctcgaaaaatagcatgaatgtgttgatgaagaacatcttggacgcgtgcactggcgccatcgggttctacctgttcggctatgcgttcgcgttcggacaccacgccaaccagacctccaacgccttcatcggcgaccacaacttcgcgctgtcgtacaccacacaggtcagcagcctcgacagcaacgtcagctacgacgggttcgccacgcagggctggcacgtgttcttcttccaatggagcttctgcgcggccgccaccaccatcgtgtccggcgccgtggcggagcgctgcaccttccaggcctacctggcctacgccttcttcatctcctccttcgtctaccccgtggtggtgcactgggtgtggagcgccagcggctggctgtccgcattcaacacgtcccgggacggctacgcgctgctcctgcagacgggcgccatcgacttcgcgggcggcggcgtggtgcacctcaccggcggcatggcggcgctcatgggcgcttggatcatcggcccccgcatcgggcgctttgacgcgtccggcaaggtgaacgagatgaaggggcacagcgccacactggtggtgatgggcaccttcctgctgtggtttggattctacggcttcaaccctggatccaacctcaccatcgcgaccacggcctcggccatcgtggtgtcccgtgttgcggtgaccaccacgctgtctgcgggcgcggccgggctcacggggctgttctggcgctacatgcgcacatccacctgggacacagtgctggtgtgcaactgctgcctggccggcctggtgggcataacatgcagctgtagtgtggtggagccctgggcggcgctcatctgcggcttcgtggcggcgttcgtgttcatcgggttcgaatacgtggtgttgtacaagatgaagatcgacgaccccgtgagtgcggtggcgctgcacctgttctgcggcgtgtgggggctgctcttccccggcctcctggcgcaacccacctatgtggcggacgtgtacggcgcgtacggcttcgggccggatgtgaagggcagcaagaagttcggcatcctgtacggcggtcacggccaggtgctgctgtgtcaggtgattgaggcgctgtccatctgcgcctgggtgggcgtcatgatgggcgccttcttcgggctgctcaaggtggccaagaggctgcgcgtgcccgtggaccaggagctggcgggactggacgtgagcaagcacaccaaggaggcctacaacggcgccatcatgcccacagcgggaggaggggcaggaggcgggggcggctacggctccaatggcggggagcggggcagcggcttctacacgggggcggggccggcaggcgacaccagcacgggcggggggcacgccgccaacggcggctacgactgagctggactgcgccgctgggaagagaaggcgagctggtggcagggctgggattggggaggagccgtgcgcttgctcattgtgcgtagcgtccgggcgcgtttgttgggatgtggggaaggtgcgggatcacaggatgggggttagctgcgacgctgcgagacagaggttgggcagggccctgcgaaggagtgtgctggcacgtatggaaagctaagaggcaaatgtttgggcttgtgatgagccaggggcgtcattaagacgatgcatgcgcgtgtgttgtgtgtcggcgacagcggcgcaggtggtgtgcggccgtgtgacacgcgggcagcggcagctcgacggggtcactgaagtaaccgcgtgcctggcggtccgtgtgtgcccggcataccgtatgaactgtgtgtgcccagctcaatgactatgtgctttgtgtgtggaactgtggacgattgcgcgcgtgtgcgcgagcgttgtggcggtgcaggccgtaattcatccgtgtgtgtaacaagtggtaagttcgtgaggaggaggcgcgtggcaggacaaggcaggaacttggacgagcgctgggatgcatgccatgccatagagtggagcggaacaactgtgtggctgcaacagggggcaagtggccaggccttgcctatcagggcagggagctgagtagcagagcactagagcagcagaaggcggacatcctgtaactgtacgccc

SEQ ID NO: 4025 - protein, 579 aa, Chlamydomonas reinhardtii
MASPAPSGSPPLVIYSCTDEQMLEVTELVGDSATAAIVCSQYDCSFTAVSCVLKYLAAQQADLSEQMDGTAKAEVALSLDVAFLLFSAYLVFGPMQLGFALLCAGAIRSKNSMNVLMKNILDACTGAIGFYLFGYAFAFGHHANQTSNAFIGDHNFALSYTTQVSSLDSNVSYDGFATQGWHVFFFQWSFCAAATTIVSGAVAERCTFQAYLAYAFFISSFVYPVVVHWVWSASGWLSAFNTSRDGYALLLQTGAIDFAGGGVVHLTGGMAALMGAWIIGPRIGRFDASGKVNEMKGHSATLVVMGTFLLWFGFYGFNPGSNLTIATTASAIVVSRVAVTTTLSAGAAGLTGLFWRYMRTSTWDTVLVCNCCLAGLVGITCSCSVVEPWAALICGFVAAFVFIGFEYVVLYKMKIDDPVSAVALHLFCGVWGLLFPGLLAQPTYVADVYGAYGFGPDVKGSKKFGILYGGHGQVLLCQVIEALSICAWVGVMMGAFFGLLKVAKRLRVPVDQELAGLDVSKHTKEAYNGAIMPTAGGGAGGGGGYGSNGGERGSGFYTGAGPAGDTSTGGGHAANGGYD

SEQ ID NO: 4026 - DNA, 1296 bp, Dictyostelium discoideum (Slime mold)
  CDS (1)..(1296)
atggaacaattttcaacttcatcatcagaaagttcagattcatcatcagagtattcattagagttttatatggatacttcatgggttttagatgctgcaaatttagtattttttatgcaagcaggatttggcatgttagaagcaggtatggttagagcaaagaatacaaagagtatattattaaagaatttaattaatacagcaatatgtgcaatttcatattattgtgttggacattcatttgcgtatggaaaggttaatccaaattcatttgtaggatttgggaatttctttttaatggattatacacattatgcctattggatgatacaatgggcctatgcagcaactgcaacaacaatagcaacgggcgcaatggccgagagattacaactacattgttatatattgtttacattggttcaaactatactgatttatccattcgttgcacattggatttggagtcagaatgggtggttgttcgatttgggtattgtggattttgcaggtggtgccgtcattcatattgtggcgggtataactggtgcatgtggaagttttctattgggtccgagaattggtaggttcaatcaagagagtggtaaaccaaagaatttacccggtcattcggtggtgttgatgagtttgggcgcaatgatactttggtactcttggtatggttatacagctggtgcttcattaggtatgacaagaagtagagttttaccagcttctcgtgttagtgttgttgtaacactatcaggtgcaactggtttaataacggttttaggtattggtaaaatattcaatggtcattatgacttggttaaaggtataaatggtttaattgctggtttagtatcttcaacttcatcttgtgcttatattgaaccatgggctgcaattataattggttttattggtggtattgtttattggttttcatcatgggcattattaaattggttaagattagatgatccagttgattcaacagcaattcatttatttggaggatgttggagtctaataagtgttgcatttttcgctacacatggtagagttaggaacccagatatcattttacctggtggaatattttatggtggtggaattagtttattatgggtacaattagttggaatggttctggcaattttatgggcaggtttcctatcaggtattttcttttttacaatggattattttggtaaacttagagttgatgttgatactgagttagcaggtttagataattcaaatcatggtggtagtgcttatatatttgattaa

SEQ ID NO: 4027 - protein, 431 aa, Dictyostelium discoideum (Slime mold)
MEQFSTSSSESSDSSSEYSLEFYMDTSWVLDAANLVFFMQAGFGMLEAGMVRAKNTKSILLKNLINTAICAISYYCVGHSFAYGKVNPNSFVGFGNFFLMDYTHYAYWMIQWAYAATATTIATGAMAERLQLHCYILFTLVQTILIYPFVAHWIWSQNGWLFDLGIVDFAGGAVIHIVAGITGACGSFLLGPRIGRFNQESGKPKNLPGHSVVLMSLGAMILWYSWYGYTAGASLGMTRSRVLPASRVSVVVTLSGATGLITVLGIGKIFNGHYDLVKGINGLIAGLVSSTSSCAYIEPWAAIIIGFIGGIVYWFSSWALLNWLRLDDPVDSTAIHLFGGCWSLISVAFFATHGRVRNPDIILPGGIFYGGGISLLWVQLVGMVLAILWAGFLSGIFFFTMDYFGKLRVDVDTELAGLDNSNHGGSAYIFD

SEQ ID NO: 4028 - DNA, 1434 bp, Hebeloma cylindrosporum
  CDS (1)..(1434)
atggtcaacgtcacatacgatgattctggcagcttggttgcctacacgcccgatggcactccaatcgtctacaacctcggcgacatggcctggattgctgcctccatggctctcgtctggattatgattccaggcgttggccttttttattctggtttgctacggcggaagaacgcgctgtcgatgatttggacgtctctcgcatccatcgctgttgtttcatttcaatggtttttctgggggtactcccttgcgttcagcgaaacgggaaacgccttcattggcgatcttaaatactttggtctaaagggtgtccttgatcagccttctattggcagcagccgtattcccgccatccttttctgtatctatcagctcatgttcgcggcgatcaccgctgccctcgccgtgggcgctattgctgagcgtggtcgtctcggccctctacttgtctttattttcgtctggtccacaatagtttacgaccctattgccaattggacctggaacaccaacggatggtcattcatcctcggcggtctcgattttgctggaggaacacccgtccatatcagctctggaaccgccgccctcgccatttccatcttcctgggaaagcgccgtggatatggaactgaacgcctcgcttacaagccccataacaccacctacgttatcctcggtaccgttttcctgtggttcggttggtttggtttcaatggtggttcagccctctccgccaacctccgcgcaatccaggcatgcattgtaaccaacctcgctgcttccgttggcggcctgacgtggatgctttgggattatcggattgaaaggaagtggtccgctgttggtttttgctccggagccgtctctggtctcgttgcaatcacccccgcctctggtttcgttggcgctcccgccgcggtcgcctttggcgttcttggtggaacggcctgcaattttgccacccagctaaaattcgttcttggttacgacgatgccctcgacatttttgctactcacgctattgggggaattgttggtaacctcctcaccggccttttcgcccaggccagtgtagctggattcgatggtatcaccgaaatccctggtggctggttggacaggcattacatccagcttgcccatcaactcgctgattccgtcgccggatttgcttactcctttgtcatgacaactatcatactttgggtcatgcatattattcccggtctgacgctccgcaccaccgaggaggcggagatcctcggtgtggatgacgctgagatgggagagttcgcatacgattatgtcggcattgaccaagaaatcggccatactctcgacactggccttaccgcgactggtggaggccgcgagcctgaccatgccaaggcagtgtcgaccagcagcgtagaagagaaatcagcatga

SEQ ID NO: 4029 - protein, 477 aa, Hebeloma cylindrosporum
MVNVTYDDSGSLVAYTPDGTPIVYNLGDMAWIAASMALVWIMIPGVGLFYSGLLRRKNALSMIWTSLASIAVVSFQWFFWGYSLAFSETGNAFIGDLKYFGLKGVLDQPSIGSSRIPAILFCIYQLMFAAITAALAVGAIAERGRLGPLLVFIFVWSTIVYDPIANWTWNTNGWSFILGGLDFAGGTPVHISSGTAALAISIFLGKRRGYGTERLAYKPHNTTYVILGTVFLWFGWFGFNGGSALSANLRAIQACIVTNLAASVGGLTWMLWDYRIERKWSAVGFCSGAVSGLVAITPASGFVGAPAAVAFGVLGGTACNFATQLKFVLGYDDALDIFATHAIGGIVGNLLTGLFAQASVAGFDGITEIPGGWLDRHYIQLAHQLADSVAGFAYSFVMTTIILWVMHIIPGLTLRTTEEAEILGVDDAEMGEFAYDYVGIDQEIGHTLDTGLTATGGGREPDHAKAVSTSSVEEKSA

SEQ ID NO: 4030 - DNA, 1251 bp, Staphylococcus aureus (strain MW2)
  CDS (1)..(1251)
atgaatcttaacgatacgatatttatgtttttgtgtacattattagtttggctaatgacaccaggattaagtttattttatggtgggttagttcaatctaaaaatgcgcttaatactgtcatgcaaagtatggcagcaattgtgcttgttacatttgtatggataacagttggttttacaattagttttgggaatgggaatttatggttcggaaattgggaatatacttttcttaatcatgtaggttttgcgactcaagaagatattagcccacatattcctttcgctttgtttatgttatttcaaatgatgttttgtacgattgcaatttctattttatctggttcaatcgctgagaaaatgaagtttattccttatttattattcgtagtaatatggactgctcttgtatacagtccagtagcacattgggtttggggcggcggttggattaacaaactcggtgtattagatttcgctggaggtacggttgttcatattacatcaggtgtttctggtttagtattagctattatgattggaaaaggaaacaaacattctgaatcaacaccacataatcttatcattacgttgattggcggtatattcgtgtggattggttggtatggatttaatgtaggtagtgcttttacatttgataaaattgcgatgcttgcatttacaaatactgtcatttcagccagtgcaggttctataggttggttaattttagaatatatttttaaaaagacgacaagtttacttggacttttactcggtgcattagcaggattagttgtcattactcctgcagcaggatatgtaacatatcttagtgcaacaataatggctttaataggaggtatctgttgttatattgtcattaattacatcaaggtaaaactaaaatatcatgatgcattagatgcatttggtatccacggtgttggtggtattattggtgctgctttaacagcagttttccaaagtaaaaaagcaaatcctgacattgaaaatggttttatttatactggtgacatacatattatacttgtacaaatattatgtgtaacagcagttgtaatttttagtatcgtcatgacgtttattattgcgaaagtaattaaattaattacaccattatctgttacggaacaagaaacgaatataggattagacaagattgttcacggtgaacatgcttactttgaaggtgagctaaatagattcaataaacatattcgatattag

SEQ ID NO: 4031 - protein, 416 aa, Staphylococcus aureus (strain MW2)
MNLNDTIFMFLCTLLVWLMTPGLSLFYGGLVQSKNALNTVMQSMAAIVLVTFVWITVGFTISFGNGNLWFGNWEYTFLNHVGFATQEDISPHIPFALFMLFQMMFCTIAISILSGSIAEKMKFIPYLLFVVIWTALVYSPVAHWVWGGGWINKLGVLDFAGGTVVHITSGVSGLVLAIMIGKGNKHSESTPHNLIITLIGGIFVWIGWYGFNVGSAFTFDKIAMLAFTNTVISASAGSIGWLILEYIFKKTTSLLGLLLGALAGLVVITPAAGYVTYLSATIMALIGGICCYIVINYIKVKLKYHDALDAFGIHGVGGIIGAALTAVFQSKKANPDIENGFIYTGDIHIILVQILCVTAVVIFSIVMTFIIAKVIKLITPLSVTEQETNIGLDKIVHGEHAYFEGELNRFNKHIRY

SEQ ID NO: 4032 - DNA, 1476 bp, Xanthomonas campestris (pv. campestris)
  CDS (1)..(1476)
atgcgctctgaccccacccaccccggagtccctatgaagacaggtcttgttgccgggtggaaagcccggttctacagcgtctgcatgctgatgctgttcagtgcgctggtggttggcggcttgggcaacgcgcaggctcagtccggcgcgcaggtcaccccattgccgaccgagccggtcaccaccgaaccgctccccaccgcacagccggccgccgcgccggttgcggcggccgaggcggcgccagtggtggagaagggtgacgtcgcctggatgctgacctccacgttgctggtgctgctgatggtggtgccgggcctggcgctgttctacggcggcatggtgcgcgccaagaacgtgttgtcggtgctgatccaggtggcggtggtgttctcgctgctggtggtgctgtgggtgttctacggctacagcctggcgttctccggcgaaggcccgtggatcggcaatctggacaaggccttgctcaagggcgtgaccatcgaaacgttgtcggccaccttcaccaagggcgtcagcctgccggaatacgtgttcgtggcgttccaggccaccttcgccggcatcaccggtgcgctgatcgtcggtgcgtttgccgaacgcgccaagttcgctgcggtgctgctgttctcggtgatctggttcaccttcggctatctgccgctggcgcacatggtctgggccaccggcggctatctgttcggcttgggtgcgctggatttcgccggtggcacggtggtgcacatcaatgccggtgtcgccggtctggtgggcgcctacttcgtgggcaagcgggccgggctcgggcgtgaggcgatcaagccgcacaacgtgaccctgaccttcgtcggtgcttcgctgctgtgggtgggctggttcggcttcaacgccggttccaacctggaagccaatgccggtgcggcgctggccttcctcaacaccttgctggccaccgcagccgcggtcctgggctggtcgctcaccgagaagatcatcaagggcaagtcctccgccctgggcgtggcctcgggcatggtcgccggcctggtcggcatcaccccggcctgcggcacggtgggcccgttcggcgcgatcatcattggcctggcggccggcgtgctgtgcgtgtggggcgtcactggcctcaagcgcctgcttggtgccgacgacagcctggacgtgttcggcgtgcatggcctgggcggcatcatcggcgcgatcctcaccggcgtgttctcggcggcctcgctcggcggccagaagggcggcgactacgacatgctgcatcaagtcggtatccaggcgctgggcgtgggcatcacggtgggctggatcggcgtggtgtcggtggtgggctttgtggtcgccaagctggtgttcggcctgcgcgtcaccgaagaagccgagcgtgaggggttggacatcacctcgcacggcgaagctgcttacgagtcctga

SEQ ID NO: 4033 - protein, 491 aa, Xanthomonas campestris (pv. campestris)
MRSDPTHPGVPMKTGLVAGWKARFYSVCMLMLFSALVVGGLGNAQAQSGAQVTPLPTEPVTTEPLPTAQPAAAPVAAAEAAPVVEKGDVAWMLTSTLLVLLMVVPGLALFYGGMVRAKNVLSVLIQVAVVFSLLVVLWVFYGYSLAFSGEGPWIGNLDKALLKGVTIETLSATFTKGVSLPEYVFVAFQATFAGITGALIVGAFAERAKFAAVLLFSVIWFTFGYLPLAHMVWATGGYLFGLGALDFAGGTVVHINAGVAGLVGAYFVGKRAGLGREAIKPHNVTLTFVGASLLWVGWFGFNAGSNLEANAGAALAFLNTLLATAAAVLGWSLTEKIIKGKSSALGVASGMVAGLVGITPACGTVGPFGAIIIGLAAGVLCVWGVTGLKRLLGADDSLDVFGVHGLGGIIGAILTGVFSAASLGGQKGGDYDMLHQVGIQALGVGITVGWIGVVSVVGFVVAKLVFGLRVTEEAEREGLDITSHGEAAYES

SEQ ID NO: 4034 - DNA, 1365 bp, Azoarcus sp. BH72
  CDS (1)..(1365)
atgaacgatgtgcaattcccgaccgcagccgcggcccgaccacacccacgcggcaccgcggcaacggcggcgctgctgatgctcggcctgtccggcaccgcactggcgcaggaagccgcgccggccacgctcaacagcggcgataccgcctggatgatggtctccagcgtgctggtgctgatgatgctggtgcccggcctcgccctcttctacggcggcatggtgcgcgccaagaacgtgctgtcggtgttcacccagtgtttcggcgttgccggcgtgatcggcatgctgtgggtcatctatggctacagcatcttttccgacaccaccgccatggaggcgggcgtcgtcaacctgcacagcttcatcggcggcttcaagcaggccatctcgccaacatcgaccgcgccagcctcaccggccagcatcccggagagcgtgttcgccaccttccagatgaccttcgcgctgatcacccccgtgatcatcgccggctccttcgccgagcgcatgaagttcagcgcggtgctgctgttcaccgcgctgtggttcaccttctggtacgcgcccttggcgcacatggcgtggagcgccccgggcggccctgcttgggactggggcatcctggaattcgccggcggcaccgtggtgcacatcaacgccggcgtcgccgggctggtcgccgccctggtgctgggccgtcgccgcggctatccgcacgtcgccatgccgccgcacaacctgggcttcgcgctggctggcgcggcgctgctgtgggtgggctggttcggcttcaacgtcggctcggcggtcgccgccaacgagaacgccggcatggcgatgctcaccacccagatcgccgcctgcgccggcgtggtcggctggctggtggtggaatggctcaaggcgggcaagccgagcgcgctgggcgcggcctccggcgccctcgccggcctggtggcgatcaccccggcctgcggcttcgtcggtccgtccggcgcgctgtacatggggctgatcaccggcgccgtctgcttcttcgccatcggctggctcaagcgcaagctgggctatgacgacagcctgggacccttcggcctgcacggcatcggcggcatcgtcggctcgctgctgaccggggtcttcgcgtcgaagagcctgggcggcttccaggacatcgagatcgccagccaggtgcagatccaggcccagagcgtgctcttcacggtgctgtactgcgcgatcgtcacctgggtgctgctgaagctcaccgggctggtcacccgtggcctgcgggtgagcgcggacgacgagcaggaagggctggaccagagccagcacaacgagcgcgcctacaacgtctga

SEQ ID NO: 4035 - protein, 454 aa, Azoarcus sp. BH72
MNDVQFPTAAAARPHPRGTAATAALLMLGLSGTALAQEAAPATLNSGDTAWMMVSSVLVLMMLVPGLALFYGGMVRAKNVLSVFTQCFGVAGVIGMLWVIYGYSIFSDTTAMEAGVVNLHSFIGGFKQAISPTSTAPASPASIPESVFATFQMTFALITPVIIAGSFAERMKFSAVLLFTALWFTFWYAPLAHMAWSAPGGPAWDWGILEFAGGTVVHINAGVAGLVAALVLGRRRGYPHVAMPPHNLGFALAGAALLWVGWFGFNVGSAVAANENAGMAMLTTQIAACAGVVGWLVVEWLKAGKPSALGAASGALAGLVAITPACGFVGPSGALYMGLITGAVCFFAIGWLKRKLGYDDSLGPFGLHGIGGIVGSLLTGVFASKSLGGFQDIEIASQVQIQAQSVLFTVLYCAIVTWVLLKLTGLVTRGLRVSADDEQEGLDQSQHNERAYNV

SEQ ID NO: 4036 - DNA, 1430 bp, Azoarcus sp. BH72
  CDS (24)..(1430)
gccctgtaacggagaatcaaacaatgaaaaaactattcgcgatcctgctgacggccttaaccgtcggctttgcgggcggcgttatcgcccaggaaaacacggcggcgccgactgctccggccgccgtcgaggcgccggccgccaccgacgccgccccggctgcagctgaagccccggccgccgccgaagaagtcgtggccacggtcaacaagggcgacgtcgcctggatcatgaccgccaccctgctggtgctgttcatggccctgcccggcctcgcgctgttctacggcggcctcgtccgcaccaagaacatgctgtcggtgctgatgcaggtgatggtggtgttctcgctgatcgccgtgctgtgggccttctacggctacagcctggccttcaccgaggccagccccttcatcggctcgctcgacaagctgttcctgtccggggtgagcaacagcaccctcgccgacaccttcagcgccgatgcgaagctgccggagtacgccttcatcgccttccaggccaccttcgcgggcatcacctgcgcgctgatcgtcggctccttcgccgaacgcatcaagttctccgcggtgctgctgttctcggtgatctggttcaccttctgctacctgccgatctgccacatggtgtggggcccgggcggcttcctgctgggtgacggcgcgctcgacttcgccggcggtaccgtggtgcacatcaacgccggtgtcgccggtctggtgggtgcctacatggtcggcaagcgcatcggcttcggtcgcgaatccatggctccgcacttcgtgacgctgaccatggtcggtgcctcgatgctgtgggtgggctggttcggcttcaacgccggctccaacctggaagccaccgcgggtgccgcgctcgccttcatcaacaccctgctcgccaccgccgccgccgtgctggcctggtcgctgggcgaagcgatgttcaagggcaagccctcgatgctgggtgcggcctccggcgcggttgccggcctggtggcgatcaccccggcttgcggctcggtcggcccgatgggcgcgatcatcatcggcctgctcgccggcttcgtctgcctgtggggcgtcaatggcctcaagcgcatgctcggcgcggatgactcgctcgacgtgttcggcgtgcatggcctcggcggcatcctcggcgccatcctgaccggcgtgttcaccgcgccgtcgctcggcggcaccggtgccgaagacttcgcgatgggccaccaggtgtgggtgcagacctactcggtgctgatcaccatcgtctggtccgccgtggtcgccttcatcggctacaagatcgccgacatgttcgtcggtctgcgggtgccggaagaagaggaacgcgaaggcctggacgtgaccgcccacggcgaaaccgcgtaccactactaa

SEQ ID NO: 4037 - protein, 468 aa, Azoarcus sp. BH72
MKKLFAILLTALTVGFAGGVIAQENTAAPTAPAAVEAPAATDAAPAAAEAPAAAEEVVATVNKGDVAWIMTATLLVLFMALPGLALFYGGLVRTKNMLSVLMQVMVVFSLIAVLWAFYGYSLAFTEASPFIGSLDKLFLSGVSNSTLADTFSADAKLPEYAFIAFQATFAGITCALIVGSFAERIKFSAVLLFSVIWFTFCYLPICHMVWGPGGFLLGDGALDFAGGTVVHINAGVAGLVGAYMVGKRIGFGRESMAPHFVTLTMVGASMLWVGWFGFNAGSNLEATAGAALAFINTLLATAAAVLAWSLGEAMFKGKPSMLGAASGAVAGLVAITPACGSVGPMGAIIIGLLAGFVCLWGVNGLKRMLGADDSLDVFGVHGLGGILGAILTGVFTAPSLGGTGAEDFAMGHQVWVQTYSVLITIVWSAVVAFIGYKIADMFVGLRVPEEEEREGLDVTAHGETAYHY

SEQ ID NO: 4038 - DNA, 1317 bp, Pseudomonas stutzeri (Pseudomonas perfectomarina)
  CDS (1)..(1317)
atgactctgcgaagattcgcagggctaggagcccttttgtctctgttaagcccaggcctggccatggcgcaggaggcaacgctggattcaggcgatacggcatggatgctgacggccactgcgctggtgctgttcatgaccatccccggactggcgctgttctacggcggcatggtccgctcgaagaacatcctctcggtgatgatgcagtgcttcgccatcaccggcctgatgagcatcctctggatggtctatggctacagcctcgcattcgataccaccggtatggaagcgggcgtcaccaacttcaattccttcgtcggtggtctggatcgcgccttcctcagcggcctgactcctgacagcctggtcggcgccttcccggaaagcgtcttcatcacgttccagatgaccttcgccatcatcaccccggcgctcatcgtcggcgccttcgccgagcgcatgaagttctcggcgatgctggtgttcatggacgtgtggttcaccctggtctatgcgccgatcgcgcatatggtctggggcggtgacggtggcctgatgtgggactggggcgtgctggatttcgccggtggcaccgtggtgcacatcaatgccggtatcgccggtctggtggcctgcctggtcctgggcaagcgcaagggcttcccgaccacgccgatggcaccgcacaacctggggctgaccctggtcggcgcggcgatgctgtggattggctggttcggcttcaacgccggttcggccgtggctgccaacggcaccgctggcatggccatgctggtcacccagatcgccaccgccgcagctgcgttgggctggatgttcgccgagtggatcggccacggcaaacccagcgcgctgggcatcgcctcgggcgtggtcgccggtctggtcgccatcaccccggctgccggcaccgtcgggccgatgggcgcgctgatcatcggcctggtctcgggcgtggtctgcttcttctgcgccaccagcctgaaacgcaagctcggctacgacgattcgctggatgcctttggcgtgcacggcgtgggcggcatcgtcggtgcgctgctcaccggcatcttcgccgcacccatgctgggcggtttcggtgaggtggagaacatcggcctgcagctgtggattcagttcaagggcgtgctcttcaccgtcgtctacaccggcatcgtcacctacctgatcctcaaggcgatcgacctggtgatgggcctgcgggtgaacgaggagcaagagaccatcggcctcgacctcagcctgcacaacgagcgcggctacaacctgtaa

SEQ ID NO: 4039 - protein, 438 aa, Pseudomonas stutzeri (Pseudomonas perfectomarina)
MTLRRFAGLGALLSLLSPGLAMAQEATLDSGDTAWMLTATALVLFMTIPGLALFYGGMVRSKNILSVMMQCFAITGLMSILWMVYGYSLAFDTTGMEAGVTNFNSFVGGLDRAFLSGLTPDSLVGAFPESVFITFQMTFAIITPALIVGAFAERMKFSAMLVFMDVWFTLVYAPIAHMVWGGDGGLMWDWGVLDFAGGTVVHINAGIAGLVACLVLGKRKGFPTTPMAPHNLGLTLVGAAMLWIGWFGFNAGSAVAANGTAGMAMLVTQIATAAAALGWMFAEWIGHGKPSALGIASGVVAGLVAITPAAGTVGPMGALIIGLVSGVVCFFCATSLKRKLGYDDSLDAFGVHGVGGIVGALLTGIFAAPMLGGFGEVENIGLQLWIQFKGVLFTVVYTGIVTYLILKAIDLVMGLRVNEEQETIGLDLSLHNERGYNL

SEQ ID NO: 4040 - DNA, 2195 bp, Chlamydomonas reinhardtii
  CDS (28)..(1647)
ctgacctaagttaaaatagacacaaacatgtcaggagactttggctctgagcccctgggctcgtgctcagtggaaaccgttacggccttgctcggctatgggctcgagcaggacagcatcacggcgctttgccagcccgaggggggcgctggttgcaccagcacagataactgcatgttccagtatctgatgggcgcgaccgcggacgcgcagagcacggccagcgatgtgggagtcgggctcgacgtgagcttcctgttgttcagcggctatctggtattcgtgatgcagctcgggttcgctgtgctgtgcgctggaagcatccgctccaagaactgcatgaatatcctgctgaagaacatgctggacgcctgcgtgggcgctatcggcttctatgtcttcggatacgcgttcgcgtacggccgcaagtatggacagaatagcaacggcttcattggcaactggaactttgcgctctcgtacacaactcagacgtcaatgagcggcaccgagttcaccacgtttggatggcaccagttcttcttccagtggagcttctgcgccgccaccaccaccatcgtgtctggcgcggtggccgagcgctgcaccttcatggcctacatgatctacgcgttcttcctctcctccttcgtctaccccgtcatcgtgcactgggtgtgggacggccagggctggctcagtgccttcaacacattccaggacggctacgccctgatcctcaagaccggtgccattgactttgcgggctcgggcgtcgtgcacatgacgggtgggattgcggcactcatgggtgcctggattatgggcccccgtgtcggtcgcttcgctaatgacggcacggtgaatgagatgaggggccactcctccacgctggttgtgatgggcaccttcctgttgtggttcggctggttcggattcaaccccggcagcaacctggtggtcgcctcccaggctgcggccacagtcgtgtcgcgtgtcgcagtgaccaccgctctggcaggtggcgcgggtggaatctccatgctcttctacaagttcctgaccgtcaaggcttgggacgtggtggcgacgtgcaatggcatcctggctggcctcgtggccgtcacggctagctgctccgtcattgagccctgggcggccatcatcactggggccatcggggcaatcatcttttccattgctgattacgtgacgctttacaagctgaaggtggacgaccccgtgagcgcctttgccctgcacggcgccgtgggcgcatggggcgtgttgttccccggcttcctggcggctccccactatgtggtagaggtgtacggtgcctacggattcggaatggatgcacgggagggcaagaggttcggtctgttctacggcggccacggccaggtgctgctggtgcagctcatcgaggtgctggccatctttgggtggactggattcatgatgggcagcttcttcttcatcctcaacaaggctgggctgctgcgtgtgcccctgcaggaggagatggcgggtctggatgcggctaactacagcaagagcgttggcagcaaggacccctccgtccactgcaccgttggtgtggacaagctggaaggcggcgcgctgggggagggcaaggcctgatgggcacgcggcaacgaatggccaactcggtttgatggaaatccttcttgactgcggcacatttgatgacccgctacaacaaagaaaagcatgataggctgataccagagaggcacggcagtcgtgtgatgctgcagtgtgctgtggccctgaccactcatgtttcttacttagagagtagtcctggagagtcagagaggcgtgcttgcgatcctcgcattctttttgcgtgcaatgcatatccatagaccatacagttcatatcgtacagttgctaccaggagtttatcagggtcccctcatcttcagcaggggaacccctgttatatagcaccctcgccaatggggcgactgaccgaccatccaaccggcttacagctccgcgcggggacatcttgccctgattggtgtgggcttgcattggccaggccatagcgacgcgagccagcataattgcatctgttgtcagaagctgcttcctagtccttagcacctccaacctgcgggcgtcaaggcgcctattgtaactgcattcgtgaaaaaaaaaa

SEQ ID NO: 4041 - protein, 539 aa, Chlamydomonas reinhardtii
MSGDFGSEPLGSCSVETVTALLGYGLEQDSITALCQPEGGAGCTSTDNCMFQYLMGATADAQSTASDVGVGLDVSFLLFSGYLVFVMQLGFAVLCAGSIRSKNCMNILLKNMLDACVGAIGFYVFGYAFAYGRKYGQNSNGFIGNWNFALSYTTQTSMSGTEFTTFGWHQFFFQWSFCAATTTIVSGAVAERCTFMAYMIYAFFLSSFVYPVIVHWVWDGQGWLSAFNTFQDGYALILKTGAIDFAGSGVVHMTGGIAALMGAWIMGPRVGRFANDGTVNEMRGHSSTLVVMGTFLLWFGWFGFNPGSNLVVASQAAATVVSRVAVTTALAGGAGGISMLFYKFLTVKAWDVVATCNGILAGLVAVTASCSVIEPWAAIITGAIGAIIFSIADYVTLYKLKVDDPVSAFALHGAVGAWGVLFPGFLAAPHYVVEVYGAYGFGMDAREGKRFGLFYGGHGQVLLVQLIEVLAIFGWTGFMMGSFFFILNKAGLLRVPLQEEMAGLDAANYSKSVGSKDPSVHCTVGVDKLEGGALGEGKA

SEQ ID NO: 4042 - DNA, 1494 bp, Oryza sativa (japonica cultivar-group)
  CDS (1)..(1494)
atggcgtcgccgccgcagcccgggccgtacatgccggacctgccggcggtgccggcgtggctgaacaagggcgacaccgcgtggcagctggtggcggcgacgttcgtcggcatccagtcgatgcctgggctggtggtgatctacggcagcatcgtgaagaagaagtgggccgtcaactccgccttcatggcgctgtacgcctacgcgtccacgcttatcgtgtgggtgctcgtcggcttccgcatggcgttcggcgaccggctgctcccgttctgggccaaggccgggccggcgctgacgcaggacttcctggtgcaacgcgcggtgttcccggcgacggcgcactacggcagcgacggcacgctcgagacgccgcgcaccgagccgttctacgcggaggcggcgctggtgctgttcgagttcgagttcgcggccatcacgctggtgctgctcgccgggtcgctcctggggcggatgaacatcaaggcgtggatggcgttcaccccgctctggctcctcttctcctacaccgtcggcgcgttcagcctctggggcggcggcttcctctaccagtggggcgtcatcgactactccggcggatacgtcatccacctctcctccggcgtcgccggcttcaccgccgcctactgggtgggcccgaggctgaagagcgacagggagcggttctcgccgaacaacatcctgctcatgatcgccggcggcgggctgctgtggttgggctgggccgggttcaacggcggcgcgccgtacgcccccaacgtcaccgccacggtcgccgtgctcaacaccaacgtcagcgccgcgacgagcctcctcacctggacctgcctcgacgtcatcttcttcggcaagccctccgtcatcggcgccgtgcagggtatgatgacggggctcgtctgcatcacgcccggcgccgggctggtgcacacgtggtcagcgatgctgatgggcatgttcgccggcagcgtcccgtggttcacgatgatgatcctgcacaagaaatccaccttcctcatgaaggtcgacgacaccctcgccgtcttccacacccacgccgtcgccggcatcctgggcggcgtcctcacgggcctcctcgccacgccggagctctgcgctctcgattgcccgatcccgaacatgcgcggcgtcttctacggcagcggcatcggccagctcgggaagcagctcggcggcgcgctgttcgtcaccgtctggaacctcatcgtcaccagcgccattctcctctgcatcggcctcttcatcccgctccgcatgtccgacgaccagctcatgatcggcgacgacgcggcgcacggggaggaggcctacgctctgtggggggacggtgagaagttcgacgtgacgcggccggagacgacgaggacgggaggtgcaggcggcgcgggcagggaggacaccatggagcagaggctgaccaacatgggagccaggggtgtcaccattcagttgtag

SEQ ID NO: 4043 - protein, 497 aa, Oryza sativa (japonica cultivar-group)
MASPPQPGPYMPDLPAVPAWLNKGDTAWQLVAATFVGIQSMPGLVVIYGSIVKKKWAVNSAFMALYAYASTLIVWVLVGFRMAFGDRLLPFWAKAGPALTQDFLVQRAVFPATAHYGSDGTLETPRTEPFYAEAALVLFEFEFAAITLVLLAGSLLGRMNIKAWMAFTPLWLLFSYTVGAFSLWGGGFLYQWGVIDYSGGYVIHLSSGVAGFTAAYWVGPRLKSDRERFSPNNILLMIAGGGLLWLGWAGFNGGAPYAPNVTATVAVLNTNVSAATSLLTWTCLDVIFFGKPSVIGAVQGMMTGLVCITPGAGLVHTWSAMLMGMFAGSVPWFTMMILHKKSTFLMKVDDTLAVFHTHAVAGILGGVLTGLLATPELCALDCPIPNMRGVFYGSGIGQLGKQLGGALFVTVWNLIVTSAILLCIGLFIPLRMSDDQLMIGDDAAHGEEAYALWGDGEKFDVTRPETTRTGGAGGAGREDTMEQRLTNMGARGVTIQL

SEQ ID NO: 4044 - DNA, 1883 bp, Oryza sativa (japonica cultivar-group)
  CDS (87)..(1580)
gcacgagcttacatgtaagctcgtgccgaattcggcacgagcttacaatccaaacaatcacgtcggtcgacgagaagaagtgagtgatggcgtcgccgacccggccggggccgtacatgccgcgcccaccggcggtgccggagtggctgaacaccggggacaacgggtggcagctcgcggcggcgacgttcgtcgggctccagtcgatgcctgggctggtggtgctgtacggcagcatcgtgaagaagaagtgggccgtcaactcggccttcatggcgctgtacgcgtacgcgtccacgctcatcgtgtgggtgctggtcggcttccgcatggcgttcggcgaccggctgctcccgttctgggggaaggccggcgcggcgctgacggaggggttcctcgtggcgcgcgcgtcggtcccggccacggcgcactacgggaaggacggcgccctggagtcgccgcgcaccgagccgttctacccggaggcgtccatggtgctgttccagttcgagctcgccgccatcacgctggtgctgctcgccgggtcgctcctcgggaggatgaacatcaaggcgtggatggcgttcactccgctctggctcctcttctcctacaccgtctgcgccttcagcctctggggcggcggcttcctctaccagtggggcgtcatcgactactccggcggatacgtcatccacctctcctccggcatcgccggcttcaccgccgcctactgggtggggccgaggctgaagagcgacagggagcggttctcgccgaacaacatcctcctcatgatcgccggcggcgggctgctgtggctgggctgggccgggttcaacggcggcgcgccgtacgccccaaacatcaccgcgtccatcgccgtgctcaacaccaacgtcagcgccgcggcgagcctcctcacctggacctgcctcgacgtcatcttcttcggcaagccctccgtcatcggcgccgtgcagggcatgatgaccggtctcgtctgcatcacccccggcgcaggtctggtgcacacgtgggcggccatactgatgggcatctgtggcggcagcttgccgtggttctccatgatgatcctccacaagagatcggcgctgctccagaaggtggacgacaccctcgccgtcttccacacccacgccgtcgcgggcctcctcggcggcttcctcacgggcctgttcgccttgccggacctcaccgccgtccacacccacatccctggcgcgcgcggcgcgttctacggcggcggcatcgcccaggtggggaagcagatcgccggcgcgctcttcgtcgtcgtgtggaacgtcgtggccaccaccgtcatcctgctcggcgtcggcctcgtcgtcccgctccgcatgcccgacgagcagctcaagatcggcgacgacgcggcgcacggggaggaggcctacgcgctatggggagacggcgagaggttcgacgtgacgcgccatgagggggcgaggggcggcgcgtggggcgccgcggtcgtggacgaggcgatggatcaccggctggccggaatgggagcgagaggagtcacgattcagctgtagtggtggtagagtgggcattttgtcgcaggctttgccgcactgcagctaaactggacgttgaccatacgataattctcatctcgtacaggtagatcttgcaactagcaagatggagtagcagatattactaaacacatatgcttcattattttatttctggagtaaatcaagattcgttttggggtagtggtagatatttgcaatctgatgcagtcagtatgcaatgtgtcctaccctgggagtcccaatagataaacaaacttttgccagcattgcacacaagcaaaaaaaaaaaaaaaaaaa

SEQ ID NO: 4045 - protein, 497 aa, Oryza sativa (japonica cultivar-group)
MASPTRPGPYMPRPPAVPEWLNTGDNGWQLAAATFVGLQSMPGLVVLYGSIVKKKWAVNSAFMALYAYASTLIVWVLVGFRMAFGDRLLPFWGKAGAALTEGFLVARASVPATAHYGKDGALESPRTEPFYPEASMVLFQFELAAITLVLLAGSLLGRMNIKAWMAFTPLWLLFSYTVCAFSLWGGGFLYQWGVIDYSGGYVIHLSSGIAGFTAAYWVGPRLKSDRERFSPNNILLMIAGGGLLWLGWAGFNGGAPYAPNITASIAVLNTNVSAAASLLTWTCLDVIFFGKPSVIGAVQGMMTGLVCITPGAGLVHTWAAILMGICGGSLPWFSMMILHKRSALLQKVDDTLAVFHTHAVAGLLGGFLTGLFALPDLTAVHTHIPGARGAFYGGGIAQVGKQIAGALFVVVWNVVATTVILLGVGLVVPLRMPDEQLKIGDDAAHGEEAYALWGDGERFDVTRHEGARGGAWGAAVVDEAMDHRLAGMGARGVTIQL

SEQ ID NO: 4046 - DNA, 1437 bp, Emericella nidulans (Aspergillus nidulans)
  CDS (1)..(1437)
atgtcgacttaccctgttgcctacaatgggaccggcgtgaacggtggtgactccctcagggaggatctcaacatctactacagttctggtgatattgcatgggttattacctcaaccgcgctagttcttctaatgataccgggtgtaggattcttctactccggtctcgctcgtcggaagtccgccctctccctgatatggctttcattgatgtctatcggtgtggtctcattccaatggttcttctggggttattcgttggccttttcccacactgccggaaagtacattggtaacttggataactttgggttcaagggtgtcctgggcgctccttcagtgggctcaaccaaggtccccgatcttctgtttgctgtctttcagggaatgtttgctgcgattaccgttgcacttgccgttggtgccgttgcagagcgtggtcgtatgcttccctgcatggttttcgtctttatctggagtaccatcatctacgaccccgttgcatgctggacctggaatgcttctggttgggtcttccagttaggaggcttggactttgctggtggcacgccagtccacattgtctccggtacgacggctctggcctactctttgatgctcggcaagcgtcgtggtcacggaactcatgagctcaactatcgccctcacaacgttactcatgttgtgattggcaccgtctttctttgggttggctggttcggtttcaacgccggctccgccttgagcgctaatctgcgtgctgtgatggctgctgtagtgacaaacttggctgcttctgtaggtggtgtcacctggtgcttgctcgactaccgtctagaaagaaagtggtcaaccgttggcttctgttccggtgtgatttccggccttgttgccattacccccggttctggcttcgtgactccctgggctgcgtttatcttcggcgttgtcggtgctgctgcttgcaacttcgcgactaaagtcaagtatctcatccgagttgatgatgctctcgatatcttcgctgtgcacggtatcggtggtcttgtcggtaacctcctgaccggtctcttcgcagctgactacattgcccacctggacggctctaccgagatcgacggcggctggatcaaccacaattacatccaactcggctaccaacttgccgattccgtcaccggcatggcctactccttcttcggcagctgcatcattctctttatcatcaacatgatccccggccttagcctgcgcgtccctgaagaagatgaagtccttggtatcgatgacgccgaaattggcgaatttgcttatgactacgtcgaactcacccgcgacgttattaacgggaccactgagccgatggacggcgcatccaagcgcagcaccactcccaccggacccgtcgaaccatcccctgccgagctcaaagcgtaa

SEQ ID NO: 4047 - protein, 478 aa, Emericella nidulans (Aspergillus nidulans)
MSTYPVAYNGTGVNGGDSLREDLNIYYSSGDIAWVITSTALVLLMIPGVGFFYSGLARRKSALSLIWLSLMSIGVVSFQWFFWGYSLAFSHTAGKYIGNLDNFGFKGVLGAPSVGSTKVPDLLFAVFQGMFAAITVALAVGAVAERGRMLPCMVFVFIWSTIIYDPVACWTWNASGWVFQLGGLDFAGGTPVHIVSGTTALAYSLMLGKRRGHGTHELNYRPHNVTHVVIGTVFLWVGWFGFNAGSALSANLRAVMAAVVTNLAASVGGVTWCLLDYRLERKWSTVGFCSGVISGLVAITPGSGFVTPWAAFIFGVVGAAACNFATKVKYLIRVDDALDIFAVHGIGGLVGNLLTGLFAADYIAHLDGSTEIDGGWINHNYIQLGYQLADSVTGMAYSFFGSCIILFIINMIPGLSLRVPEEDEVLGIDDAEIGEFAYDYVELTRDVINGTTEPMDGASKRSTTPTGPVEPSPAELKA

SEQ ID NO: 4048 - DNA, 1635 bp, Emericella nidulans (Aspergillus nidulans)
  CDS (1)..(1635)
atggcctctgaaggcatggctcccttcactcccgagtatgcctcgtacaactggacaggcgctccctcagactattccagcctggccaccaacgagctgggcggaaactcaagggtggaaaacttgaacaaatggtaccaatcgggtgaccaagcctacatcatcgttgcttcggccatggtcatgctcatggtgcctggcctcggattcctttactccggtctcgctcgccgcaagtcagccctcagcatgatctgggcttgtatgggctcgatgtgcgttgtaacattccaatggtacttctggggttactcgcttgctttctctcccaccgctacaaatggatacattggaaacctgcgcaatttcggtctgatgaaggttctggcggaccccagcccagggtctcctctggttcctaacctcctctacgccttctaccagatgcaattctgtgccgtaactgctgctatcattatgggagcggttgccgaacgtgggcgtcttcttcctgccatggtctttactttcgtctgggccacaatcgtgtactgccccatcgcttgctgggtatggaatgtcaacggctgggccttcaactatggcgtgctggattatgctggtggtggccccgtcgaaatctgctccggtctttcggcgctcgcatactctatggtcctcggtcgtcgccaggagcgcatgatgctcaacttccgcccccacaatgtttccctcattctgctcggtaccgtctttctctggttcggatggcttggattcaacggtggctcgtcattcggtgcaaacatgcgcgctacgatggcatgctggaacacaaacttgaccgctgcctttggcgcgatcacttgggttattctcgattggcgcctggctcgcaagtggtcgatggtcggttggtgttccggtacaatctccggtcttgtcgctgctactcctgcttccggtttccttcctccctgggctagtgttgttctcggtattgtgaccggcattgtatgcaactactccacgaaggtgaaatactggatccgtattgatgactctatggatgtgttcgccgagcacggtgttgctggtattgtcggtctcattttcaacgccttcttcgcagacgacgccatcgtcggccttgacggggtcaacaccggttctgaaatgggcggctggctcatccacaactggaagcaactttacatccaaatcgccttcatcgtcgctgcctccgcctactccttcgttgtgtcggccattgtcgcctacgccatcaacgccatcccaggcctgaagctccgtgcatccgaagaggccgaactcctcggcatggatgatgatcagctgggtgaattcgcttacgactatgttgaggtccgtcgtgactaccttgcctggacaccccagaagcacgaccaacacgcagacggtcatgaggttcctgctgccgcgaggtatggcatcggggagcacagcgagatgatgctcgacggtgaggctcccacaggtgcgaccaacagccgcggaagtgaggtatcaggcgtgcaagaaatcaatgtcaaggaagaatcgcaacggcctgcgccgccgaccgacgccgagaaggctgctcaggggctttaa

SEQ ID NO: 4049 - protein, 544 aa, Emericella nidulans (Aspergillus nidulans)
MASEGMAPFTPEYASYNWTGAPSDYSSLATNELGGNSRVENLNKWYQSGDQAYIIVASAMVMLMVPGLGFLYSGLARRKSALSMIWACMGSMCVVTFQWYFWGYSLAFSPTATNGYIGNLRNFGLMKVLADPSPGSPLVPNLLYAFYQMQFCAVTAAIIMGAVAERGRLLPAMVFTFVWATIVYCPIACWVWNVNGWAFNYGVLDYAGGGPVEICSGLSALAYSMVLGRRQERMMLNFRPHNVSLILLGTVFLWFGWLGFNGGSSFGANMRATMACWNTNLTAAFGAITWVILDWRLARKWSMVGWCSGTISGLVAATPASGFLPPWASVVLGIVTGIVCNYSTKVKYWIRIDDSMDVFAEHGVAGIVGLIFNAFFADDAIVGLDGVNTGSEMGGWLIHNWKQLYIQIAFIVAASAYSFVVSAIVAYAINAIPGLKLRASEEAELLGMDDDQLGEFAYDYVEVRRDYLAWTPQKHDQHADGHEVPAAARYGIGEHSEMMLDGEAPTGATNSRGSEVSGVQEINVKEESQRPAPPTDAEKAAQGL

SEQ ID NO: 4050 - DNA, 1215 bp, Methanosarcina acetivorans
  CDS (1)..(1215)
atgataaatactggttcaacaggctttatgctacttgcgacaagtcttgtgatgctcatgacccctggtctggcattcttttacggaggacttgcctgtaagagaaacattttaggaataatgatgcagagttttgtttctctcgggctgacaaccattttatggtttttcgtaggatattctctctgcttcagcggaggagaaggtgcaatcctaggaaacctggacaaaatgttcttgaacgggattgccccgacggatatgtttggagatgccgggttccccgagctcgtcttcgtagcttaccagatgatgtttgcaatcattaccccggccctgattacgggagcatttgcaaacaggattacttttaaggcttacattattttccttgtcgtctggcagctctttgtttactatccttttgtacacatggtctggggaggcggcctgcttgccgaaatgggggttatcgactttgccggtggaatcgtggttcatgcgacagccggatttgcagcccttgcctcagtgttttatgtaggctcgaggaaatataaggattcaaagccaaataatatccccttaatggctgtcggaactgcacttctctggttcggatggtacgggtttaatgcaggcagcgaactcaatgtggacgggattacagcccttgcattcctgaacagcgacattgcagcttcttttgcagctattacctggatgataatagaatggttaagggaaacaaaaccaaaattcgttgggcttatgaccggagctgttgcagggcttgcgacaattactcctgcagcagggcttgtttccatgcatgtggctgcattaatgggcatcctcggagctattgcctgctactttgcagtacatattaaaaacaggatgcaatgggatgatgccctggatgtatggggtgttcacggaataggaggagtaacagggacaattttacttggaatctttgcttcaactgccataaatccggtaggagccgacggactgttttacggtggcactgcattctttatcaaagaactttcagttgttttaggtgcttcaatttatgcatttatatttacctacattatgctgatgctcataaacgtaataactccggtcaaagtttcggatgaagaagagctggcagggctggatatctcaatgcatggcgaatgcgcctacgatgcgattcactga

SEQ ID NO: 4051 - protein, 404 aa, Methanosarcina acetivorans
MINTGSTGFMLLATSLVMLMTPGLAFFYGGLACKRNILGIMMQSFVSLGLTTILWFFVGYSLCFSGGEGAILGNLDKMFLNGIAPTDMFGDAGFPELVFVAYQMMFAIITPALITGAFANRITFKAYIIFLVVWQLFVYYPFVHMVWGGGLLAEMGVIDFAGGIVVHATAGFAALASVFYVGSRKYKDSKPNNIPLMAVGTALLWFGWYGFNAGSELNVDGITALAFLNSDIAASFAAITWMIIEWLRETKPKFVGLMTGAVAGLATITPAAGLVSMHVAALMGILGAIACYFAVHIKNRMQWDDALDVWGVHGIGGVTGTILLGIFASTAINPVGADGLFYGGTAFFIKELSVVLGASIYAFIFTYIMLMLINVITPVKVSDEEELAGLDISMHGECAYDAIH

SEQ ID NO: 4052 - DNA, 1209 bp, Methanosarcina acetivorans
  CDS (1)..(1209)
atgaggtggatagaaatggcaatcgtagcagcagataccgtatgggtattgatttcctctgcccttgtattattaatgcttccagggctcgcactgttttatggcggattggttcagcgtaagaatgtactgagcagcatgatgcattcatttgttgcaatgggtgtcatggctctcgaatgggtaataattggttactcgcttgcgtttgggagcggaaacggtttcataggcagcctggaacacgtattcctgaaaggaattgacccttactcggtaacagggacaattcccacatatgcatttattgcctttcagggaatgtttgcaataattacccctgcccttatctcaggggccattgtcggacgtgtcaagttcaaatcatacatcgcattcatcgccctctggggactcattgtctatgcaccggtctgccactgggtatggggcggtgggttcctcacaggagaagcccttgactttgcaggtggaacggtagtccatataacatcaggcatatcctcactggcaattctgaccttccttggaaagaggagagggtacggcatagattcgataaaaccgcacaatgtcaccctgactcttctggggaccgggctcctctggttcggatggttcgggttcaatgccggctcctctcttgctgcaaatgaaattgcagccctcgcattcattacaaccctcgtagcccccgcagctgcagggtttgtctggatgaccctggaatggatccacctggggcgccctactgccctcggatttgcaacaggcgtcctggcagggcttgttgccataaccccggctgcagggtttgttacccccatggcagcaattccgataggtgtggttacaagctttatctgctaccaggctgtaatgctcaagggaagattaggttatgatgattctcttgatgctttcggagtccacggagtaggcggaattagcggggcaattctgacaggcgtatttgcaagcatagggtcttcaggactccttctcggcaactccgagcaactgatgctccaggtagaaggcgttattgccacgcttgtttacgcaagtgtttgcacccttatcatcgggtttgtactccacaagacgatcgggctcaaggtaagcgagagcgaagaaaatatcgggcttgaccggacacaacacggagaagcagcatataacatttga

SEQ ID NO: 4053 - protein, 402 aa, Methanosarcina acetivorans
MRWIEMAIVAADTVWVLISSALVLLMLPGLALFYGGLVQRKNVLSSMMHSFVAMGVMALEWVIIGYSLAFGSGNGFIGSLEHVFLKGIDPYSVTGTIPTYAFIAFQGMFAIITPALISGAIVGRVKFKSYIAFIALWGLIVYAPVCHWVWGGGFLTGEALDFAGGTVVHITSGISSLAILTFLGKRRGYGIDSIKPHNVTLTLLGTGLLWFGWFGFNAGSSLAANEIAALAFITTLVAPAAAGFVWMTLEWIHLGRPTALGFATGVLAGLVAITPAAGFVTPMAAIPIGVVTSFICYQAVMLKGRLGYDDSLDAFGVHGVGGISGAILTGVFASIGSSGLLLGNSEQLMLQVEGVIATLVYASVCTLIIGFVLHKTIGLKVSESEENIGLDRTQHGEAAYNI

SEQ ID NO: 4054 - DNA, 2239 bp, Methanosarcina mazei (Methanosarcina frisia)
  CDS (537)..(1730)
gaataaaaattctctgatagaagagatgaaaaggggaagtctgggttttgaacccgggttgatcgaattcaataacgaatatttttacaggtttttgccccaaactgttcaaataattagcacatatttagatagaattaaatagaataaagtaggatagaggatacctactggtggtcgcgatgaaatacgtaattgcaatgataaggcctgaaaggcttgatgcagtcaaaagagagcttcagaaaatcgaagtgagcaggttgactgtatcatccgtttccggctatggcgctcaaaaaggatatatggaaatctacagagcgatggaatatgatgcaaacctgcttgaaaaaatcaagatcgaaatcgctgtaaatgacgaattccttgagccaacaattgaggcaataaaaactggagcaaaaggcagtgacggttacgttggaagcggaaagatcttcgtgctgccacttgaaaacgtgataaggatccgcacgaacgaaaccggacctgaggcaatttgagggttgaaaatggctataaacgaagcagacactgtatgggtattgctttcatcggcattggtattattaatggttcctgcgctggcactgttctacggagggcttgtccagcgtaaaaacgtcctgagcagcatgatgcattcattcgttgcaatgggcgtcctggctcttgaatggataataataggttactcccttgcgttttcagaaggcaactggtttattggcggccttgagaatgtgtttctgagcgggattgatccttactccgtaacaggtacgattcccacctatgcatttgttgcattccagggaatgttcgcaataattactcctgcacttatatccggtgccatagtagggcgtgtcaagttcaagtcttacatcgcgttcatcctgctctggggccttattgtctatgccccggtatgtcactgggtttggggcggcggattccttaccggagaagcccttgactttgcaggcggtacggttgtccacataactgcaggtatgtcttcacttgcaatactggcatacctcggcaagagaaggggatatggtgttgattccctgaagccgcacaacgttaccctgaccctcctcggagccggacttctctggttcgggtggttcgggttcaacgcaggctcggctcttgctgcaaacgaaatagcagcccttgcattcatgaccacgctcgttgctcccgctgcagcaggttttgtctggatggcgcttgaatgggcgcaccttggacgccccaccgcactcgggtttgcaaccggcatcctggcagggcttgtagggataactcctgctgccggatttgtcactccagtagccgcgattgccataggtgcgattgcaagcttcatatgttaccaggctgtgatgttcaaaaacaggctaggatacgacgattcacttgatgcatttggagttcacggagtcggcggaatagtcggtgcgatattaacaggcgtatatgcaagtgtaggcggagaaggcctacttctcgggaactctgcccagttgatgattcagcttcagggcgtggttatcacaattgtatacgcaatggcctgcaccctgctgataggatttgtactccataaaacgatagggctcaaagtcagtgaaagcgaagaaatcatagggcttgacaaaacccagcatggtgaagcagcatacaacatttgagttcgggtgaatcttcaccctggctctcaaacagatttttttatttcttaactgttttttatttcttaactgttttttatttcttaactgttttatatttcttaactgttttatatttcttaactgttttttatttcttaactgttttttagttcgcagaaaaacatgttttttagagaaagtatgtctgataaagagaagagggaattataattcctgagaacttttacgctgcttttatagaggatttaaaggaacactgtaaacatgaatatacgttttaagagatgcctggaagacaataaattaagggtcacatgacaggacggtttcatatgacagaaaaaatcccatctgagataattgatgaattggaacgcgcgaaccgtctgcatgaacaggcggtatgtgaccatgaaaaatgcagagaattcagcgaaagtctatccaaacttctgaccaggcttgaagacatgaaatactacaggacagcagacaggctgatgagt

SEQ ID NO: 4055 - protein, 397 aa, Methanosarcina mazei (Methanosarcina frisia)
MAINEADTVWVLLSSALVLLMVPALALFYGGLVQRKNVLSSMMHSFVAMGVLALEWIIIGYSLAFSEGNWFIGGLENVFLSGIDPYSVTGTIPTYAFVAFQGMFAIITPALISGAIVGRVKFKSYIAFILLWGLIVYAPVCHWVWGGGFLTGEALDFAGGTVVHITAGMSSLAILAYLGKRRGYGVDSLKPHNVTLTLLGAGLLWFGWFGFNAGSALAANEIAALAFMTTLVAPAAAGFVWMALEWAHLGRPTALGFATGILAGLVGITPAAGFVTPVAAIAIGAIASFICYQAVMFKNRLGYDDSLDAFGVHGVGGIVGAILTGVYASVGGEGLLLGNSAQLMIQLQGVVITIVYAMACTLLIGFVLHKTIGLKVSESEEIIGLDKTQHGEAAYNI

SEQ ID NO: 4056 - DNA, 1446 bp, Neurospora crassa
  CDS (1)..(1446)
atgtcgtccggccccgttgaaacgtacgagggggttgccggcgtcgccaacaatggaggcaacccccttctcgaagacctcaaccgatattattctgccggagatttcggatggatcatgacatgtacagccctcgtgctgctcatggttcccggtgtcggtttcttctacagcggtcttgcacgaagaaagtcagccttggccctcatctggctttccctcatgtcgatagccatcgtagggtttcaatggttcttctggggttactcgcttgccttctcccacaccggaagcgcctacatcggcaacctctccaactttggtctcatgaagaccctcgcccagccaagcgttggcagcggcaagatccccgaccttcttttctgcctctatcagggcatgttcgctgccatcactcccgcgctcgctattggcgcgtgcgctgatcgcggccgtatgcttcccgctctggtcttcatgttcatctggaccaccatcgtctacgaccccatcgcctactggacctggaacggcaatggttggtccttcaagatgggcggtctcgactttgcgggcggcacgcccgtgcacatcagctccggagccgccgccctcgcctactcgctcatgctcggcaagcgcaacggctacaacaaggtcaacggtctgccctatcgcccccacaatgtcacccacgtcgttctaggcaccgtattcctctgggtcggctggttcggttttaacggcggtagcgccctggccgccaacctccgcgccgtcatggcctgcatcgtcactcacattgctgcttgcgtcggtggcttgacttgggtcttgctcgattaccggctggagaggaagtggagcaccgtcggcttctgctccggtgccattgctggtcttgtcgccatcacccctgctgcgggttacgtccctccctggtcggctttcatctttggtgttgtcggcggtatcagctgcaactttgctactaagctcaagttccttctgggtattgatgaggcactcgatgtgtttgctgagcacggtgttggaggtattgtcggcaacttgttgactggtatctttgctgctgactacattgccgctctcgacggtgtctccatcggcgactcagccatcgccggcggctgggttaaccaccactacatccagctcgcctaccagcttgccgacagcgtcgccggcttctcttactccttcgtcatgacctgcgtcatcctcttccttctcaacctcgttcccggcctctctcttcgtgtcgaccaccaccaggaggacattggcctcgacgacgaccagcttggcgaattcgcatacgattatgtggaggtcactcgcagcttggatgttattcctggattaactgcccccaacagcacagctggtagcatcagcgggagggaccctgagaagcaggtctaa

SEQ ID NO: 4057 - protein, 481 aa, Neurospora crassa
MSSGPVETYEGVAGVANNGGNPLLEDLNRYYSAGDFGWIMTCTALVLLMVPGVGFFYSGLARRKSALALIWLSLMSIAIVGFQWFFWGYSLAFSHTGSAYIGNLSNFGLMKTLAQPSVGSGKIPDLLFCLYQGMFAAITPALAIGACADRGRMLPALVFMFIWTTIVYDPIAYWTWNGNGWSFKMGGLDFAGGTPVHISSGAAALAYSLMLGKRNGYNKVNGLPYRPHNVTHVVLGTVFLWVGWFGFNGGSALAANLRAVMACIVTHIAACVGGLTWVLLDYRLERKWSTVGFCSGAIAGLVAITPAAGYVPPWSAFIFGVVGGISCNFATKLKFLLGIDEALDVFAEHGVGGIVGNLLTGIFAADYIAALDGVSIGDSAIAGGWVNHHYIQLAYQLADSVAGFSYSFVMTCVILFLLNLVPGLSLRVDHHQEDIGLDDDQLGEFAYDYVEVTRSLDVIPGLTAPNSTAGSISGRDPEKQV

SEQ ID NO: 4058 - DNA, 2689 bp, Tuber borchii (White truffle)
  CDS (386)..(1837)
ggcacgagcaaccaacgtgcggccggccctgattattctcgacactccagaaagcgtgcgttgcgagaaaataataaaggaagaggaaaaaaaggaaagaaatttaatacaaacaactaattcgtcgtcctaacccgtgcacgttttattcgaaccctttttctctcaccattttctactgttttgtccgacaaacctacctaccgcacctaccaacctacaaccgtccaaccaaccctccgcttcatccatcatacttgtacgagtactgtagctgtgcaactctatcaccgccctctacatttcactctgacactttgctacttgcgccaagataaaccttcaacttcaagcgggaatatacgagtagtagagtttagccacaatgaatgacccagatcatctcaattatgtcccacttgttcctttcaatggaactaaaccattcgggggtgattcactgactcaagacctgaacatttggtacgagagcggaaatgttgcctgggtcatgacctcgactgcgcttgttctgctgatgattccgggtgtcggattcttctattcgggactcgcgagaagaaagtcggctctttctctcatctggctgtcaatgatggcaaccgctgtagttagctttcagtggttcctttggggttattctttggctttctcgcatactggtggtagattcattggaaaccttgacaatttcggatttaagggacttctcggttatccttctattggaagtgagaaaattccggacctgctgtttgctctctatcagggaatgttctctgctattacggttgctctggctattggtgccgctgcagagagaggccgtatgttgccttgtgtagtttttatgtttgtctgggctactttgatttacgaccctattgcatgctggacgtggaattcctcgggatggtcgttcaggatgggtggattggattttgctggtggaacgccagttcatatttcatccggatccgccgccttggcctactctctgatgttgggaaagcgacgaggccatggaacacatgagttaaactaccgcccacacaatgtcactcacatcgttctcggaacagttttcctgtgggttggctggtttgggtttaacggaggatccgctctttctggcaacatgagagctgttatggcttgtgtcgtcactaatttggctgcatctgttggaggaattacttggtgtcttctcgattaccgtttggagcagaagtggtctactgtgggattctgttcaggagtcattgccggactggttgctattacccctggatctggatatgttccctcttgggctgctgttatttacggtgttgttggtggtgccgcatgtaactatgctaccaagctcaagtttgttattggcgtagatgatgctttggatatcttcgcggagcacggtgtcgggggtattgtaggaaatatcctgacagccttctttgcggctgattacattgcgcatcttgacggctctaccgagattaatggaggttggttgaacggacactataagcaacttggatatcaagttgcggactctgttgcgggttttgcatactccttcggaggcacttgtatcatcctcttcatcatgaatcttatccctggtttgagtcttcgtgctactgaggaggccgagattcttggtattgatgatgccgagctcggagagttcgcctatgactatgttgagcttactcgcgaagttatctctgacgatgacactgtacctaaaatgtcatcggagaacaatgcgagtgtagaactacctgctgaaagggctgagaagtctgcttaaagacttcatcgcttcctcttttcacaaacaatggatccacttgaattcaacactgttcatgtctttctttcttcctttctttcttcctcatcactttcaacgtgctgtgatttctgggcttcaactattcataagtatcaagggaggggggtcacgggaaaaaaaggaaatttaatcggtcacagtgatcagcttactggggaaaaatgaaatattttcctttttatattccctatttgttaattacttgtttcgggggcgtcttgttgttccctatagtgggggtgtgatttggatgaatgataggcttcaataccctcttattttttcttctcgctttttctgtctgggtgcggctctgtctacttttgctcttttttgctttctcacaacttttatttggtctggtcttggtttctctttttctttttttatatatctataaaaaaaaaaaagaagctcctgcttgaatagaagaggaagcaaggtgtcgagaattattgttcgcctttggcaccaatgcttgtagcgttttactctttcttttttaaatttctttcctactgttgatattaactttctactttttttgcccaattcttctttcttctttaccttacattacattttttatttcttaactatgataccggtagagcaacaggtggcagtgggtgtacctttacttgtctgggaggggggttttttttaatgaaaccttgcacgagcgagccggatgtgtgatgaaggaggggtgggggtggatgtacagatttctagggctgtattgtatgtacttgctgtatatgcaggtggataatttttttccctctcaaaaaaaaaaaaaaaaaa

SEQ ID NO: 4059 - protein, 483 aa, Tuber borchii (White truffle)
MNDPDHLNYVPLVPFNGTKPFGGDSLTQDLNIWYESGNVAWVMTSTALVLLMIPGVGFFYSGLARRKSALSLIWLSMMATAVVSFQWFLWGYSLAFSHTGGRFIGNLDNFGFKGLLGYPSIGSEKIPDLLFALYQGMFSAITVALAIGAAAERGRMLPCVVFMFVWATLIYDPIACWTWNSSGWSFRMGGLDFAGGTPVHISSGSAALAYSLMLGKRRGHGTHELNYRPHNVTHIVLGTVFLWVGWFGFNGGSALSGNMRAVMACVVTNLAASVGGITWCLLDYRLEQKWSTVGFCSGVIAGLVAITPGSGYVPSWAAVIYGVVGGAACNYATKLKFVIGVDDALDIFAEHGVGGIVGNILTAFFAADYIAHLDGSTEINGGWLNGHYKQLGYQVADSVAGFAYSFGGTCIILFIMNLIPGLSLRATEEAEILGIDDAELGEFAYDYVELTREVISDDDTVPKMSSENNASVELPAERAEKSA

SEQ ID NO: 4060 - DNA, 1311 bp, Ralstonia solanacearum (Pseudomonas solanacearum)
  CDS (1)..(1311)
atgcccaacaagggcgacacggcgtggctgctggtttcgaccgccttcgtgatcctgatgacgctgccgggcctggcgctgttctacggcggcctggtgcgcaagaagaacatgctgtcggtcctgatgcaatgtaccggcatcttctcgctcatcatgatcctgtgggccatctacggctacagcatcgccttcaccgagggcaatgccttcttcggcgggctcgaccggctgttcctgaagggtctgacgccggattcggttgccgctacgttcagcaagggcgtggtagtgccggagtatgcgtacttcgccttccagggcgcatttgccgcgatcacctgcgcgctgatcatcggtgccttcgccgagcgcgccaagttctcggccgtgctggtcttcgtggtgctgtggttcacctttgcctacctgccgatcgcccacatggtctggttctggccggggccggacggcttcaccgacgccaaggcggccgaagtgatgacggccaagggcggctggctgttccagaagggcgcgctggacttcgccggcggcaccgtggtgcacatcaacgccgccgtggcgggcctggtgggtgccttcctgttcggcaagcggatcggcttcggccgcgaagcgctcaagccgcatagcctgacgctgaccatggtcggtgcctcgctgctgtggttcggctggttcggcttcaacgccggttcggccctggaagccaacggcagcgccgcgctggccttcgtcaacacgctgctcgccaccgccgccgccgtgttgtcgtggagcttcggcgagtggatcggcaagagcaagccgtcaatgctgggtgccgcgtcgggcgccgtcgccggcctggtggcgatcaccccggcagccggcttcgtcggcccgatgggcgccatcgcgatgggcatcctcgccggcgtgctgtgcctgtggggcgtcaacggcctcaagcgcatgctgggcatggacgacacgctggacgtgttcggcgtgcacggcgtgggcggcatcatgggcgcgctgctgaccggcgtgttcgcctcgccgagcctgggcggcaccggcatctacgactatgtcgccaacaaggtggccgatggctactcgatcggcggtcagctgtggattcagctgcagggcgtgctgaccaccatcgtgtggtctgccgtggtggctttcgttgcctacaagatcgtggacgcgatcatcggtctgcgcgtgccggaagaagaggagcgcgaaggtctggacatcacgtctcacggcgaaaccgcttacgaagactga

SEQ ID NO: 4061 - protein, 436 aa, Ralstonia solanacearum (Pseudomonas solanacearum)
MPNKGDTAWLLVSTAFVILMTLPGLALFYGGLVRKKNMLSVLMQCTGIFSLIMILWAIYGYSIAFTEGNAFFGGLDRLFLKGLTPDSVAATFSKGVVVPEYAYFAFQGAFAAITCALIIGAFAERAKFSAVLVFVVLWFTFAYLPIAHMVWFWPGPDGFTDAKAAEVMTAKGGWLFQKGALDFAGGTVVHINAAVAGLVGAFLFGKRIGFGREALKPHSLTLTMVGASLLWFGWFGFNAGSALEANGSAALAFVNTLLATAAAVLSWSFGEWIGKSKPSMLGAASGAVAGLVAITPAAGFVGPMGAIAMGILAGVLCLWGVNGLKRMLGMDDTLDVFGVHGVGGIMGALLTGVFASPSLGGTGIYDYVANKVADGYSIGGQLWIQLQGVLTTIVWSAVVAFVAYKIVDAIIGLRVPEEEEREGLDITSHGETAYED

SEQ ID NO: 4062 - DNA, 1356 bp, Rhizobium meliloti (Sinorhizobium meliloti)
  CDS (1)..(1356)
atgtcgtcattcaccctttccacctctcttcgacgcgtgggagcgaccgctgccgcgatgctcgcgccggtcgttgcatttgcccaggaagccgcgcccgccgcggccgcaacaccggtgccggacaaggccgacaccaccttcatgttcctttcgacgcttctcgtcctgttcatgctgatcccgggcctcgccctattctacggcggcctcgtgcgcgccaagaacatgctgtcggtgctgatgcagtgcacggtgatcggcgccgccatgatgatcgtctgggtcgtctacggttattccttcgccttcggcggctcgacgagcgcctatttcggcggcttcgccaagctcttcctcgcgggcgtgaccgtcgacagcaccgcggcgaccttctccgatggcgtcgtcattccggagtatctgttcatgctgttccagatgaccttcgccgcgatcaccccggcactcatcgtcggcgcctttgccgagcgcatcaagttctcggccgcgatcctcttcgccatcctctgggcgacattcgtctatttcccgatcgcgcacatggtctgggacgcaaacggcctgctcttcggcatgggcgcgctcgatttcgccggcggcaccgtggtccacatcaatgccggcgtcgccggcctcgtcggtgcattcatggtcggcaagcgcaccggctacggccgtgacatgatggccccgcattccatgaccctgacgctcgtcggcgctgccatgctgtggttcggatggttcggctttaacgccggctccaatctcgaagcctccggcggtgcggttctcgccaccgtcaacaccttcctcgcaacggctgccgcagtcctttcgtggtcgctcgtcgagacgctgacgcgcggcaaggcgtcgatgctcggcgccgcttcgggcatgatcgccgggctcgtcgccgtcacgccggcggccggtatcgccggtccgatgggcgcgatcatcatgggcctgatcgtctcgccgctctgctacttcttcgtctcggtgatcaagaacaagttccactatgacgacacggcagacgtcttcggcgtgcacggcgtcggcggcttcttcggcgcgatcgcgaccggcgtcttcgcctcctcctcgctcggcggcatcggctatgccgacggcgtgaccatgggaagccagctgatgacccagatcacggccgtcgccatcacgatcgtctggtgcggtgtcgtttccgccatcctctacaaggtggtcgatgcgcttgtcggccttcgcgtatcgatggaagcggagcgggaagggctcgacctctcctcgcatggcgaagccgcctatcacgcgagctga

SEQ ID NO: 4063 - protein, 451 aa, Rhizobium meliloti (Sinorhizobium meliloti)
MSSFTLSTSLRRVGATAAAMLAPVVAFAQEAAPAAAATPVPDKADTTFMFLSTLLVLFMLIPGLALFYGGLVRAKNMLSVLMQCTVIGAAMMIVWVVYGYSFAFGGSTSAYFGGFAKLFLAGVTVDSTAATFSDGVVIPEYLFMLFQMTFAAITPALIVGAFAERIKFSAAILFAILWATFVYFPIAHMVWDANGLLFGMGALDFAGGTVVHINAGVAGLVGAFMVGKRTGYGRDMMAPHSMTLTLVGAAMLWFGWFGFNAGSNLEASGGAVLATVNTFLATAAAVLSWSLVETLTRGKASMLGAASGMIAGLVAVTPAAGIAGPMGAIIMGLIVSPLCYFFVSVIKNKFHYDDTADVFGVHGVGGFFGAIATGVFASSSLGGIGYADGVTMGSQLMTQITAVAITIVWCGVVSAILYKVVDALVGLRVSMEAEREGLDLSSHGEAAYHAS

SEQ ID NO: 4064 - DNA, 1655 bp, Lotus japonicus
  CDS (37)..(1497)
tgaacaggttgaaggtttcaagctaaggctgcagccatggcaactcccacagcttaccaagaaaaccttccagcatcaccagaatggctaaacaaaggagacaacgcatggcaaatgacagcagcaactctggttggcctccaaagcatgccaggcctagtgattctctatgccagcatagtcaaaaagaaatgggcagtgaactctgctttcatggccctctatgctttcgcagcggttctcttatgttgggtccttttgtgttaccgtatggcatttggagacaagcttttccctttctggggaaagggtgcaccagcactaggccagaaatttctcataaaccaagccagtgtccctgaaagcacacactacttcaacaatggttccattgaaacccaaactcaaaggcctttttatcccatggctactcttgtgtatttccagttcaattttgctgctattacaatgattttgctggctggatctgtgcttggcagaatgaacatcaaggcttggatggcttttgttcctctctggctcattttctcatacactgttggggcatttagtatttggggtggtggttttctgtaccactggggtgtcatcgatttttctggtggctatgtcatccatctttcctctggaatcgccggtttcactgccgcttactgggttggaccaaggttaaagagtgacagggagaggttcccaccaaacaatgtgttgcttatgctagcgggtgctgggttgctgtggatgggttggtcagggttcaatggaggagcaccatatgcagccaacattgatgcttctattgctgtgctcaacactaacatatgtgcagccactagcctccttgtctggacctctctggatgttgccttcttcggcaagccttcagtcatcggtgccgttcagggcatgatgaccgggcttgtttgcatcacccccggagcaggacttgtgcaatcgtgggcggctatagtgatgggaatactatctggaagcattccatgggtctccatgatgatccttcacaagaagtcaagtcttctacagaaggtagatgatacacttggagtgtttcacacacatgctgtggctgggcttttgggtggcctcctcacaggtctgttagcagaaccagaactttgcaggctcgtattgccggtgagtaactcaaggggcgccttctacggtggcaccggcggtgcacagttcttgaagcaattggtggcagcactcttcgtcattggatggaacttggtttccaccactctcattcttcttgccattcaattgttcattcccttgaggatgccggactaccagctcgagattggtgatgacgccgttcatggtgaggaagcttatgccctgtggggtgatggagaaaaatatgatccaaccaagcatggatccacaatagtggatgaaactctagcatcggcctatagtgttggagcaaggggtgtaaccgtaaatttatgagtcatgtaaagacagtttataatgctaacggattaggatcattttgtgtcacctaacactatcatctgaaacttgtgtgtttatatttgttcataaatatttagaggatcgaggatctcacatatttaaaaaaaaaaaaaaaaaaaaaaaaaaaaaaa

SEQ ID NO: 4065 - protein, 486 aa, Lotus japonicus
MATPTAYQENLPASPEWLNKGDNAWQMTAATLVGLQSMPGLVILYASIVKKKWAVNSAFMALYAFAAVLLCWVLLCYRMAFGDKLFPFWGKGAPALGQKFLINQASVPESTHYFNNGSIETQTQRPFYPMATLVYFQFNFAAITMILLAGSVLGRMNIKAWMAFVPLWLIFSYTVGAFSIWGGGFLYHWGVIDFSGGYVIHLSSGIAGFTAAYWVGPRLKSDRERFPPNNVLLMLAGAGLLWMGWSGFNGGAPYAANIDASIAVLNTNICAATSLLVWTSLDVAFFGKPSVIGAVQGMMTGLVCITPGAGLVQSWAAIVMGILSGSIPWVSMMILHKKSSLLQKVDDTLGVFHTHAVAGLLGGLLTGLLAEPELCRLVLPVSNSRGAFYGGTGGAQFLKQLVAALFVIGWNLVSTTLILLAIQLFIPLRMPDYQLEIGDDAVHGEEAYALWGDGEKYDPTKHGSTIVDETLASAYSVGARGVTVNL

SEQ ID NO: 4066 - DNA, 1497 bp, Oryza sativa (Rice)
  CDS (1)..(1497)
atgtcgggggacgcgttcaacatgtcggtggcgtaccagccgtcggggatggcggtgccggagtggctgaacaagggcgacaacgcgtggcagatgatctcggcgacgctggtggggatgcagagcgtgccggggctggtgatcctgtacggcagcatcgtgaagaagaagtgggcggtgaactcggcgttcatggcgctctacgccttcgccgccgtgtggctgtgctgggtcacctggggctacaacatgtcgttcggccacaagctcctcccgttctggggcaaggcgcggccggcgctgggccagagcttcctcctcgcccaggccgtgctcccgcagacgacgcagttctacaagggcggcggcggcgccgacgccgtggtggagacgccatgggtgaacccgctctacccgatggccaccatggtgtacttccagtgcgtgttcgccgccatcacgctcatcctcctcgccggctcgctgctggggcggatgaacatcaaggcgtggatgctgttcgtcccgctctggctcaccttctcctacaccgtcggcgccttctcgctgtggggcggcggcttcctcttccactggggggtcatggactactccggcggctacgtcatccacctctcgtcgggtgtcgccggcttcaccgcggcgtactgggtggggcccaggtcgaccaaggacagggagaggttcccgccaaacaacgtgctgctcatgctcaccggcgccggcatactgtggatggggtgggcggggttcaacggcggcgacccgtactccgccaacatcgactcctcgctcgccgtgctcaacaccaacatctgcgccgccaccagcctcctcgtctggacttgcctcgacgtcatcttcttcaagaagccgtccgtcatcggcgccgtccagggcatgatcaccggcctcgtctgcatcactcccggcgcaggcctggtgcagggttgggcggcgatcgtgatgggcatcctctccggcagcatcccgtggttcacgatgatggtggtgcacaagcggtcgcgcctcctgcagcaggtggacgacaccctgggcgtcttccacacccacgccgtcgccggattcctcggcggcgccaccacgggcctcttcgccgagcccgtcctctgctccctcttcctccccgtcaccaactcccgcggcgccttctaccccggccgcggcggcggcctccagttcgtccgccaggtggccggcgccctcttcatcatctgctggaacgtggtggtcaccagcctcgtctgcctcgccgtccgcgccgtggttcccctccggatgcccgaggaggagctcgccatcggcgacgacgccgtgcacggggaggaggcgtacgcgctgtggggcgacggcgagaagtacgactccaccaagcacggatggtactccgacaacaacgacacgcaccacaacaacaacaaggccgcgcccagcggcgtcacgcagaacgtctga

SEQ ID NO: 4067 - protein, 498 aa, Oryza sativa (Rice)
MSGDAFNMSVAYQPSGMAVPEWLNKGDNAWQMISATLVGMQSVPGLVILYGSIVKKKWAVNSAFMALYAFAAVWLCWVTWGYNMSFGHKLLPFWGKARPALGQSFLLAQAVLPQTTQFYKGGGGADAVVETPWVNPLYPMATMVYFQCVFAAITLILLAGSLLGRMNIKAWMLFVPLWLTFSYTVGAFSLWGGGFLFHWGVMDYSGGYVIHLSSGVAGFTAAYWVGPRSTKDRERFPPNNVLLMLTGAGILWMGWAGFNGGDPYSANIDSSLAVLNTNICAATSLLVWTCLDVIFFKKPSVIGAVQGMITGLVCITPGAGLVQGWAAIVMGILSGSIPWFTMMVVHKRSRLLQQVDDTLGVFHTHAVAGFLGGATTGLFAEPVLCSLFLPVTNSRGAFYPGRGGGLQFVRQVAGALFIICWNVVVTSLVCLAVRAVVPLRMPEEELAIGDDAVHGEEAYALWGDGEKYDSTKHGWYSDNNDTHHNNNKAAPSGVTQNV

SEQ ID NO: 4068 - DNA, 1479 bp, Hebeloma cylindrosporum
  CDS (1)..(1479)
atgagtaatttagctaccggccagttcgaccgtggtgacatatctttcatcgtcgtcgcgggcgccatggtgttcttcatggtgcccggtctggctttcctttattccggcctttctcgtcgcaaaagtgcactgtctcttatatgggccgttgcagcgagcaacgccgtcgtgatattccagtggtatttcgtcggctactctctggcgttctccagcacggcgacaaacggctacattggaaacctgagaaattttgggctcatgaaggttgaggctgatccctctccgggctcccctctcattcccgagattctttacagtttcttccagatggaattcgcatgcgtaaccgccggtattctaatgggcggtctcgccgaacgtggtcgcgttttcccggccatgattttcatatttttttggatgaccttcgtctactgccctcttgcttgttgggcatggagcacgcatggctgggcttttaaatggggtgttcttgattttgcaggcggtggtcccgttgagattggaagcggtgttggtggcctggcctatgcctgggtccttggtcgcaggaacgaacgagaattgcttaacttccgtcctcataacgttggcctggttggcttgggaaccttcatgctatggtttggatggatcgggttcaacggaggaagtgcttttggtgcaaatctccgcgccatctttgccatttggaataccatgattgctgcgtcattcgggggcatggtttggtgccttctcgatttccgcatcgagcgtcggtggagtatggtcggattttgctccggtacgatcgccggtcttgttgcagctacaccttcctctggctacttgagaccatggtcgtcagttgtggtcggagttcttgcgggcaccttgtgtaattttgctaccaaagtcaagtttttgttgcgaatcgatgacgcgctcgatctattcgcggaacacgctgtaggtggcgttgttggtttgatgttgaacgcattctttgccgaaactgccgttattgccatggacgatgttaccatcggagttcgtggtggttgggtcgatcacaattggaagcaactttatattcagtttacctatgtggttgcgacttgcgcctactcttttgtcatgactgctctggtggcaaaaaccgtcgatctgatccctggcctgaaactcagaagtagtccagaaggcgagatgcttggtatggacgaggttgagatcggagaattcgcaactgattacattgaattgcgccgggacgttgcggactgttcgactttcggtttcacaagaggttctaatggatacatcccacatgctgcgacgaatgaaacacacgctcaagatactagttctaacgacgacccgcatcatcgtatcgatgaacccacggcgcctgaacgtttggaacccctcaccgaaaaaaatgaatgtgggaccgtgactccatcataa

SEQ ID NO: 4069 - protein, 492 aa, Hebeloma cylindrosporum
MSNLATGQFDRGDISFIVVAGAMVFFMVPGLAFLYSGLSRRKSALSLIWAVAASNAVVIFQWYFVGYSLAFSSTATNGYIGNLRNFGLMKVEADPSPGSPLIPEILYSFFQMEFACVTAGILMGGLAERGRVFPAMIFIFFWMTFVYCPLACWAWSTHGWAFKWGVLDFAGGGPVEIGSGVGGLAYAWVLGRRNERELLNFRPHNVGLVGLGTFMLWFGWIGFNGGSAFGANLRAIFAIWNTMIAASFGGMVWCLLDFRIERRWSMVGFCSGTIAGLVAATPSSGYLRPWSSVVVGVLAGTLCNFATKVKFLLRIDDALDLFAEHAVGGVVGLMLNAFFAETAVIAMDDVTIGVRGGWVDHNWKQLYIQFTYVVATCAYSFVMTALVAKTVDLIPGLKLRSSPEGEMLGMDEVEIGEFATDYIELRRDVADCSTFGFTRGSNGYIPHAATNETHAQDTSSNDDPHHRIDEPTAPERLEPLTEKNECGTVTPS

SEQ ID NO: 4070 - DNA, 1416 bp, Hebeloma cylindrosporum
  CDS (1)..(1416)
atggtgaatgtcacctacgacgcctctcagccactcgtatggactgacgctgccggaaacactggtgtctatagcccaggagatatcgcctgggtcctagcttcaactgcgttggtatggataatggtccccggtgttggattcttctattctggattgcttcggcggaagaatgctctgtctatgatatacctgagcatgatgacagtagccgtggtgtctttccaatggttcttctggggtttctcgcttgcttttagcgacggtgctagtctgttcatcggagacctaaaatatttcggcatgaaaggcgtcctcgaagagccttccattggaagtacacgtataccggccatcgttttcagtgtctatcagctcatgttcgcggctattacaccaatgatcgcggtcggtggtttcgccgaacgcgcgcaccttggacccctgcttttcttcgtttttgtgtggtcaaccctcgtttatgaccccattgcatgctggacatggaactccaaaggctggtctttcgtccacggaagctacgacttcgccggtggaacacctgtccacatctcttctggcacggccgccctcgctatttccatctacctcggaaaacgacgcggatacggcactgaagtgcttacatataagcctcacaacactacctacgttatccttggaactattttcctttggtttggatggttcggattcaacggaggctccgcccttgcagctaacttgcgagcggcccaggcttgtatcgttaccaatttggccgcgagtgttggtggactgacctggatgctttgggactatcgtattgaaaaaaaatggtcggctgtcggcttttgctcaggcgctatcgcaggcctcgtcgccattactcccggctctggtttcgtgggttcccctgctgccgttttattcgggttcatggccggtacagtgtgcaatttcgcgacccaactcaagttctttgctggatatgacgactccctcgatatcttcgcttcccatgccgtcggaggtgtcgtcggtaatctgctaacggcgctcttcgcacaagccagcgtcgctggtttcgatggcttcaccgtcatccctggaggttggttggaccgccactacatccagctcgcatggcacgtcgccgactcggctgcgggcctcagttattcatttgtggtgactactatcatcctctgggtcatgcactttatccccggtctccgccttcgcgtcccagaagaaaccgaaataataggtatcgacgaagccgacatgggcgaattcgcctacgactacgtaggcctggagaccgagctcaagccacatgtatacgtgcgctcaacaggaacagcttatgactccggccggaactccgagctcaaggaacgctcaagtgcctag

SEQ ID NO: 4071 - protein, 471 aa, Hebeloma cylindrosporum
MVNVTYDASQPLVWTDAAGNTGVYSPGDIAWVLASTALVWIMVPGVGFFYSGLLRRKNALSMIYLSMMTVAVVSFQWFFWGFSLAFSDGASLFIGDLKYFGMKGVLEEPSIGSTRIPAIVFSVYQLMFAAITPMIAVGGFAERAHLGPLLFFVFVWSTLVYDPIACWTWNSKGWSFVHGSYDFAGGTPVHISSGTAALAISIYLGKRRGYGTEVLTYKPHNTTYVILGTIFLWFGWFGFNGGSALAANLRAAQACIVTNLAASVGGLTWMLWDYRIEKKWSAVGFCSGAIAGLVAITPGSGFVGSPAAVLFGFMAGTVCNFATQLKFFAGYDDSLDIFASHAVGGVVGNLLTALFAQASVAGFDGFTVIPGGWLDRHYIQLAWHVADSAAGLSYSFVVTTIILWVMHFIPGLRLRVPEETEIIGIDEADMGEFAYDYVGLETELKPHVYVRSTGTAYDSGRNSELKERSSA

SEQ ID NO: 4072 - DNA, 1771 bp, Ustilago maydis (Smut fungus)
  CDS (149)..(1735)
ccctttccccttctctcttctctcttgctccattccccctccgttctccagctgcttccaagcttgtcgtcatcctcgatccgtctgactcgagtcgcgcctcgcctcgcctcgcctcgcctcgccttggtcgcagtttgtctacaaaatggtcaacatcacttacggtgtgcttcaagcacccgatggctcctcggctacctcgagcgccatcgccaagggaactgacattatcgtttcttacggcccaaatggcgagagcgtcgcttcctattcgcccggtgacatttcctgggttctcacatgtaccgctctcgtatggctcatgattcccggtctcggttacctctactctggtcttgctcgcagaaagaacgcgcctcacctccttttgctcactttggccgctctcgccgttgtctcgttccagtggttcttttggggctactcgctcaccttttctcaaacctcaggcgctttcctcggcaatctgcgcaactttggctacatgggtgttctcgaaaatcccgtgcctcaggcatacaacaaagtgcccgaaattgtatacgccatctaccagtgcatgttcgccaaccttgtccccgccatcgccatcggtgccgcttgtgagcgtggccgtgtctggcctttcctcgtctttacctttgtctggaccacgctcgtctacgatgtgatcgcctgctgggtctggaaccccaccggttgggcgttcaagtggggtgttcttgactacgccggtggtggacccgtcgagattaactcgggtatcactggtctcgtcatctcttactatcttggccctcgtaccggttatggcaccgagcgtctactcttcaagccacacaacgtttcctacatcttcctgggcaccgccttcctctggttcggctggatcggcttcaacggtggttcggtctttgctgccaacctccgtgcggctatggccatcagcaccaccaacctcgccgcttcgtccgccggtctcacctggatgttcctcgactggcgtctcgaacgcaagtggtccgtcgttggcttctgcacgggtgccattgctggtctcgtcgccatcactcccgctgctggctttgtcggcatgcccgctgctttgctcgtcggagtcgtttcctcggccgtttccaactttgccaccgttctcaagggccccatgcgcgttgacgatgtcatggacattttctcggtccacgctctcgccggtattgttggcacccttctcaccggtatcttcgcccaggcttccgtagccaacaacgacggcaacacggtcatcgccggtggctggctcgactcaaactggatccagctcgcctatcaactcgcctactgtgtcgctgtcacctgttggtgtggtggcgtcacgtttgctatcatgtttgttattgaccacattccttacatcggtcccttccgttcgagcgagatgggtgaagtggtgggtatggatgaggaccagtgtggcgagtgggcttacgactacgcctttatcaaccgtgatcttgagggcaactacaagcccgaccacggtcagacgctcgacatcaacgaaaagatgcccaacgttcatcaaaccgactcgctgcgctccgaaacgcacgccgactcgagccaagacaaccccaactcgcagctcgccgctgccgaacaccagtctccatccaccgctgaaccagccgtggaaatgaagcaggcttaaaagttgcaaagacgtcgtagagtgcaagcgttcgaa

SEQ ID NO: 4073 - protein, 528 aa, Ustilago maydis (Smut fungus)
MVNITYGVLQAPDGSSATSSAIAKGTDIIVSYGPNGESVASYSPGDISWVLTCTALVWLMIPGLGYLYSGLARRKNAPHLLLLTLAALAVVSFQWFFWGYSLTFSQTSGAFLGNLRNFGYMGVLENPVPQAYNKVPEIVYAIYQCMFANLVPAIAIGAACERGRVWPFLVFTFVWTTLVYDVIACWVWNPTGWAFKWGVLDYAGGGPVEINSGITGLVISYYLGPRTGYGTERLLFKPHNVSYIFLGTAFLWFGWIGFNGGSVFAANLRAAMAISTTNLAASSAGLTWMFLDWRLERKWSVVGFCTGAIAGLVAITPAAGFVGMPAALLVGVVSSAVSNFATVLKGPMRVDDVMDIFSVHALAGIVGTLLTGIFAQASVANNDGNTVIAGGWLDSNWIQLAYQLAYCVAVTCWCGGVTFAIMFVIDHIPYIGPFRSSEMGEVVGMDEDQCGEWAYDYAFINRDLEGNYKPDHGQTLDINEKMPNVHQTDSLRSETHADSSQDNPNSQLAAAEHQSPSTAEPAVEMKQA

SEQ ID NO: 4074 - DNA, 1557 bp, Sulfolobus tokodaii
  CDS (1)..(1557)
atggaaattcaaaaaacctttccccaaaataatcttataaagttattaataatactaattagtttttcaatcattctattatcattacactcatttggacagacatcatcaaatactacagcagaaatacagagtttaaatcaaagtattttggctttagaaaatcatacagcagattacccatctgcagcagttcctagctggttagatacgggtagtaatgcatggatgcttacggctgcaacgtttgtaggacttcaaagtgtacctggtgtagcactatattatgctggattatccaaaaagaaatatgctgtaaattccgcattaatggtattttatgcttttgctgcagttttagttgtttggatgatagctggttataatgctggttttggtcatcctgcattacttagtattaacggttatggaattttaggttatccattaccagcatggttaggtcactatgaagctagtcaaaccgtatttggtccaactggaacaccggtagatattccaacatctacttacatattcttccaatttgtctttgccgcaataactccagtattattagctggaggagtattagagagaatgaatttcaaagcatggatgatatttgtacccttctggagtttattagtatatagcccagtagcttattggttatttgctggtggatggttaaatcaactaggagctgtagactttagcggaggatatgttatccatgtagatgccggagtcggtgcgttagctgctgcattagcaataggtcctagattagcatctgaaagaaaattagaagctcatagcttaccattagttcttgcaggagctggtttaatttggttaggatgggatggatttaacggtggtgatcccggtggtgcaacaatcgatgctgcaatagcagtattaaatacaaatattgcaacagctgttagtgcaataacttggatgttaatggatatggcattctttaagaaaccaacattagtgggtgcaacaagtggtgcaataactggacttgtagctattacgccagctgcaggatatgtaaatggttgggaagcaatgcttattggaattgcatctggaagtataccatggttatctctgtataaatttgagcctagactgaaagttgatgatacattaggagtattctctactcacggtattgcaggaatagtgggaggattgttaactggtgtgttcgcagatccaaatgtgacacaatatgtggatccaacgttaaaaggtgctttatatggtaacttatatcaactaggaatacaagctgccgctgcagcagtagtatttgtttatgattttgcaataacttttggtctgttaaagttaataggactattcataccattgcaagcaccacctgatacattagctatcggtgattatgcaatgcatggagaagtagcatattctgaactactagctactttaccagaatcgcagataaagaaagaagaaattagagaagaggcacaagaagagaaagaagatccagatgagaaaaaatctaaataa

SEQ ID NO: 4075 - protein, 518 aa, Sulfolobus tokodaii
MEIQKTFPQNNLIKLLIILISFSIILLSLHSFGQTSSNTTAEIQSLNQSILALENHTADYPSAAVPSWLDTGSNAWMLTAATFVGLQSVPGVALYYAGLSKKKYAVNSALMVFYAFAAVLVVWMIAGYNAGFGHPALLSINGYGILGYPLPAWLGHYEASQTVFGPTGTPVDIPTSTYIFFQFVFAAITPVLLAGGVLERMNFKAWMIFVPFWSLLVYSPVAYWLFAGGWLNQLGAVDFSGGYVIHVDAGVGALAAALAIGPRLASERKLEAHSLPLVLAGAGLIWLGWDGFNGGDPGGATIDAAIAVLNTNIATAVSAITWMLMDMAFFKKPTLVGATSGAITGLVAITPAAGYVNGWEAMLIGIASGSIPWLSLYKFEPRLKVDDTLGVFSTHGIAGIVGGLLTGVFADPNVTQYVDPTLKGALYGNLYQLGIQAAAAAVVFVYDFAITFGLLKLIGLFIPLQAPPDTLAIGDYAMHGEVAYSELLATLPESQIKKEEIREEAQEEKEDPDEKKSK

SEQ ID NO: 4076 - DNA, 1356 bp, Rhizobium loti (Mesorhizobium loti)
  CDS (1)..(1356)
atgaatatttcttccaccttgaagacaacgggacgggcggccctgctgggctcgcttgctctggcagcattgggcagcgtcgccgcctttgcgcaggaagccgctccggccgctgccgcagccgccccggctgccgctcccaccccggtgctcgacaccggcaacaccgcctggatgctgacctcgacggccctggtgctgatgatgaccattccgggcctggcgctgttctacggcggcatggtgcgcaagaagaacgtgctcgccaccatcatgcagagcttcgccatcacctgcctggtgacggtgctgtggttcatgttcggctattcgctggccttctccgacggcggcggcatgaatgcctatctcggcggcttctcgaaattcttccatcacggcatcacggtctcgacgctctggctgccgggggtctcgaacattcctgaattcgtcttctcgatgttccagatgaccttcgccatcatcacacctgccctcatcgccggcgccttcgccgagcgcatgaagttctcggcgctgctgctgttcatggcgctgtggttgatcgtggtctattgcccgatcgcacattgggtctggggtggcggcttcctcggcacggctggcgtgctcgacttcgccggcggtacggtcgtccacatcaacgccggtgtcgcgggcctggtctgcgcgctggttcttggcaagcgcgaaggctacggcaccaccaacatggcgccgcacaacctggtctattcggtgatcggcgcttcgctgctgtgggtcggctggttcggcttcaacgccggttcggaactggcggcggacggtcttgccggcgctgcgatgatgaacacgcaggtcgccaccgctgccgccgcgctcgcctggatgttcgctgaatggatcgtcgccaagaagccctcggtgctcggcatcatctcgggtgccgtcgccggcctcgtcgcggtgacgccggcttccggcttcgtcaacccgaccggcgctttcatcatcggcatcgttgccggcgtgctctgctacatctcggcggtcaaggtgaagcacatgttcggctatgacgactcgctcgatgccttcggcgtgcacggcgtcggcggcatcatcggtgcgctgctcaccggcgcgctggccgatccggcgatcaacgcgctcggcaagggcggctctgtggtcacccagctctacggcatcgtcttcaccatcctgtggacggcgatcgccaccttcgtgatcctctacatcgtcaaggcgctggtcggcctgcgtccgacgacccaggaagaggtcgaaggcctcgacatctcccagcatggcgaagtggtgccgtaa

SEQ ID NO: 4077 - protein, 451 aa, Rhizobium loti (Mesorhizobium loti)
MNISSTLKTTGRAALLGSLALAALGSVAAFAQEAAPAAAAAAPAAAPTPVLDTGNTAWMLTSTALVLMMTIPGLALFYGGMVRKKNVLATIMQSFAITCLVTVLWFMFGYSLAFSDGGGMNAYLGGFSKFFHHGITVSTLWLPGVSNIPEFVFSMFQMTFAIITPALIAGAFAERMKFSALLLFMALWLIVVYCPIAHWVWGGGFLGTAGVLDFAGGTVVHINAGVAGLVCALVLGKREGYGTTNMAPHNLVYSVIGASLLWVGWFGFNAGSELAADGLAGAAMMNTQVATAAAALAWMFAEWIVAKKPSVLGIISGAVAGLVAVTPASGFVNPTGAFIIGIVAGVLCYISAVKVKHMFGYDDSLDAFGVHGVGGIIGALLTGALADPAINALGKGGSVVTQLYGIVFTILWTAIATFVILYIVKALVGLRPTTQEEVEGLDISQHGEVVP

SEQ ID NO: 4078 - DNA, 1296 bp, Rhodospirillum rubrum
  CDS (1)..(1296)
atgatgagagccttcacgttcctccccgccgccctggtcgcccttctggcgccggccctggcctatgcccaggatgcggcccccaccctggattcgggcaataccgcctggatgctgacctcgaccgcgctggtccttctgatgaccatcccgggcctcgcgcttttctatgccggcatggtccgcaagaagaacgtgctggcgaccatgatgcagagcttcatcatcaccgcgctggtcagcgtcgtgtggatggtggccggctactcgatcgcctttggcaccggcaacgcctatttcggtgacttctcgaagttcctgctgtcggacatcagcattgacagcctgaacggcaccttccccgaaacggtgttcgtcgtcttccagatgaccttcgccatcatcaccccggccctgatcaccggcgccttcgccgaacgcatgaagttctcggcgatgctgtggttcatcggcctgtgggtgctgatcgtctacgcgccgatctgccattgggtgtggagttcctcgggcttcctgttcaacgccggcgtccttgattacgcgggcggcaccgtggttcacatcaacgccggcgtggccggtctggtctgcgccctcgtcttgcgtcgtcgcgccggcttcggcagcgagaacatggccccctataacctgtcgctggccgtgatcggcgccgccctgctgtgggtgggctggttcggcttcaacgccgggtccgccgtcgccgccgatggccgtgccggcatggccatgctggcgacccagcttggcgccgccggtgccaccttgtcgtggatcgccgccgaatggctggtgcgcggcaagcccagcgtgctgggcgcggtttcgggcgccgtcgccggtctggtcgccatcaccccggcctcgggcttcgttctgcccggtggcgccctggtcatcggcctggtggccggcgtcgtctgcttctggggcgcgacttggctgaagaagaccctgggctatgacgacagcctggacgccttcggcgtgcatggcatcggcggtctggtcggcgccctgctgaccggcgtcttcgccgcccagagcgttggtggcgaagccgccgtcggcctgctcgaaggcaatcccggtcaggtcctcacccaggcctggggctgccttgccaccatcgtgtggacggccgtcgcctcctacgtgatcttgaaggtcattgatctggccatcggcctgcgggtttcgcccgagcaggaaagcgaaggcctcgacatctcgctgcacggcgagcgcctgcagtaa

SEQ ID NO: 4079 - protein, 431 aa, Rhodospirillum rubrum
MMRAFTFLPAALVALLAPALAYAQDAAPTLDSGNTAWMLTSTALVLLMTIPGLALFYAGMVRKKNVLATMMQSFIITALVSVVWMVAGYSIAFGTGNAYFGDFSKFLLSDISIDSLNGTFPETVFVVFQMTFAIITPALITGAFAERMKFSAMLWFIGLWVLIVYAPICHWVWSSSGFLFNAGVLDYAGGTVVHINAGVAGLVCALVLRRRAGFGSENMAPYNLSLAVIGAALLWVGWFGFNAGSAVAADGRAGMAMLATQLGAAGATLSWIAAEWLVRGKPSVLGAVSGAVAGLVAITPASGFVLPGGALVIGLVAGVVCFWGATWLKKTLGYDDSLDAFGVHGIGGLVGALLTGVFAAQSVGGEAAVGLLEGNPGQVLTQAWGCLATIVWTAVASYVILKVIDLAIGLRVSPEQESEGLDISLHGERLQ

SEQ ID NO: 4080 - DNA, 1473 bp, Dictyostelium discoideum (Slime mold)
  CDS (37)..(1428)
aaagaccaataataataagtaataagtaatataataatggtagcaggagaaataataaaaggtgttgcagccgaaataacaaacggttcatcatcatcagttgttcaaaaatatcttgattgtgcaaatcaagtagcaccagatccaggtaatacaacatgggttttactttcaactattttagtattaggtatgatgcctgcactcgcattctttgaagcaggtctcttaagaagtaaaaatacactttcaattatcacacaaattatgtctggtattgtagttttaactgtcatgtggcaagcatttggttattcattaacttttggcccagatcaaaaaggtattattggtaatttagatcatgcatttttaattaatgtttcatatgacgattgttcaccaaatgcaccaaatattccagcagcagcttatgcattctttatgatgatgtttgcaaatattacaccattattgatgactggtgcattcgcagaaagagttaaattcaaagcattcatcgcactcaccgttgcttgggaaattattgttttctatccagttgctcattggatttggggtggtggttggttacataaatattttggtgttttagattttgctggtggtattgttattcatacaagtgctggtgttagtgctttagttattgcattatatgttggtagaagaaaagattttgaaaaatatggtggtgaattcccaccatcaaatttaccattagcaacaattggagcagcattattatggatgggttggtttggttttaatgcaggtagtgcattagcagcaggtaatattgcaacatcagcagtagcaagcacacaaattggtggtagtttttcagctattgtttggatcatcctttctgccgccaaaggaaaaccaaatactgtatcggttatcaatggtgttattgcaggtttagcaggtatcacaccagcatctggttatatcaatagtcaatattcaattgggttgggtatttgtttaggtttagcttcttactattccgttgtattattaaaacataaacttcacatcgatgatgctttagacgttagctctgtacatggtttaactggtattattggttcattggcaattggtttctgtgctgaactctctgttaatccaaatggtgcaaatggtgctttctatggtaatccaaaattaattggtactcaattactcggtgtcgtttctgtcgctgtttgggctgccgcttggacttgggtcctcttaaagattatcgatgccactatcggtgttaaaatcgatgaatctgaagaagaattaggtctcgatctcgtcgaacatggtgaattcgcttatcataatatctcacttcaaggtaatgaaaatcattattcatctgttattaatagtcatgatttttttaaataaataaataaataaataaataaataaattaaattataataataaaaa

SEQ ID NO: 4081 - protein, 463 aa, Dictyostelium discoideum (Slime mold)
MVAGEIIKGVAAEITNGSSSSVVQKYLDCANQVAPDPGNTTWVLLSTILVLGMMPALAFFEAGLLRSKNTLSIITQIMSGIVVLTVMWQAFGYSLTFGPDQKGIIGNLDHAFLINVSYDDCSPNAPNIPAAAYAFFMMMFANITPLLMTGAFAERVKFKAFIALTVAWEIIVFYPVAHWIWGGGWLHKYFGVLDFAGGIVIHTSAGVSALVIALYVGRRKDFEKYGGEFPPSNLPLATIGAALLWMGWFGFNAGSALAAGNIATSAVASTQIGGSFSAIVWIILSAAKGKPNTVSVINGVIAGLAGITPASGYINSQYSIGLGICLGLASYYSVVLLKHKLHIDDALDVSSVHGLTGIIGSLAIGFCAELSVNPNGANGAFYGNPKLIGTQLLGVVSVAVWAAAWTWVLLKIIDATIGVKIDESEEELGLDLVEHGEFAYHNISLQGNENHYSSVINSHDFFK

SEQ ID NO: 4082 - DNA, 1494 bp, Schizosaccharomyces pombe (Fission yeast)
  CDS (1)..(1494)
atgtcttccactaccgatgccactcccaccccttcgggtgtcaatggcggtgattccatgaccgtcaatcttaatcaattttacaataatggtgatgttgcctggattctcacaagtaccgctttggtgtttatcatgattcccggtgtcggtttcttttactccggcttggctcgtcgtagaagtgccatttctatgctgtttttgtcaatgatgtctgtcgccattgttgcctttcagtggttcttttggggttattcgcttactttctctcacgagggtggtccatacatcggatccctcgccaatttcggtcttcgccaaacgttgggtagaccttcttccggtgcttccagtgtacccgacatcttgttttgcgtgttccaaggtatgtttgccgccattactcccgctttggctatcggtgctgccgctgatcgcggtcgcatgtttccctgtatggtcttcatgtttctctggacttccatcgtctacgacccaatcgccttttggacttggaatcctaatggttggttgaacaagttgggctcttacgatttcgctggtggctctcccgttcacatctcctccggtatggctgctttggcttattccatcgtaattggaaagcgttgtgaccatggtactaccaaatatcgcccacacaacgttccccacgtcgttcttggcaccgtatttttgtggtttggttggttcggctttaacggtggttcttccgctgctgccaacatgcgtggtgtcatggctgtcgtcgttacacatcttgctgcttctgttggtggtattgtttggtgtgttatcgattttgccaagaaccgtcactggtctgtcgtcggcttctgtgaaggtgccgtcgctggtttggtcgccattactcctggctccggtttcgttcctccatgggctgccgtcgtcattggtgctttaggcgctgtcttctgctatgctgctacttaccttaagaaaatcatccgtgtcgatgatgccttggatatctttgctgaacatggtgttggtggtatggttggcaatatccttaccgctctttttgccgctgattacattgaagctttggatggtagtggtactgcttacactggtggttggattactcaccattacattcaacttggttatcagcttgcagacactgtctcttgtgccgcatattcattcgctgtctcatgtgcactcttgtttgttatgaattacattccaggactttcacttcgtgtttcacgcgaggatgaggttctcggtttggataagattgaacttggtgaaagtgcatattattacaaagactctactgacgagcctcccccaatcactacaagtggcgttcaatacacttctccaactgttagcgattccgcatccaacgaaaaggagcaagaacacagagctcaaaatgaggctcaaaaggaagaggagtatagagctgaatctgaggctcaagctccggctatttag

SEQ ID NO: 4083 - protein, 497 aa, Schizosaccharomyces pombe (Fission yeast)
MSSTTDATPTPSGVNGGDSMTVNLNQFYNNGDVAWILTSTALVFIMIPGVGFFYSGLARRRSAISMLFLSMMSVAIVAFQWFFWGYSLTFSHEGGPYIGSLANFGLRQTLGRPSSGASSVPDILFCVFQGMFAAITPALAIGAAADRGRMFPCMVFMFLWTSIVYDPIAFWTWNPNGWLNKLGSYDFAGGSPVHISSGMAALAYSIVIGKRCDHGTTKYRPHNVPHVVLGTVFLWFGWFGFNGGSSAAANMRGVMAVVVTHLAASVGGIVWCVIDFAKNRHWSVVGFCEGAVAGLVAITPGSGFVPPWAAVVIGALGAVFCYAATYLKKIIRVDDALDIFAEHGVGGMVGNILTALFAADYIEALDGSGTAYTGGWITHHYIQLGYQLADTVSCAAYSFAVSCALLFVMNYIPGLSLRVSREDEVLGLDKIELGESAYYYKDSTDEPPPITTSGVQYTSPTVSDSASNEKEQEHRAQNEAQKEEEYRAESEAQAPAI

SEQ ID NO: 4084 - DNA, 1797 bp, Lotus japonicus
  CDS (76)..(1581)
ccacgcgtccgcccacgcgtccgcctcttgactcttgactctcccttctctttccaagtccactaccccaaaacgatggcgctgccggagtgctcggcggcgaacctagcgcagctcatcggccccaacgcgacagacgccgccgcagtcgccggattcatctgcgaccagttcaccgccgtgggtcaacgattctccgacacagcattcgcggtggacagcacctacctcctcttctccgcctacctcgtattctcgatgcagctcggcttcgccatgctctgcgccggctccgtccgcgccaaaaacaccatgaacatcatgctcaccaacgtcctcgacgccgccgccggcggcctcttctactatctcttcggtttcgcctttgccttcggcgcaccctccaacggcttcatcggccgccacttcttcggcctcaaagacgtccccaccgtagccttcgactacagctacttcctctaccagtgggcgtttgccatcgccgccgccgggatcaccagcggctcaatcgctgaacgcacacagttcgttgcctacctcatctactcgtcgttcctcaccgggtttgtctaccccgtcgtgtctcactggttctggtccggcgacggttgggccagcgccaccaacaccgggaacttgctgtttggcaccggggtgattgattttgccgggtcgggtgtggttcacatggttggtggtgttgcgggtctttggggcgcgcttattgagggacccaggattggccggtttgaccatgccggtcgagccgtttcgcttcgcggacacagtgcttcgcttgttgtgcttggaaccttcatgctctggttcggttggtacggttttaaccccggttcgttcaccaagattctcagcgcctatgattcaggcaactattatggtcagtggagcgcaataggaaggaccgccgtaacgacaacattggctggctgcacggcggcgctgaccacccttttcgggaaaagaattatctccggccactggaacgtcaccgacgtatgcaacggcttactcggcgggttcgcagcaatcaccgccggttgctccgtcgtggagccctgggcagccatcgtgtgcggcttcgtcgccgcagtggtgcttatcgcgtgcaacatgctcgcagaaaaggtgcgttacgacgaccccttagaggcagctcagcttcacggcggttgcggcgcgtgggggatcatattcaccgcgctattcgccaaggaggagtacgtgaaccaggtttacccgggtaaaccgggtcggccatacgggttgttcatgggtggtggagggaagctgctcggagcgcacgtgatccagattttggtgattatcgggtgggtcagcgccacaatgggtcctctgttcttcattctgaataagatgaagttgcttcggatctcaacggaggatgaacttgcgggtatggatctgacccgacatggtgggtttgcatatgcatatgaggatgatgaatcgcacaagccagggattcagctacggaagattgaacctaactcttcttccactcctagtgctgagtcatgataataattagtagtaataatttcgttttgtatttttccactctttgtgttctagatatttttctttcttttcttttgtagtagtagtttgtacgggcattgtaatttgtattggtcctacacctacatttgtgtgctgtgctggattctatacagcgttgatgaaaatataaaagataggtgaattctaccgtaaaaaaaaaaaaaaaaaaaaaaa

SEQ ID NO: 4085 - protein, 501 aa, Lotus japonicus
MALPECSAANLAQLIGPNATDAAAVAGFICDQFTAVGQRFSDTAFAVDSTYLLFSAYLVFSMQLGFAMLCAGSVRAKNTMNIMLTNVLDAAAGGLFYYLFGFAFAFGAPSNGFIGRHFFGLKDVPTVAFDYSYFLYQWAFAIAAAGITSGSIAERTQFVAYLIYSSFLTGFVYPVVSHWFWSGDGWASATNTGNLLFGTGVIDFAGSGVVHMVGGVAGLWGALIEGPRIGRFDHAGRAVSLRGHSASLVVLGTFMLWFGWYGFNPGSFTKILSAYDSGNYYGQWSAIGRTAVTTTLAGCTAALTTLFGKRIISGHWNVTDVCNGLLGGFAAITAGCSVVEPWAAIVCGFVAAVVLIACNMLAEKVRYDDPLEAAQLHGGCGAWGIIFTALFAKEEYVNQVYPGKPGRPYGLFMGGGGKLLGAHVIQILVIIGWVSATMGPLFFILNKMKLLRISTEDELAGMDLTRHGGFAYAYEDDESHKPGIQLRKIEPNSSSTPSAES

SEQ ID NO: 4086 - DNA, 1491 bp, Arabidopsis thaliana (Mouse-ear cress)
  CDS (1)..(1491)
atgtcaggagctattacttgctctgcggctgatctctcagccctactcggcccaaatgccacggcagcggctgactacatttgcggccagttgggttccgttaacaacaagtttaccgatgcagcctacgctatagacaacacgtacctcctcttctctgcctatcttgtctttgcgatgcagctcggcttcgctatgctttgtgctggctccgttagagctaagaacacgatgaacatcatgctcactaatgtccttgatgctgcagccggaggactcttctactacctctttggttatgcatttgcctttggtgaatcctccgatggattcattggaagacacaactttggtcttcaaaactttccgactctcacctcggattactccttcttcctctaccaatgggcgtttgcaatcgcagccgctggaatcaccagcggctccattgccgagaggactaagttcgtggcgtatttgatatactcttcttttttgaccgggtttgtttacccagttgtctctcactggttctggtctccggatggatgggctagtcccttccgttcagaagaccgtttgtttggcactggagccatcgactttgctgggtcaggtgttgttcacatggttggtggtatcgcaggattatggggtgcccttattgaaggccctcggattggtcggtttcctgatgggggtcatgctattgctctgcgaggccactctgcctcactcgtcgtcttagggaccttccttctctggtttggttggtacgggttcaaccctggttccttcaccaagatactcattccctacaattctggttccaactatggccaatggagtggaataggccgcaccgcggttacaactacactctcgggatgcacagcggctctaaccacactcttcggaaaacgtctcctatcaggccactggaacgtaactgacgtttgcaacgggttactcggagggtttgcggccataacggcaggttgctctgtggttgatccatgggcagcgatcgtatgtggcttcgtggcttccctcgtccttatcggatgcaacaagctcgcagagctcttaaaatatgacgatccacttgaggccgcacaactacacggagggtgtggtgcttggggtttgatatttgtaggactgtttgcaaaagagaagtatataaatgaggtttacggcgcgagcccaggaaggcactacgggctatttatgggcggaggagggaagctattgggagcacaactggttcaaataattgtgattgttggatgggttagtgccacaatgggaacactcttcttcatcctcaaaaagctcaatttgcttaggatctcggagcagcatgaaatgcgaggaatggatttagcaggtcatggtggttttgcttatatctaccatgataatgatgatgattccattggagtgcctggatctccagtacctcgtgcgcctaaccctccagccgtttga

SEQ ID NO: 4087 - protein, 496 aa, Arabidopsis thaliana (Mouse-ear cress)
MSGAITCSAADLSALLGPNATAAADYICGQLGSVNNKFTDAAYAIDNTYLLFSAYLVFAMQLGFAMLCAGSVRAKNTMNIMLTNVLDAAAGGLFYYLFGYAFAFGESSDGFIGRHNFGLQNFPTLTSDYSFFLYQWAFAIAAAGITSGSIAERTKFVAYLIYSSFLTGFVYPVVSHWFWSPDGWASPFRSEDRLFGTGAIDFAGSGVVHMVGGIAGLWGALIEGPRIGRFPDGGHAIALRGHSASLVVLGTFLLWFGWYGFNPGSFTKILIPYNSGSNYGQWSGIGRTAVTTTLSGCTAALTTLFGKRLLSGHWNVTDVCNGLLGGFAAITAGCSVVDPWAAIVCGFVASLVLIGCNKLAELLKYDDPLEAAQLHGGCGAWGLIFVGLFAKEKYINEVYGASPGRHYGLFMGGGGKLLGAQLVQIIVIVGWVSATMGTLFFILKKLNLLRISEQHEMRGMDLAGHGGFAYIYHDNDDDSIGVPGSPVPRAPNPPAV

SEQ ID NO: 4088 - DNA, 1554 bp, Schizosaccharomyces pombe (Fission yeast)
  CDS (1)..(1554)
atgcttaacgagccgaatgcgctattacgtcgcgacgcaaactccactatcgcgactgtaacagaactgtttcccaacgaatactcaaatgctgatatagcgtacgtacttttgagtacagtggtagtatttaccgtaacccccggtatagctctttattatgctgggatggttagaaagaattcggctctctcaatattgactcagtcgtttttggttacagcagtggtgtttattcaatggtatctgtttggatactctcttgcttgctcatcggggtcctctttttatggaacgttgtggcaaggagggatgaaccatctttggttagaaccatatataccagggtccacaattccagcaattgtttactttccatttggtggtctctttgctgtagcgacagctcaattgtttgccggggcaatggctgagcgcggtaggctaattccctctctcgtaatatcttttttatacattacgctggtttattgtccacaggcatactggacatgggcacccaatggctggctctacacattgggtgcccttgactttgcaggcggcggtcccgtacatatttcatctggttttgctgcgctcgcttattccttatgtttaggtcgtcgcattgttgtcgacgagccagacagacccgattcaattcggtcgaccgataatgcagatttaccgtcgtcttcccaaaacaactgcaaagctaattggaagcggtggtttgggttcaaatctgtttcctggaagaattccttcggcagaggaaagatagctcataatcctccgcatgatgctggtatggtttacattggcgttgttttgatttggtttgcatggctctgcttcaattctggtactctattgactgttaatattcgtacagcttatatcatgaccaacacgctcatttcctcgtcatttggtgctttgacatgggcgattattgattacatccgttatagaaagttttccactataggtatttgcgaaggtgccattgcagggttagtgggtatcacaccagcctgtggatttgtatttccatggggagccgctgctgggggtatcgtaccggcattggtatgtaactttcttcatgacctcaatgaatggattggcgttgatgaaacgcttcgtgtctttaacttacacggtatcggcggcattgttggctccatcgtgctcggtgtagtagcgcatcccgatgtcgctgcctcagatggcgctacagttatagacgggggctgggccgttcatcactggaaacaaatgggttatcaatttgcaggttttacctctgttgctgcatggtctttcgtcataacagctatcatatgtctgttagtagatctagtaccgggccttcatattcgtgcatcttttgaagaagagttacgaggaatggattttgttgagttagaagagcaacttccaggccaaactttagagtcaaaacctatgattatatacgctcaggaaatggacgaacctgtaactcagggttcaaatataaaacaggaaaagcaggatgagttttga

SEQ ID NO: 4089 - protein, 517 aa, Schizosaccharomyces pombe (Fission yeast)
MLNEPNALLRRDANSTIATVTELFPNEYSNADIAYVLLSTVVVFTVTPGIALYYAGMVRKNSALSILTQSFLVTAVVFIQWYLFGYSLACSSGSSFYGTLWQGGMNHLWLEPYIPGSTIPAIVYFPFGGLFAVATAQLFAGAMAERGRLIPSLVISFLYITLVYCPQAYWTWAPNGWLYTLGALDFAGGGPVHISSGFAALAYSLCLGRRIVVDEPDRPDSIRSTDNADLPSSSQNNCKANWKRWFGFKSVSWKNSFGRGKIAHNPPHDAGMVYIGVVLIWFAWLCFNSGTLLTVNIRTAYIMTNTLISSSFGALTWAIIDYIRYRKFSTIGICEGAIAGLVGITPACGFVFPWGAAAGGIVPALVCNFLHDLNEWIGVDETLRVFNLHGIGGIVGSIVLGVVAHPDVAASDGATVIDGGWAVHHWKQMGYQFAGFTSVAAWSFVITAIICLLVDLVPGLHIRASFEEELRGMDFVELEEQLPGQTLESKPMIIYAQEMDEPVTQGSNIKQEKQDEF

SEQ ID NO: 4090 - DNA, 1476 bp, Xanthomonas axonopodis (pv. citri), and
  CDS (1)..(1476)
atgcgctctgaccccaccagccccggagttcgtatgaagacagctctttttgccgggtggaaagcccggttctacagcgtgtgcatgctgatgctgttcagcgcgctgatggtgggcggcatgggcagtgcgcatgcgcagtccacgccgcaggtcaccccgctgccgaccgagccggtcaccaccgaaccgctgccgtcggcgcagccggccgccccgccggccgccgccgccgaagccgcaccggtcgtggagaagggcgatgtcgcctggatgctgacctccaccttgctggtgttgctgatggtggtgccgggccttgcgctgttctacggcggcatggtgcgcgccaagaacgtgttgtcggtgctgatccaggtggcggtggtgttctcgctgctgaccgtgctgtgggtgttctacggctacagcctggcgttctccggcgaaggcgcgtggatcggcaatctggacaaggcgttgctcaagggcgtcaccatcgaaaccctggcggcgaccttcaccaagggcgtgagcctgccggaatacgtgttcgtggcgttccaggcgaccttcgccggcatcaccggcgcgctgatcgtgggcgcctttgccgaacgcgccaagttcgcggcggtgctgctgttctcggcgatctggttcaccttcggctacctgccgctggcgcacatggtctgggccaccggtgggtatctgttcgggttgggcgcgttggatttcgccggcggcaccgtggtgcatatcaacgccggcgttgccggcctggtcggcgcctacttcgtcggcaagcgtgccggactgggacgtgaggcgatcaagccgcacaacgtgaccctgaccttcgtcggtgcctcgctgctgtgggtgggctggttcggcttcaacgccggttccaacctggaagccaatgccggtgcggcgctggccttcctcaacaccttgctggccactgccgctgccatcctgggctggtcgctgaccgagaagatcatcaagggcaagtcgtccgccctgggcgtggcctcgggcatggtggccggcctggtcggcatcaccccggcctgcggcacggtcggcccgttcggcgcgatcgtcattggtctggcggccggcgtactgtgcgtgtggggcgtcaccggcctgaagcgcctgttgggcgcggacgacagcctggacgtgttcggcgtgcatggcctgggcggcatcatcggcgccatcctgaccggtgtgttctcggcggcctcgctgggcggccagaagggcggcgattacgacatcgtccaccaggtcggcatccaggcgctgggcgtcgggatcacggtcggctggatcggcgtggtgtcggtggtggggttcgtggttgccaagctggtgttcggcctgcgcgtgagcgaagaagccgagcgcgagggcctggacatcacctcgcacggcgaagccgcgtacgagtcgtga

SEQ ID NO: 4091 - protein, 491 aa, Xanthomonas axonopodis (pv. citri), and
MRSDPTSPGVRMKTALFAGWKARFYSVCMLMLFSALMVGGMGSAHAQSTPQVTPLPTEPVTTEPLPSAQPAAPPAAAAEAAPVVEKGDVAWMLTSTLLVLLMVVPGLALFYGGMVRAKNVLSVLIQVAVVFSLLTVLWVFYGYSLAFSGEGAWIGNLDKALLKGVTIETLAATFTKGVSLPEYVFVAFQATFAGITGALIVGAFAERAKFAAVLLFSAIWFTFGYLPLAHMVWATGGYLFGLGALDFAGGTVVHINAGVAGLVGAYFVGKRAGLGREAIKPHNVTLTFVGASLLWVGWFGFNAGSNLEANAGAALAFLNTLLATAAAILGWSLTEKIIKGKSSALGVASGMVAGLVGITPACGTVGPFGAIVIGLAAGVLCVWGVTGLKRLLGADDSLDVFGVHGLGGIIGAILTGVFSAASLGGQKGGDYDIVHQVGIQALGVGITVGWIGVVSVVGFVVAKLVFGLRVSEEAEREGLDITSHGEAAYES

SEQ ID NO: 4092 - DNA, 1482 bp, Prochlorococcus sp. (strain PCC 9511)
  CDS (1)..(1482)
atgcagactaattttttatttatgaccactgctttgcaaacgcctcaaaggcgctctaggtccaaacttcaagatgcaagtcttgtaaacggacctatgctccttttgaggagtattcgtgggttcagttcaaaccgctcaatgttgtggcttgcaactgtccctctagctttgtttggtttaggtatttttaatctttcagctcacgcagctgatttacctgagttgaatgcagcttttctagctaacaatttatggcttttgatcgctactattttagtgatcttcatgaacgccggtttcgctatggttgaagcgggtatgtgtcggtctaaaaacgccgtcaacattcttgctaaaaaccttttcgtatttgctttagctgtaacctcttattggtttattggctactcattaatgtacggaggaagtgttgctgacggatggctatattttggaggcttattttttgatccgacagtaacagccgatatggttactgatgctggattagttccaacagttgatttcttattccagtctgcttttgcaggtactgcagcaactatcgtttctggtcttgttgctgaaagagttaaatttggtgaatttgttgtttttgcgattgtattaacagcatttatttatccaattgctggtagctggaaatggaatggtggctggcttgattctcttggtttcgttgactttgcaggttcttcaattgttcactcagttggagcatgggcaggtttagtgggggctatgctcctaggaccaagaatcggtaaatactccgatggaaagccacaggctatgcctggtcacaatatggctattgctactttaggcgctttaattctatggataggttggtacggatttaatcctggttctcaacttgctatggatcaatgggttccatatgttgctgtaacgactactcttgcagctgcagctggtgctattggagcaactattgtttctactttaacttccggaaagccagatcttactatgatcattaatggtattcttgctggtttggtaagtattactgcaggttgtggtgacatgactcttgcgggagcttggttcgctggactagttggcggtattatcgttgtattctccgttgcagcacttgatgcagctgaaattgacgatcctgttggtgcattctctgttcacggagtttgtggtgtatggggtaccctagttattggtctttggggaactgcagttcaaggagatggagcaggtatgggattgttcaatggtggtggtattaatctacttcttgttcaagctcttggtgccgcggcttatgctatctggacactagttacttgctggatcgcttggtctattatcggaggtttattcggaggaatccgtgtatctgaggaagaagagactcaaggtttagatatttctgagcatggtatggaatcatatccagactttgcatctgctaaataa

SEQ ID NO: 4093 - protein, 493 aa, Prochlorococcus sp. (strain PCC 9511)
MQTNFLFMTTALQTPQRRSRSKLQDASLVNGPMLLLRSIRGFSSNRSMLWLATVPLALFGLGIFNLSAHAADLPELNAAFLANNLWLLIATILVIFMNAGFAMVEAGMCRSKNAVNILAKNLFVFALAVTSYWFIGYSLMYGGSVADGWLYFGGLFFDPTVTADMVTDAGLVPTVDFLFQSAFAGTAATIVSGLVAERVKFGEFVVFAIVLTAFIYPIAGSWKWNGGWLDSLGFVDFAGSSIVHSVGAWAGLVGAMLLGPRIGKYSDGKPQAMPGHNMAIATLGALILWIGWYGFNPGSQLAMDQWVPYVAVTTTLAAAAGAIGATIVSTLTSGKPDLTMIINGILAGLVSITAGCGDMTLAGAWFAGLVGGIIVVFSVAALDAAEIDDPVGAFSVHGVCGVWGTLVIGLWGTAVQGDGAGMGLFNGGGINLLLVQALGAAAYAIWTLVTCWIAWSIIGGLFGGIRVSEEEETQGLDISEHGMESYPDFASAK

SEQ ID NO: 4094 - DNA, 1317 bp, Corynebacterium glutamicum (Brevibacterium flavum)
  CDS (1)..(1317)
atgggtgcagatcaaattgcagcagtctccggcaattcagcttggatgctgatgtccgcgtcgctcgtgctgctaatgacaccagcactggcacttttctatggcggcatgtctcgtcaaaagtccgtgctcaacatgatgatgatgtcctttggagcattgggcgtcgttactgttatttacctcttgtggggatggtcgatgtcttatggaacccaatcaatcgcgggaatctttgctaacccttttgagttcttcggtcttaaagattccatcgttgatgcagacggcaactacattgagggcgcagctggctacccaaacattattgatatcggattccagcttaccttcgccgttatctccactgcactgatctccggtgcgttggcagagcgtgtgaagttttccacctggcttattttcagcggcgcgtgggtgactttggtgtacttcccactggcacacatggtgtggggtggcggattgttgggccataatgtcactggttttgcttcgtggttgtttggttctaccgatggtgaagccaatatcgctccgatcgactttgctggtggtaccgttgttcacatttcggcgggcacagcggcccttgtgctggcttttatcgtcggcaagcgaaagacgtttggcaaggcaattgccaggccgcacaacctgcccatggtcatgctcggcgctgcgctgttgtggtttggttggttcgggttcaacggtggctcggcgttcgcagccgacggccttgcgggcctggcctgggtgaacaccacggcggcaaccgcagctgcgatgcttggctggttggctactgaaaaattccgcgatggacacgcaacctccttgggtgctgcttctggtgtcgtcgccggtctggtcgcaattactccagcagctggcgcactgaccccagtgacctccctgatcctcggtgcaatcggcggcatcttggcgtgcttgggcgtggggctgaagtaccgcttcggtttcgatgactccctcgacgtagttggtgtgcacctggtcgctggcctgtggggcaccgtgggtgtaggacttcttgccactgacatcggatggtttagtggtggtggcatggatggacttaaactctttattgtccagatcgtcatcgcgctagtcgctgtagttttcgcaggtgtgattactgcgctcatcgcattcgccctgaaggccacagtaggatggcgcgttgatgatgatgtggagcagcaaggcattgatactcacgaacacgcagaatccgcttatgacaccacgggtccggaaattcgttaa

SEQ ID NO: 4095 - protein, 438 aa, Corynebacterium glutamicum (Brevibacterium flavum)
MGADQIAAVSGNSAWMLMSASLVLLMTPALALFYGGMSRQKSVLNMMMMSFGALGVVTVIYLLWGWSMSYGTQSIAGIFANPFEFFGLKDSIVDADGNYIEGAAGYPNIIDIGFQLTFAVISTALISGALAERVKFSTWLIFSGAWVTLVYFPLAHMVWGGGLLGHNVTGFASWLFGSTDGEANIAPIDFAGGTVVHISAGTAALVLAFIVGKRKTFGKAIARPHNLPMVMLGAALLWFGWFGFNGGSAFAADGLAGLAWVNTTAATAAAMLGWLATEKFRDGHATSLGAASGVVAGLVAITPAAGALTPVTSLILGAIGGILACLGVGLKYRFGFDDSLDVVGVHLVAGLWGTVGVGLLATDIGWFSGGGMDGLKLFIVQIVIALVAVVFAGVITALIAFALKATVGWRVDDDVEQQGIDTHEHAESAYDTTGPEIR

SEQ ID NO: 4096 - DNA, 1690 bp, Ustilago violacea (Smut fungus) (Microbotryum violaceum)
  CDS (19)..(1500)
ttcgacttcagtctcatcatggtcaacgttgcgtacgatacgacagggactcttgttgccaatgtagatggcactcagaccgtgtacaatggcggtgacatggcatgggtgcttgtcgccggtgttctcgtcatgatcatgtcccccggagttggtttcctctattctggtcttttgcgtaggaagaatgctttgtctatgatgatgctcggtgtccttgtctatgcggttattacaattcaatggtttttttggggctactcgttggcttttagcagcaccggcagtgccttcatcggcgacttgaagcactttggcctcatgaacgtcacgctcgaaccatccgccgggtcctccaagattcctgctctgttgtattacttctaccaatccatgttcgccactgtgactgtggttattcttgttggaggtattgcagaacgtgcacgtattctaccgcttctcattttctgcttctgttgggccaccatcgtgtacgaccctattgccaactgggtctggaaccccaacggatggctctacaagctcggtgagctcgactttgccggcggaggacccgtccatatcacttcgggaaccgctggctttgcgtggtcgctctacttgggccgtcgtcgcggttatggtacagccaagctcgcttaccgcccccactcggtcttccaaatcatcctcggcaccgtcttcctctggttcggctggttcggatttaacggtggatccgaactggcgatgaacttgcgcgcagtccaggcctcgactgtcaccaacatcgctgccgctatgggtggaatcacctggttcgcgatggattggttctacaccaagaagtggtctgctgtctcgatgtgctccggtatcctcgctggtctcgtcggcatcacccctgcggctggttatattggctctcccgcggcgttggccattggtttcctcaccgcaattgcatgcaactttggcactggcctcaaagttctgctcggaatcgatgatgccgtcgactcgttcgcgctccacgccattgggggctactgcggatccgccttgactgcgctcttcgccgatagccgcgtcgctggatttgatggctacaccgagattcctggcggctggatcaaccacaactacatccagcttgggtggcaactcgccggagcgacgacgatcatggcttacaccttcgtcgtcacctacctgctcctctttgtcatcgaccacattcctggcctcaaactccgagctactgaggacatggagattcttggtatcgacgagaccgagctcggcgagaacgcctacgactttgtcttccgcaaccgtgatcttgagaaccctgaggaattctccgaattgcacaaccgagcaactggcgaagaccttagccgccaagtgagccatcactcgtcgtcgagccacaacaaggacatcaagtcgcctcactccgctgtccccgtgacggaggagaaattgagcgtttgagacggaatgtagagaccactgcaccgactcgccggctttgaccagcgctgtacactctcccatatccaaccactttgcctctctgtctgacctaacgtcgcctgtgcttctaccaatctcgcattcgttttcttttgggggtattctttgtgtttcctatatttaattacacatatgctctttcagccgc

SEQ ID NO: 4097 - protein, 493 aa, Ustilago violacea (Smut fungus) (Microbotryum violaceum)
MVNVAYDTTGTLVANVDGTQTVYNGGDMAWVLVAGVLVMIMSPGVGFLYSGLLRRKNALSMMMLGVLVYAVITIQWFFWGYSLAFSSTGSAFIGDLKHFGLMNVTLEPSAGSSKIPALLYYFYQSMFATVTVVILVGGIAERARILPLLIFCFCWATIVYDPIANWVWNPNGWLYKLGELDFAGGGPVHITSGTAGFAWSLYLGRRRGYGTAKLAYRPHSVFQIILGTVFLWFGWFGFNGGSELAMNLRAVQASTVTNIAAAMGGITWFAMDWFYTKKWSAVSMCSGILAGLVGITPAAGYIGSPAALAIGFLTAIACNFGTGLKVLLGIDDAVDSFALHAIGGYCGSALTALFADSRVAGFDGYTEIPGGWINHNYIQLGWQLAGATTIMAYTFVVTYLLLFVIDHIPGLKLRATEDMEILGIDETELGENAYDFVFRNRDLENPEEFSELHNRATGEDLSRQVSHHSSSSHNKDIKSPHSAVPVTEEKLSV

SEQ ID NO: 4098 - DNA, 1658 bp, Arabidopsis thaliana (Mouse-ear cress)
  CDS (63)..(1490): n means a or g or c or t/u
cccacgcgtccgcacaaacccaacaaaaatttcatcaactccgggaaagatagaataacaaaatggccggagcttacgatccaagcttgccggaggttcctgaatggctcaacaaaggagacaacgcgtggcagctcacggcagcgactctggttggtctacagagtatgccaggtcttgttatcctctatgcctccatcgtcaagaagaaatgggctgtgaattcagcttttatggctctttacgctttcgccgccgttcttctctgttgggtcctcctctgttacaaaatggcttttggagaagagcttttgccgttttggggcaaaggtggtccagctttcaaccaaggataccttaagggacaagcaaagatcccaaatagtaatgtggcggcgccgtattttccgatggcgacgttggtgtattttcagttcacattcgcggcgataacgacgatacttgtggcgggatctgtgttggggaggatgaatattaaagcatggatggcttttgtgccattgtggttgatctttagctacacagtnggagcttatagtatatggggaggtgggtttctgtatcagtggggagttattgattattccggcggttatgttattcatctctcctccggtgttgccggtttcgtcgctgcttactgggtaggaccaaggcctaaggctgacagagagagattcccaccgaacaatgttctactaatgcttgctggagctggccttttatggatgggatggtccggttttaacggtggtgctccttacgcggccaatttaacctcctctatcgcggtgttaaacaccaacctctctgccgccacaagcctccttgtgtggacaacacttgatgtcatcttctttggcaaaccttctgtcatcggagcaattcaaggcatggttactggcttagccggcgtcactcccggagcaggtttgatccaaacatgggcagctataataattggagtagtctcaggaacagctccatgggcctctatgatgatcattcacaagaaatccgctctccttcaaaaggtggatgatacattagcggtgttttacacacacgccgtggctggtttacttggtggaataatgacagggttgtttgcacaccctgatctctgcgttttggtacttcctctcccagcgaccagaggagctttctacggtggcaatggcggcaaacagcttttgaaacagttggctggagctgccttcattgccgtctggaatgtggtgtcgactactatcattctactcgctattagggtgttcataccattgagaatggctgaggaagagctcgggattggagacgacgcagcacatggggaagaagcttatgctctttggggagatggagagaagtttgatgctacaaggcatgtgcaacagtttgagagagatcaagaagctgctcatccttcttatgttcatggtgctagaggtgtcaccattgttctatgatttttcttcttctttttcttatttatttttttgtgtattgatttccttatgacattagagatgtgaatgagttatttgtgttctgtataggtggtaaaacttcacttttcatattttttggtgtgtatttggagttaacaaccaaaaaaaaaaaaaaaaaaaaaaaaa

SEQ ID NO: 4099 - protein, 475 aa, Arabidopsis thaliana (Mouse-ear cress)
MAGAYDPSLPEVPEWLNKGDNAWQLTAATLVGLQSMPGLVILYASIVKKKWAVNSAFMALYAFAAVLLCWVLLCYKMAFGEELLPFWGKGGPAFNQGYLKGQAKIPNSNVAAPYFPMATLVYFQFTFAAITTILVAGSVLGRMNIKAWMAFVPLWLIFSYTVGAYSIWGGGFLYQWGVIDYSGGYVIHLSSGVAGFVAAYWVGPRPKADRERFPPNNVLLMLAGAGLLWMGWSGFNGGAPYAANLTSSIAVLNTNLSAATSLLVWTTLDVIFFGKPSVIGAIQGMVTGLAGVTPGAGLIQTWAAIIIGVVSGTAPWASMMIIHKKSALLQKVDDTLAVFYTHAVAGLLGGIMTGLFAHPDLCVLVLPLPATRGAFYGGNGGKQLLKQLAGAAFIAVWNVVSTTIILLAIRVFIPLRMAEEELGIGDDAAHGEEAYALWGDGEKFDATRHVQQFERDQEAAHPSYVHGARGVTIVL

SEQ ID NO: 4100 - DNA, 1359 bp, Corynebacterium glutamicum (Brevibacterium flavum)
  CDS (1)..(1359)
atggacccctcagatctagcctggattctcgcagcttttgcgttggtaagcctgatgttccccggattgtccctgctctacggcggcatgctgggtgggcaacacgttcttaacacgttcatgatggttatgagctcacttggaatcatcagccttgtgtacatcatttatggacacggacttgtcttaggaaactccatcggtgggtggggaattatcggaaatccccttgaatacttcggcttccgcaacattatggaagatgacggcaccggagacctcatgtgggccggcttctacattctgttcgctgcaatctcactcgcacttgtttcatctggtgcagcggggcgcatgcgctttggagcgtggctggtcttcggtgtcctgtggttcacctttgtgtacgcgccactggcacactgggttttcgctatcgatgatcctgagtccggctacgtgggtggctggatgaaaaatgtgcttgagttccacgactttgctggtggaacggcagtgcacatgaatgcgggtgcgtctggactcgcgctggcaatagtgctgggacgccgccactccatggctgtgcgtccacacaaccttccactgattttgattggtgcaggactgatcgttgcgggctggttcggattcaatggtggtaccgcaggtggtgccaacttcctcgcaagctacgtggtcgttacctctctcattgctgcagctggcggaatgatgggcttcatgctcgttgaacgtgtgttcagcggaaaacccactttctttggctcggcaaccggcacaatcgcaggccttgtggctatcaccccggccgcggatgcagtgagcccgctcggagcattcgccgtcggagcgctcggcgcagttgtctccttctgggcaattagctggaagaagggacaccgagtcgatgattccttcgatgtgttcgcagtccacggaatggccggcattgcaggtgcactgtttgtcatgctctttggcgatccactagcaccagcgggagtttccggagtcttcttcggtggcgaactctccctgctgtggagggaaccactggccatcatcgtgacccttacatacgcattcggcgtgacctggttgattgccacgatcttgaacaagttcatgactctgcgcatcacctccgaagccgaatatgaaggcattgaccgcgcagaacacgcagaatctgcctaccacctcaattccaacggaattgggatggcaacccgcaccaatttcggacctgaaatccccgaggaaaccgtgcccgacgccgtgcaggtgggcgtcgataagcaaaaaatcgctgatactcgaaaggcctcaaaatga

SEQ ID NO: 4101 - protein, 452 aa, Corynebacterium glutamicum (Brevibacterium flavum)
MDPSDLAWILAAFALVSLMFPGLSLLYGGMLGGQHVLNTFMMVMSSLGIISLVYIIYGHGLVLGNSIGGWGIIGNPLEYFGFRNIMEDDGTGDLMWAGFYILFAAISLALVSSGAAGRMRFGAWLVFGVLWFTFVYAPLAHWVFAIDDPESGYVGGWMKNVLEFHDFAGGTAVHMNAGASGLALAIVLGRRHSMAVRPHNLPLILIGAGLIVAGWFGFNGGTAGGANFLASYVVVTSLIAAAGGMMGFMLVERVFSGKPTFFGSATGTIAGLVAITPAADAVSPLGAFAVGALGAVVSFWAISWKKGHRVDDSFDVFAVHGMAGIAGALFVMLFGDPLAPAGVSGVFFGGELSLLWREPLAIIVTLTYAFGVTWLIATILNKFMTLRITSEAEYEGIDRAEHAESAYHLNSNGIGMATRTNFGPEIPEETVPDAVQVGVDKQKIADTRKASK

SEQ ID NO: 4102 - DNA, 1751 bp, Lycopersicon esculentum (Tomato)
  CDS (56)..(1522)
tccccttcatcttcttcgcacccacccacccctctaccccacccccaccccaccaatggcttgttccgtcgatactctcgctccgttcctcggtcctaacaccaccaacgccgtcgccgccgcttcatacatctgcaaccaattttcaggtgtatcggacagattcgtcgataccggttatgcaatcgattctacatatctcctcttctctgcttatctcgttttctccatgcagcttggtttcgctatgcttttggcgggctctgtgcgaaatacaatgaatattatgctcacgaacgtcctcgatgccgccgccggtggacttttttactatctattcggattcgcttttgctttgggtggtccgtctaatggattcatcggccgacattttttcgggcttaaagagatcccgtcaaattcattcgattacatgaatttcctctatcaatgggctttcgccatcgccgccgccggtatcaccagcggttcaatcgccgaacgaacccaatttgttgcctatttgatttattcctcttttctaacgggtttcgtttacccggttgtttctcattggttttggaccccagatgggtgggctagcccgactaattcaaatctattattcggatccggtgtaatcgatttcgccgggtcgggtgtagttcatatggtaggtggaatcgccgggttttacggagctttgattgaaggtccacgaatcgggcggtacgatcatacgggtcgatcggttgcgcttcgtggacatagcgcgtcactcgtggttctaggcacctttttattatggttcggatggtacggatttaaccccggttcatttaataaaatcctagttacttacggtgcatccggagggtattatggtcaatggagcgctgtaggacgtaccgcggttacaactaccctagccggttgcaccgcagccctaacgactcttttcggtaaacgtatcctttcgggtcattggaacgtaaccgatgtatgtaacggtttactaggcggatttgcagcgatcacggctgggtgctcggtcgtcgagccgtgggccgcgattatatgtgggttcgtagcggctttagttttaattggttttaacatgttagcggaaaaatttaaatacgacgatccacttgaagcagcacaattacatgggggttgtggtgcatgggggataatttttaccgggttattcgctaaaggggagtttgtggatcaagtatacccgggtaaaccgggtcgacctcacgggttatttatgggtggtggagggaaactactcggggcgcatataatccagatactcgtaataatcgggtgggtcagcgcgacaatgggtccgcttttttatatacttcataaattcaagttgcttcggatatcgtccgaagacgaaatggcgggtatggatctgacccgacatggtgggtttgcttattatcatgaagaggatccgaaattaggaatgcaaatgagaagaattgaaccaacaacctcaacttagaaaaaaaaataaaaaaaaaaattatctttttatttatgtatctttgaattgtctagtttatatttttataaaattaatattagggtgtttgtgaaaagaaaaaaaaaatagtggatttttttaatggtaaaaatgagtggttgtgtatgaagataatgtgaacatgtcctcttttattattttctactagttatcctatatttgactattaatatccaaaaaaaaaaaa

SEQ ID NO: 4103 - protein, 488 aa, Lycopersicon esculentum (Tomato)
MACSVDTLAPFLGPNTTNAVAAASYICNQFSGVSDRFVDTGYAIDSTYLLFSAYLVFSMQLGFAMLLAGSVRNTMNIMLTNVLDAAAGGLFYYLFGFAFALGGPSNGFIGRHFFGLKEIPSNSFDYMNFLYQWAFAIAAAGITSGSIAERTQFVAYLIYSSFLTGFVYPVVSHWFWTPDGWASPTNSNLLFGSGVIDFAGSGVVHMVGGIAGFYGALIEGPRIGRYDHTGRSVALRGHSASLVVLGTFLLWFGWYGFNPGSFNKILVTYGASGGYYGQWSAVGRTAVTTTLAGCTAALTTLFGKRILSGHWNVTDVCNGLLGGFAAITAGCSVVEPWAAIICGFVAALVLIGFNMLAEKFKYDDPLEAAQLHGGCGAWGIIFTGLFAKGEFVDQVYPGKPGRPHGLFMGGGGKLLGAHIIQILVIIGWVSATMGPLFYILHKFKLLRISSEDEMAGMDLTRHGGFAYYHEEDPKLGMQMRRIEPTTST

SEQ ID NO: 4104 - DNA, 1671 bp, Arabidopsis thaliana (Mouse-ear cress)
  CDS (10)..(1569)
ggctcaaacatgtcaggagctataacatgctctgcggccgatctcgccaccctacttggccccaacgccacggcggcggccgactacatttgcggccaattaggcaccgttaacaacaagttcaccgatgcagccttcgccatagacaacacctacctcctcttctctgcctaccttgtcttcgccatgcagctcggcttcgctatgctttgtgctggttctgttagagccaagaatacgatgaacatcatgcttaccaatgtccttgacgctgcagccggaggactcttctactatctctttggttacgcctttgcctttggaggatcctccgaagggttcattggaagacacaactttgctcttagagactttccgactcccacagctgattactctttcttcctctaccaatgggcgttcgcaatcgcggccgctggaatcacaagtggttcgatcgcagagaggactcagttcgtggcttacttgatatactcttctttcttaaccggatttgtttacccggttgtctctcactggttttggtccccggatggatgggccagtccctttcgttcagcggatgatcgtttgtttagcaccggagccattgactttgctggctccggtgttgttcacatggttggtggcatagcaggtttatggggtgctcttattgaaggtcctcgtcgtggtcggttcgagaaaggtggtcgcgctattgctctgcgcggccactctgcctcgctagtagtcttaggaaccttcctcctatggtttggatggtatggtttcaaccccggttccttcactaagatactcgttccgtataattctggttccaactacggccaatggagcggaatcggccgtacagcggttaacaccacactctcaggatgcacagcagctctaaccacactctttggtaaacgtctcctatcaggccactggaacgtaacggacgtttgcaacgggttactcggtgggtttgcggccataaccgcaggttgctccgtcgtagagccatgggcagcgattgtgtgcggcttcatggcttctgtcgtccttatcggatgcaacaagctcgcggagcttgtacaatatgatgatccactcgaggcagcccaactacatggagggtgtggcgcgtgggggttgatattcgtaggattgtttgccaaagagaagtatctaaacgaggtttatggcgccaccccgggaaggccatatggactatttatgggcggaggagggaagctgttgggagcacaattggttcaaatacttgtgattgtaggatgggttagtgccacaatgggaacactcttcttcatcctcaaaaggctcaatctgcttaggatctcggagcagcatgaaatgcaagggatggatatgacacgtcacggtggctttgcttatatctaccatgataatgatgatgagtctcatagagtggatcctggatctcctttccctcgatcagckctcctcctcgcgtttaattttcaactttttggtaatttattaccgtttaagtattgtttgggctttggttttgaaatataaatatttggatgttttggtttgttttaagtgacctatcgtctttttgtgtttataagtgttttagtttatgttttttttttttaaaaaaaaaaaaaaaaaaaa

SEQ ID NO: 4105 - protein, 519 aa, Arabidopsis thaliana (Mouse-ear cress)
MSGAITCSAADLATLLGPNATAAADYICGQLGTVNNKFTDAAFAIDNTYLLFSAYLVFAMQLGFAMLCAGSVRAKNTMNIMLTNVLDAAAGGLFYYLFGYAFAFGGSSEGFIGRHNFALRDFPTPTADYSFFLYQWAFAIAAAGITSGSIAERTQFVAYLIYSSFLTGFVYPVVSHWFWSPDGWASPFRSADDRLFSTGAIDFAGSGVVHMVGGIAGLWGALIEGPRRGRFEKGGRAIALRGHSASLVVLGTFLLWFGWYGFNPGSFTKILVPYNSGSNYGQWSGIGRTAVNTTLSGCTAALTTLFGKRLLSGHWNVTDVCNGLLGGFAAITAGCSVVEPWAAIVCGFMASVVLIGCNKLAELVQYDDPLEAAQLHGGCGAWGLIFVGLFAKEKYLNEVYGATPGRPYGLFMGGGGKLLGAQLVQILVIVGWVSATMGTLFFILKRLNLLRISEQHEMQGMDMTRHGGFAYIYHDNDDESHRVDPGSPFPRSALLLAFNFQLFGNLLPFKYCLGFGFEI

SEQ ID NO: 4106 - DNA, 1659 bp, Lycopersicon esculentum (Tomato)
  CDS (179)..(1561)
aaaggattcaatatctactcgtacaaaaaaaaagatgaaaaactttaatctatgtataaacccctggatactacctgactcagttatcaaataagtttcgtggaccattccagttcacctgttttttaaataaatatcctattatgtgaatgttgtgtgaagcaagcaaatagcaataatggattcttcatgggaagctagtgtaactgattccataaatgcaatttaccttttattctctgcttacttggtttttgtaatgcaattgggttttgccatgctttgtgctggttctgttagggcaaagaatgcaatgaacattatgcttacaaatgtagttgatgctgttgttggtagtctttcatactatctttttggttttgcttttgcttttggcgattcaaatccatttataggtgctagttattttgctcttaaagacattccttctagctcttatgactacagtttctttctttatcaatgggcttttgctattgctgttgctggaattactagtggttctattgctgaacgtactcaatttactgcttatcttgtcttctcttttttccttactggatttgtttatcctgttgttgctcattggctttggtcttctaatggttggttaagtccaaattcaacttatcttctttttggttctggtgctattgactttgccggtagtggtgttgtgcatttggttggtgggattgctggtttttggggttctattgtagaaggtccaagagttggacggtttgatgcctttggtaatcctgtcaaaatgagaggacataatgctactctagtagtgcttggaacattgttgttgtggtttggatggttcgggtttaatcctggatcattcaacaaaattcttgttgcctacccacatatggctgatcaaggtaactggacctctgtgggacggactgctgtcacgactaccctggctggttcaaccgcggggattgttaccttgtttggacgaaggttattggtgggacattgggatgcaatggatgtttgtaatggagttcttggtgggtttgttgcaatcacttcaggttgttcagtggtagaaccatgggctgcaattttgtgtgggttctgtgcagcttgggtactgataggattgaacattttagcgcttaaattcaaattcgatgatccgttagaagcagcacagttacatggagggtgtggagcttggggtttgatatttacagggttgtttgctaaagaagaatttgtgttacaagcttataattccggtaaaacacaaattatacgaccttccggcctgattttaggaggtggatggggtttgtttggggcacaaatagttgaactattgagtattgtggtttgggtaagtttgacaatgggacctttgttttatctacttcagaaacttggaattttgaggatatcatcggacgaggaggttgctggtcttgatatctctagtcacggaggttatgcctacgatgctagtcaagaagaaagtaatgctcgcttctatggcgagtatttaaggatgcaacaacaataataaggtgcacacctcaactattctaccgtatacaagattgctttcatcaaatgtaaatatatgcaactttgtaatttcctcaaaaaaaaaaaaaaaaa

SEQ ID NO: 4107 - protein, 460 aa, Lycopersicon esculentum (Tomato)
MDSSWEASVTDSINAIYLLFSAYLVFVMQLGFAMLCAGSVRAKNAMNIMLTNVVDAVVGSLSYYLFGFAFAFGDSNPFIGASYFALKDIPSSSYDYSFFLYQWAFAIAVAGITSGSIAERTQFTAYLVFSFFLTGFVYPVVAHWLWSSNGWLSPNSTYLLFGSGAIDFAGSGVVHLVGGIAGFWGSIVEGPRVGRFDAFGNPVKMRGHNATLVVLGTLLLWFGWFGFNPGSFNKILVAYPHMADQGNWTSVGRTAVTTTLAGSTAGIVTLFGRRLLVGHWDAMDVCNGVLGGFVAITSGCSVVEPWAAILCGFCAAWVLIGLNILALKFKFDDPLEAAQLHGGCGAWGLIFTGLFAKEEFVLQAYNSGKTQIIRPSGLILGGGWGLFGAQIVELLSIVVWVSLTMGPLFYLLQKLGILRISSDEEVAGLDISSHGGYAYDASQEESNARFYGEYLRMQQQ

SEQ ID NO: 4108 - DNA, 1603 bp, Ustilago maydis (Smut fungus)
  CDS (91)..(1554)
cagctcccctgttcctgagcaagcttgtacaacagcttcgccattcccacttttccctttccagagcggcatcgctgatctctcccaaaaatggttaacgccagctacacgcccagcggcgatctgatcacctactacgatgaccaaggcacgcccaccgaactcatctataacctcggcaacatgtcgtggatcattgtttcgaccgccttggtctttatcatgattcccggtcttggtttcttctacgccggtctgctcagaaagaagtcggcgctctctatgatctggatgtccatggtgattttgtcggtcgcatccttcgagtggttcttctggggcttttctctcgctttctccaccagctctagcaacaagttcattggtaaccttgacaactttggtctgatcaacgtcgacattgggccttctacaggagggaccgggcttccacagctgctcttctgcatctaccagatgatgttcgccgccatcacccctgtgattgcctgcggtgcgtttgccgaccgtgctcgattgggtcccgttctcattttcgccttctgctggtgcactattgtctacaatcccatcgcctattggacatggaacgtcggcaagggttgggccaacgtcatgggtggtctcgacttcgccggtggtacacctgttcacatctcttcgggtaccgctgcgctcgccatctcgatcttcctcggcaagcgtaaggggtacggcacggagcagttggcctaccgaccccacaacgttgcctacgtcatcttgggaaccgtgctgctgtggtttggctggttcggcttcaacggtggttcggctcttggtgccaaccttcgtgctgttcaggccatgatggtcactcaggtggctacctcggtcggtggtctcacctggatgttctgggactggaggctggagcgcaagtggtcggctgtcggtttctgctctggtgccatctcgggtctggtcgctatcacgccagcttctggttacgtcggaacgcccgcagctgttgcctttggcgtgctcggtggtacggcttgcaactttgccactggtctcaagaaccttttcggttacgatgatgctctcgacatctttgctgctcacggtattggtggtattgtgggcaacttgcttactggtatctttgccgacaaccgcgttgcgtcgtttgacggtaccgctccgatccctggtggttggatcaacaagaactggattcagcttggttatcagcttgccgactcggctgccggtttcggttggtcgtttgtggttacgctcatcctgctgttcgccatcgaccgcatccctggctgccacttccgatctagcgaggaggacgagtctctgggtatcgatctcactcagatcggagaagaggtcatggtgatgcctctgcttcacgactttgttcgcccagaggacggcgcagagattcatcacgctactgcatccaccgatctcaagttctcgcctgctcacagcgagaaggacctcgaggctgctcgtccacagcctactgctgtctaagcttgactcctgcccccctccccgctattcttggcccctatctttgggc

SEQ ID NO: 4109 - protein, 487 aa, Ustilago maydis (Smut fungus)
MVNASYTPSGDLITYYDDQGTPTELIYNLGNMSWIIVSTALVFIMIPGLGFFYAGLLRKKSALSMIWMSMVILSVASFEWFFWGFSLAFSTSSSNKFIGNLDNFGLINVDIGPSTGGTGLPQLLFCIYQMMFAAITPVIACGAFADRARLGPVLIFAFCWCTIVYNPIAYWTWNVGKGWANVMGGLDFAGGTPVHISSGTAALAISIFLGKRKGYGTEQLAYRPHNVAYVILGTVLLWFGWFGFNGGSALGANLRAVQAMMVTQVATSVGGLTWMFWDWRLERKWSAVGFCSGAISGLVAITPASGYVGTPAAVAFGVLGGTACNFATGLKNLFGYDDALDIFAAHGIGGIVGNLLTGIFADNRVASFDGTAPIPGGWINKNWIQLGYQLADSAAGFGWSFVVTLILLFAIDRIPGCHFRSSEEDESLGIDLTQIGEEVMVMPLLHDFVRPEDGAEIHHATASTDLKFSPAHSEKDLEAARPQPTAV

SEQ ID NO: 4110 - DNA, 1470 bp, Geobacter sulfurreducens
  CDS (1)..(1470)
atgaagtggaaacgttcgatcatcacacttgccctggccgccgcagccttcatggctccggccgcagtcctcgccgaagaggccaaggcccccgccgtggcggcaacccaggcagccgtcacctccgcccaggctgctccggcggccgttgccccggctgaggccgcaccggcggctgccgaagcccccaaggtggccgaaccggtcctcaataccggcaataccgcctggatgctcgtctgcgcggccctggtccttctgatgcttcccggccttgccctcttttacggcggcatggtccggagcaaaaacgtcctctcaaccctgatgcattcctttgttgccatggggatcgtgggggtccagtgggccgtcatcggttactcgctggccttcggtcccgacatgggcggcatggggcttgtgggagacttcagccgggcgctgctcaacggaatgatcagcttcaaggacggcgcgccggtctacaccctctggcagaacgtgaccagtgaacccaacgccatccccgagtacgtctttgccatgttccagggaatgttcgccatgatcaccgtagccctcatctccggcgccatggccgagcgggttaagttctccgcctactgcgtctttgtgctcctttggaccaccctggtctacgatcccctggcccactgggtctggatggtggacggctggctcttcaagaagggtgccctggactttgccggcggcaccgttgttcacctctcctccggtatttccgccctggcgttcctcgtcttcctcggcaaacgtcacgggttcccccatgagcgtatggctccccataacctctccatgaccatgctcggcgtggggctcctctggttcggctggttcgggttcaacgcgggttcggcggtagtcggcgtgaacaacgttgatgcggccggcgggcttgcgggcctcgccttcgccaccaccaccatcgccccggcagccggcggcctggcctggatgatcgccgaatggatccacgcgggcaggccctcggcactcggcttcggttcaggcgtggtcgcaggactggtcggcattacgcccgcggccggctttgtccagccgggcgctgccatcatcatcggcctcggcgccggcgtgatctgctacctgggtgtgctcatgaaggcgaagctcaagtatgacgactccctggatgccttcggcgtgcacggcgtgggcggcacctttggcgccctcgtcaccggcgtcttcgccacggtgggggccacggggctcctctccggcaacgtgtcccagttcatcacccaggtgatcggggtggtgtcggccggtgcctatgccttcatcgtgaccctggtcatcgccttcatcctcgacaagaccatcggtctccgggtggagaaggaagacgagatcatgggcctcgaccagacccagcactccgagtcggcgtacaactag

SEQ ID NO: 4111 - protein, 489 aa, Geobacter sulfurreducens
MKWKRSIITLALAAAAFMAPAAVLAEEAKAPAVAATQAAVTSAQAAPAAVAPAEAAPAAAEAPKVAEPVLNTGNTAWMLVCAALVLLMLPGLALFYGGMVRSKNVLSTLMHSFVAMGIVGVQWAVIGYSLAFGPDMGGMGLVGDFSRALLNGMISFKDGAPVYTLWQNVTSEPNAIPEYVFAMFQGMFAMITVALISGAMAERVKFSAYCVFVLLWTTLVYDPLAHWVWMVDGWLFKKGALDFAGGTVVHLSSGISALAFLVFLGKRHGFPHERMAPHNLSMTMLGVGLLWFGWFGFNAGSAVVGVNNVDAAGGLAGLAFATTTIAPAAGGLAWMIAEWIHAGRPSALGFGSGVVAGLVGITPAAGFVQPGAAIIIGLGAGVICYLGVLMKAKLKYDDSLDAFGVHGVGGTFGALVTGVFATVGATGLLSGNVSQFITQVIGVVSAGAYAFIVTLVIAFILDKTIGLRVEKEDEIMGLDQTQHSESAYN

SEQ ID NO: 4112 - DNA, 1221 bp, Geobacter sulfurreducens
  CDS (1)..(1221)
atggactctctgtcaatggtgacaggtctcaggaacagtgccgacgtgctgtttctcatgctgggtgcggtcatggtctttgccatgcacgcaggcttcgcattcctggaagtgggcaccgtccgcaagaaaaaccaggtcaatgcctttgtaaagatcctcaccgactggtccgtttcaaccgtggcctattttctggtgggattccccatttcctacggaatatcctttctcgtacctgccggcgaccttcttggcaccacccagggatacgacctagtccgctactttttcctgctctgtttcgcagcatgcatcccggcgatcatctcgggcggaatcgcggagcgggccaagttctggccccaggttttggcgggtgccatctttgccggcgtctcctaccccctgttcgaatccctgatctggggccagaacgcctcgctgctccaaggctttttcaaaagcgtgggcggagctgaattccacgacttcgccggttcggttgtcgtccactccgtcggaggctggctggctctgccggccgtgctggtactgggtccccgcatggggcgctacgtgcgcggcaagtcgcatcccatccccatcagcaacataccgttcctggcgctcggctcctggattctcgccgtggggtggttcggcttcaatgtcatgagcgcggggcatgtggaaaaaatctcggggctggtggcggtcaactcgctcctggcaatggtcggcggcgtactcgcagccattgttgccgggcggaatgaccccggcttcgttcacaacggcgccttggccggcctcatcgccatctgtgctggcagcgacatcatgcacccccttgcagccttcgccaccggtgccgttgcctccgtcatcttcgtctacggcttccagtacgagcaggaacggctcaagatcgacgacgtacttggtgtctggcccctccacggtgtcatcggcacctggggcggcattgctgcggggatattcggtcagccgctgttcggaggcatgggtggcgtctccttcgtttcccaattcctgggaagcctcgcggccgtggtcttcgcacttgttaacggtttcctggtctatggcattctctcccgcaccgtgggcatccggctaaccgatgaacaggagtttgccggcgccgacctttcgatccaccagattggcgcctatcccgaagaccatgtgcgctaa

SEQ ID NO: 4113 - protein, 406 aa, Geobacter sulfurreducens
MDSLSMVTGLRNSADVLFLMLGAVMVFAMHAGFAFLEVGTVRKKNQVNAFVKILTDWSVSTVAYFLVGFPISYGISFLVPAGDLLGTTQGYDLVRYFFLLCFAACIPAIISGGIAERAKFWPQVLAGAIFAGVSYPLFESLIWGQNASLLQGFFKSVGGAEFHDFAGSVVVHSVGGWLALPAVLVLGPRMGRYVRGKSHPIPISNIPFLALGSWILAVGWFGFNVMSAGHVEKISGLVAVNSLLAMVGGVLAAIVAGRNDPGFVHNGALAGLIAICAGSDIMHPLAAFATGAVASVIFVYGFQYEQERLKIDDVLGVWPLHGVIGTWGGIAAGIFGQPLFGGMGGVSFVSQFLGSLAAVVFALVNGFLVYGILSRTVGIRLTDEQEFAGADLSIHQIGAYPEDHVR

SEQ ID NO: 4114 - DNA, 1656 bp, Triticum aestivum (Wheat)
  CDS (93)..(1505)
ctcgtgccgaattcggcacgaggctacgtggccgccggacggcgaggacaagcaactgagcaaggtataggtaggtagatcagtcgggcaagatgtcggtgccggtggcgtaccaggggaacacgtcggcggcggtggccgactggctgaacaagggcgacaacgcgtggcagctgacggcgtccacgctggtgggcctcatgagcgtgccgggcatggtggtgctgtacggcggcgtggtgaagaagaagtgggcggtcaactccgccttcatggcgctctacgccttcgccgccgtctggatctgctgggtcgtctgggcctacaacatgtccttcggcgaggagctgctcccgttctggggcaaggccggcccggcgctcgaccaggccttcctcgtcggccgcgcctcgctcccggccaccgcgcactaccgcgcagacggcacgctcgagacggccatggtggagccctacttccccatggccaccgtcgtctacttccagtgcgtgttcgccgccatcacgctcatcctggtggccgggtcgctgctgggccgcatgagcttcctggcgtggatgctcttcgtgccgctctggctcaccttctcctacaccgtcggcgccttctccgtgtggggcggcggcttcctcttccactggggcgtcatcgactactgcggcggctacgtcatccacatccccgccggcgtcgccggcttcaccgccgcgtactgggtcgggccaaggaccaagaaggacagggagagcttcccgcccaacaacatcctgttcgcgctcaccggcgccgggctgctgtggatggggtgggccgggttcaacggcggcgggccgtacgcggccaatgtcgactcgtccatggccatcctgaacaccaacatctgcacggcggcgagcctcatcgtctggacctgcctcgatgccgtcttcttcaagaagccctccgtggtcggcgccgtccaggccgtgatcaccggtctcgtctgcatcacgccaggcgcaggtgtcgtgcagggttgggcggcgctggttatgggcgtgctggccggcagtgtgccgtggtacaccatgatggtgctccacaagcgctccaagctccttcaacgcgtcgacgacacccttggcgtcatccacacccacggcgtcgccggcctgctgggcggcgtcctcacgggcctcttcgccgagccgaacctctgcaatctattccttccggtcaccaactcccggggcgccttctacggtggtaacggtggggcgcagctcgggaagcagatcgccggagcgctcttcgtgatcgggtggaacgtggtcgtcacgtccattatctgcgtcgtcatccgccttgtcgtcccgctgcgcatgtccgaggagaagctcgccattggcgacgacgccgtgcacggcgaggaggcctacgcgttgtggggcgatggcgagcactacgatgacaccaagcacggcgccgccgtcgtgccggtgtgattttctctgctttgcttccttgttatgtttgtcccgtctatattgtgtcctgctttattttctcttgtctcttgccttccaaatgtaaatttgtagctcatgtataatgtgaccaaaattttcatagataaaaaaaaaaaaaaaaaaaaaa

SEQ ID NO: 4115 - protein, 470 aa, Triticum aestivum (Wheat)
MSVPVAYQGNTSAAVADWLNKGDNAWQLTASTLVGLMSVPGMVVLYGGVVKKKWAVNSAFMALYAFAAVWICWVVWAYNMSFGEELLPFWGKAGPALDQAFLVGRASLPATAHYRADGTLETAMVEPYFPMATVVYFQCVFAAITLILVAGSLLGRMSFLAWMLFVPLWLTFSYTVGAFSVWGGGFLFHWGVIDYCGGYVIHIPAGVAGFTAAYWVGPRTKKDRESFPPNNILFALTGAGLLWMGWAGFNGGGPYAANVDSSMAILNTNICTAASLIVWTCLDAVFFKKPSVVGAVQAVITGLVCITPGAGVVQGWAALVMGVLAGSVPWYTMMVLHKRSKLLQRVDDTLGVIHTHGVAGLLGGVLTGLFAEPNLCNLFLPVTNSRGAFYGGNGGAQLGKQIAGALFVIGWNVVVTSIICVVIRLVVPLRMSEEKLAIGDDAVHGEEAYALWGDGEHYDDTKHGAAVVPV

SEQ ID NO: 4116 - DNA, 1278 bp, Mycobacterium paratuberculosis
  CDS (1)..(1278)
atgcacggaatcgatccggccgccacggcctggctgctggccagcaccgcgctggtgttgctgatgacccccggcctggcgatcttctacggcggcatggtccgcaccaccggcgtgctcaacatgatcatgatgagcttcatctccatccccctggtgaccgtggcctggttgctggtcggctacacgatggcgttctcccaggacgggatgagcgggctggtgggcaatctgcggcatttcgggatgctcggcatcactcccgacaccacccacggcgcggtccccgaattgctgtacgccactttccaattgacgttcgcgatcatcaccgcggcgctggtcagcggcgcgatcgccgaccgcgccaagttcgccgcctggatggttttcgtcccggtgtggacggttgcggtgtattcggttgtggcgcaatgggtctgggggccgggcggctggctggcccggctgggcgtgctggactatgcgggtgggctggtggtcgagatcgtctccggcagctccgcgctggccctggcgctggtgctcgggccgcggatcggcttcaagaaggacgccatgcggccgcacaatctgccgctgctgttcgtcggcgtcgggctgctgtggttcggctggttcgggttcaacgccggatcggcgttggcggccaacggaaccgccgcggccatcttcctcaacaccctggtggccggctgcctgggcatgctgggctggctgtcggtcgagcagatccgcgacgggcggcccaccacgttcggcgccgcctcgggcgtggtcgccggcctggtcgccatcaccccgtcctgcggcaccgtcaacacgctgggggcgacggtggtcgggctggcggccggcgtcgtgtgctcgttcgcggcgggcgcgaaactgcgcttcaactatgacgattcgctcgacgtggtcggtgtgcacttcgtcggcggggtggtcggggtgtcgctgatcgggctgttcgccaccgcggtcatgacggcgggcccgcaggggctgttctacggcggcggcgtggcccagctgggcaagcaggcgctggcgatcgcggtggtggcgctctacgcgttcaccgtgtcgttcctgctggccaaggtcatcgaccgggtgatgggcttccgggtcagcgccgaggacgagaccaccggcgtcgacctgacccagcacgccgagaccgcctacgccgagggcgtgcacggtcatctgccgcagcgccgcccgggccccggcgaccggttgaagtag

SEQ ID NO: 4117 - protein, 425 aa, Mycobacterium paratuberculosis
MHGIDPAATAWLLASTALVLLMTPGLAIFYGGMVRTTGVLNMIMMSFISIPLVTVAWLLVGYTMAFSQDGMSGLVGNLRHFGMLGITPDTTHGAVPELLYATFQLTFAIITAALVSGAIADRAKFAAWMVFVPVWTVAVYSVVAQWVWGPGGWLARLGVLDYAGGLVVEIVSGSSALALALVLGPRIGFKKDAMRPHNLPLLFVGVGLLWFGWFGFNAGSALAANGTAAAIFLNTLVAGCLGMLGWLSVEQIRDGRPTTFGAASGVVAGLVAITPSCGTVNTLGATVVGLAAGVVCSFAAGAKLRFNYDDSLDVVGVHFVGGVVGVSLIGLFATAVMTAGPQGLFYGGGVAQLGKQALAIAVVALYAFTVSFLLAKVIDRVMGFRVSAEDETTGVDLTQHAETAYAEGVHGHLPQRRPGPGDRLK

SEQ ID NO: 4118 - DNA, 1440 bp, Mycobacterium paratuberculosis
  CDS (1)..(1440)
atgcgagtgacatacccgatactgggccagcccaataccggcgataccgcctggatgctggccagttccgcgctggtgctgttgatgacgccgggtctggcgtttttctacggcgggatggtgcgcgccagaagcgtgctgaacatgctcatgatgagcatcagcgcgatgggcgtggtcaccgtgctgtgggtgctttacggctattcggtcgccttcggcgacgacgtcggcaacttcatgggcaagccgacgtcctactggggcctcaagggtctcatcggcgtcaacgcggtggccgccgacccgagcaaaggcactgcggcaacggacattccgctggccggcacgctgccggccaccgtgttcgtggccttccagctgatgttcgcgatcatcaccgtcgccctgatctccggcgcggtgtccgaccggctgaagttcgccgcctggctggtgttcgccggcctgtgggcgacgttcgtctatttcccggtggcgcactgggtgttcgcgttcgacggcttcgcctccgagcacggcggctggatcgccaacaagctgcacgcgatcgacttcgccggcgggacggcggtgcacatcaattccggtgtggcgggcctgatgctggcgatcgtgctgggcaagcgccgcggctggcccaccacgttgttccggccgcacaacctgccgttcgtgatgctgggcgccgggctgctgtggttcggctggtacgggttcaacgccggatcggccaccagctccaacggcgcggcggggtcgacgttcatgacgacgacgatcgcgaccgccaccgcgatgctggcctggatgctcaccgaacgcatccgcgacggcaaggccaccacgttgggcgcggcgtccgggatcgtcgccgggctggtcgccatcaccccgtcctgctcgtcggtcaacgtgctgggcgcgctggtggtgggcctggtggccggcgtggtgtgcgcgctggcggtcggcctgaaattcaagctgggctttgacgactcgctcgacgtggtcggggtgcacctggtcggcgggttggccggcaccctgctggtgggcctgctggccgccccggagagcccggccatcagcggcgttaccggcgtgtccaagggactgttctacggcggcggctgggcgcagctggaacggcaggcggtcggcgcgttcagcgtcctcatctactctggggtggttacgctgatcctggcgttgatcctgaagtacacgatggggcttcgtctcaacccggaggccgaagcctcgggtatcgacgaggctgagcacgccgagagtggttacgatttcgccgtggctaccggctcggttctcccgccccgggtcgctgtggcggatacccgcaacggcctggaggagcagcgagtgggcgacaaagtggaggcagagcagtcatga

SEQ ID NO: 4119 - protein, 479 aa, Mycobacterium paratuberculosis
MRVTYPILGQPNTGDTAWMLASSALVLLMTPGLAFFYGGMVRARSVLNMLMMSISAMGVVTVLWVLYGYSVAFGDDVGNFMGKPTSYWGLKGLIGVNAVAADPSKGTAATDIPLAGTLPATVFVAFQLMFAIITVALISGAVSDRLKFAAWLVFAGLWATFVYFPVAHWVFAFDGFASEHGGWIANKLHAIDFAGGTAVHINSGVAGLMLAIVLGKRRGWPTTLFRPHNLPFVMLGAGLLWFGWYGFNAGSATSSNGAAGSTFMTTTIATATAMLAWMLTERIRDGKATTLGAASGIVAGLVAITPSCSSVNVLGALVVGLVAGVVCALAVGLKFKLGFDDSLDVVGVHLVGGLAGTLLVGLLAAPESPAISGVTGVSKGLFYGGGWAQLERQAVGAFSVLIYSGVVTLILALILKYTMGLRLNPEAEASGIDEAEHAESGYDFAVATGSVLPPRVAVADTRNGLEEQRVGDKVEAEQS

SEQ ID NO: 4120 - DNA, 1236 bp, Bacillus cereus ATCC 10987
  CDS (1)..(1236)
atgaatacaggagatacggtttttatgtttgtagcgacagtaatggtcatgttaatgacaccaggattagcacttttttatggaggtatggttcgcagtaaaaacgtactcagtacgacaatgcatagttatagcgcaatggctatcgtttcgattcaatggattgtaattggttattctttatcattcggacccgattggcacggacttatcggcacattcaattggttcggtttaaacggagttacctacgcaccaaatccagactactcatctactattcctcacaatttatttatgatgtttcaactcatgtttgctattctaacccccgctctaatttcaggagcatttgccgaaagaatgcgattttcagctttccttattttcatccttctatggacaacaatcgtttacaatcctgtcgctcattgggtatggggcgttggcggatggctaagagaacttggcgcattagacttcgctggcggtaatgtcgttcatattacatctggcgtggctggcctcgtattagctattttccttggaaaacgaaaaaacataaacggttcgtctcctcatcatttaccatttacgatgttaggcgctgggctgctatggttcggctggttcggttttaacgtcggaagcgcattatctttaaatgatgtagctttaactgcatttattaatacaaatatagctgccgctgcctccgcattaacttggatgctttcagagtggttcttccaatcaaaaccgaccgcgatgggagctgcttgtggcgccgtttccggtctagtcgctattacaccagcttgcgggttcgttacacctttctcagctcttcttatcggagcaattggcggcgtattatgcttcggagcggtctttttcttaaaaacaaaattcggatacgacgatacactcgatgcatttggatgtcacggcatcggcggaacttggggcggcattgcgacaggactatttgcaactactaccgtaaacagcgatggcgctaacggattattttacggaaacgccgcgttgctgtttaaacaacttgtagcaatcggcgcaacatatgcgttcacaattataatgacgtacgcgattattaaagcaattaacttcttcctccctgtccgggtagatgagcacgaggaacatatgggacttgatatttcaatgcatggggagaaagcttatgagtatgtagaaaaatcggctaattaa

SEQ ID NO: 4121 - protein, 411 aa, Bacillus cereus ATCC 10987
MNTGDTVFMFVATVMVMLMTPGLALFYGGMVRSKNVLSTTMHSYSAMAIVSIQWIVIGYSLSFGPDWHGLIGTFNWFGLNGVTYAPNPDYSSTIPHNLFMMFQLMFAILTPALISGAFAERMRFSAFLIFILLWTTIVYNPVAHWVWGVGGWLRELGALDFAGGNVVHITSGVAGLVLAIFLGKRKNINGSSPHHLPFTMLGAGLLWFGWFGFNVGSALSLNDVALTAFINTNIAAAASALTWMLSEWFFQSKPTAMGAACGAVSGLVAITPACGFVTPFSALLIGAIGGVLCFGAVFFLKTKFGYDDTLDAFGCHGIGGTWGGIATGLFATTTVNSDGANGLFYGNAALLFKQLVAIGATYAFTIIMTYAIIKAINFFLPVRVDEHEEHMGLDISMHGEKAYEYVEKSAN

SEQ ID NO: 4122 - DNA, 1332 bp, Rhodopseudomonas palustris
  CDS (1)..(1332)
atgaccttgttgctacgccgcgcggcgtcggccgcgacgggctacatacttgcaacattcggccttgcggcagtcggcgtcacgccggcgctggcgcaggggatggccacggcggcgccgggcatcagcccggccgacaccgcctggatgacggtcgccaccgccttcgtgctgatgatgacgatccccggcctggcgctgttctactccggcatggtgcgcaagaagaacgtgctggccacgatggcgcagagcctcgcggctgtggcgctgatctcgatcctgtgggtggcattcggctactcgctggccttcaccggcagcggcagcctgatcggctcgttcgaccggatcttcctggccggcatgaccatggacagcgtcaatccggcggccaagaccatcccggaagcgctgttcatgctctatcagatgactttcgcggtcatcacggtggccctggtggccggctcggtcgccgaccggatgcggttttccgcctatctgttgttctcgatcggctggttcatcttcgtctatgtgccgctggcgcattggatctggggcggcggctttttgggcgcaatgggcgtgctggacttcgccggcggcctggtggtgcacctgtcggccggcaccgggggcttggtggcggcgatcgtgatcggccgccgccatggctacggcatggaaaacctgtcgccgttcgacctgtcgctggcggtgatcggcactggcctgttgtgggtcggctggttcggattcaatggcggctccgccctggcggcggattcccgtgcggtgttcgccatcacggcgacgcatctggcggcgtgctcgggcgcgctgacctggggcgcaatcgaatggatggcgcggcgcaagccgtcggtgctgggcatgatttccggtgccgtcgccggcctcggcaccatcacaccggcatcgggctatgtcgaaccctggcacggcgtggtgatcggcatcgtcgccggcctgatctgttactgggcctgcacttggctgaagcaccggctgcgctacgacgactcgctcgacgtgttcggcgtccacggcatcggcggcctgaccggcacgttcctggccggcattttcgccacagcctcgatcggtggcgtctcgggcgccctcgagggttcgtggatgcagccgctgacgcagctcgccggtattctagtcaccttcgtgtggtccgccgtggccacctatgtgttgctgaaggccgtcagcctgttcgtggcgctgcgcgtctcccgtgagcacgagatcgaaggcctggacatttcgcagcatggcgaggcgctgcagtaa

SEQ ID NO: 4123 - protein, 443 aa, Rhodopseudomonas palustris
MTLLLRRAASAATGYILATFGLAAVGVTPALAQGMATAAPGISPADTAWMTVATAFVLMMTIPGLALFYSGMVRKKNVLATMAQSLAAVALISILWVAFGYSLAFTGSGSLIGSFDRIFLAGMTMDSVNPAAKTIPEALFMLYQMTFAVITVALVAGSVADRMRFSAYLLFSIGWFIFVYVPLAHWIWGGGFLGAMGVLDFAGGLVVHLSAGTGGLVAAIVIGRRHGYGMENLSPFDLSLAVIGTGLLWVGWFGFNGGSALAADSRAVFAITATHLAACSGALTWGAIEWMARRKPSVLGMISGAVAGLGTITPASGYVEPWHGVVIGIVAGLICYWACTWLKHRLRYDDSLDVFGVHGIGGLTGTFLAGIFATASIGGVSGALEGSWMQPLTQLAGILVTFVWSAVATYVLLKAVSLFVALRVSREHEIEGLDISQHGEALQ

SEQ ID NO: 4124 - DNA, 1443 bp, Rhodopseudomonas palustris
  CDS (1)..(1443)
atgacgttcaaacgtccctacggcgcgggactggcggtccttgcggccggcatgttcgccgcaaccgcggcctacgccgagccaacggtcaacaagggcgacaacgcctggatgctcacctcgacggtgctggtgctgttgatgaccatcccaggcctggcgctgttctacggcggtctggtccgctccaagaacatgctctcggtgctggcgcaggtgttctacaccgtgtgtatcgcctgcattatttgggctctgtacggctacagcctcgccttcaccggcggttcggacttcatcggcggcttctccaaggcgttcctcgccggcgtgaccaccgactccaaggccgcgaccttctcggtcgacgccaacatctcggagctggtttacgtatgcttccagatgaccttctgcgcgatcactcccgcgctgatcgtcggcgccttcgctgagcgcacccggttcgccgccgtggcgctgttcatcccgctgtggatcaccctgatctacctgccgatggcccacatggtctggtactgggccggtccggacgcgatcaacgacgccgccaaggcgctcgctgccgctgccgacgaagccgccaagaccgccgcgcaggccaagctcgacgaagtcaacgccgactccggcttcctgttcaagaagggcgcgatcgacttcgcgggcggcaccgtggtgcacatcaacgccggtatcgccggtctggtgggcgccctgctggtcggccgtcgcaccggctacggcaaggagttgatggccccgcactcgctgaccatgaccatgatcggcgcctcgctgctctgggtcggctggttcggcttcaacgccggttcgaacctcgaagcttcgggcggcgctgcgctcgccatgaccaactccttcgtcgcgactgcggcggcggcgctgtcgtggatgttcgccgagtggatcttcaagggtcatccgtcggtgctcggtgcgctgtcgggcgccgttgccggtctggtcgcggtcaccccggctgccggcttctccggcccgatgggcgcgatcgtgctcggcctggtggtcggcgtggtctgcctgttcttctgcaccgtggtgaagaacgcgctgaagtatgacgactcgctcgacgtgttcggcgtccacgcggtcggcggcatcgtcggcgcgatcggcaccggcatcctggtgaacccggctctcggcggcaccggcgtgtacgactacgtggccggcaaggtcggcgactacgacatgaccacccagctgatctcgcagtgctggggcgtgggcaccaccgtgctgctgtccggtatcggctcggcgatcctctacaaggtcgtcgacgtgatcgtcggtctgcgggccccggtggaagtcgaacgcgaaggcctcgacctcgtcgagcacaccgagcgcgcttacaacatgtaa

SEQ ID NO: 4125 - protein, 480 aa, Rhodopseudomonas palustris
MTFKRPYGAGLAVLAAGMFAATAAYAEPTVNKGDNAWMLTSTVLVLLMTIPGLALFYGGLVRSKNMLSVLAQVFYTVCIACIIWALYGYSLAFTGGSDFIGGFSKAFLAGVTTDSKAATFSVDANISELVYVCFQMTFCAITPALIVGAFAERTRFAAVALFIPLWITLIYLPMAHMVWYWAGPDAINDAAKALAAAADEAAKTAAQAKLDEVNADSGFLFKKGAIDFAGGTVVHINAGIAGLVGALLVGRRTGYGKELMAPHSLTMTMIGASLLWVGWFGFNAGSNLEASGGAALAMTNSFVATAAAALSWMFAEWIFKGHPSVLGALSGAVAGLVAVTPAAGFSGPMGAIVLGLVVGVVCLFFCTVVKNALKYDDSLDVFGVHAVGGIVGAIGTGILVNPALGGTGVYDYVAGKVGDYDMTTQLISQCWGVGTTVLLSGIGSAILYKVVDVIVGLRAPVEVEREGLDLVEHTERAYNM

SEQ ID NO: 4126 - DNA, 21 bp, Primer
atggctcggggtgacggacat

SEQ ID NO: 4127 - DNA, 25 bp, Primer
tcatgcttcttttgcgtgatgcaat

SEQ ID NO: 4128 - DNA, 1128 bp, Saccharomyces cerevisiae
  CDS (1)..(1128)
atgaatatggcagaacgtgcagaagcaacaaaaagttggtcctgtgagcccctttctggaaagacgctagaagagattgttcaaaatgcagaaaatgcagctgatttggtagcttacattcgcaaaccagaggtagatttggactttaggttgaagtttatcgcagaacatgaggagttttttaatgaacaactatcggatcgaaattcaagaataaggacgtgtcacaacttgagcgataaagggatacggggtgatactgttttcgtcttcgtgcctgggttggctggcaacttagaacaatttgaacccttactcgagcttgtggactctgatcaaaaggcatttttgacgttagatctgcccggctttggtcatagttcagaatggagcgactaccccatgctgaaagtggtggaacttattttcgttcttgtatgtgacgtcttaagaaaatggtctacagcggtgccgaataatgataacgtaaatccatttaacggtcataagatagtgcttgtagggcattctatgggttgttttctggcatgtcatctttacgagcagcacatggctgatacaaaagcggtacaaacgctagttttgttgacgccccccaaagcacatatcgagcagctttctaaggataaacatattatccagtgggctctctatggtgtgtttaaattgccatggctatttgacgtttatagaaacaaattcgatcaggtaaaaggtctacaaagttccggcatcaagcagtatttttatcaacaaggtgatgatgtcaagttgaaatacaggaagttctggcaatttaaaaacaacataagcaacaaaagtagaaccatcataggttatttactaggatgggaaactgttgattgggttaaattcaatggtgtattgacgcaaacggatatgaaacagaaaattataatatttggcgctgaaaaagatcctatagctcctattgaaaatttggaattttacaaacaaactataaataaagaatgtcttcgtaaagtgattattttacctgactgttctcataatttatgcttcgaccgtccagaattggtgtgtgaaaactttcaacgagaggtgattgataattccaaattgtag

SEQ ID NO: 4129 - protein, 375 aa, Saccharomyces cerevisiae
MNMAERAEATKSWSCEPLSGKTLEEIVQNAENAADLVAYIRKPEVDLDFRLKFIAEHEEFFNEQLSDRNSRIRTCHNLSDKGIRGDTVFVFVPGLAGNLEQFEPLLELVDSDQKAFLTLDLPGFGHSSEWSDYPMLKVVELIFVLVCDVLRKWSTAVPNNDNVNPFNGHKIVLVGHSMGCFLACHLYEQHMADTKAVQTLVLLTPPKAHIEQLSKDKHIIQWALYGVFKLPWLFDVYRNKFDQVKGLQSSGIKQYFYQQGDDVKLKYRKFWQFKNNISNKSRTIIGYLLGWETVDWVKFNGVLTQTDMKQKIIIFGAEKDPIAPIENLEFYKQTINKECLRKVIILPDCSHNLCFDRPELVCENFQREVIDNSKL

SEQ ID NO: 4130 - DNA, 1962 bp, Candida albicans
  CDS (1)..(1962)
atgctggaagtagacacagatgatacacaggaattattagccaccaatgctgcttctggctcctctactacaactggtgcacctagattcgaggcattgtcgtcattatcacaatcacaccaagaaaaatcatctacgaaatacaaaaaaatttcagaatttgttaaaattaatgtgctcggacatcctaataattttgaggaatatgtactacgcaatgaggcaagtgactgttccttgatagcaaaatactgtaaaacaactacaattgatttatcaactcaaccaacattatcaatagactccatatctttgaacaccattcacatcccacatcctttaatcaatttcatgaaaaatgaagccaaccagcaattatctcccgatgatcaagttgatgtcagtaatgagttacaagaatcacctattgttgtttttttgcatggattaggaggacaaatgtcacaatttgaaccgttgatgggtttattatcccaatgtctggaaattttgtctttagatttacctgggtttggaaattcaaaattgcaatttgaagaaggctttaaatttatatccgaaatttctgattctgataaatcaaaaatatcttcaagtattcaaaaaatgaattgggacgacttttctaccgacaatattgttagaatagtgtatgaattcattagccagaacgtgcccctgagcaagaagattgtgttgatcggccactcaatgggaactcatatttcgatcaaacttgctaaaaaattgcctcaatcaaaagtcgaaggattaattttgttatcacccccagcattgacagacgacattaacacgaacgagcaaaacacgaaaaacactcataatctgctaagcttgtttaccgtgtttacatatttcccctgggtattcaattcttttagaacttggaatagattggagggattagatagtgcaagtgttgttagacaattatcgaaaactaataattctatttataataagctaagacaatttagatggaatttggatgttaactctgatattgtattaaaatatgctagcgggtttcaaagggcaacaaactcagatttgatatctgcaattagtcggtttaatgataatcctgaagacaaacaagtttatgaaaaaaccgttttcatctgtgggaataatgaccaaatgactccagtttcgacaatatataaatgtgatgagtttttaacttccaattttggtagaaaagtatcagcagccattgaagttaagggtgttgggcattcattattattactgaaacccgagtttatcagtggaataatcttgaatcatatagagctgaagttccctgaacgattgcatttatctcctgcttgggtattaaaaattaaagcaaaagtatctggcgataaatgggggttgaaaaacgaacagaaatggctgaacatacaatccgtgtcgtataatattacaagaaaccgaggcaaagatattgcaccattgttaggaatgaagacattaagagaaagcgatccaattcattcaccatctattttagaaaagcaattttatggggacaattcatcaaatcaaataaaggggaacttgattgctataattgacatttccgccgacatccctccttacagccccaaatcctttgaaaaaataaagtattacaaatgtgctaccgtatcaaaagtagttccagatcaaagtgcgattcgaagatttatacaactagtcaatgatattttacatgaaaatacagtagcaaatccattgatagctgttcattgccattatgggttcaatagaactggatttttaatttgttgttatttaattgaggtattggggtggtcagttgaagaagcagtagaaggattcaaaatagcaaaacaacctggtatcaaacatcctcatttcattgatgcattgtatgtcagatatgaaaaatga

SEQ ID NO: 4131 - protein, 653 aa, Candida albicans
MLEVDTDDTQELLATNAASGSSTTTGAPRFEALSSLSQSHQEKSSTKYKKISEFVKINVLGHPNNFEEYVLRNEASDCSLIAKYCKTTTIDLSTQPTLSIDSISLNTIHIPHPLINFMKNEANQQLSPDDQVDVSNELQESPIVVFLHGLGGQMSQFEPLMGLLSQCLEILSLDLPGFGNSKLQFEEGFKFISEISDSDKSKISSSIQKMNWDDFSTDNIVRIVYEFISQNVPLSKKIVLIGHSMGTHISIKLAKKLPQSKVEGLILLSPPALTDDINTNEQNTKNTHNLLSLFTVFTYFPWVFNSFRTWNRLEGLDSASVVRQLSKTNNSIYNKLRQFRWNLDVNSDIVLKYASGFQRATNSDLISAISRFNDNPEDKQVYEKTVFICGNNDQMTPVSTIYKCDEFLTSNFGRKVSAAIEVKGVGHSLLLLKPEFISGIILNHIELKFPERLHLSPAWVLKIKAKVSGDKWGLKNEQKWLNIQSVSYNITRNRGKDIAPLLGMKTLRESDPIHSPSILEKQFYGDNSSNQIKGNLIAIIDISADIPPYSPKSFEKIKYYKCATVSKVVPDQSAIRRFIQLVNDILHENTVANPLIAVHCHYGFNRTGFLICCYLIEVLGWSVEEAVEGFKIAKQPGIKHPHFIDALYVRYEK

SEQ ID NO: 4132 - DNA, 1050 bp, Plasmodium falciparum (isolate 3D7)
  CDS (1)..(1050)
atgtatacacaatacgacattgaatatgaatatgttacatgtacgaaaggatatacgttcataatatattctccaaatttatttgaaaatgtaaatgcaaaaagtagtgattctacatctccatatactgagaaaaataaagaagaagatgaacaacaagaagaacaacaacaagatgaacaagaacgagatgaacaagaacaagatgaaataaataatgaaaatattattgttttatttctacatggattaaatggaaatagctatcaatttgaaaatgtcttttatacgttaatacactttaactataaatttatatctatagatttttatggacatgggaatagtagcctcttacgaaacgttaataaatttacggaaaaattatttattgaacaaatatatgatgttttaaaaaaaaaaaatatatttaattctaattttgttgtcattgggttttctatgggttgtattatagcagcacatttatctgtggataataaactaaagataaaaaagtactgtttaataagtgcagccgggctagccaaaccaaggcatcgatttttacattttttattaaaacataacattcgtctttgtctacgagtcgcaaaaagatatagtcatttatttgtaaatgaagaaacgtttaaaaatgaatataatgatattcacaacaatgcttattatagtcataacagatgttctattttaaaagaaaatcatgaaaaatttattgagacattcttaaaagtcctaacagggacaaaaatacaagattccaaaaaatattatagcgccttcttgaaaaaaaattcagacgttctcttcatttatggaagagatgatgatgttacaccttgtgcttatacaataaaatttttagaaaaacaaaaaaaatatctaaataatgttaagctaataatatttcctgaatgctcccatcttgtattaacagaaaaatcatacgaattagctcaacatataatttattttttacaaaataaatatatatataatgtagaaagaaatagtgacgatatataa

SEQ ID NO: 4133 - protein, 349 aa, Plasmodium falciparum (isolate 3D7)
MYTQYDIEYEYVTCTKGYTFIIYSPNLFENVNAKSSDSTSPYTEKNKEEDEQQEEQQQDEQERDEQEQDEINNENIIVLFLHGLNGNSYQFENVFYTLIHFNYKFISIDFYGHGNSSLLRNVNKFTEKLFIEQIYDVLKKKNIFNSNFVVIGFSMGCIIAAHLSVDNKLKIKKYCLISAAGLAKPRHRFLHFLLKHNIRLCLRVAKRYSHLFVNEETFKNEYNDIHNNAYYSHNRCSILKENHEKFIETFLKVLTGTKIQDSKKYYSAFLKKNSDVLFIYGRDDDVTPCAYTIKFLEKQKKYLNNVKLIIFPECSHLVLTEKSYELAQHIIYFLQNKYIYNVERNSDDI

SEQ ID NO: 4134 - DNA, 24 bp, Primer
atgaatatggcagaacgtgcagaa

SEQ ID NO: 4135 - DNA, 26 bp, Primer
ctacaatttggaattatcaatcacct

SEQ ID NO: 4136 - DNA, 372 bp, Saccharomyces cerevisiae; identical to SEQ ID NO: 943
  CDS (1)..(372)

SEQ ID NO: 4137 - protein, 123 aa, Saccharomyces cerevisiae; identical to SEQ ID NO: 944

SEQ ID NO: 4138 - DNA, 32 bp, Primer; identical to SEQ ID NO: 945

SEQ ID NO: 4139 - DNA, 27 bp, Primer
ctataatatattcatgattccgattgc

SEQ ID NO: 4140 - DNA, 1416 bp, Saccharomyces cerevisiae
  CDS (1)..(1416)
atgatcgtatttcgtcgctttcctacgtgccttttacatcacattcgacaaccggcatccaggagtcttttgttggaatcacaaaggcgatcattatcttttacatcttataaatataacagcagccacattgatgatgataaaagtaaaaaaaagcttaaaaatgttttccaaatgaatagcaatagagtcattcgtaagcaaaaaacaaaagaagaattggccaaagagaggttcgaagaacaactgaggtcacctaatagatttgtgaggtggggagctattgcgagatcagaaaagttttcaaagggaatgaccaagtacatgatcggtgcttatgtgatatttttaatctatggtctcttctttaccaaaaaactgtttgcgaaagacaaagaactggaaagattgttgaagaaacaagaagaagggaatgccaatgaatacgaagcattaaggattaaagaattgaaaggaaaactaaggaggagagatgaattgaaattagaagaatacaaaaaaatgcaagaagaaggcattgaaaacttcgatgatattcgggtacagaattttgatcaaaacaaattgaatgaacaaatattgccagcaagagacacaacaaacttttaccaagaaaaagctaacgaatatgataaggcaattaatatggaagagagagtaatatttctcggtaaaagaaggaaatggttaatgaaacattgtcaaggggatgttttggaagtttcatgcggtacaggaagaaatatcaagtaccttgatatgtcacgcatcaactctataacattcttagactcttctgaaaatatgatggaaattacacataaaaaattccgagaaaagtttcctaagtataaaaaagttgcatttgttgttggaaaggcggaaaatctagtagacttagcagagaaaggtaagccctctctagagaatgaaaaggaaaaccaagtaaaatatgatactatcgtggaggcgtttggtttgtgttcccatgaagatccggttaaggcacttaataattttggcaagttattaaagccagatggaagaattattttactggaacatggtagaggtcaatacgattttataaataagatattagacaacagagctgaaagaagactgaatacttggggctgtcgatggaatctcgacttaggcgaagtgttagatgattctgacctagaattggtggaagaaaaacggactcacttaggcactacttggtgtatcgttgcaaagagaaaaggtgatgtgaaaaagaaagacgagcttgggtttgtagaaaaatacttgcaatcaagtattagaaagagaatggaatcattcgaaaaaaaagacgatatggcatctaaaaaagaacttgagccagtacctcctgtaagtaaaagttaa

SEQ ID NO: 4141 - protein, 471 aa, Saccharomyces cerevisiae
MIVFRRFPTCLLHHIRQPASRSLLLESQRRSLSFTSYKYNSSHIDDDKSKKKLKNVFQMNSNRVIRKQKTKEELAKERFEEQLRSPNRFVRWGAIARSEKFSKGMTKYMIGAYVIFLIYGLFFTKKLFAKDKELERLLKKQEEGNANEYEALRIKELKGKLRRRDELKLEEYKKMQEEGIENFDDIRVQNFDQNKLNEQILPARDTTNFYQEKANEYDKAINMEERVIFLGKRRKWLMKHCQGDVLEVSCGTGRNIKYLDMSRINSITFLDSSENMMEITHKKFREKFPKYKKVAFVVGKAENLVDLAEKGKPSLENEKENQVKYDTIVEAFGLCSHEDPVKALNNFGKLLKPDGRIILLEHGRGQYDFINKILDNRAERRLNTWGCRWNLDLGEVLDDSDLELVEEKRTHLGTTWCIVAKRKGDVKKKDELGFVEKYLQSSIRKRMESFEKKDDMASKKELEPVPPVSKS

SEQ ID NO: 4142 - DNA, 630 bp, Nostoc sp. PCC 7120
  CDS (1)..(630)
atgaaaattatgggtttttattcgcaagtcattttaccgcgtcttctagactggagcttgtctgatcctaccctagctacatatcgtcaggaactactaacagacgtaacaggagaagtactagaaatcggttttggcactggattaaatttggcttactacccttcgcatattcacaaaatcaccacggttgatgtgaatcctgggatgaacaccatagcacaaaagcgtattgatgactctgggattaaagttcaacaactcctgctatcaggtgaaaatcttcctatggcagataatacctttgatagcgtggtcagcacatggactttatgcagtattgccaatgtggaacaagccctacaagaagtttatcgggtattaaaaccaggtggtaagttcttttttctagaacatggactgagtaataagcctaatgtacaagtctggcagaatcgcctaaccccaattcaaaaagtcttagccgatggatgtcacttgaatcgaaatattcaacaattagtagaacaaagttttgaccatgtagagctaaaacgctttacacctgagaattttcctgatttgatggcacatttttacaaaggatgtgcaactaaaaaatcaatataa

SEQ ID NO: 4143 - protein, 209 aa, Nostoc sp. PCC 7120
MKIMGFYSQVILPRLLDWSLSDPTLATYRQELLTDVTGEVLEIGFGTGLNLAYYPSHIHKITTVDVNPGMNTIAQKRIDDSGIKVQQLLLSGENLPMADNTFDSVVSTWTLCSIANVEQALQEVYRVLKPGGKFFFLEHGLSNKPNVQVWQNRLTPIQKVLADGCHLNRNIQQLVEQSFDHVELKRFTPENFPDLMAHFYKGCATKKSI

SEQ ID NO: 4144 - DNA, 603 bp, Pyrococcus abyssi
  CDS (1)..(603)
atgagctacagggagaagtacaacagaataggttcaaggtacgacatcctcgaggttccactaaacaggtactttgaaccgttgagggaaaaagccgtaaagcgagttagcggcaaagtcttagaaatcggggtgggaaccgggaagactttgaagtattatcccaggaatgtagagctttatgccatcgacggaagtgaagagatgcttaaggttgctagagagagggcaaaatctctcgggataaacgctaagttcataagggccgaagccgagaacttacctttcccaaacgatttctttgactacgtagtttcatctttcgtcttttgcacagttccaaatccagagagggctatgaaggagatagtgagggttctgaaaccaggtggtggggctatattcctggagcacacacttagcgatagcacggtgctcaacttgttcttcctaatgcctctggagttaatactaagtcccctcctggatgacagcacgacgagggaaacgcataagttagtaagaaaattcctggaggttgagaaggaagaaagctactatagaggcatcgttaggcttatagtggctaggaaacctttttaa

SEQ ID NO: 4145 - protein, 200 aa, Pyrococcus abyssi
MSYREKYNRIGSRYDILEVPLNRYFEPLREKAVKRVSGKVLEIGVGTGKTLKYYPRNVELYAIDGSEEMLKVARERAKSLGINAKFIRAEAENLPFPNDFFDYVVSSFVFCTVPNPERAMKEIVRVLKPGGGAIFLEHTLSDSTVLNLFFLMPLELILSPLLDDSTTRETHKLVRKFLEVEKEESYYRGIVRLIVARKPF

SEQ ID NO: 4146 - DNA, 651 bp, Pseudomonas aeruginosa
  CDS (1)..(651)
atgctttcccctccagccgctgtgccaggagagagtttcgtgggcatctatgaccgttacgtgttgccgcgcctgatcgacttcgcctgcggcatgggcgacgtgatgaagcagcgttcgctgctggtgccgcgcgcccatgggcgggtgctggagatcggtctgggcaccgggctcaacctgggcttctacgacgcggcgaaggtgtcggcgatcgtcggcgtcgacccggccgcgcaaatgcaggcgctggcccgcgagcgcgcggcgcaaatcggcatcccggtggaaatggtcgccctcgagcttggcgagatccgcgccgaggcggaaagcttcgacaccatcgtctgcactttcaccctttgctccatcgccgcgccgctgccggcgctgggcgagatgcgtcgggtgctgaagcgtggcggcgaattgctgttctgcgagcacgggcgcgcgccggacgcctcggtgctggcctggcaacggcgcctgacgccctggtggaaaccgctggccggcggttgccatctggaccgcgacatgccggccttgctgcgcgaggccggctttcgcatcgacgagctggaacagggctacctgcccgggccgcggccgatgacctacgtctaccgcggcgtcgcgcgctga

SEQ ID NO: 4147 - protein, 216 aa, Pseudomonas aeruginosa
MLSPPAAVPGESFVGIYDRYVLPRLIDFACGMGDVMKQRSLLVPRAHGRVLEIGLGTGLNLGFYDAAKVSAIVGVDPAAQMQALARERAAQIGIPVEMVALELGEIRAEAESFDTIVCTFTLCSIAAPLPALGEMRRVLKRGGELLFCEHGRAPDASVLAWQRRLTPWWKPLAGGCHLDRDMPALLREAGFRIDELEQGYLPGPRPMTYVYRGVAR

SEQ ID NO: 4148 - DNA, 786 bp, Archaeoglobus fulgidus
  CDS (1)..(786)
atgataacagtgttaattttgaggtgtattatggtaaaatcaaccacgagaaagtctgccaagagtgacagaagaagatacaacaggatagcgaggttctacgacctctttgaaactccaatggagttaatgaacttcaggaagtggagaaaaatgctcttcgacctcataaaagctgagaaaggtcttgtgctcgaaattggtgcagggactggcaagaacattccacactatccttccaacgttgtggcgctggacataagcgagaagatgcttgaaagagcggtgagaagggctaaagagagcggtaaaaaagttgattttcttctggcagatgcggagaatcttcctttccgcagtaacagctttgatgtagttttcacaaccttcgttttctgctccgtagatgacccggtcagaggtttaagagaagcgttcagagtgctgaagaaggggggaagggcatactttctggagcacatgctccccaaaagcaggtttttgcatccactctttaacctcctcaatcccatattcagggcattcggacctgagattaacaggaggacggacgaaaacatacaaagggcaggattccaaatcgttaaggaatacatgctttttggtagtgttttcaggttgatagtggcagaaaagcctcttgattcagtagatgaagcgtctggttacagtttgaaacgttctgaatcatctgacagctccaattttagacgtttcatcgggcaatccctattgcctttgaggttaacacagttattgaggtga

SEQ ID NO: 4149 - protein, 261 aa, Archaeoglobus fulgidus
MITVLILRCIMVKSTTRKSAKSDRRRYNRIARFYDLFETPMELMNFRKWRKMLFDLIKAEKGLVLEIGAGTGKNIPHYPSNVVALDISEKMLERAVRRAKESGKKVDFLLADAENLPFRSNSFDVVFTTFVFCSVDDPVRGLREAFRVLKKGGRAYFLEHMLPKSRFLHPLFNLLNPIFRAFGPEINRRTDENIQRAGFQIVKEYMLFGSVFRLIVAEKPLDSVDEASGYSLKRSESSDSSNFRRFIGQSLLPLRLTQLLR

SEQ ID NO: 4150 - DNA, 624 bp, Thermotoga maritima
  CDS (1)..(624)
atgagtgttgagagaaagtacgacagatttgcagcactgtacgataagttcgaaagttttattgagaaaaagtttttctcacggtttcgtgaagaactcttcaaaagagtagaagggaagaaaatattggaagttggtatcggcaccggaaagaacgttccgtactattcggacgatatggatgttgtaggtgtagatatcagtgaaggaatgctcagggtgtgtcaggaaaggttaaaaaagtttccagaaaaaaaggtgaagttgttgagagcggacgttcagaatcttcctttttcagacggagagtacgactgtgttgtttctacgttcgttttctgcacagtgcctgatcctgtgaaaggtttgaaggaagttcacagagttctcagaccttctggaaaagccgtttttctcgaacacatgagaagcagaaaatggtacgttaacgtgattttgtttttgatgcacatcttcacgaaacttcttttgggaacaagcatgctcagaaaaacggttgataacataaaaaaagcaggatttgtgatcgaagaagaaaagtaccttctaagtgatgtggtgcggctgataattgccagaaaaggaagtgaagaaagtgattga

SEQ ID NO: 4151 - protein, 207 aa, Thermotoga maritima
MSVERKYDRFAALYDKFESFIEKKFFSRFREELFKRVEGKKILEVGIGTGKNVPYYSDDMDVVGVDISEGMLRVCQERLKKFPEKKVKLLRADVQNLPFSDGEYDCVVSTFVFCTVPDPVKGLKEVHRVLRPSGKAVFLEHMRSRKWYVNVILFLMHIFTKLLLGTSMLRKTVDNIKKAGFVIEEEKYLLSDVVRLIIARKGSEESD

SEQ ID NO: 4152 - DNA, 645 bp, Caulobacter crescentus
  CDS (1)..(645)
atgaccgggggaggaccaaccatggccaactggtacgagcgcaacatcctgccgaagctgctgtgctgcgcctgcggcgcgccggccatccaggctcagcggcggcgcgtcgcgccccgcgccgagggcgaggtgctggagctggggatcggcggtggcctgaacctggcctattacgacccgaccaaggcaaagcgcgtcacgggggtggacccctcgcccgaactgcgggccatcgccgagcaggcgccgcgtccggacggcttggtcgtcgacatccaggccggcgaggccgagcgcctgcccttcgccgacgccagcttcgacaccgtgctgtgcaccttcaccctgtgttcggtccggtcgccgaaggcggtgctggccgaggcccgccgcgtgctgcgccccgatggacgcttcctgttttgcgagcacggcctgtcgcccgacgccgaggtttcgcgctggcaacgtcgcctcgaaccgctgtggaagcgtatggccggcggctgtcacctgacgcggccggtggcgagcgccgtcgcggcggcgggtttcgccctggacgaggtcgagcagcgctacatgcccaagaccccaaggcctctgggctggtgcgaatggggcgtggcgcggctggcctag

SEQ ID NO: 4153 - protein, 214 aa, Caulobacter crescentus
MTGGGPTMANWYERNILPKLLCCACGAPAIQAQRRRVAPRAEGEVLELGIGGGLNLAYYDPTKAKRVTGVDPSPELRAIAEQAPRPDGLVVDIQAGEAERLPFADASFDTVLCTFTLCSVRSPKAVLAEARRVLRPDGRFLFCEHGLSPDAEVSRWQRRLEPLWKRMAGGCHLTRPVASAVAAAGFALDEVEQRYMPKTPRPLGWCEWGVARLA

SEQ ID NO: 4154 - DNA, 747 bp, Schizosaccharomyces pombe
  CDS (1)..(747)
atgggcatattaaagaaaactatctttataggaggtatatacggtctaggtgtctacattggtgcggtagcttggaggttgaggaaagatgttctcaattatgaatcgcgacagaagtcagacttattaattccgaacagcaatagtatttcaatttataatcaaattgctgataaatatagcagaaaaattacgcgagaggaaatattttctggaatatattttcttcgatatttcctcttacgaaatgcgaagggtgatgtattagaagttgggagtggaccaggtactaatttcccattttacaagtggaaaaaaattaacactctaacactggttgagccggctgaaaaaatgcgtgaaattgcagatgctcgtgctaaaaaaaaggtacctccaaatgtattgtatcgacaatttgcagacttgcgtcagcttccgccaaaccaaagttatgacactatcattcaaacattttgtatttgctctcaagaaaaagcggtcgaacaattaaataactatcgctctttattgcgttccgatggtcgtattttactgatagaacatggcaaaggaaaatacaagttcctaaatagaattttaaatgcatatgcggaatcacattatgagtcttggggatgtgtttggaatcgagacattgaacaattattagaagattctgaactgaccatagattcttgtaagcgtttcaactttggtactacatatgtgattgaagcacattag

SEQ ID NO: 4155 - protein, 248 aa, Schizosaccharomyces pombe
MGILKKTIFIGGIYGLGVYIGAVAWRLRKDVLNYESRQKSDLLIPNSNSISIYNQIADKYSRKITREEIFSGIYFLRYFLLRNAKGDVLEVGSGPGTNFPFYKWKKINTLTLVEPAEKMREIADARAKKKVPPNVLYRQFADLRQLPPNQSYDTIIQTFCICSQEKAVEQLNNYRSLLRSDGRILLIEHGKGKYKFLNRILNAYAESHYESWGCVWNRDIEQLLEDSELTIDSCKRFNFGTTYVIEAH

SEQ ID NO: 4156 - DNA, 915 bp, Plasmodium yoelii yoelii
  CDS (1)..(915)
atgtttacgttttcctcctttcaaaagctattgtttggtgtgactgtttcaagcggaggaatagtgttaagttgtttttatatttacaaaaaaaatagacccttaaatgattataatgtagatgcaccaagcgagaaatttcgaataaaagtatttgacgatttagcaaaaaattatgatgaaaaaaatgattttgttgaaaaaattacatctattgccaaatataaaaaaaaaaactttcgaaaagttagaggagttgtattagaaataggggcagggacaggcagaaatttgaattttttaaaaaatatagatgcattagtatgtgtggaaaaaagtgaaaaaatgtgtgaacagttgaaaaaaaaaatagaaaaaataaatcctccatatcctgtatatgttataaataatgatataaaaaataattattttaaacctgatacttttgattctgtaatttcatctttctccttatgctcattggaacatgttgatgaatgtttacaacaagttcacgaagtcatgaaacatgatggaaaattttttttagttgaaagaggtattatttataataaatttattagatatattttagaaagattcgatttatatcccaatagaaaaattccatgggaatatggatactatgaaaatcgatctcctttggatattttaaaaaacaatggatttaacattacttttaaactgatcaaaaatgcgggaagtatatacatcttaatagctaagaaaataaaacgattaccaaataaaacagtaaacgaaaataaccaaatacatacaaatcaaagcgttgataaagataaatcgaaaaaaaaagaaattcatattaacgaaatattgctagagaaggataaggttcctatttattatattcatagaaatgactcttaa

SEQ ID NO: 4157 - protein, 304 aa, Plasmodium yoelii yoelii
MFTFSSFQKLLFGVTVSSGGIVLSCFYIYKKNRPLNDYNVDAPSEKFRIKVFDDLAKNYDEKNDFVEKITSIAKYKKKNFRKVRGVVLEIGAGTGRNLNFLKNIDALVCVEKSEKMCEQLKKKIEKINPPYPVYVINNDIKNNYFKPDTFDSVISSFSLCSLEHVDECLQQVHEVMKHDGKFFLVERGIIYNKFIRYILERFDLYPNRKIPWEYGYYENRSPLDILKNNGFNITFKLIKNAGSIYILIAKKIKRLPNKTVNENNQIHTNQSVDKDKSKKKEIHINEILLEKDKVPIYYIHRNDS

SEQ ID NO: 4158 - DNA, 1440 bp, Neurospora crassa
  CDS (1)..(1440)
atggcaacaaggataccactctcccttaggggagcttcccaacgttcatctcacatcttccttacggccaaccgcctcaccctcgccagtagggccttcacaactacctctctcctcgccaagtccaaaaagctccctccgcaaccatccaaggcatccaagctgtccaggccatccacaaccgctcagccgatcccagaagtaacccccgaaccacaatcagaagaacctcccaaatccaactccaatgcccaggacctcggcaccctcctccaacagcgcagatggcccctcctcttctccggcctgaccgccctgatcatgggcgcctacatctccatgctcatcgcctctctttctcggggtcccgatgcctgttcccacgtcgacccggcgaccggccaacttcccgtgaccggccgtccgcgcgagctagactctctgacatccaaccccgtcgtcaacgaccgcatcctgcgcgagaaggccatggccttcgacaacgggctcaacatgcccgagcgcgtcatgggcatccggctcctaaggaaatggctgggcactcgcgtaaagggccacgtgctggaggtggcggtcggcacaggcaggaacctgcagttttacgactggaccgaggtggtcaaggggccggttaccgggcgggagttgacggcggaggaggagaaggaggaagaagaaaaggccaaggagaggatcaggagcgttttggatcagggagggaaagatgaggaaaagaaaagagataaggattgggtggagaagatgaagatgccgggcgcgctggagggcgagatgctcacgttcacgggagtcgatattagcgagggcatgatgggcgtcgcgaggcagcggttgagggagaatgtccctggaggaaagcagttggtgcccaagggcgcgttcttgacgtcgagggaggcaagtgagagcaggattggagagggtaagaggggtgaggggcaggaggtgctgctcagtacgctggaggataggatcaggctggtgagggcggatgccgaggctaagctgcctgaggcgcctgcttatcccgcaagggttgggagcaaggaggagggcaagtacgatactgtcgtccagaccttcggcctctgctcggtttccaacccgcttgccttgctgcaaaacatggcgggtgtggtcaagccggataccggacgcatcattttgctggagcacggaaagggttggtcggactggatcaatgagaagctggatgcttgggcacctcagcacttcagccggtacgggtgctggtggaacagggatattgagaagttggtgaaggaggcggagcagaaggtgcccggattggagattgtgaagatcgagagacctgggttcttccaggccggcactactgtgttggtgcagttaaaggtcaaaagccaaggaaagtag

SEQ ID NO: 4159 - protein, 479 aa, Neurospora crassa
MATRIPLSLRGASQRSSHIFLTANRLTLASRAFTTTSLLAKSKKLPPQPSKASKLSRPSTTAQPIPEVTPEPQSEEPPKSNSNAQDLGTLLQQRRWPLLFSGLTALIMGAYISMLIASLSRGPDACSHVDPATGQLPVTGRPRELDSLTSNPVVNDRILREKAMAFDNGLNMPERVMGIRLLRKWLGTRVKGHVLEVAVGTGRNLQFYDWTEVVKGPVTGRELTAEEEKEEEEKAKERIRSVLDQGGKDEEKKRDKDWVEKMKMPGALEGEMLTFTGVDISEGMMGVARQRLRENVPGGKQLVPKGAFLTSREASESRIGEGKRGEGQEVLLSTLEDRIRLVRADAEAKLPEAPAYPARVGSKEEGKYDTVVQTFGLCSVSNPLALLQNMAGVVKPDTGRIILLEHGKGWSDWINEKLDAWAPQHFSRYGCWWNRDIEKLVKEAEQKVPGLEIVKIERPGFFQAGTTVLVQLKVKSQGK

SEQ ID NO: 4160 - DNA, 609 bp, Methanosarcina mazei (Methanosarcina frisia)
  CDS (1)..(609)
atgttcacaatgtccgcagcctcaaaatacaaccggatagcgcccgtttatgaactgctagacctgccacttgaatttttctttttccggaaatggagaaaagaagcactttcaggccttagcggaaaagttctggaaatcggggtaggaagcggaaggaacctgaaatactatccagcaggctgttctgtaacgggaatcgatgccagtgagggtatgctcgaaaaagccaggcagaaaaccgggggagtgaaaaacgtcaatcttcttctgatggacgcagaacatcttgaatttccggacaagagctttgattatgtaattgcgacttttgtcctctgcacaatccctgatcctgtaatagctcttaaagaaatgaggcgtgtccttaaaccttcaggtgaacttatagcccttgagcacatgcacagcagtaactcaattatttctctttttgagcacatgatcgatccttttctgtttttcctgcttggggaccataccacacggcagacggttaaaaatatacagaaggcgggctttaccattctggaggcaaaaaaactggcttttaaggatattttccgaaaaatcagggcaaaaccgtaa

SEQ ID NO: 4161 - protein, 202 aa, Methanosarcina mazei (Methanosarcina frisia)
MFTMSAASKYNRIAPVYELLDLPLEFFFFRKWRKEALSGLSGKVLEIGVGSGRNLKYYPAGCSVTGIDASEGMLEKARQKTGGVKNVNLLLMDAEHLEFPDKSFDYVIATFVLCTIPDPVIALKEMRRVLKPSGELIALEHMHSSNSIISLFEHMIDPFLFFLLGDHTTRQTVKNIQKAGFTILEAKKLAFKDIFRKIRAKP

SEQ ID NO: 4162 - DNA, 600 bp, Methanosarcina acetivorans
  CDS (1)..(600)
atgtccgtaatctcaaagtacaacagaatcgcagccatttatgacctgatggaattacctatggagtttttcttatacgggaggtggagagaggaaacgctttcagacctgcaaggcagagttctggaagtcggagtgggaaccggaaggaatctgaaatactactcttcgggctcttcggtaacaggaatcgatgtcagtgaaggtatgcttgaaaaggcacgaaaaaaagcggaaggcatgaaaaatgtaaatcttctccttatggatgcggagcacctggagttttcggataagacctttgattatgtcattacaacctttgtcctctgttcaatccccgatcccgtgaaggctctaaaagaaatgaggcgcgttctgaaaccctcaggggagttgatcgccattgaacacatgcgcagcagtaacaatcttatttccatatttgaaactttaatcaatccgattatgttttccattatcggagatgaggtgaccagggatactgtgggaaacataagaaaggctggattcattatcaaagaagaaaagaatctggcttttaaagatgttttcaaaaaaatccgggtaagcccataa

SEQ ID NO: 4163 - protein, 199 aa, Methanosarcina acetivorans
MSVISKYNRIAAIYDLMELPMEFFLYGRWREETLSDLQGRVLEVGVGTGRNLKYYSSGSSVTGIDVSEGMLEKARKKAEGMKNVNLLLMDAEHLEFSDKTFDYVITTFVLCSIPDPVKALKEMRRVLKPSGELIAIEHMRSSNNLISIFETLINPIMFSIIGDEVTRDTVGNIRKAGFIIKEEKNLAFKDVFKKIRVSP

SEQ ID NO: 4164 - DNA, 546 bp, Pyrococcus furiosus
  CDS (1)..(546)
atggagatacgagctttttcaaaatacaggaaaagagccctaagtcttgttaggggtaaagtcctcgagataggagtaggaacgggaaagaacctcccatattacccgaaggatgtggaggttattggcatagacttcagcagaaacatgcttaaaaaagctgaagaacggagaaggaagctcaggttagagaacgtcacgcttttatacatggacgcccaagatctggagtttgaggataataccttcgacaccatagttagcacgttcgtcttctgtacagttccagatccgattaaagggctaaaagaggcttacagagtgctaaaacctggaggaagagcaatatttcttgagcacatgaaaagcgagtcaaagcttctcaacgtccccctctacctcatggagcccttcataagaacgctcctcggaacttctctgctgagggaaactcagagaaacatcgagagggcgggctttaaaatagaaaaggtcgagaacctcttctatgatatcgtgaggctgataatagctacaaaagactga

SEQ ID NO: 4165 - protein, 181 aa, Pyrococcus furiosus
MEIRAFSKYRKRALSLVRGKVLEIGVGTGKNLPYYPKDVEVIGIDFSRNMLKKAEERRRKLRLENVTLLYMDAQDLEFEDNTFDTIVSTFVFCTVPDPIKGLKEAYRVLKPGGRAIFLEHMKSESKLLNVPLYLMEPFIRTLLGTSLLRETQRNIERAGFKIEKVENLFYDIVRLIIATKD

SEQ ID NO: 4166 - DNA, 1056 bp, Plasmodium falciparum (isolate 3D7)
  CDS (1)..(1056)
atgcacgataaaatatatattatatataaatgtatgctcatatatgtacatttatttctttccataaatatatttttccaggttttattaggggtgacatttgccaatgttagtgttataggtagctgtttttatatatataaaaagaatagacctttgaatgatgaaaccttagaagtaccgaatgaaaattttcgtataaggatattcgatactttagcaaaagaatatgatgagaaaaatgattttatagaaaagattactagtataaataaatatcgaagaaaaaattttagaaaaattcgaggaatagtattagagattggtgctggttctggtcgtaatatttcatatttaaaaaatgttgatgtattagtatgcgttgaaaaaagtgaagaaatgtgtaaagtattaaaaaataaggttgataaaataaaaccacctttctctgtatatataataaaagatgatattaaaaataaaatattcaaacctaatatttttgataatgttatttcgtcctttaccttatgttcattagaatatgtaaatgaaagcttacaaaatatttataatgttatgaaaagtaacgggaagttttatcttatagaaagaggaatcatatatcacaaaacacttcgatatgttttggaaaaattgaaactatatcctaataaaaaaattccttgggaatatggttattatgaaaatagatatcctatagatattttaaaaaataataacttctccataatttttaaagttatcaaaaatgctggaagtatttatgtactcatagccaaaaaaaataaatataacaataataacaataataataatatccctttaaatgatcataatataataaaaccaaacataaataaagtcatcagtaatgaccaacatgtgaataaaaaccatcaagataattcacaaaaaacacaaagtattaatacaatatcaaaggtttctaaaaagaattttgatattcatgatatattatataaacctaatatggttaccaatatatatcattcgtatatctttgagaaataa

SEQ ID NO: 4167 - protein, 351 aa, Plasmodium falciparum (isolate 3D7)
MHDKIYIIYKCMLIYVHLFLSINIFFQVLLGVTFANVSVIGSCFYIYKKNRPLNDETLEVPNENFRIRIFDTLAKEYDEKNDFIEKITSINKYRRKNFRKIRGIVLEIGAGSGRNISYLKNVDVLVCVEKSEEMCKVLKNKVDKIKPPFSVYIIKDDIKNKIFKPNIFDNVISSFTLCSLEYVNESLQNIYNVMKSNGKFYLIERGIIYHKTLRYVLEKLKLYPNKKIPWEYGYYENRYPIDILKNNNFSIIFKVIKNAGSIYVLIAKKNKYNNNNNNNNIPLNDHNIIKPNINKVISNDQHVNKNHQDNSQKTQSINTISKVSKKNFDIHDILYKPNMVTNIYHSYIFEK

SEQ ID NO: 4168 - DNA, 25 bp, Primer
atgatcgtatttcgtcgctttccta

SEQ ID NO: 4169 - DNA, 26 bp, Primer
ttaacttttacttacaggaggtactg

SEQ ID NO: 4170 - DNA, 426 bp, Saccharomyces cerevisiae
  CDS (1)..(426)
atgaaatgtcacgcgaaacggacccttgcctttttggcgacggcacttcccctatctggaaaaagccgagcatgcacccgtaccccacaaagcttcgcttccggtttccgggcagcagcgccgtttcttttttcccgctgcttcgccctttgtattactcattgcgcactttttcacttgccatattcgttcaccggtttttctttttatttcttcgtcttttttcgtctttttcttcactggatatacgctttttgcatttgcaatagcacatatgtgtatatatataagcaagtgttgagcttgcctgtcaaatcctccatgtgtccttctcgtctatcttgttctgtctggtatagagtaatacttacatacatatacgtacattgtttccgctggctagttcgtaaccacctcctttcctag

SEQ ID NO: 4171 - protein, 141 aa, Saccharomyces cerevisiae
MKCHAKRTLAFLATALPLSGKSRACTRTPQSFASGFRAAAPFLFSRCFALCITHCALFHLPYSFTGFSFYFFVFFRLFLHWIYAFCICNSTYVYIYKQVLSLPVKSSMCPSRLSCSVWYRVILTYIYVHCFRWLVRNHLLS

SEQ ID NO: 4172 - DNA, 23 bp, Primer
atgaaatgtcacgcgaaacggac

SEQ ID NO: 4173 - DNA, 23 bp, Primer
ctaggaaaggaggtggttacgaa

SEQ ID NO: 4174 - DNA, 1980 bp, Saccharomyces cerevisiae; identical to SEQ ID NO: 13
  CDS (1)..(1980)

SEQ ID NO: 4175 - protein, 659 aa, Saccharomyces cerevisiae; identical to SEQ ID NO: 14

SEQ ID NO: 4176 - DNA, 26 bp, Primer
atggatagtacgaatttgaacaaacg

SEQ ID NO: 4177 - DNA, 26 bp, Primer
ttagagtatttccagatctgaatctg

SEQ ID NO: 4178 - DNA, 2079 bp, Saccharomyces cerevisiae; identical to SEQ ID NO: 1273
  CDS (1)..(2079)

SEQ ID NO: 4179 - protein, 692 aa, Saccharomyces cerevisiae; identical to SEQ ID NO: 1274

SEQ ID NO: 4180 - DNA, 2253 bp, Neurospora crassa; identical to SEQ ID NO: 1275
  CDS (1)..(2253)

SEQ ID NO: 4181 - protein, 750 aa, Neurospora crassa; identical to SEQ ID NO: 1276

SEQ ID NO: 4182 - DNA, 24 bp, Primer
atggggaagagagtatacgatcca

SEQ ID NO: 4183 - DNA, 23 bp, Primer
tcactccagcttaaacatggcgg

SEQ ID NO: 4184 - DNA, 2577 bp, Saccharomyces cerevisiae; identical to SEQ ID NO: 81
  CDS (1)..(2577)

SEQ ID NO: 4185 - protein, 858 aa, Saccharomyces cerevisiae; identical to SEQ ID NO: 82

SEQ ID NO: 4186 - DNA, 1065 bp, Geobacter sulfurreducens
  CDS (1)..(1065)
atgaaaaaaatcatcaagcaacgttcccgcaagacaggccttcctcccggcagtctggtccacatcggcgagcagaccggcgaaccggtccggatatcccttgtcgactacgacgaaacgagcatcagcgagcgggaaacggacgacattgccgagtgttttccccatagcgaccagccgggggtgcggtggctcgacatggagggtatccaccggcccgaactgctcaagacactcggcgaatgctacggtatccaccccctcaccctcgaagacatcctcaataccgaccagcgccccaaactggaggacttcgacgactatctcttcgtggtcctgaagatgctctccctccagccggatggctcgcttaccgcggaacaggtcagcttcgtgctcggcccctcgtttctcatctccttccaggaaggattcaagggagacctcttcgactccatccgccggcgcctgagggaaaaccggggcaagcttcgcaagagcgggtccgactttctgctctactcactcatggacgccattgtggactactacttcgtgatcctcgaagatctggccgagcggatcgaggaactggaagaagaagtcatcgccggccccagccgcaagacggtcgtgaagatccagcacctcaagcgggaaaccatctttctgcgcaaatccgtctggcccctgcgagaggtgctgggacggctggagcggcgcgaatcgcccctggtgcgcggcgaaaccgtcatctacctgcgggacgtctacgaccactgcatccagatcatcgaaaccgtggagaccttccgggacctcctgtcggagatcctcgacatctacctctccgccatcggcaaccggaccaacgaagtgatgaaggtgctcaccatcatcgccaccatcttcatgccgctcaccttcatcgccggggtctatggcatgaacttccgctacatgcccgagctcgaatggcactggggctacccggccgttctcctgctgatgctcctggtaagcctgggtatgggaatattcttccggcgcaagagatggctgtag

SEQ ID NO: 4187 - protein, 354 aa, Geobacter sulfurreducens; identical to SEQ ID NO: 170

SEQ ID NO: 4188 - DNA, 1143 bp, Nostoc sp. PCC 7120; identical to SEQ ID NO: 103
  CDS (1)..(1143)

SEQ ID NO: 4189 - protein, 380 aa, Nostoc sp. PCC 7120; identical to SEQ ID NO: 104

SEQ ID NO: 4190 - DNA, 1056 bp, Archaeoglobus fulgidus
  CDS (1)..(1056)
atgcggattccagcgacaatcaaaaagaagatggcccttccacccgcaactcccgtcttcaccggcgaaaagaaagttgaggaaactaaaattactgcggcaatttacgacgagaaatcggtggagtttaaggagctagaggtgggggagcttgaaagtgtggtcagaagcgcgctcgcactcaataaaaagctctggattgatgtcgttggtgttcacgatgaaagtcttatcgctaaaatctgcgaattcctgggaatccaccctctcgctgctgaggacattctcaacacagcccagagggtaaaaattgaagactacgacgaccacctttttcttgtacttaaaattctgctttacaacgagacccttgaaattgaccagctcagcctggttttgaagaaaaaccttgtggcgacgtttgaagaaagagagtactggattctcgactccatccgctcaaggcttaagtccggggggagaatgagaaagctcgctggcgattatcttgcctataccatactcgacgcggttgttgacagctacttcgaagcacttctgaaaatttcggatgagattgaggtgttggaggatgaggttgtttctggggacagcacactcatcgggaagattcacagcctgaagagggaaatacttgccttcagaaacgccgtatggcccctaagagatgttctcagcttctttaccagagttgagcacgagcttataggtgaggaggtaaaggtgtattacagggacgtttacgaccacgctgttcgactcatggaggttcttgagacgcagagagagctgctggtgagcttgagagacttatttctgtcagcggtcagcaacaagctcaacgagataatgaaggtgctcactatgattgcgaccatattcattcccctgagcttcattgcgggtgtttatgggatgaattttaagtacatgcctgagctggagtggaagtacgggtatccggccgttctgacagttatggccgtcatcgcactggtaatgattgccttcttcaggaggaaggggtggttatga

SEQ ID NO: 4191 - protein, 351 aa, Archaeoglobus fulgidus; identical to SEQ ID NO: 94

SEQ ID NO: 4192 - DNA, 969 bp, Caulobacter crescentus
  CDS (1)..(969)
atgagcctgatcgccgccaccgcctacaaggccggacagccggtccgcgtgctggacctgtcctcgcccgaggacctggttccgcgcgagggcgaatttgtctggatcggcctggccgagcccgacgaggccgaactgcgccgcctgcagacggcgtttggcctgcacccgctggcggtcgaggacgcgctgcacgcccgccagacccccaaggtcgaggtctatggcgaccagctgttcgtggtggccaagaccgcccacctggagggtgaccgtatcgcctatggcgaaaccgacttcttcgtcggacgccagcacctgatcaccgtccgccacggcagcgcccgggcccataccgagctgcgcgcccagctggaggcggcgccggtccaactggcccacggggtcgactatgtgctgcacgcggtgctggacttcatcgtcgacggctacatgccgatcgtcgaccagatcgaggaagagcttcagggcatcgagcagcgcgcgctggacgccttcctcagccgggccgagatcacccgcatcttcgccctgcgccgctcgctgatgcggttcaagaagatgctgggcccgatggcccagatggccggcgccttggagcatcacgacctgccctgcatcgacagcgaggtgcggatgtacttccgcgatgtccatgaccacgtgcagcgcaccgagatcctggtcgacggcctgcgcgaggtgctgacctcagtgttcgaaatcgccagcctgctggaacagcagcgccagggggtgatcacccgccagttggccgcctgggccgcgatcctggcggtgcccacggcgatcgccgggatctacggcatgaacttcgagcacatgcccgagctgaagtggcagtacggctactacggcgtgatcggcgccatcgccgtggtctgcggcctgctgtaccagcgcttcaagaaggcgggctggctttag

SEQ ID NO: 4193 - protein, 322 aa, Caulobacter crescentus; identical to SEQ ID NO: 106

SEQ ID NO: 4194 - DNA, 3525 bp, Candida albicans
  CDS (338)..(3106): n means a or g or c or t/u
tatataatatataatatataaacataacatattaaaaaaaacttcatattttcaactgttcaacccaacacccccctgttcctagtctagtccaatttattaagtcatatattgttgattaattaaacagtcactagtcctcagtcctcagtccttagttcttggttcttaatattaagatnttccattttttttttttacccaagctatgaaaattatttttgttgtctaacaactataataatatttaccagaaattgctacaaatataaataaataaataaataaatataattaagagtatatctccccttttgttttttttttcttcccagccatgtccgatagtgaaagttattatcaaaattcaactactaatcaacctattcctagatctgatgaagtattggatgatcatagaaatcaaatcactaatgattgtgccattagtgatagtgaagatgagttggaattaaaatcagaattagaatcagaagttgtaaaaagcgaaaaacaacaacaacatcatcaagagattacatcagataatgctaaaccattgactcgtaaatctggttcttcaattaagaaaaaatctaatcttaccgataaagatagaattaccaaccctatgagtttatctggtggtgatgatactattaacagcggtcacaaaaatcgtaattataacatgagttcattacgtaaagatttttatttaaaagataatactgacgacaattctactaataatcatactcatcttgcaattccaattccaattccaattccaaccccaattattactaatgctaataaatcaagaagaaaatctcaattggaaaatttacctccattaattaaaaagaaaacaattggtcgtaataattctaataattttgaaaatgatttagttagtcccatgacaaaaatgaaaactaatgatagtgaagatattactaatactagcaccactgctaatcatatgaaacttggtattggtgctacaacccttggtgttggaactggtactaccgccactgccactgccactgctgctgctggtagaagaccatctcgttcatctattgatagtgaagctgattctcatgcatcaagatcatctcaagaaactgaagaagatgtttgttttcctatggttggtgatcatattagagttaatggaattgattttgatgaaattgatgaatttattagagaagaaagagaagaagcttatttacaaaaacaaatgattgctaaaaatattctgcgtattgatgaatttcaaaatctttccaaaaataatactactagtggtgcatctcgtcatccatatcatcatcacagtaataataataaaaaaaataatggtggtgatggtggtggttctagtatggcagcattaaaatatactccaaaaaatattttaaagaaaacattatcaagatttgaatttactcatgaaaattcttcatcttcagaagaaatttatgaattgaagactaaacaacaaccaccttacaaatatgatgatcaattatcattaacttcatctacatcttctacttctggatctggatctgggcaggtgaaatttggtggagcaagaatttctgatgggattaatggaggttcattacctgatagattttcacttttccattctgaatcagaagaaactattcatgcccccgatattccatcattagtatcaccaggtcaatctgttcgagatttatttagaaatggtgaagaaacttggtggttagattgtacttgtcctactgattcggaaatgaaaatgttggccaaagcatttggtattcatcctttaactgctgaagatattcgaatgcaagaaactcgtgaaaaagttgaattatttaaaagttattattttgtttgtttccatacttttgaagctgataaagaatctgaagattatttagaaccgataaatgtttatattgttgttttccatgatggtatattaacgttccatttttcaccaatttctcatccagcaaatgttagaagaagagttcgtcaattgagagattatgtcgatgttagtgctgattggttatgttatgccttaatcgatgaaattaccgatggttttgcccccgtgattcatggaattgaatatgaagctgatgccattgaagatgccgttttcactgctagagatactgattttagtagtatgttacaaagaattggtgaatcaagaagaaaagtcatgactttaatgagattattatcaggtaaagctgatgtcattaaaatgtttgctaaaagatgtcaagaagaagctaattcttcttctggttattatcaacgtcaatataacttacaacaacaacaacaacaggccccaccaccaccacctaatcctattattacttcaccaattaattcaactttgaatcttaatagtttaggaacttcaactggtggaggagtaggagtaggaggaattaattttggtcccaatccaactggaaataatactaatactaatactaatactactggttcaccttcaccacctcaacaacaacaacaacatggtatcactaacaaatctttccccatccccgatgcacgtccaagagctgatattgcattatatttaggtgatattcaagatcatataatcaccatgtttcaaaatttattagcctatgaaaaaattttcagtcgttcacattcaaattatttagctcaattacaagttgaatcattcaattccaataataaaatcaccgaaatgttttctaaaattactttgattgggacaatgttagttccattaaatttagtcacgggactttttggtatgaatgtaagagtccctggtgaaggtggtaccaatttaggttggtttttcggaattgttggagtattaatatttataattattggatcatttatatttgctcaatggtggttgaaaaaattgaataattcaattgaaggacaaaataatggtaatcgaccaatttttaatcattcatcaagaagatcaattagaagtttaggtttaaaaaaacatggtggtaataaatcaattattagtttccccaataaatatgaataagaataatcaaagaaatgccacagagtttgatggtttgttttttttttttttattgtcatgatggagttgtatatacatatactttttatagaagtaacaatagtaaatgataatagtagtcatcaatcatcatatttataattgtatataatcgtatactaacttcttcttgatttagggaaagagttatattatttactataaacatttatttttacgagttgtgttaaattggagagtcaaattaataggatgtaaaagaagtttttaaagaaggaataaagaaatattataattcagangttcatacagaaggggggggaaggagaaggggatatatatcggcatttgttggtacttttgtttttgaaataaaatataagtttatctaaattattatcaattattatcaatattgc

SEQ ID NO: 4195 - protein, 922 aa, Candida albicans
MSDSESYYQNSTTNQPIPRSDEVLDDHRNQITNDCAISDSEDELELKSELESEVVKSEKQQQHHQEITSDNAKPLTRKSGSSIKKKSNLTDKDRITNPMSLSGGDDTINSGHKNRNYNMSSLRKDFYLKDNTDDNSTNNHTHLAIPIPIPIPTPIITNANKSRRKSQLENLPPLIKKKTIGRNNSNNFENDLVSPMTKMKTNDSEDITNTSTTANHMKLGIGATTLGVGTGTTATATATAAAGRRPSRSSIDSEADSHASRSSQETEEDVCFPMVGDHIRVNGIDFDEIDEFIREEREEAYLQKQMIAKNILRIDEFQNLSKNNTTSGASRHPYHHHSNNNKKNNGGDGGGSSMAALKYTPKNILKKTLSRFEFTHENSSSSEEIYELKTKQQPPYKYDDQLSLTSSTSSTSGSGSGQVKFGGARISDGINGGSLPDRFSLFHSESEETIHAPDIPSLVSPGQSVRDLFRNGEETWWLDCTCPTDSEMKMLAKAFGIHPLTAEDIRMQETREKVELFKSYYFVCFHTFEADKESEDYLEPINVYIVVFHDGILTFHFSPISHPANVRRRVRQLRDYVDVSADWLCYALIDEITDGFAPVIHGIEYEADAIEDAVFTARDTDFSSMLQRIGESRRKVMTLMRLLSGKADVIKMFAKRCQEEANSSSGYYQRQYNLQQQQQQAPPPPPNPIITSPINSTLNLNSLGTSTGGGVGVGGINFGPNPTGNNTNTNTNTTGSPSPPQQQQQHGITNKSFPIPDARPRADIALYLGDIQDHIITMFQNLLAYEKIFSRSHSNYLAQLQVESFNSNNKITEMFSKITLIGTMLVPLNLVTGLFGMNVRVPGEGGTNLGWFFGIVGVLIFIIIGSFIFAQWWLKKLNNSIEGQNNGNRPIFNHSSRRSIRSLGLKKHGGNKSIISFPNKYE

SEQ ID NO: 4196 - DNA, 1041 bp, Streptomyces coelicolor
  CDS (1)..(1041)
atgaccatggcgggcagtctgcggaaggtcacggggctgggcagggccggcggcctgcggaaggtggcacggctggcccgccggcggccgcgggtggatctgagccaccccgcccgttccccgctgggctcctcggtggtgaactgcgtgacctaccgggacggtgtccgcatgcccgaggccggagatccggtcgacgtcgtgacccggatgcgcaggcgcgggacgggcttcgtctggctcggtctgcacgagccgacggaccaggagttcgcgggcgtcgcggagctcttcgagctgcatccgctggcggtcgaggacgcgatcgaggcgcaccagcggcccaaggtggagcggtacggggagacgctcttcgccgtgttcaagacggtctgctacgtggagcacgaggagctgacggccacgagcgaggtggtgagcaccggcgagatcatggtgttcgccgggccggacttcgtggtcaccgtgcggcacgggaggcacggctcactgggaccgctgcgggaaggactggagtccgatccggcccagctcgcgaagggcccctcggcggtgctgcacgcgatcgcggaccatgtggtggacgatttcctgagcgtcatcgagtcggtccaggaggacatcgaccatgtcgagacggaggtgttcgcggagaacggcgcgcgggtcgacccgggacgcatctaccagctcaagcgtgaactcctggagctccggcgggccgtggtgccgctcggccggccgctggaggagctggccacccggccgttccgggtggtcgagccggagatacgggcctacttccgcgacgtcgccgatcatctgctgcgggccaccgagcagatcgcggcgttcgacgaactcctcaactccatcctccaggcacacctggcccgcgtgacggtcgcgcagaacgaggacatgcggaagatcacggcctgggccgccatcgtcgcggtgcccacgatggtctgcggcgtgtacggcatgaacttcgaccacatgccggctgggctgtag

SEQ ID NO: 4197 - protein, 346 aa, Streptomyces coelicolor
MTMAGSLRKVTGLGRAGGLRKVARLARRRPRVDLSHPARSPLGSSVVNCVTYRDGVRMPEAGDPVDVVTRMRRRGTGFVWLGLHEPTDQEFAGVAELFELHPLAVEDAIEAHQRPKVERYGETLFAVFKTVCYVEHEELTATSEVVSTGEIMVFAGPDFVVTVRHGRHGSLGPLREGLESDPAQLAKGPSAVLHAIADHVVDDFLSVIESVQEDIDHVETEVFAENGARVDPGRIYQLKRELLELRRAVVPLGRPLEELATRPFRVVEPEIRAYFRDVADHLLRATEQIAAFDELLNSILQAHLARVTVAQNEDMRKITAWAAIVAVPTMVCGVYGMNFDHMPAGL

SEQ ID NO: 4198 - DNA, 1128 bp, Deinococcus radiodurans
  CDS (1)..(1128)
atgatgtggcgcatggccgcttctcccgctgcggatgccacgtctccttcttcccagtcggcgccgccacgtcctccgacagacgccggaccgggcgaccctttgctggatggaagtggtcaacccgcgccccatgccgaggcgcatgtgttccgggacggcaaggtgcggcaccttccgctggacctgaacctcgcgcgtgggctgctggacgacccgcaggcgttcgtgtggttcgatctggtcaacccggaccccgccgacctcgaagccctgcgcgagccgttcgacctgcacccgctggcgatcgaggacgcgctcgtgggtgggcagcgggtcaaggtggagccctacgacaccttctggttcgtggtgctgcacggcgcctccttgccgtcgcaggaccgcttgcaactgcacgaaatggcgctgtttatcgggcaacggttcgtactgaccattcagcatcagccgctgttcgccgacgaggaaatcgtggagcgctggcaacttgtccccgccgcgtggcgttccagtgccagttcgctgacctacgtgattctggacaccatcgtggacaatctgcgcgagctgaccgaccagattgagcgcgaactgcgcgaggtccgcacgacgatgacgcgcagccaggtcgtgcatcccgagctgcttcagcgcattttttcgcttgaggaagtcacccatgaggcttacaccgtcgccctgtcgctgcgcgacaccctgccaactttcgtgcacgcgccggaggaggcgcctgtcggcggcccggcccaggcgccgtactaccgcgatgtccacgaccacgcgataggggtggtcgaacgcctcggcgccgagcgcgacctgagtcagcgggtgttcgacgtgtaccagtcgctcgccgctcagcaacagagtgaggtggcgcggcagctcacggtggtgtccaccatttttctgccgctgaccttcctcacggggtttttcggtcagaacttcgagtacctgactcagaagatagcgagcgagcgggcgttctgggtctggggtttcgggtcttatctgctgtcgctgctggcaatcgcctgggtcattcgccgggtgtcgcgttgggggcgtgacgggtag

SEQ ID NO: 4199 - protein, 375 aa, Deinococcus radiodurans; identical to SEQ ID NO: 100

SEQ ID NO: 4200 - DNA, 1065 bp, Clostridium acetobutylicum; identical to SEQ ID NO: 101
  CDS (1)..(1065)

SEQ ID NO: 4201 - protein, 354 aa, Clostridium acetobutylicum; identical to SEQ ID NO: 102

SEQ ID NO: 4202 - DNA, 954 bp, Methanococcus jannaschii
  CDS (1)..(954)
atgattacggtaattgctatagctaaagatggcagtattgtcgagccaaaacttgatgaaattagctttgaagattatagacttatttggattgattgttatgacccaaaagatgaagagctatataaactctctaaaaaaattggtatttctgtctctgatttacaaattggtttagatgagcaggaaattccaagggtagaggaagatgaggacttttacttaattatttacaaagctccattatttgaagaggatattacaacaacatccttaggtatctatattaagaataacctcctactaacaatccactcggataaaataaaggctattggaagattgcataaattaatatcaacaaaaaaaccaagaattgtatttgaaagaggaattggctttttattataccatatattaaatgagattacaaggagttattcaagaattttaatgaatttagaagatgagttggaggagttggaggataaattattagctggctatgacagagaggttatggaaaaaattttaggattaagaaaaactttggtttattttcataaatctttaatagctaatagggatgtcttagttttattaaagagaaagtatcttccaataaccacaaaagaagacagagagaactttgaagacctttactacgacactttacagttaattgatatgtcagcaacctatagagaggttttaacctcaatgatggatataaccctctcattagaaaatataaagatgaaccaaattatgaaaatcctaactatggttacgacaattttcgctgttcccatgtggattactggaatatacgggatgaacttctcttatttacctttagcaaacaaccctcaaggtttttggcttgtaatggctttgatggttgtaataattatgatatttgtctatatatttagaaggtcaggatggatttag

SEQ ID NO: 4203 - protein, 317 aa, Methanococcus jannaschii; identical to SEQ ID NO: 86

SEQ ID NO: 4204 - DNA, 960 bp, Bacillus subtilis
  CDS (1)..(960)
atgatcaacattaccgcaatcacaacagagcatcagctgctgaaaaatataccgatcgaacgagtggaacagcctgatattgcatggtactgggttgatttttacggcccggaggatacggaaacggcgttattgagagatttttttcattttcacccgcttgccattgaggattgcttccagcatatgcagcggccaaagcttgaccattatgacggctatcgtttttacgtgattcatgcgctgaataaggaaacacttgagacggaggaagtcgatatctttcaaggcgaaaaatttgtcgtcacctttcatttacacgaaacgcccggtatcgctaaagtccgggagcgtttgtatgcttcaccggacatattgaaaaaagggcccgggcatatttcttatatgatcatggatcagcttgttgatgaatattttcctctcgtgtataaaattgaagaccggctgaatgaaattgaagaaagccgtccccacaaaacgtatggaacgctgatgaacgaggtgtttgatctcagaacagacctattgcatttgagacggacgattatcccgatgcgtgatttgctctaccggattttaagccttgaccatgtgaaagagcagcgggaaacgaaagcctatttcagcgacatatatgatcatttgttaaagttgtctgaaattgtggaatccaaccgtgacatgacgtccgacttgcgtgacagctacgtgacgctaaactcaaaccggatgaatgcgattatgatgacactgacgatcgtatcaaccattttcatcccgctcacctttattgccggtgtatacggtatgaacttcgactttatgccggagctgcattggaaatacggatatttcgctgtacttggcctgatggccgcgcttgtgattggaatgctgatttggtttgtacataaaggatggttcaatatttttaaatga

SEQ ID NO: 4205 - protein, 319 aa, Bacillus subtilis; identical to SEQ ID NO: 92

SEQ ID NO: 4206 - DNA, 1056 bp, Thermotoga maritima
  CDS (1)..(1056)
atggaggaaaagaggctgtctgctaagaaaggtctccccccaggaacgctcgtttacacagggaagtacagggaagattttgagattgaagtgatgaattactccatagaggaatttcgcgagttcaaaaccacagatgtcgaatccgttcttcccttcagagattcttcaacacccacctggataaacataacaggcatacacaggacggatgtggttcaaagggtaggtgagttctttggtattcatcctctcgtgctcgaagacatcctcaatgtgcatcagagaccaaaagtggagtttttcgaaaactacgtgttcatcgttctgaagatgttcacctatgataaaaatcttcatgaactggaatcggagcaggtcagtttgatactcacaaaaaactgcgttcttatgtttcaggaaaagataggggacgtgttcgatcccgtacgggaaagaatcagatacaacaggggaatcataaggaaaaagagagcggattacctcctctactcactgatagatgcactggtggatgactatttcgtcctgctggagaagatcgacgatgagatcgatgtactggaggaagaagtgctcgaaagacctgaaaaagagacagttcagaggacacatcaactcaagagaaatctggttgaactgagaaagacgatctggccgttgagagaagtgttgagttctctttacagagatgttcctcctcttatagaaaaagaaacggtcccatatttcagagatgtatacgatcacactatccagattgcagacaccgtagaaaccttcagagacatcgtgagcggtcttcttgatgtgtatctttcgagtgtaagtaacaaaacaaacgaagtgatgaaggtgctcaccatcatagcgacgatcttcatgcctctcaccttcatagcgggtatctacggaatgaacttcgaatacatgccggagctcagatggaaatggggctatcctgtggttctcgctgttatgggtgtgatcgctgtcatcatggtggtctacttcaagaaaaagaagtggctgtga

SEQ ID NO: 4207 - protein, 351 aa, Thermotoga maritima; identical to SEQ ID NO: 96

SEQ ID NO: 4208 - DNA, 1854 bp, Schizosaccharomyces pombe
  CDS (1)..(1854)
atgccatccaatacatcccggtcagtgcctacgggcttttattacaaacaaaatgctaggatgcagaacaggcctagattttctgatcgtaaacactcgagtaaatctaaacatcgatttccagtggaccctagtttgcaaccagacgaagcggatgagggaacaagattattgggaaacagtgatagtgatctattagaaccaccgtctgagcattcaagtaatggggaagatgacaaggatattaataaccctccttcaatgcctagttctgtttgttcttccccgaaaagtccacaccgtcactatgaaagcgatgaagacatcgaaaatatatcactgccggaaagccatccagaggacattcaaaggaaagaatttgagacggaaaatgggaagaatacaagagatcaacctagtccacttgctgaggtcagtgactttgctatttcatccccccatgtctaccctaaatcagctaattctcatgatagtcactatgaacagtttgcaaacaacgacgtgactgagagtgctgttgatgatcatccggctactcgaaagttatctcgggatgagttgtatttacccatatctccaaacaatgctcaagaaccaaagttttctgtccttgatgaatggaccaaaaagatggttgccaattttgaagaatattcggtagaagatgttgataagcgtcgtgaaagaaataggaagttgagtgaaccgttacttgtaaatggccgttatcgtgttcgtgatcgttgggctcaatttcgtaagtcagaaattgaaaaaccatatcgatttacattctttaccgatgagcttccttctactatccattcacatgaaatgtgggaactcgttcacgatggccaaagctttgaggaccttttccattctggaggaacttggtggctagatgtctcttgtccaaaggaagaagaaattcgagttctggcaaaggcttttggaatccatcctttaaccgttgaagatattactctcgaagaggatcgtgaaaaagtcgagctttttagaacgtattactttgttaccttccgttcattcaaccaattaccctcaaactctgagtacctaaagccgttgaatttttatctagtcgtctttcgtgacggtataattacttttcatatgaacccgacaccgcatccagctaatgttcgtcgaaggattcgtcaactgaatggttatctgacagtgaatgcagattggatcgcatatgcattgctggacgatactacagatgctttcgctccattcattgagcaaattgaagatgaagtcgacacaattgattccatgattttgagtatccattatgatcacgtaatggaagtgaagcctcaagagagaatgttgcagcgcgttggtgaatgccgcaagctgatcatgagtttgctacgtttgcttgccaataaggcagatgttgttagaggtctttccaaacgatgcaacgagtcatggcaagtagctcctagaggtgaaattgctttatatcttggtgatgtgcaggatcacatagtcactatggttcaaaatttgaaccattacgaaaaaattttatctcgaagtcattcaaattatttggctcagatttctattaatatgacacttgtttcgaatgaaacaaatgaagtcttatcacgtttgactatcttgggtacaattctaattccgttgaacttggttaccggtttatggggtatgaatgttaaagttccaggacaagacgtaccaggacttggttggttctttagtattcttggtagtctgatgatttttgcgatttcatctttcattctttgtaaatggtacaaagttatttag

SEQ ID NO: 4209 - protein, 617 aa, Schizosaccharomyces pombe
MPSNTSRSVPTGFYYKQNARMQNRPRFSDRKHSSKSKHRFPVDPSLQPDEADEGTRLLGNSDSDLLEPPSEHSSNGEDDKDINNPPSMPSSVCSSPKSPHRHYESDEDIENISLPESHPEDIQRKEFETENGKNTRDQPSPLAEVSDFAISSPHVYPKSANSHDSHYEQFANNDVTESAVDDHPATRKLSRDELYLPISPNNAQEPKFSVLDEWTKKMVANFEEYSVEDVDKRRERNRKLSEPLLVNGRYRVRDRWAQFRKSEIEKPYRFTFFTDELPSTIHSHEMWELVHDGQSFEDLFHSGGTWWLDVSCPKEEEIRVLAKAFGIHPLTVEDITLEEDREKVELFRTYYFVTFRSFNQLPSNSEYLKPLNFYLVVFRDGIITFHMNPTPHPANVRRRIRQLNGYLTVNADWIAYALLDDTTDAFAPFIEQIEDEVDTIDSMILSIHYDHVMEVKPQERMLQRVGECRKLIMSLLRLLANKADVVRGLSKRCNESWQVAPRGEIALYLGDVQDHIVTMVQNLNHYEKILSRSHSNYLAQISINMTLVSNETNEVLSRLTILGTILIPLNLVTGLWGMNVKVPGQDVPGLGWFFSILGSLMIFAISSFILCKWYKVI

SEQ ID NO: 4210 - DNA, 1158 bp, Gloeobacter violaceus
  CDS (1)..(1158)
atgcgagaccggaagccggaagccggagaagcaatgggttccgacgaggatgagtcctacgtcgattaccattacgacgaccccggtaccatgccgggaacgctcagcatcgacaaaaacgctccaccgcccgagatccacctcatcgattacgatgccgaacaatccaccggccgcagggtggaaaatcccgaggaactgacgccttacctggacaaccactcggtctcgtgggccgacgtgcgcggcttcggcagcgaggacatcctgcgccgcctgggcaaggtattcgggctgcatccgctggtgctcgaagatatcgtgaatgtgccccagcgccccaaggtggaagaatacaaggatcacttgctgattatcgccaggatggtctgtcccacctccgaaacagcagaagaatttttcagcgaacaggtgagtttgatcctgggcaaaaactatttgctcacggtccaggaagaagccaaattcgacgtcttcggccccgtgcgcgagcgcatccgcaccgccaagggcatcatctgcaatcagcgcgccgactacctggcctacacgctgctcgatgcgatcatcgacggcttttacccggtgctcgaagacttcggcgaacgcctcgaggaactcgaagcggaggtggtagaaaaccccacccgcgctacccttgagagaatctatctgctccggcgcgaactgctcatgctgcggcgcgccatctggccccagcgcgatgtgatcaacgccctcatccgcgatgccaacccgctgattggcgaggaggtgcgcctctacttgcgcgactgctacgaccacgccatccagatcatcgatatggtggagacataccgggaactggcttcgagcctgaccgacatctacatgtcctcggtgagcaaccgtatgaacgaggtgatgaagaccctcacggtgatctcggccatttttattccgctgacctttatcgccggggtttacggcatgaacttcgatcccgaaaaatccccctggaacatgcccgaactggaatggtactggggctatccgttcagcctggtgctgatgttcatagtggccgtgggtctggtcgtctatttttggcggcggggctggtttgagagcttctcctcgcagagcaaaaagtga

SEQ ID NO: 4211 - protein, 385 aa, Gloeobacter violaceus; identical to SEQ ID NO: 168

SEQ ID NO: 4212 - DNA, 1038 bp, Chromobacterium violaceum; identical to SEQ ID NO: 165
  CDS (1)..(1038)

SEQ ID NO: 4213 - protein, 345 aa, Chromobacterium violaceum; identical to SEQ ID NO: 166

SEQ ID NO: 4214 - DNA, 2100 bp, Neurospora crassa
  CDS (1)..(2100)
atgtttgaccaggaggaaaacgtggggaactccgggtactcaaccccggtgcccgaacttgacgaccaccggaaccaatccgtttctgtccaacgacccgaccgtcctcgacgcggaacattcgattctctatacgggccaggacaggtgattgagacgggcccaacacgcagcgattcgttccagggcacaaggatccgagattttgaggaagctgttgttgacgaggaggatcaggagaactcgccagtttatcggagagatcggcgaggaactgtagagtctgctgtgttagatgttcggtctatctcacccccgaactcggttaaggctttcgcggaagcacgccgaagggagcgagatctctccttctccgagccaacgagacctgagcgtcgagtcgaagagccacccgagctgcagcgggctaactctatcgtcagtcgccgtagctaccgcagcaagcagccgacggtgattgatgacaccgccagcttggccaccaacaaatccgcggaggaagacgtttgcttccccttgcaagatgatcatagggatgacaacttgcatatcgatttccactacttggagacctttatcaaggctgagaatgaagcccgacagtcagctcgccgcccctcggccatccgtgtcttccccgatttgcggcctgccgagcccgatgttacccccaccgtaccaatggtaacactggatggggatatcctttcggccccttcggagacggatattcggcgggaaaagagtcatgagacagacgacgatgccgaggccaaaaggactccaccaccgccacaacctcaggttgaccagagccgggtcagtttcttttcctcagcttgggaatccacgatccacgctgccgacctggagggtttgattttgcccggggaggacattagagggcttttcagtttcccaaagggggagactgatggagtctggtggctcaatatgaacaatccctccgaagaagaagtccgtgccgtctgcagagcttttggcatccaccccttgacaattgaggatatcaccacgcaggaatcccgggagaagattgagcttttcccatcctactatttcgcctcgttcagatcgttcttcattgaggtagaggataccaccggggaaaaggagtacgtgcccttcaacatttacgtggtagtgtttcgcgaaggcacattgagcttcagctacgccaacaattcccatgcctcacatgtgaggaagagaattacgatgctgaaggactatgtctcattgagtagcgattggatttgctacgccctgattgacgacattgtcgattcgttcgctcccgaaatcagcaaacttgagcacgaaaccgaccagatcgaggacgatgtgttcattgctcggtccgacgacatggctcagttcttgaagaagattggcattgctcgcaagaatgtcatgggcttgatgcgcttgctcggcggaaaagcagatgtcctcaggggcttcaccaagcgctgcaacgagaactacaaagtcacgccacgtatggacattggtctatacctcggtgacatccaggaccacgtagtgaccatgatgaccaacctgggccatttcgagaagatgctgtctcgtgcacacagcaactacctcgctcagatttccatcgacggcatcatccagggaactgctacgaaccgtgtcctcagcaagatcaccctgctggcctccatcatcgtcccgctcaacgtggtgactgggaaagggctgccaagcaatgtcgataacatggctgttataacatgggagtgtggcgcaacaatggatattcctcaggccgacctcgatctcctcaacgagaaggacaagaacgagcttcgcggtttcatttccaacgagacgcagcgccagagggtgcaaggacagacccacgcccttaccgattcctgctggaagaaatgcgtcacctcccccatcaagaccaaccagctcgacaagaccgaggccgtctgcatggcggactgcgttgagcgcttcctggacgtcaacctgaccatcatggcccacgtgcaaaagatcaccaggggtggcagcaagtag

SEQ ID NO: 4215 - protein, 699 aa, Neurospora crassa; identical to SEQ ID NO: 126

SEQ ID NO: 4216 - DNA, 2469 bp, Neurospora crassa; identical to SEQ ID NO: 123
  CDS (1)..(2469)

SEQ ID NO: 4217 - protein, 822 aa, Neurospora crassa; identical to SEQ ID NO: 124

SEQ ID NO: 4218 - DNA, 1101 bp, Mycobacterium bovis
  CDS (1)..(1101)
atgttcccagggtttgacgcattgcccgaagtgctgcgaccggtcgcgcgaccccagccgccgaacgcacaccccgttgcccagccaccggcccaagccttggtcgactgcggtgtctacgtctgcggccagcgactgcccggcaagtacacctacgccgccgcgctgcgcgaggtgcgcgagatcgaactgaccgggcaggaggcgttcgtctggatcgggctgcacgagcccgatgaaaaccagatgcaggacgtagcagacgttttcgggttgcacccgttagccgttgaggacgccgtgcacgcgcaccagcgacccaagttggagcgctacgacgagacgctgttcctcgtcctcaagaccgtcaactacgtcccgcacgaatcggtggtactggcccgcgagatcgtcgaaaccggcgagatcatgatcttcgtcggcaaggatttcgtggtcaccgtccgccacggcgaacacggcgggttatccgaggtgcgtaagcggatggatgccgaccccgaacatttgcggttgggaccgtatgcggtgatgcacgcgatcgccgactacgtggtcgaccgctacctcgaggtgaccaatctcatggagaccgatatcgacagcatcgaggaagtagcgttcgcgccgggccgcaagctcgacatcgaaccgatctatctgctcaagcgggaagtggtcgagttgcgccggtgcgtgaatccgctatcgaccgcattccagcgcatgcagaccgagagcaaagacctcatttcgaaagaagtgcggcgctacctgcgcgacgtcgccgaccaccagaccgaggccgccgaccagatcgccagctacgacgacatgctcaactcgctggtgcaggccgcgctcgcccgggtcggcatgcagcaaaacatggacatgcgcaagatatccgcgtgggcaggtatcatcgcggtccccaccatgatcgcgggcatctatggcatgaactttcacttcatgcccgagctggactccaggtggggttacccgacagtgatcggcgggatggtccttatctgtctgttcctctaccacgtcttccgcaacagaaactggctctag

SEQ ID NO: 4219 - protein, 366 aa, Mycobacterium bovis; identical to SEQ ID NO: 164

SEQ ID NO: 4220 - DNA, 1098 bp, Rhodopirellula baltica
  CDS (1)..(1098)
atgcgtcttcgtgtgcaccggccgcggtgggctcgttcacgatccaagattggaaacgttcccggggatctgtcgagcgatgtttcgacgaaaaagaaagacaccgttcccagccacattcgtgtcatccagtacgacggacgaacgcacaccaacgaagtcgtcgaatcgatcgataacgaggactcggacaatccagacatcgtgacctggatcgatttgcatggcatccgtgacatggaggcactgcgttcgcttgggcgacgattcggtttgcacccactcgcgttggaagacgtggtgcagatggatcaacatgcaaaaatggaacgctacggcgagacgttgttttttatcgccaggatgccggttggcgacaatggttttcagaccgaacaagtcagcattttcttggtcggcaacaccgtcatcaccattcaggagaaggtcggggattgcctcgatcccgttcgcgatcgaatttcgcgggcaatgggacgtattcgagatcgcggggcggactacctggtctacgccgttatcgatgcaatcatcgatggctatttcccgatcattgatcgttacgaaagccatttgtctgagatggcggaattgcttcaggatgcggacaacgacaatcttccgatgcatttgcaccacatacgggcggacttgttgtcgattcgaaagacggttcagcaacaccgagacgcgttgcggttgttgctgcgggaaggtgacggcattttggccaatgacacgcgtttgtatctccgagattgccaggaccatatcgggcaattgatggaagcagcggacaccgaccgcgagacatgcggcgaattgcgagagctgtattttgcgttgttggggcaaaaaaataatgacgtgatgaaagtgctcacgatcatcgcaacgcttttcatcccaatgagttttgtcgctgggatctatgggatgaacttcgaccagaaagcatcgcccctgaatatgcccgaactggaatggagttttggttacccgttcgctctttcagtgatgatggttttggcattgagtctgctgtacttcttgtaccgcaagggatggttgtggtag

SEQ ID NO: 4221 - protein, 365 aa, Rhodopirellula baltica; identical to SEQ ID NO: 162

SEQ ID NO: 4222 - DNA, 1011 bp, uncultured Acidobacteria bacterium
  CDS (1)..(1011)
atggaaatttttgtttaccggcacggcgccccaaacattgaagaaggcttcaccatcgccgagcttccggcactactcaaagacgagcaggccatcgtctgggtgaacatgaaccaaccgacgaaggttgacgaggacgtgctcctcgatgtttttcagtttcatccattgacggtggaggactgccgcgagaaccgccactatcccaaggtcgaagaattccccagctatctttatctgatcgtacacggcgtgcgggcggatacgagtcccgatcacttcaacacgatcgagctcgacgcgtttctcggtcccaattacgtcatcacttatcaccacgacgagtttcgcagtattgaaaatgtcaagcagctcatacgcactagcccgattgcctgccaacgcggcgccgccttcctgctccatcagatactggatcagattgtcgattattactcgcccgtactcgacgattttgacgagcgtatcgaccaactcgaggcggatattttcactttgaagactcctaacaattcaatcctcgaggagattatggatctgaagcgcggcgtgctgcggctcagaagaatctcagcgaaacaaagagaggtaatgctgcgcatgagccgcggcgagtttcaactgatcgatgcgcagatgctgcccttctatcgcgacgtgcacgatcacatcgtgcgcgtcaccgatctggcggagagttatcgcgatttgatcagcggcacgctcgaggcgtatttgtcagtagtctcaaaccgcatgaacgagatcatgaaagtgctcacgatcttttcggcgatcatgctgccgttaacttttatcgccggcgtttacggcatgaacttcgacaacatgccggagctacactcgcgctacggctattacaccgtttggatcatcatgagcgttgttgctgtgggaatgctgggattgttttggaagcgtggctggatcgggagtgggccgaagaagaggattaaggatgaaggatga

SEQ ID NO: 4223 - protein, 336 aa, uncultured Acidobacteria bacterium; identical to SEQ ID NO: 130

SEQ ID NO: 4224 - DNA, 951 bp, Bacillus cereus; identical to SEQ ID NO: 159
  CDS (1)..(951)

SEQ ID NO: 4225 - protein, 316 aa, Bacillus cereus; identical to SEQ ID NO: 160

SEQ ID NO: 4226 - DNA, 963 bp, Bacillus anthracis; identical to SEQ ID NO: 157
  CDS (1)..(963)

SEQ ID NO: 4227 - protein, 320 aa, Bacillus anthracis; identical to SEQ ID NO: 158

SEQ ID NO: 4228 - DNA, 1032 bp, Streptomyces avermitilis
  CDS (1)..(1032)
atgcgcacctgtccgcgcgacggaagaatacgctcagtgatcgtcgattgcgccatctaccgtgacggccgccgcacggagggcccggaggacctctccgacgcccttgacgaggcgcgtgcacagggtgacagcttcctctggatcggcctccacgagccgacggagaaggagttcgacctggtcacccatgagttcggactccatccgctggccgtcgaggacgccctgaaggcgcaccagcggcccaagctggaggtgtacgacgactcgctgttcgtggtcctcaagccggtgacgtacgagccgtacagcgacaccgtctcctcgggcgaggtcatggtcttcgtcggtgactccttcgtggtgaccgtgcgccacggggagggtgcgccgctgtcgagcatccggcacgaactggagcgccggccggacatgctccggcacggtcccaccggggtgctgcacgcgatcgcggactccgtcgtcgaccactatctggacgtggccacggagctggggaccgatctggaggagctggaggcggaggtcttctcgcccagcggcggggcgcggaacacggcgtcgcggatctactcgttcaagcgccagatccaggagttccgccgggccacggttccgctcacgccgccgctgacccggctcgccggcctggggcccaacctcgcggcggtgccgttcgtgaaggaggaggcgcggcccttcttccgcgacgtcaacgaccacctgacgcgcgtcaacgaatccgtggagggcctggaccggctggtctccgacatcctctcggcgcatctcgcgcagatgagcgtgcgtcagaacgacgacatgcggaagatctccgcgtgggcggccatggcggcgatccccacgatgatcgcggggatctacggcatgaacttcgagcacatgccggagctgcactggacgtggtcgtatccggcggtgatcgcggcgatggtggtgctcgaggttctgctgtaccggctgttcaagcagcgggggtggctgtag

SEQ ID NO: 4229 - protein, 343 aa, Streptomyces avermitilis; identical to SEQ ID NO: 156

SEQ ID NO: 4230 - DNA, 1065 bp, Streptomyces avermitilis; identical to SEQ ID NO: 115
  CDS (1)..(1065)

SEQ ID NO: 4231 - protein, 354 aa, Streptomyces avermitilis; identical to SEQ ID NO: 116

SEQ ID NO: 4232 - DNA, 1116 bp, Streptomyces avermitilis
  CDS (1)..(1116)
atgtcgatgatccgtgacctccgtgccgcggtccgcccgtcccgtccctcgatgcgcaaggacggcagtgcgtacgacaccacgcgtgacccctcgacgccctccgccgtcgtcgactgcgccatctaccgcgacggcgcccgcgtcgcgaccgaccggccgctcaccccgcacgaggcgatgcgccaggtgcggcgcgacgggggcttcgtgtggatcggcctgcatgagccgacggaagccgaattcgccggtatcgcgggcgagttcgggctgcacccgctggccgtcgaggacgccgtccaggcgcaccagcggccgaagctggagcgctacgacgactccctcttcaccgtcttcaagaccatccactacgtggagcacgaccagctgaccgccaacagcgaggtcgtcgagaccggcgaggtcatgtgcttcaccggccgggacttcttcatcaccgtgcggcacggcgggcagggctcgctgcgggcgctgcggcaccggctccaggacgaccccgagctgctcgcgaaggggccctcggcggtgctccacgcgatcgccgaccacgtcgtcgacggctacatcgcggtcgcggacgcggtgcaggacgacatcgacgaggtggagacggaggtgttctcgccgggccggaagggaacgccgcgcggtacggacgcgggccgtatctaccaactcaagcgtgaggtgctggagttcaagcgggcggtctcgccgctgctgaggcccatgcagctgctgagtgagcgaccgatgcgactgatcgacccggacatccagaagtacttccgggacgtggcggaccacctcgcccgggtccaggagcaggtgctgggcttcgacgagctgctcaactcgatcctccaggccaacctcgcgcaggcgtccgtcgcgcagaacgaggacatgcgcaagatcacgtcctgggcggcgatcatcgccgtaccgacgatggtgtgcggggtgtacggcatgaacttcgagcacatgccggagctgcactggcggttcgggtacccggtgatcatgagcgtcaccgtggtgctgtgtctgggcatccaccgcgccctgaagcgcaacggctggctgtga

SEQ ID NO: 4233 - protein, 371 aa, Streptomyces avermitilis; identical to SEQ ID NO: 152

SEQ ID NO: 4234 - DNA, 1161 bp, Streptomyces avermitilis
  CDS (1)..(1161)
atgtccgagcgacgcgcccgcccagcttcgaagaacggcaggaagtccgcctggcgccgggccctgaacccgcccgcgacgccgcccgccgaacctccggcgggcggccccgacgcgccggccccggaaacggcggatgcggccagcgtcgtacaggcgaccctgtaccgcgacggcgtacgcgtctcctcgcccgcctccctcgccgacacgttccgggagctgcgcgacgagccgtccggcatggcctggatcggcctcgcgcgccccacggagtccgaactcctttccctggccgaggagttcgatctgcatccgctcgccgtcgaggacgcgatggaggcacaccagcggccgaaactggagcgctacggcgagacgctcttcgtcgtcctgcgggccgcccgctatctggacgcgccggaggaggtcgacttcggcgaactccatgtcttcgtgggcccggacttcgtgatcacggtccggcacggcgcggcccccgacctgtcggccgtccgccgccgtatggaggagacgccggagctgctgaaactggggccggaggcggtgctgtacgcgatcctggacgcggtggtcgacggctatgtgccggtggtggccggtgtccagaacgacatcgacgagatcgagacggaggtcttccgcggcgacccggccgtctcccgccgcatctacgaactctcccgcgagatggtcgagttccagcgcgccacccgccccctggtcggcatgctgcacagcctgatggcgggcttcgccaagtacggcacggacgaggaactccagcgctacctccgggacgtggccgaccacgtcacccacaccagcgaacgcgtcgacggcttccgccaggcactggcggacatcctgacggtgaacgcgaccctggtcacccagcaacagaacgcggagatgcgggcgttggcggaggcagggttcgagcagaacgaggaaatcaagaagatctcgagctgggcagcgatcctcttcgcccccacgctcgtcggaaccatctatggcatgaacttcgagcacatgcccgagttgggctggagcttcggataccccttcgcgatcggcctgatggggctggtctgcgtcagtttgtacgtgattttcaagcggcggggctggctctga

SEQ ID NO: 4235 - protein, 386 aa, Streptomyces avermitilis; identical to SEQ ID NO: 150

SEQ ID NO: 4236 - DNA, 972 bp, Pseudomonas syringae
  CDS (1)..(972)
atgggtcgagttgttgcagcagcggtttacaccaaaggcaaaaaagtccgcgacattacccttgatgaaggcgctgcctgggctgcaaagcccgagcactttgtctggatcgggctggagcaacccagcgccgatgagctgaccagtctcaaagagcagttcaacctgcatgaactggcccttgaagacgcgatggaagttcacagtcgccccaagcttgaaacctttggcgatgcgctgtttatcgtgacctacgcgccggtgcgcgataacggcaaactggtgttcatcgaaacccatatcttcgcgggcaagggttacgtcatcacctcgcgcaatggccattcaaagtcttacgggctggttcgtcagcgctgcgaagcgcggcctttgctgctggaacacggcgaagacttcgtgctttacgcccttctggatttcgtcaccgagaactatcagccggtgaccgaagccattcacaccgagcttgagctgctggagcagagcgtcatcggcggttcactgcgcgagtctgatatccagcatattcatgcactgcgtcgcgacctgttgcgaatgcgccgttacgtggcaccgatggtggaagtgggcgaagaactgcagcgactcagttttccgtttatcgacaagaacatgcgcccctacttccgtgacgtggaaattcacgtgaagcgccagatggaggacctgggcaacctgtgtgacatcgccagccagaccatcgaaataggcctgctgctggagtcctcgcgacaaagcatcgtgcagcgcaagtttgccgggtgggcagccattctggcgttcccgacggcgattgccggcatctacggcatgaacttcgagaacatgcccgagctcaagtggcactacggctacttcatcgtgctgggcgtgatcgttggcggctgtacggcactgtttgccagcttcaagcgctccggctggctatag

SEQ ID NO: 4237 - protein, 323 aa, Pseudomonas syringae; identical to SEQ ID NO: 148

SEQ ID NO: 4238 - DNA, 972 bp, Pseudomonas putida
  CDS (1)..(972)
atgggtcgagtcgtggcatcggcggtgtacagcgccggcagaaaggtcaccaacatcagcatcgacgaaggcagcgagtgggcgcgcaagccggggcatttcgtgtggatcggcctggaagagcccaatgccgaggagctggccaacctgcagtcgcagttcaacctgcacgaactggccatcgaagatgccctggaaaaacacagccggcccaagctggaaaccttcggtgacgcgttgttcatcgtcacctattcgccagtgcgccacgaaggcaagctggaattcatcgaaacccatatcttcgcgggcaacggctacatcatcacctgccgcaacggccactccaaatcctacgccatggtccgccagcgctgcgaggctcggccgctgctgctggaacatggcgaagacttcgtgctgtacgccctgctcgacttcgtcaccgagaactaccagccggtcagcgaggccattcatggcgagatcgaagcgctggaggaaagcgtactgggcggctcgctgcgggaagacgacatccgccgcctgcacagcctgcgccgtgacatcctgcgcctgcgccgctacgtggcccccctggttgaagtgagcgaagaactgcagcgcctgagcttcccgttcatcgacaagaacatgcgcccgtactttcgtgatgtgcaaattcacgtgacacggcagatggaagacttggccggcatccgcgacattgccagccagacgatcgagatcggcatgctgctggagtcgtcacggcaaagcatcgtgcagcgcaaattcgcggcctgggcggcgattctggcattccctacggcgattgccggggtttacggcatgaacttccagaacatgccggagctgagctggcactacggttacttcgcggtactgggggtgattgcgacggggtgtgccgggttgtatgccagcttcaagaaatcgggttggctttga

SEQ ID NO: 4239 - protein, 323 aa, Pseudomonas putida; identical to SEQ ID NO: 146

SEQ ID NO: 4240 - DNA, 1020 bp, Leptospira interrogans; identical to SEQ ID NO: 143
  CDS (1)..(1020)

SEQ ID NO: 4241 - protein, 339 aa, Leptospira interrogans; identical to SEQ ID NO: 144

SEQ ID NO: 4242 - DNA, 828 bp, Chlorobium tepidum; identical to SEQ ID NO: 139
  CDS (1)..(828)

SEQ ID NO: 4243 - protein, 275 aa, Chlorobium tepidum; identical to SEQ ID NO: 140

SEQ ID NO: 4244 - DNA, 1071 bp, Methanosarcina mazei; identical to SEQ ID NO: 119
  CDS (1)..(1071)

SEQ ID NO: 4245 - protein, 356 aa, Methanosarcina mazei; identical to SEQ ID NO: 120

SEQ ID NO: 4246 - DNA, 1056 bp, Fusobacterium nucleatum; identical to SEQ ID NO: 137
  CDS (1)..(1056)

SEQ ID NO: 4247 - protein, 351 aa, Fusobacterium nucleatum; identical to SEQ ID NO: 138

SEQ ID NO: 4248 - DNA, 1065 bp, Legionella pneumophila; identical to SEQ ID NO: 127
  CDS (1)..(1065)

SEQ ID NO: 4249 - protein, 354 aa, Legionella pneumophila; identical to SEQ ID NO: 128

SEQ ID NO: 4250 - DNA, 1071 bp, Methanosarcina acetivorans; identical to SEQ ID NO: 117
  CDS (1)..(1071)

SEQ ID NO: 4251 - protein, 356 aa, Methanosarcina acetivorans; identical to SEQ ID NO: 118

SEQ ID NO: 4252 - DNA, 972 bp, Ralstonia solanacearum
  CDS (1)..(972)
atgcccatggtgatcaacagcgcgttgtatcgcaacggccggcgcgagcgtgatctgtcggtcgacgccatcagcgatgtgctgcacgcgccgggcaccttcgtctggctgggcctgcacgagccggacgacgccatgctcgcccgcgtgcaggaggaattccacctgcacgacctcgccatcgaagacgcccgcaaggctcaccagcgccccaagctggagacctacggcgacacgctcttcatcgtgctgaacacggcgcagatggagcagggcgaggtggtcttcggcgaaacgcacctgttcgtcgggcgcgacttcctggtctcggtgcggcacgggccgtcgacgtcgtactcgccggtgcgcgagcgctgcgagcacgtgccgcacctgctggccaagggcgcgccgttcgcgctgtacgcggtgatggatttcgtggtcgacaattaccagccggtgctcgaatccatggaggcggcgttcgacgcgatcgagggccagctcttcggcgatgcgttcgaccgtgccgccatcgagcggctgtacacgctcaagcgccagctgctgcgcctgcgcaacgccgcgctgccggtggaggacatcgccggccagctggtgcgcctgcacgaagatgtcgtgcccaaggagctgcgcgcgtacttccgcgacgtggccgaccacgcccaccggctggtcggcgcgctggacgtgatccgcgaaatgctgaccacggcgatctcggtgaacgtggcgctggtgtcggtcacgcagaacgacatcgtcaagcggctggccgggtggggcgcgatcctggcgattccgaccgtggtgttcagcaactacggcatgaacttcaagggcatgcccgagctggagcatccggcggggtatcccatcgtgctggcctgcaccgcggcggcgtgcgtgtggctgtatcgcaagctgcgcaggtcgggctggatctag

SEQ ID NO: 4253 - protein, 323 aa, Ralstonia solanacearum; identical to SEQ ID NO: 136

SEQ ID NO: 4254 - DNA, 1008 bp, Rhizobium loti
  CDS (1)..(1008)
atggaatatgtccgagagttcaagcccgcggcgccgacatcaggcattatcgcctccagtgtctacacggccgggcggcgtatcgccgacattccgatcgaggaagccggcgaatgggccaagaaatcgggacatgtcgtctggatcgggctgctcgaaccggatcgcgagcttctgttgcgcgtccaggcgcagttccatctgcatgaactggcgatcgaggatgccgagcatccgcaccagcggccgaagatcgagcaatatggcgatgcgctgttcatcgtcgcccgcaccgcgcaattgatcgaaggacgggtgactttcggcgagacgcatctgttcgtcggctcgggctatatcgtcagcgtcaggcatggcccgtcgacctcctacgccgccgtgcgccagcactgggaaagctgtccgcattcgctggccaagggcgaggatttcgtcctctacgccattctcgatttcatcgtcgacaactacatgccagtgctcgagcagatcgaggacgaggtcgaggtgatcgaggacagggtgcttttgaagccgatgaccggtcctgatatcgagcggctctacatgctgcgccgcgatctgctgcgcctgcgcaatgcggcacttccgctggtggaagtctgccgccgcctgaccagcgccgacctgccgcagatccattcggccatgcacccgttgtttcgcgatgtgaccgaccacatccgcaccgtccaggagaagatcgacagtctgcgcgaggtgctggccttcgccttcgaggcgagcctgctggtcggtcagagccaggaaacggcgatttccaagaaactcgcctcctgggcggccatactggccgtgccgacggcgttcgccggcatctacggcatgaacttcaccgacatgccggaactgaagatggaatatggctacccgatcgttctggccaccatcgcgacgatctgcgcgtttctctactggcggttccgcaagaatgggtggctgtga

SEQ ID NO: 4255 - protein, 335 aa, Rhizobium loti; identical to SEQ ID NO: 134

SEQ ID NO: 4256 - DNA, 1095 bp, Rhizobium loti
  CDS (1)..(1095)
atggcaaaggccgatgcggtgaagaggcgggcgccggcgaagacgaggcggccgcccgtcggcgcctcgccgggcacgctgatcgccgatccggcggcgcggcgcagtgagctcaggctgacgctgatttcgcccgaaaaattcaagaccatcgacaatgccagcatcgatgatctcaatgtccattgcgaccgctggccggtcgtctggctggattgcaccgggctcgccaacatcccgctgatcgaggagatcggccggatcttcaacctgcatccgctggccctggaggatgtcgtcaacaccgaccagcgaccgaaggtcgatttcttcgaggaccacgccttcgtcgtcgtgcgcatgatcgacgatgtcacagctcatcgctacgagcagatcgccgtgttcttcggtaagaatttcgtcgtcactttccaggaacgcgagggagatccgttcgacccggtacgcaagcgtatcgggagttcggcgcccaaccgcctgcgcacacgcggcgccgactatctggcctacgcgctgatcgacgccatcgtcgacagctattttccgccggtcgaggcggccggcgaccaggtcgacggcatcgaggacgagatgctgcattcgacgcacaagcatcagatgcggcaactgcacgaattgcggcgcgacgccaatgtgctgaagggcgtgctgtggccgatgcgcgatgcgctggcgacgctgatccgcaacgacgtgccctatgtcaaagccgagaccaaggttttcctcaatgacacactcgaccattcgctcaggctgatcgagctggttgagacccagcgcgacatgctgaccgggctgatcgagatgcatctgtcgctgagccaggcgcgcaccaacgacgtcatcagctatctcaccatcgtctcggtcatcttcatgccgctcaccttcctggtcggcgtctggggcatgaatttcagtcccgatgcctcgccatggaacatgccggaactgcgatcttactatggttatccggcggcgctcgtcttcatgctgcttgtcgcgatcggcctgattgccttcttcaaatggaaaaaatggctttga

SEQ ID NO: 4257 - protein, 364 aa, Rhizobium loti; identical to SEQ ID NO: 132

SEQ ID NO: 4258 - DNA, 1116 bp, Streptomyces coelicolor
  CDS (1)..(1116)
atgtcgatgatccgtgacctgcgcgccgcggtccgcccgtcccgcgtctcgctgcgcaaggacggcggtgcctacgacaccacccgtgacccggcgacggcctccgccgtcgtcgactgcgccgtctaccacgacggcacccgcgtcgagacggacgtgccgctgaccccgcacacggcgatgcgccaggtgcgtcgcgacggcgggttcgtgtggatcggcctgcacgagcccaccgaggacgagttcgccggtatcgcccgggagttcgggctgcacccgctggccgtggaggacgccgtccaggcccaccagcggcccaagctggagcgctacgacgactccctgttcacggtcttcaagaccgtccactacgtcgaccacgaccagctcaccgccaacagcgaggtcgtcgagaccggcgaggtcatgtgcttcaccggccgggacttcttcatcaccgtccggcacggcgggcagggctcgctgcgtgcgctgcgccgccgcctccaggaggacccggagctgctgctcaagggcccctccgcggtgctgcacgccatcgccgaccacgtcgtcgacggctacatcgcggtcgccgacgcggtgcaggacgacatcgacgaggtcgagacggaggtgttctcgccggggcgcaagggctccccgcgcggcacggacgccgggcggatctaccagctcaagcgcgaggtgctggagttcaagcgggcggtggcgccgctgctgcgtcccatgcagctgctcagcgagcggccgatgcggctggtcgacccggagatccagaagtacttccgggacgtggccgaccacgtggcccgagtgcaggagcaggtcatcgggttcgacgaactgctgaactccattctccaggccaacctcgcccaggcgtccgtggcgcagaacgaggacatgcgcaagatcacctcgtgggccgcgatcatcgccgtacccacgatggtgtgcggggtctacggcatgaacttcgactacatgccggagacgcactggaagttcggctacccgctggtcctgtcggtcacggtctgcatctgtctgggcatccaccgcaccctcaagcgcaacggctggctctga

SEQ ID NO: 4259 - protein, 371 aa, Streptomyces coelicolor; identical to SEQ ID NO: 142

SEQ ID NO: 4260 - DNA, 2910 bp, Saccharomyces cerevisiae; identical to SEQ ID NO: 109
  CDS (1)..(2910)

SEQ ID NO: 4261 - protein, 969 aa, Saccharomyces cerevisiae; identical to SEQ ID NO: 110

SEQ ID NO: 4262 - DNA, 2580 bp, Saccharomyces cerevisiae
  CDS (1)..(2580)
atgtcatcatcctcaagttcatcagagtcatcgccttatttatcgcggtcaaactcactggctaacacgatggtttccatgaaaacagaagaccatacgggattgtacgaccataggcagcaccctgactcactgccggtccgtcaccaacctccaacattgaagaacaaggaaattgctaagtccactaaaccttctattcctaaggagcagaagagtgcaacgagatacaacagccatgtggatgtgggaagcgtacccagtaggggccgcatggattttgaagatgaagggcagggtatggatgaaacggttgctcatcatcaattgagggcatctgccattttaacttctaacgcgaggccttccagactagcccactccatgccacatcaaaggcagctttatgtggaaagtaatatacacacaccaccaaaggatgtaggtgtaaagagagactatactatgtcatcttctactgcatcatcaggtaacaaatccaagctgagcgcatcttcctcggcaagtcctattacgaaggttagaaaatcttcgctggtcagtcctgttcttgagatcccacacgaatcgaaatctgatacacactccaagctggctaaacccaagaagaggacatattctaccacatctgcgcattcatctatcaatcccgcagttttactgacgaaaagcacatcccaaaaatcggatgcagatgatgatacattggaaagaaaaccagtacgtatgaatactagagcttcttttgatagtgacgtatcacaggcgtcgagagattctcaagagacggaagaagatgtttgtttccctatgccaccacaattgcataccagagttaacggtatagatttcgatgaactggaagagtacgctcagtttgcaaacgcggagaagagtcaatttttggcaagtctgcaagtgcccaacgaacagaagtacagtaacgtttctcaggatatcgggtttaccagctctacttccacttcgggatcatcagctgccctaaaatatacaccaagagtttcgcagactggtgaaaagagcgagagtaccaatgaaacagaaatccatgaaaagaaggaagacgagcatgagaaaatcaagcctagtttacaccctggtatatctttcggtaaaaataaagttgaaggggaagagaatgaaaacattccatccaatgacccggcgtattgctcttaccagggtacagactttcaaattcctaatagattttcttttttctgttccgaatctgatgaaaccgttcatgctagtgatatcccttccttagtgtctgagggacaaacattctatgaattattcaggggaggtgagccaacatggtggttagattgtagttgtccaactgatgatgaaatgcgttgcatagcaaaggcgtttggtatccatccattgactgcagaagatatcagaatgcaagaaacacgtgaaaaggtggaacttttcaaatcgtattacttcgtttgtttccatacctttgaaaatgataaagaatcagaggatttcctggaacctattaacgtttacattgttgtctgtaggtcaggtgttttaacattccattttggcccaatatctcattgtgctaatgtcagaaggcgtgtaagacagttacgtgactatgtcaatgtcaattcagattggttatgttatgctttaatcgatgacattactgatagtttcgctcctgtaattcaatctattgaatatgaagcagatgcaatcgaagattctgtgttcatggctcgtgacatggattttgcagcaatgttacaaagaattggtgaaagtaggcgtaagacaatgacgttgatgagacttcttagtggtaaggctgatgttatcaaaatgtttgccaaaagatgccaagatgaagctaatggtattggaccggcactaacatctcaaataaatattgctaacttacaggcaaggcaggataacgccagtcatatcaaaaataatagttcgacaactgtaccaaataattatgcgcccaccacatcacaaccgaggggggatatcgccctatacttgggtgatattcaagatcatttgttgacaatgtttcaaaatttgctggcgtacgaaaaaattttttctagatcccatacaaactacttagctcaactgcaagtggaatcatttaattctaataataaagtgacagaaatgttgggtaaagtcaccatgataggtacaatgctagttccattaaatgttatcactggtcttttcggtatgaatgttaaagttccgggggagaattccagtatcgcgtggtggtttgggatattgggtgtgctgcttttgctggccgtccttggttggttcttggccagctattggattaaaagaatagaccctcctgcaacacttaacgaggccgctgaaagtggagccaaatcggttatttcgagcttcttgccaaaaagaaacaagagattcaatgatcgttccaaaaatataaatgtaagagccggtccttcaaacaaatcagttgcaagtcttcctagtagatatagccgctacgactga

SEQ ID NO: 4263 - protein, 859 aa, Saccharomyces cerevisiae
MSSSSSSSESSPYLSRSNSLANTMVSMKTEDHTGLYDHRQHPDSLPVRHQPPTLKNKEIAKSTKPSIPKEQKSATRYNSHVDVGSVPSRGRMDFEDEGQGMDETVAHHQLRASAILTSNARPSRLAHSMPHQRQLYVESNIHTPPKDVGVKRDYTMSSSTASSGNKSKLSASSSASPITKVRKSSLVSPVLEIPHESKSDTHSKLAKPKKRTYSTTSAHSSINPAVLLTKSTSQKSDADDDTLERKPVRMNTRASFDSDVSQASRDSQETEEDVCFPMPPQLHTRVNGIDFDELEEYAQFANAEKSQFLASLQVPNEQKYSNVSQDIGFTSSTSTSGSSAALKYTPRVSQTGEKSESTNETEIHEKKEDEHEKIKPSLHPGISFGKNKVEGEENENIPSNDPAYCSYQGTDFQIPNRFSFFCSESDETVHASDIPSLVSEGQTFYELFRGGEPTWWLDCSCPTDDEMRCIAKAFGIHPLTAEDIRMQETREKVELFKSYYFVCFHTFENDKESEDFLEPINVYIVVCRSGVLTFHFGPISHCANVRRRVRQLRDYVNVNSDWLCYALIDDITDSFAPVIQSIEYEADAIEDSVFMARDMDFAAMLQRIGESRRKTMTLMRLLSGKADVIKMFAKRCQDEANGIGPALTSQINIANLQARQDNASHIKNNSSTTVPNNYAPTTSQPRGDIALYLGDIQDHLLTMFQNLLAYEKIFSRSHTNYLAQLQVESFNSNNKVTEMLGKVTMIGTMLVPLNVITGLFGMNVKVPGENSSIAWWFGILGVLLLLAVLGWFLASYWIKRIDPPATLNEAAESGAKSVISSFLPKRNKRFNDRSKNINVRAGPSNKSVASLPSRYSRYD

SEQ ID NO: 4264 - DNA, 1164 bp, Synechocystis sp
  CDS (1)..(1164)
atgccccaaacccaacccggcattgaggattttctcctgcgccaactgcgtcatccccaagaagaagaggaagaagaagattattttgactacttctatgacgagccgggtagtgaaccgggtaccctcagcattgaacccgatgcgcccccttcccgcattgtgttggtggattatagccccagccatgccgtgcgaaagtcggatattagtcccaatgccctgagaccttatttaggtacaaatactgtttcttggatggatattgaaggtttaggcagtgaagaagtgcttaaggaagtgggggaaatttttaaattacaccccctacttttagaagatattgttaacgtcccccagcgagcaaaggtagaagattataacgaccatgtgatggttattgcccatcgggtgcgtcctaatcgggaagaagatggctttgaaagtgagcaggttagttttgtgttgggcaaacgttacctattaactttccaggaagggcacattattgattgttttaatcccctaagggaaagaattcgcaccaatcaaggtaaagtttgccaacaaggagcggattatctttgctatttgttaattgatatgttaattgatgaatattttcccctcttggaagattatgaagaacgcattgaagccctagaagacaccattattcgtaatcccaacagctcattaatggaggaaatttaccatattcgccgggaacttttagccctgagaaggttgatttggcccctgcgccatgtgatgaatgtgctgctgcgggacaccaccaattccatcgtaacagcagacgtaagaatttactttcgagattgctacgatcacattattcaggtgttagatattatcgaagcttaccgggaattagcttctagtttaatggaggtttatatgactgccatgagcaataaaatgaatgaagtaatgaaatttttgaccgtcatttctaccatttttattcccctaacttttattgccggggtttacggtatgaacttcaaagaaatgccagaactaaacagccgctggggctactatattacttggatagtgatgctcttaattgccggaggatccctctatttcttctggcgtaagggctggcttagtccctcctatgatttgggagaaaagtag

SEQ ID NO: 4265 - protein, 387 aa, Synechocystis sp; identical to SEQ ID NO: 88

SEQ ID NO: 4266 - DNA, 1143 bp, Synechocystis sp; identical to SEQ ID NO: 89
  CDS (1)..(1143)

SEQ ID NO: 4267 - protein, 380 aa, Synechocystis sp; identical to SEQ ID NO: 90

SEQ ID NO: 4268 - DNA, 2412 bp, Schizosaccharomyces pombe; identical to SEQ ID NO: 107
  CDS (1)..(2412)

SEQ ID NO: 4269 - protein, 803 aa, Schizosaccharomyces pombe; identical to SEQ ID NO: 108

SEQ ID NO: 4270 - DNA, 1122 bp, Mycobacterium leprae
  CDS (1)..(1122)
atgggggttgagatgttcccggggtttgacccgttacctgaagcgctgaggccggtcacgaagccccgactgtacacgcctcacgtacatcccattttccccccgctcaccgagcccttggtcgactgcggcgtctatgtcggaggccatcggctacccgacaaatacacaacgtacaccgccgcgctgagcagggtgcgcgagatcgaactgatggggaacgagggattcgtctggatcgggttacacgagcctgaagcaagccacatgcataacgtcgccgacgttttcgggctacaccccttggcagtcgaggacgccgtgcacgcccatcagcggcccaagttggaacgctacgacgacacgttgtttctggtcctcaagaccgtcaattatgtaccgcacgaatcggtggtgctggcccgccagatcgtcgaaaccggcgaggtgatgatcttcgtcggcaagaatttcgtggtcacggtccgccacggcgagcatggtgagctgtccgaggtgcgtaagcgaatggataccgaccccgagcatctgcggctgggctcgtacgctgtgatgcatgccatctcggactacgtggtagaccgctatttagcggtgaccaatctgatggaaggcgatatcgacgccatcgaggaagtggcgtttgctcccggccgcaagctcaacgtcgagccgatttacctactcaagcgcgaggtcatcgaacttcgccgctgtgttgccccgctctccgccgcactccagcgaatgcaaacggataacaaagacttaatctccaaagaattgcgccgctacctgcgtgacgtagctgaccaccagaccgaggccgcagatcaaatagccagctatgacgacatgctcaattcactagtacaggccgcattggctcgtgtcgggatgcagcagaacaacgatatgcgcaagatggcggcctgggccggcatcgtggcgatgcccactatggtcgccgccatctacggtatgaacttccgtttcatgcccgagctgaactggacgtggagttacccgctggtaatggccggaatgaccattgtctgcctggttctttactggcaattccgaaacaggaactggctgtag

SEQ ID NO: 4271 - protein, 373 aa, Mycobacterium leprae; identical to SEQ ID NO: 98

SEQ ID NO: 4272 - DNA, 25 bp, Primer
atgtcgtccttatccacttcatttg

SEQ ID NO: 4273 - DNA, 26 bp, Primer
ttaattgtaacggctatatctactgg

SEQ ID NO: 4274 - DNA, 924 bp, Saccharomyces cerevisiae; identical to SEQ ID NO: 736
  CDS (1)..(924)

SEQ ID NO: 4275 - protein, 307 aa, Saccharomyces cerevisiae; identical to SEQ ID NO: 737

SEQ ID NO: 4276 - DNA, 25 bp, Primer
atggttcagcaactaagcctttttg

SEQ ID NO: 4277 - DNA, 27 bp, Primer
ttatattagaatatttccatgtgctac

SEQ ID NO: 4278 - DNA, 264 bp, Saccharomyces cerevisiae; identical to SEQ ID NO: 172
  CDS (1)..(264)

SEQ ID NO: 4279 - protein, 87 aa, Saccharomyces cerevisiae; identical to SEQ ID NO: 173

SEQ ID NO: 4280 - DNA, 258 bp, Pectinaria gouldii; identical to SEQ ID NO: 1023
  CDS (1)..(258)

SEQ ID NO: 4281 - protein, 85 aa, Pectinaria gouldii; identical to SEQ ID NO: 217

SEQ ID NO: 4282 - DNA, 264 bp, Schizosaccharomyces pombe; identical to SEQ ID NO: 178
  CDS (1)..(264)

SEQ ID NO: 4283 - protein, 87 aa, Schizosaccharomyces pombe; identical to SEQ ID NO: 179

SEQ ID NO: 4284 - DNA, 249 bp, Guillardia theta nucleomorph; identical to SEQ ID NO: 1027
  CDS (1)..(249)

SEQ ID NO: 4285 - protein, 82 aa, Guillardia theta nucleomorph; identical to SEQ ID NO: 189

SEQ ID NO: 4286 - DNA, 252 bp, Drosophila melanogaster; identical to SEQ ID NO: 194
  CDS (1)..(252)

SEQ ID NO: 4287 - protein, 83 aa, Drosophila melanogaster [sequence omitted]

SEQ ID NO: 4288 - DNA, 246 bp, Anopheles gambiae; identical to SEQ ID NO: 1031
  CDS (1)..(243)

SEQ ID NO: 4289 - protein, 80 aa, Anopheles gambiae; identical to SEQ ID NO: 207

SEQ ID NO: 4290 - DNA, 270 bp, Giardia lamblia; identical to SEQ ID NO: 204
  CDS (1)..(270)

SEQ ID NO: 4291 - protein, 89 aa, Giardia lamblia; identical to SEQ ID NO: 205

SEQ ID NO: 4292 - DNA, 249 bp, Oryza sativa; identical to SEQ ID NO: 1035
  CDS (1)..(249)

SEQ ID NO: 4293 - protein, 82 aa, Oryza sativa; identical to SEQ ID NO: 1036

SEQ ID NO: 4294 - DNA, 246 bp, Danio rerio; identical to SEQ ID NO: 214
  CDS (1)..(246)

SEQ ID NO: 4295 - protein, 81 aa, Danio rerio; identical to SEQ ID NO: 215

SEQ ID NO: 4296 - DNA, 258 bp, Branchiostoma belcheri tsingtaunese; identical to SEQ ID NO: 1039
  CDS (1)..(258)

SEQ ID NO: 4297 - protein, 85 aa, Branchiostoma belcheri tsingtaunese; identical to SEQ ID NO: 203

SEQ ID NO: 4298 - DNA, 252 bp, Ceratitis capitata; identical to SEQ ID NO: 200
  CDS (1)..(252)

SEQ ID NO: 4299 - protein, 83 aa, Ceratitis capitata; identical to SEQ ID NO: 201

SEQ ID NO: 4300 - DNA, 249 bp, Plasmodium falciparum; identical to SEQ ID NO: 198
  CDS (1)..(249)

SEQ ID NO: 4301 - protein, 82 aa, Plasmodium falciparum; identical to SEQ ID NO: 199

SEQ ID NO: 4302 - DNA, 249 bp, Arabidopsis thaliana; identical to SEQ ID NO: 208
  CDS (1)..(249)

SEQ ID NO: 4303 - protein, 82 aa, Arabidopsis thaliana; identical to SEQ ID NO: 209

SEQ ID NO: 4304 - DNA, 252 bp, Ictalurus punctatus; identical to SEQ ID NO: 212
  CDS (1)..(252)

SEQ ID NO: 4305 - protein, 83 aa, Ictalurus punctatus; identical to SEQ ID NO: 213

SEQ ID NO: 4306 - DNA, 252 bp, Spodoptera frugiperda; identical to SEQ ID NO: 1049
  CDS (1)..(252)

SEQ ID NO: 4307 - protein, 83 aa, Spodoptera frugiperda; identical to SEQ ID NO: 197

SEQ ID NO: 4308 - DNA, 273 bp, Homo sapiens; identical to SEQ ID NO: 1051
  CDS (1)..(273)

SEQ ID NO: 4309 - protein, 90 aa, Homo sapiens; identical to SEQ ID NO: 193

SEQ ID NO: 4310 - DNA, 201 bp, Homo sapiens; identical to SEQ ID NO: 1053
  CDS (1)..(201)

SEQ ID NO: 4311 - protein, 66 aa, Homo sapiens; identical to SEQ ID NO: 191

SEQ ID NO: 4312 - DNA, 252 bp, Rattus norvegicus; identical to SEQ ID NO: 1055
  CDS (1)..(252)

SEQ ID NO: 4313 - protein, 83 aa, Rattus norvegicus; identical to SEQ ID NO: 177

SEQ ID NO: 4314 - DNA, 267 bp, Caenorhabditis elegans; identical to SEQ ID NO: 1057
  CDS (1)..(267)

SEQ ID NO: 4315 - protein, 88 aa, Caenorhabditis elegans; identical to SEQ ID NO: 219

SEQ ID NO: 4316 - DNA, 264 bp, Candida albicans; identical to SEQ ID NO: 220
  CDS (1)..(264)

SEQ ID NO: 4317 - protein, 87 aa, Candida albicans; identical to SEQ ID NO: 221

SEQ ID NO: 4318 - DNA, 332 bp, Cyanophora paradoxa; identical to SEQ ID NO: 1061
  CDS (1)..(249)

SEQ ID NO: 4319 - protein, 82 aa, Cyanophora paradoxa; identical to SEQ ID NO: 223

SEQ ID NO: 4320 - DNA, 252 bp, Mus musculus; identical to SEQ ID NO: 1063
  CDS (1)..(252)

SEQ ID NO: 4321 - protein, 83 aa, Mus musculus; identical to SEQ ID NO: 225

SEQ ID NO: 4322 - DNA, 264 bp, Neurospora crassa; identical to SEQ ID NO: 226
  CDS (1)..(264)

SEQ ID NO: 4323 - protein, 87 aa, Neurospora crassa; identical to SEQ ID NO: 227

SEQ ID NO: 4324 - DNA, 252 bp, Homo sapiens; identical to SEQ ID NO: 1067
  CDS (1)..(252)

SEQ ID NO: 4325 - protein, 83 aa, Homo sapiens; identical to SEQ ID NO: 181

SEQ ID NO: 4326 - DNA, 294 bp, Homo sapiens; identical to SEQ ID NO: 182
  CDS (1)..(294)

SEQ ID NO: 4327 - protein, 97 aa, Homo sapiens; identical to SEQ ID NO: 183

SEQ ID NO: 4328 - DNA, 246 bp, Zea mays; identical to SEQ ID NO: 184
  CDS (1)..(246)

SEQ ID NO: 4329 - protein, 81 aa, Zea mays; identical to SEQ ID NO: 185

SEQ ID NO: 4330 - DNA, 264 bp, Schizosaccharomyces pombe; identical to SEQ ID NO: 178
  CDS (1)..(264)

SEQ ID NO: 4331 - protein, 87 aa, Schizosaccharomyces pombe; identical to SEQ ID NO: 179

SEQ ID NO: 4332 - DNA, 25 bp, Primer
atggaaaacgataagggccaattag

SEQ ID NO: 4333 - DNA, 24 bp, Primer
ttaacgtgagtaagaccagacgtt

SEQ ID NO: 4334 - protein, 194 aa, Artificial
  consensus
  misc_feature (1)..(1): Xaa can be Ile or Val or Met
  misc_feature (2)..(2): Xaa can be Phe or Tyr or Leu
  misc_feature (3)..(3): Xaa can be any naturally occurring amino acid
  misc_feature (5)..(7): Xaa can be any naturally occurring amino acid
  misc_feature (13)..(13): Xaa can be Tyr or Phe or Trp
  misc_feature (14)..(14): Xaa can be any naturally occurring amino acid
  misc_feature (17)..(18): Xaa can be any naturally occurring amino acid
  misc_feature (19)..(19): Xaa can be Ala or Gly
  misc_feature (20)..(25): Xaa can be any naturally occurring amino acid
  misc_feature (26)..(26): Xaa can be Gly or Asn
  misc_feature (27)..(29): Xaa can be any naturally occurring amino acid
  misc_feature (30)..(30): Xaa can be Val or Leu or Met or Lys or Arg
  misc_feature (31)..(31): Xaa can be any naturally occurring amino acid
  misc_feature (32)..(32): Xaa can be Gly or Ala
  misc_feature (33)..(33): Xaa can be any naturally occurring amino acid
  misc_feature (34)..(34): Xaa can be Val or Ile or Ala
  misc_feature (36)..(36): Xaa can be any naturally occurring amino acid
  misc_feature (38)..(38): Xaa can be any naturally occurring amino acid
  misc_feature (40)..(41): Xaa can be any naturally occurring amino acid
  misc_feature (43)..(44): Xaa can be any naturally occurring amino acid
  misc_feature (45)..(45): Xaa can be Leu or Met or Gln or Ala
  misc_feature (46)..(46): Xaa can be Leu or Val or Ala or Thr
  misc_feature (47)..(48): Xaa can be any naturally occurring amino acid
  misc_feature (49)..(49): Xaa can be Leu or Val or Met or Ile or Tyr
  misc_feature (50)..(51): Xaa can be any naturally occurring amino acid
  misc_feature (52)..(52): Xaa can be Leu or Ile or Val or Gln
  misc_feature (53)..(53): Xaa can be Pro or Ala or Ser or Thr
  misc_feature (54)..(58): Xaa can be any naturally occurring amino acid
  misc_feature (59)..(59): Xaa can be Tyr or His or Phe
  misc_feature (60)..(65): Xaa can be any naturally occurring amino acid
  misc_feature (66)..(66): Xaa can be Glu or Tyr or Val
  misc_feature (67)..(67): Xaa can be any naturally occurring amino acid
  misc_feature (68)..(68): Xaa can be Asp or Ala
  misc_feature (69)..(69): Xaa can be Leu or Ile or Val
  misc_feature (70)..(72): Xaa can be any naturally occurring amino acid
  misc_feature (73)..(73): Xaa can be any Leu or Ile or Val
  misc_feature (74)..(76): Xaa can be any naturally occurring amino acid
  misc_feature (77)..(77): Xaa can be any naturally occurring amino acid or can be omitted
  misc_feature (79)..(79): Xaa can be any naturally occurring amino acid
  misc_feature (80)..(80): Xaa can be Leu or Ile or Val
  misc_feature (81)..(81): Xaa can be any naturally occurring amino acid
  misc_feature (82)..(82): Xaa can be Leu or Ile
  misc_feature (83)..(83): Xaa can be Val or Ile or Leu or Met
  misc_feature (86)..(86): Xaa can be Leu or Phe or Tyr
  misc_feature (88)..(88): Xaa can be His or Phe
  misc_feature (89)..(89): Xaa can be Tyr or Ser or Arg
  misc_feature (91)..(94): Xaa can be any naturally occurring amino acid
  misc_feature (95)..(95): Xaa can be Arg or Lys
  misc_feature (96)..(97): Xaa can be any naturally occurring amino acid
  misc_feature (98)..(98): Xaa can be Lys or Arg
  misc_feature (100)..(100): Xaa can be Trp or Tyr or Phe
  misc_feature (101)..(101): Xaa can be any naturally occurring amino acid
  misc_feature (103)..(103): Xaa can be Val or Ile or Thr
  misc_feature (104)..(104): Xaa can be any naturally occurring amino acid
  misc_feature (105)..(105): Xaa can be Glu or Ala or Asp
  misc_feature (106)..(106): Xaa can be Leu or Ile
  misc_feature (107)..(107): Xaa can be Leu or Val
  misc_feature (108)..(109): Xaa can be any naturally occurring amino acid
  misc_feature (110)..(110): Xaa can be Gly or Ser
  misc_feature (112)..(112): Xaa can be any naturally occurring amino acid
  misc_feature (114)..(114): Xaa can be any naturally occurring amino acid
  misc_feature (115)..(115): Xaa can be Tyr or Ser
  misc_feature (116)..(116): Xaa can be Tyr or Ala
  misc_feature (117)..(117): Xaa can be Val or Leu
  misc_feature (119)..(119): Xaa can be Val or Ile
  misc_feature (122)..(122): Xaa can be Leu or Ile or Val or Thr or Phe
  misc_feature (123)..(123): Xaa can be Glu or Asp
  misc_feature (124)..(124): Xaa can be Ser or Gly
  misc_feature (125)..(125): Xaa can be Leu or Gln
  misc_feature (126)..(126): Xaa can be any naturally occurring amino acid
  misc_feature (127)..(127): Xaa can be Asp or Glu or Ser or Gly
  misc_feature (128)..(128): Xaa can be any naturally occurring amino acid
  misc_feature (129)..(129): Xaa can be Val or Ile
  misc_feature (130)..(131): Xaa can be any naturally occurring amino acid
  misc_feature (132)..(132): Xaa can be Ile or Met or Val or Asn
  misc_feature (133)..(133): Xaa can be Thr or Ala
  misc_feature (134)..(134): Xaa can be any naturally occurring amino acid
  misc_feature (135)..(135): Xaa can be Val or Ile or Ala
  misc_feature (136)..(138): Xaa can be any naturally occurring amino acid
  misc_feature (140)..(140): Xaa can be any naturally occurring amino acid
  misc_feature (141)..(141): Xaa can be Val or Leu or Ile
  misc_feature (144)..(148): Xaa can be any naturally occurring amino acid
  misc_feature (149)..(149): Xaa can be Ala or Leu
  misc_feature (150)..(150): Xaa can be any naturally occurring amino acid
  misc_feature (151)..(151): Xaa can be any naturally occurring amino acid or can be omitted
  misc_feature (152)..(152): Xaa can be Ile or Leu or Val
  misc_feature (153)..(153): Xaa can be any naturally occurring amino acid
  misc_feature (154)..(154): Xaa can be Leu or Ile or Val
  misc_feature (155)..(155): Xaa can be Val or Ile
  misc_feature (157)..(157): Xaa can be Leu or Ile or Val or Met
  misc_feature (158)..(158): Xaa can be any naturally occurring amino acid
  misc_feature (159)..(159): Xaa can be Pro or Ala
  misc_feature (160)..(161): Xaa can be any naturally occurring amino acid
  misc_feature (162)..(162): Xaa can be Leu or Ala
  misc_feature (163)..(163): Xaa can be any naturally occurring amino acid
  misc_feature (164)..(164): Xaa can be any naturally occurring amino acid or can be omitted
  misc_feature (165)..(165): Xaa can be Arg or Ala
  misc_feature (166)..(166): Xaa can be Leu or Met or Phe
  misc_feature (167)..(168): Xaa can be any naturally occurring amino acid
  misc_feature (170)..(170): Xaa can be any naturally occurring amino acid
  misc_feature (171)..(171): Xaa can be Val or Ile
  misc_feature (173)..(179): Xaa can be any naturally occurring amino acid
  misc_feature (181)..(183): Xaa can be any naturally occurring amino acid
  misc_feature (184)..(184): Xaa can be Phe or Tyr
  misc_feature (186)..(188): Xaa can be any naturally occurring amino acid
  misc_feature (189)..(189): Xaa can be Asn or His or Lys
  misc_feature (191)..(192): Xaa can be any naturally occurring amino acid
XXXGXXXGVGKTXXMLXXXXXXXXXXXXXXXXXXEXHXRXXTXXXXXXXXXXXXXXXXXXXXXXXXXXXXXXXXXXXPXXXXXDEXAXXNXXXXXXXXRXXDXXXXXXXXIXVXXXXNXQHXXXXXXXXXXXXXXXXXEXXPDXXXXXXXXXXXXDXXXXXXXXXXXXGXXYXXXXXXXAXXXXFXXXXLXXLR

SEQ ID NO: 4335 - protein, 61 aa, Artificial
  consensus
  misc_feature (1)..(1): Xaa can be Leu or Ile or Val or Phe
  misc_feature (2)..(2): Xaa can be Leu or Met or Phe
  misc_feature (3)..(3): Xaa can be any naturally occurring amino acid
  misc_feature (4)..(4): Xaa can be Ser or Ala or Val
  misc_feature (5)..(5): Xaa can be Val or Ile or Leu
  misc_feature (8)..(8): Xaa can be Asp or Glu
  misc_feature (9)..(9): Xaa can be Leu or Ile
  misc_feature (10)..(10): Xaa can be Arg or Lys
  misc_feature (11)..(11): Xaa can be Thr or Ser or Arg
  misc_feature (13)..(13): Xaa can be Leu or Phe
  misc_feature (14)..(22): Xaa can be any naturally occurring amino acid
  misc_feature (23)..(23): Xaa can be Leu or Met or Ile
  misc_feature (24)..(50): Xaa can be any naturally occurring amino acid
  misc_feature (51)..(52): Xaa can be any naturally occurring amino acid or can be omitted
  misc_feature (53)..(53): Xaa can be Val or Ile
  misc_feature (54)..(54): Xaa can be any naturally occurring amino acid
  misc_feature (55)..(55): Xaa can be Asn or Asp
  misc_feature (56)..(56): Xaa can be Leu or Ile
  misc_feature (58)..(60): Xaa can be any naturally occurring amino acid
  misc_feature (61)..(61): Xaa can be Arg or Lys
XXXXXSHXXXXPXXXXXXXXXXXXXXXXXXXXXXXXXXXXXXXXXXXXXXXXXXXXLXXXX

SEQ ID NO: 4336 - protein, 15 aa, Artificial
  consensus
  misc_feature (2)..(5): Xaa can be any naturally occurring amino acid
  misc_feature (6)..(6): Xaa can be Leu or Ile or Phe
  misc_feature (7)..(7): Xaa can be any naturally occurring amino acid
  misc_feature (9)..(9): Xaa can be Leu or Val or Ile
  misc_feature (10..(10): Xaa can be Leu or Ile or Val or Met
  misc_feature (11)..(11): Xaa can be Glu or Asp or Ala or Phe
  misc_feature (14)..(14): Xaa can be any naturally occurring amino acid
  misc_feature (15)..(15): Xaa can be Lys or Arg or Ala or Gln
LXXXXXXNXXXNAXX

SEQ ID NO: 4337 - protein, 998 aa, Artificial
  consensus
  misc_feature (1)..(43): Xaa can be any naturally occurring amino acid
  misc_feature (45)..(45): Xaa can be any naturally occurring amino acid
  misc_feature (47)..(50): Xaa can be any naturally occurring amino acid
  misc_feature (52)..(54): Xaa can be any naturally occurring amino acid
  misc_feature (60)..(61): Xaa can be any naturally occurring amino acid
  misc_feature (64)..(65): Xaa can be any naturally occurring amino acid
  misc_feature (67)..(72): Xaa can be any naturally occurring amino acid
  misc_feature (74)..(74): Xaa can be any naturally occurring amino acid
  misc_feature (76)..(78): Xaa can be any naturally occurring amino acid
  misc_feature (80)..(81): Xaa can be any naturally occurring amino acid
  misc_feature (83)..(83): Xaa can be any naturally occurring amino acid
  misc_feature (85)..(85): Xaa can be any naturally occurring amino acid
  misc_feature (87)..(88): Xaa can be any naturally occurring amino acid
  misc_feature (90)..(91): Xaa can be any naturally occurring amino acid
  misc_feature (93)..(94): Xaa can be any naturally occurring amino acid
  misc_feature (96)..(99): Xaa can be any naturally occurring amino acid
  misc_feature (101)..(112): Xaa can be any naturally occurring amino acid
  misc_feature (114)..(114): Xaa can be any naturally occurring amino acid
  misc_feature (116)..(116): Xaa can be any naturally occurring amino acid
  misc_feature (118)..(124): Xaa can be any naturally occurring amino acid
  misc_feature (126)..(128): Xaa can be any naturally occurring amino acid
  misc_feature (130)..(130): Xaa can be any naturally occurring amino acid
  misc_feature (136)..(136): Xaa can be any naturally occurring amino acid
  misc_feature (138)..(141): Xaa can be any naturally occurring amino acid
  misc_feature (143)..(144): Xaa can be any naturally occurring amino acid
  misc_feature (147)..(148): Xaa can be any naturally occurring amino acid
  misc_feature (150)..(151): Xaa can be any naturally occurring amino acid
  misc_feature (153)..(153): Xaa can be any naturally occurring amino acid
  misc_feature (155)..(156): Xaa can be any naturally occurring amino acid
  misc_feature (161)..(161): Xaa can be any naturally occurring amino acid
  misc_feature (164)..(164): Xaa can be any naturally occurring amino acid
  misc_feature (166)..(166): Xaa can be any naturally occurring amino acid
  misc_feature (169)..(169): Xaa can be any naturally occurring amino acid
  misc_feature (173)..(173): Xaa can be any naturally occurring amino acid
  misc_feature (175)..(175): Xaa can be any naturally occurring amino acid
  misc_feature (177)..(179): Xaa can be any naturally occurring amino acid
  misc_feature (181)..(185): Xaa can be any naturally occurring amino acid
  misc_feature (188)..(188): Xaa can be any naturally occurring amino acid
  misc_feature (191)..(195): Xaa can be any naturally occurring amino acid
  misc_feature (197)..(200): Xaa can be any naturally occurring amino acid
  misc_feature (202)..(202): Xaa can be any naturally occurring amino acid
  misc_feature (204)..(205): Xaa can be any naturally occurring amino acid
  misc_feature (207)..(208): Xaa can be any naturally occurring amino acid
  misc_feature (210)..(211): Xaa can be any naturally occurring amino acid
  misc_feature (214)..(215): Xaa can be any naturally occurring amino acid
  misc_feature (217)..(217): Xaa can be any naturally occurring amino acid
  misc_feature (220)..(226): Xaa can be any naturally occurring amino acid
  misc_feature (228)..(231): Xaa can be any naturally occurring amino acid
  misc_feature (233)..(235): Xaa can be any naturally occurring amino acid
  misc_feature (238)..(238): Xaa can be any naturally occurring amino acid
  misc_feature (245)..(248): Xaa can be any naturally occurring amino acid
  misc_feature (250)..(251): Xaa can be any naturally occurring amino acid
  misc_feature (253)..(289): Xaa can be any naturally occurring amino acid
  misc_feature (291)..(291): Xaa can be any naturally occurring amino acid
  misc_feature (293)..(293): Xaa can be any naturally occurring amino acid
  misc_feature (295)..(295): Xaa can be any naturally occurring amino acid
  misc_feature (297)..(330): Xaa can be any naturally occurring amino acid
  misc_feature (333)..(334): Xaa can be any naturally occurring amino acid
  misc_feature (337)..(367): Xaa can be any naturally occurring amino acid
  misc_feature (369)..(493): Xaa can be any naturally occurring amino acid
  misc_feature (495)..(521): Xaa can be any naturally occurring amino acid
  misc_feature (523)..(524): Xaa can be any naturally occurring amino acid
  misc_feature (526)..(552): Xaa can be any naturally occurring amino acid
  misc_feature (554)..(573): Xaa can be any naturally occurring amino acid
  misc_feature (575)..(644): Xaa can be any naturally occurring amino acid
  misc_feature (646)..(653): Xaa can be any naturally occurring amino acid
  misc_feature (655)..(658): Xaa can be any naturally occurring amino acid
  misc_feature (660)..(668): Xaa can be any naturally occurring amino acid
  misc_feature (670)..(698): Xaa can be any naturally occurring amino acid
  misc_feature (700)..(706): Xaa can be any naturally occurring amino acid
  misc_feature (708)..(708): Xaa can be any naturally occurring amino acid
  misc_feature (710)..(714): Xaa can be any naturally occurring amino acid
  misc_feature (716)..(739): Xaa can be any naturally occurring amino acid
  misc_feature (741)..(742): Xaa can be any naturally occurring amino acid
  misc_feature (745)..(747): Xaa can be any naturally occurring amino acid
  misc_feature (756)..(759): Xaa can be any naturally occurring amino acid
  misc_feature (761)..(764): Xaa can be any naturally occurring amino acid
  misc_feature (766)..(796): Xaa can be any naturally occurring amino acid
  misc_feature (801)..(824): Xaa can be any naturally occurring amino acid
  misc_feature (826)..(855): Xaa can be any naturally occurring amino acid
  misc_feature (857)..(858): Xaa can be any naturally occurring amino acid
  misc_feature (860)..(860): Xaa can be any naturally occurring amino acid
  misc_feature (862)..(865): Xaa can be any naturally occurring amino acid
  misc_feature (867)..(869): Xaa can be any naturally occurring amino acid
  misc_feature (872)..(902): Xaa can be any naturally occurring amino acid
  misc_feature (904)..(904): Xaa can be any naturally occurring amino acid
  misc_feature (906)..(906): Xaa can be any naturally occurring amino acid
  misc_feature (908)..(916): Xaa can be any naturally occurring amino acid
  misc_feature (918)..(919): Xaa can be any naturally occurring amino acid
  misc_feature (921)..(934): Xaa can be any naturally occurring amino acid
  misc_feature (936)..(936): Xaa can be any naturally occurring amino acid
  misc_feature (941)..(951): Xaa can be any naturally occurring amino acid
  misc_feature (953)..(964): Xaa can be any naturally occurring amino acid
  misc_feature (966)..(998): Xaa can be any naturally occurring amino acid
XXXXXXXXXXXXXXXXXXXXXXXXXXXXXXXXXXXXXXXXXXXGXLXXXXGXXXGVGKTXXMLXXAXXXXXXGXDXXXGXXEXHXRXXTXXLXXGXXXXPXXXXXXXXXXXXEXDXDXXXXXXXPXXXLXDELAHXNXXXXRXXKRXXDXXEXLXXGIDVXTTXNXQHXESLXDXVXXXTXXXXXETXPDXXXXXAXXXXLXDXXPXXLXXRLXXGXVYXXXXXXXAXXXXFXXXNLXALRELAXXXXAXXVXXXXXXXXXXXXXXXXXXXXXXXXXXXXXXXXXXXXXRXAXRXAXXXXXXXXXXXXXXXXXXXXXXXXXXXXXXXXXXLAXXLGXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXXXXXXXXXXXFXXPXXXXXXXXXXXXXXXXXXXXXXXXXXXLXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXWXXXXXXXXGXXXXTXXXXXXXXXPXXXXXXXXXXXXXXXXXXXXXXXXXXXXXLXXXXXXXAXAXXXXXLXXXXXXXXXXXXXXXXXXXXXXXXRXXLLXXXSHDLRTPLXXXXGXXXXLXXXXXXXXXXXXXXXXXXXXXXXXXXXXXXXNLLDXXXXXXXXXXXXXXXXXXXXXXXXAXXXXXXXXXXXXXXXXXXXXXXXXXXXXXXDXXLXEXXXXNXXXNAXXXXXXXXXXXXXXXXXXXXXXXXXXXXXXXDXGXGXXXXXXXXXFXXFXXXXXXXXXXXXXXGXGLGLXXXXXXXXXXXGXXXXXXXXXXXXGXXXXXXXXXXXXXXXXXXXXXXXXXXXXXXXXX

SEQ ID NO: 4338 - protein, 23 aa, Artificial
  consensus
  misc_feature (2)..(2): Xaa can be Arg or Ile or Val
  misc_feature (3)..(3): Xaa can be any naturally occurring amino acid
  misc_feature (5)..(11): Xaa can be any naturally occurring amino acid
  misc_feature (13)..(22): Xaa can be any naturally occurring amino acid
SXXTXXXXXXXLXXXXXXXXXXG

SEQ ID NO: 4339 - protein, 325 aa, Artificial; identical to SEQ ID NO: 512
  consensus
  misc_feature (1)..(77): Xaa can be any naturally occurring amino acid
  misc_feature (79)..(100): Xaa can be any naturally occurring amino acid
  misc_feature (102)..(102): Xaa can be any naturally occurring amino acid
  misc_feature (104)..(105): Xaa can be any naturally occurring amino acid
  misc_feature (107)..(112): Xaa can be any naturally occurring amino acid
  misc_feature (115)..(115): Xaa can be any naturally occurring amino acid
  misc_feature (117)..(119): Xaa can be any naturally occurring amino acid
  misc_feature (121)..(123): Xaa can be any naturally occurring amino acid
  misc_feature (125)..(127): Xaa can be any naturally occurring amino acid
  misc_feature (129)..(134): Xaa can be any naturally occurring amino acid
  misc_feature (136)..(136): Xaa can be any naturally occurring amino acid
  misc_feature (139)..(161): Xaa can be any naturally occurring amino acid
  misc_feature (163)..(190): Xaa can be any naturally occurring amino acid
  misc_feature (192)..(204): Xaa can be any naturally occurring amino acid
  misc_feature (206)..(206): Xaa can be any naturally occurring amino acid
  misc_feature (208)..(212): Xaa can be any naturally occurring amino acid
  misc_feature (214)..(216): Xaa can be any naturally occurring amino acid
  misc_feature (218)..(272): Xaa can be any naturally occurring amino acid
  misc_feature (274)..(298): Xaa can be any naturally occurring amino acid
  misc_feature (300)..(325): Xaa can be any naturally occurring amino acid

SEQ ID NO: 4340 - protein, 25 aa, Artificial
  consensus
  misc_feature (1)..(1): Xaa can be Ser or Thr or His
  misc_feature (2)..(3): Xaa can be any naturally occurring amino acid
  misc_feature (5)..(5): Xaa can be Ile or Val
  misc_feature (7)..(7): Xaa can be any naturally occurring amino acid
  misc_feature (8)..(8): Xaa can be Asp or Tyr
  misc_feature (9)..(9): Xaa can be Leu or Ile or Val
  misc_feature (10)..(11): Xaa can be any naturally occurring amino acid
  misc_feature (12)..(12): Xaa can be Leu or Met
  misc_feature (13)..(19): Xaa can be any naturally occurring amino acid
  misc_feature (20)..(20): Xaa can be Arg or Lys or Ser
  misc_feature (21)..(21): Xaa can be any naturally occurring amino acid
  misc_feature (22)..(22): Xaa can be His or Tyr or Ser
  misc_feature (24)..(24): Xaa can be any naturally occurring amino acid
  misc_feature (25)..(25): Xaa can be Ala or Val or Ile
XXXTXRXXXXXXXXXXXXXXXXGXX

SEQ ID NO: 4341 - protein, 359 aa, Artificial
  consensus
  misc_feature (1)..(18): Xaa can be any naturally occurring amino acid
  misc_feature (20)..(22): Xaa can be any naturally occurring amino acid
  misc_feature (24)..(37): Xaa can be any naturally occurring amino acid
  misc_feature (39)..(44): Xaa can be any naturally occurring amino acid
  misc_feature (46)..(47): Xaa can be any naturally occurring amino acid
  misc_feature (51)..(51): Xaa can be any naturally occurring amino acid
  misc_feature (54)..(55): Xaa can be any naturally occurring amino acid
  misc_feature (58)..(63): Xaa can be any naturally occurring amino acid
  misc_feature (65)..(65): Xaa can be any naturally occurring amino acid
  misc_feature (68)..(68): Xaa can be any naturally occurring amino acid
  misc_feature (70)..(97): Xaa can be any naturally occurring amino acid
  misc_feature (99)..(101): Xaa can be any naturally occurring amino acid
  misc_feature (103)..(104): Xaa can be any naturally occurring amino acid
  misc_feature (106)..(120): Xaa can be any naturally occurring amino acid
  misc_feature (122)..(122): Xaa can be any naturally occurring amino acid
  misc_feature (124)..(130): Xaa can be any naturally occurring amino acid
  misc_feature (132)..(143): Xaa can be any naturally occurring amino acid
  misc_feature (146)..(149): Xaa can be any naturally occurring amino acid
  misc_feature (151)..(152): Xaa can be any naturally occurring amino acid
  misc_feature (154)..(171): Xaa can be any naturally occurring amino acid
  misc_feature (174)..(183): Xaa can be any naturally occurring amino acid
  misc_feature (185)..(199): Xaa can be any naturally occurring amino acid
  misc_feature (201)..(204): Xaa can be any naturally occurring amino acid
  misc_feature (206)..(210): Xaa can be any naturally occurring amino acid
  misc_feature (212)..(237): Xaa can be any naturally occurring amino acid
  misc_feature (239)..(240): Xaa can be any naturally occurring amino acid
  misc_feature (242)..(359): Xaa can be any naturally occurring amino acid
XXXXXXXXXXXXXXXXXXRXXXIXXXXXXXXXXXXXXLXXXXXXSXXTIRXDLXXLEXXXXXXRXHGXAXXXXXXXXXXXXXXXXXXXXXXXXXXXXKXXXAXXAXXXXXXXXXXXXXXXGXTXXXXXXXLXXXXXXXXXXXXTNXXXXAXXLXXXXXXXXXXXXXXXXXXGGXXXXXXXXXXGXXXXXXXXXXXXXXXFXXXXGXXXXXGXXXXXXXXXXXXXXXXXXXXXXXXXXDXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 4342 - protein, 335 aa, Artificial; identical to SEQ ID NO: 1981
  consensus
  misc_feature (1)..(95): Xaa can be any naturally occurring amino acid
  misc_feature (97)..(102): Xaa can be any naturally occurring amino acid
  misc_feature (104)..(137): Xaa can be any naturally occurring amino acid
  misc_feature (139)..(144): Xaa can be any naturally occurring amino acid
  misc_feature (146)..(150): Xaa can be any naturally occurring amino acid
  misc_feature (152)..(184): Xaa can be any naturally occurring amino acid
  misc_feature (186)..(188): Xaa can be any naturally occurring amino acid
  misc_feature (190)..(195): Xaa can be any naturally occurring amino acid
  misc_feature (198)..(199): Xaa can be any naturally occurring amino acid
  misc_feature (201)..(222): Xaa can be any naturally occurring amino acid
  misc_feature (224)..(225): Xaa can be any naturally occurring amino acid
  misc_feature (227)..(232): Xaa can be any naturally occurring amino acid
  misc_feature (234)..(236): Xaa can be any naturally occurring amino acid
  misc_feature (238)..(240): Xaa can be any naturally occurring amino acid
  misc_feature (242)..(243): Xaa can be any naturally occurring amino acid
  misc_feature (245)..(252): Xaa can be any naturally occurring amino acid
  misc_feature (254)..(261): Xaa can be any naturally occurring amino acid
  misc_feature (263)..(263): Xaa can be any naturally occurring amino acid
  misc_feature (265)..(283): Xaa can be any naturally occurring amino acid
  misc_feature (285)..(335): Xaa can be any naturally occurring amino acid

SEQ ID NO: 4343 - protein, 136 aa, Artificial; identical to SEQ ID NO: 545
  consensus
  misc_feature (2)..(4): Xaa can be any naturally occurring amino acid
  misc_feature (6)..(8): Xaa can be any naturally occurring amino acid
  misc_feature (12)..(12): Xaa can be any naturally occurring amino acid
  misc_feature (14)..(16): Xaa can be any naturally occurring amino acid
  misc_feature (19)..(20): Xaa can be any naturally occurring amino acid
  misc_feature (23)..(24): Xaa can be any naturally occurring amino acid
  misc_feature (26)..(33): Xaa can be any naturally occurring amino acid
  misc_feature (35)..(36): Xaa can be any naturally occurring amino acid
  misc_feature (38)..(41): Xaa can be any naturally occurring amino acid
  misc_feature (43)..(43): Xaa can be any naturally occurring amino acid
  misc_feature (46)..(47): Xaa can be any naturally occurring amino acid
  misc_feature (49)..(51): Xaa can be any naturally occurring amino acid
  misc_feature (53)..(59): Xaa can be any naturally occurring amino acid
  misc_feature (62)..(63): Xaa can be any naturally occurring amino acid
  misc_feature (65)..(65): Xaa can be any naturally occurring amino acid
  misc_feature (67)..(71): Xaa can be any naturally occurring amino acid
  misc_feature (78)..(83): Xaa can be any naturally occurring amino acid
  misc_feature (85)..(85): Xaa can be any naturally occurring amino acid
  misc_feature (87)..(87): Xaa can be any naturally occurring amino acid
  misc_feature (93)..(94): Xaa can be any naturally occurring amino acid
  misc_feature (96)..(98): Xaa can be any naturally occurring amino acid
  misc_feature (104)..(105): Xaa can be any naturally occurring amino acid
  misc_feature (108)..(109): Xaa can be any naturally occurring amino acid
  misc_feature (111)..(112): Xaa can be any naturally occurring amino acid
  misc_feature (117)..(117): Xaa can be any naturally occurring amino acid
  misc_feature (120)..(120): Xaa can be any naturally occurring amino acid
  misc_feature (122)..(122): Xaa can be any naturally occurring amino acid
  misc_feature (126)..(126): Xaa can be any naturally occurring amino acid
  misc_feature (132)..(134): Xaa can be any naturally occurring amino acid
  misc_feature (136)..(136): Xaa can be any naturally occurring amino acid

SEQ ID NO: 4344 - protein, 46 aa, Artificial; identical to SEQ ID NO: 546
  consensus
  misc_feature (1)..(1): Xaa can be any naturally occurring amino acid
  misc_feature (3)..(5): Xaa can be any naturally occurring amino acid
  misc_feature (8)..(9): Xaa can be any naturally occurring amino acid
  misc_feature (11)..(12): Xaa can be any naturally occurring amino acid
  misc_feature (14)..(14): Xaa can be any naturally occurring amino acid
  misc_feature (17)..(17): Xaa can be any naturally occurring amino acid
  misc_feature (20)..(20): Xaa can be any naturally occurring amino acid
  misc_feature (23)..(24): Xaa can be any naturally occurring amino acid
  misc_feature (27)..(29): Xaa can be any naturally occurring amino acid
  misc_feature (31)..(33): Xaa can be any naturally occurring amino acid
  misc_feature (35)..(36): Xaa can be any naturally occurring amino acid
  misc_feature (40)..(40): Xaa can be any naturally occurring amino acid
  misc_feature (43)..(43): Xaa can be any naturally occurring amino acid
  misc_feature (46)..(46): Xaa can be any naturally occurring amino acid

SEQ ID NO: 4345 - protein, 301 aa, Artificial; identical to SEQ ID NO: 547
  consensus
  misc_feature (1)..(3): Xaa can be any naturally occurring amino acid
  misc_feature (5)..(6): Xaa can be any naturally occurring amino acid
  misc_feature (10)..(10): Xaa can be any naturally occurring amino acid
  misc_feature (13)..(13): Xaa can be any naturally occurring amino acid
  misc_feature (16)..(30): Xaa can be any naturally occurring amino acid
  misc_feature (32)..(38): Xaa can be any naturally occurring amino acid
  misc_feature (41)..(42): Xaa can be any naturally occurring amino acid
  misc_feature (44)..(46): Xaa can be any naturally occurring amino acid
  misc_feature (50)..(50): Xaa can be any naturally occurring amino acid
  misc_feature (52)..(54): Xaa can be any naturally occurring amino acid
  misc_feature (57)..(58): Xaa can be any naturally occurring amino acid
  misc_feature (61)..(61): Xaa can be any naturally occurring amino acid
  misc_feature (68)..(70): Xaa can be any naturally occurring amino acid
  misc_feature (73)..(74): Xaa can be any naturally occurring amino acid
  misc_feature (78)..(79): Xaa can be any naturally occurring amino acid
  misc_feature (81)..(81): Xaa can be any naturally occurring amino acid
  misc_feature (84)..(85): Xaa can be any naturally occurring amino acid
  misc_feature (88)..(89): Xaa can be any naturally occurring amino acid
  misc_feature (91)..(94): Xaa can be any naturally occurring amino acid
  misc_feature (97)..(97): Xaa can be any naturally occurring amino acid
  misc_feature (100)..(101): Xaa can be any naturally occurring amino acid
  misc_feature (105)..(107): Xaa can be any naturally occurring amino acid
  misc_feature (109)..(109): Xaa can be any naturally occurring amino acid
  misc_feature (117)..(121): Xaa can be any naturally occurring amino acid
  misc_feature (131)..(131): Xaa can be any naturally occurring amino acid
  misc_feature (134)..(136): Xaa can be any naturally occurring amino acid
  misc_feature (142)..(142): Xaa can be any naturally occurring amino acid
  misc_feature (146)..(147): Xaa can be any naturally occurring amino acid
  misc_feature (149)..(150): Xaa can be any naturally occurring amino acid
  misc_feature (158)..(158): Xaa can be any naturally occurring amino acid
  misc_feature (160)..(160): Xaa can be any naturally occurring amino acid
  misc_feature (164)..(164): Xaa can be any naturally occurring amino acid
  misc_feature (171)..(171): Xaa can be any naturally occurring amino acid
  misc_feature (174)..(199): Xaa can be any naturally occurring amino acid
  misc_feature (201)..(206): Xaa can be any naturally occurring amino acid
  misc_feature (209)..(210): Xaa can be any naturally occurring amino acid
  misc_feature (213)..(213): Xaa can be any naturally occurring amino acid
  misc_feature (216)..(217): Xaa can be any naturally occurring amino acid
  misc_feature (219)..(219): Xaa can be any naturally occurring amino acid
  misc_feature (225)..(225): Xaa can be any naturally occurring amino acid
  misc_feature (229)..(229): Xaa can be any naturally occurring amino acid
  misc_feature (234)..(234): Xaa can be any naturally occurring amino acid
  misc_feature (236)..(236): Xaa can be any naturally occurring amino acid
  misc_feature (240)..(241): Xaa can be any naturally occurring amino acid
  misc_feature (248)..(248): Xaa can be any naturally occurring amino acid
  misc_feature (251)..(254): Xaa can be any naturally occurring amino acid
  misc_feature (256)..(264): Xaa can be any naturally occurring amino acid
  misc_feature (267)..(267): Xaa can be any naturally occurring amino acid
  misc_feature (269)..(269): Xaa can be any naturally occurring amino acid
  misc_feature (271)..(278): Xaa can be any naturally occurring amino acid
  misc_feature (281)..(282): Xaa can be any naturally occurring amino acid
  misc_feature (287)..(288): Xaa can be any naturally occurring amino acid
  misc_feature (291)..(291): Xaa can be any naturally occurring amino acid
  misc_feature (294)..(301): Xaa can be any naturally occurring amino acid

SEQ ID NO: 4346 - protein, 16 aa, Artificial
  consensus
  misc_feature (2)..(3): Xaa can be any naturally occurring amino acid
  misc_feature (4)..(4): Xaa can be Gly or Ala
  misc_feature (5)..(5): Xaa can be Asp or Glu
  misc_feature (7)..(8): Xaa can be any naturally occurring amino acid
  misc_feature (9)..(9): Xaa can be Arg or Lys or Asn or His
  misc_feature (10)..(12): Xaa can be any naturally occurring amino acid
  misc_feature (13)..(13): Xaa can be Pro or Arg
  misc_feature (14)..(14): Xaa can be any naturally occurring amino acid
  misc_feature (15)..(15): Xaa can be Leu or Ile or Val or Met or Phe
  misc_feature (6)..(16): Xaa can be Tyr or Phe or Trp or Leu
GXXXXLXXXXXXXXXX

SEQ ID NO: 4347 - protein, 101 aa, Artificial
  consensus
  misc_feature (1)..(1): Xaa can be Arg or Lys
  misc_feature (2)..(2): Xaa can be Val or Leu or Ile or Ala
  misc_feature (3)..(3): Xaa can be Ile or Val or Met or Ala
  misc_feature (4)..(4): Xaa can be Ile or Val or Leu or Met
  misc_feature (8)..(8): Xaa can be any naturally occurring amino acid
  misc_feature (9)..(9): Xaa can be Gly or Ala
  misc_feature (10)..(13): Xaa can be any naturally occurring amino acid
  misc_feature (14)..(14): Xaa can be Ser or Thr
  misc_feature (15)..(15): Xaa can be Ala or Ser or Tyr
  misc_feature (16)..(17): Xaa can be any naturally occurring amino acid
  misc_feature (18)..(18): Xaa can be Leu or Ile or Val or Phe
  misc_feature (19)..(21): Xaa can be any naturally occurring amino acid
  misc_feature (22)..(22): Xaa can be Leu or Ile or Val or Phe
  misc_feature (23)..(24): Xaa can be any naturally occurring amino acid
  misc_feature (25)..(28): Xaa can be any naturally occurring amino acid or can be omitted
  misc_feature (29)..(29): Xaa can be Glu or Asp
  misc_feature (30)..(31): Xaa can be any naturally occurring amino acid
  misc_feature (32)..(32): Xaa can be Ile or Val or Leu or Thr
  misc_feature (33)..(33): Xaa can be Tyr or Phe or Leu
  misc_feature (34)..(34): Xaa can be Arg or Lys or Leu
  misc_feature (35)..(35): Xaa can be Ile or Val or Leu or Met
  misc_feature (38)..(38): Xaa can be Tyr or Phe or Met or Leu
  misc_feature (41)..(41): Xaa can be Lys or Arg
  misc_feature (42)..(42): Xaa can be Glu or Asp or Gln or Pro or Ala
  misc_feature (43)..(43): Xaa can be any naturally occurring amino acid
  misc_feature (44)..(44): Xaa can be Val or Leu or Ile or Met
  misc_feature (45)..(45): Xaa can be any naturally occurring amino acid
  misc_feature (46)..(46): Xaa can be Asn or Glu
  misc_feature (47)..(47): Xaa can be Leu or Ile or Val or Met or Phe
  misc_feature (48)..(50): Xaa can be any naturally occurring amino acid
  misc_feature (51)..(51): Xaa can be Arg or Lys or Glu
  misc_feature (52)..(52): Xaa can be Phe or Tyr
  misc_feature (53)..(53): Xaa can be any naturally occurring amino acid
  misc_feature (55)..(58): Xaa can be any naturally occurring amino acid
  misc_feature (59)..(61): Xaa can be any naturally occurring amino acid or can be omitted
  misc_feature (62)..(62): Xaa can be Trp or Met or Asn
  misc_feature (63)..(66): Xaa can be any naturally occurring amino acid
  misc_feature (67)..(67): Xaa can be Ile or Val or Ala
  misc_feature (68)..(69): Xaa can be any naturally occurring amino acid
  misc_feature (70)..(70): Xaa can be Val or Ile or Met or Leu
  misc_feature (71)..(71): Xaa can be any naturally occurring amino acid
  misc_feature (72)..(72): Xaa can be Ile or Val or Leu or Phe
  misc_feature (73)..(75): Xaa can be any naturally occurring amino acid
  misc_feature (77)..(78): Xaa can be any naturally occurring amino acid
  misc_feature (79)..(79): Xaa can be Gly or Ala or Lys or Val
  misc_feature (80)..(82): Xaa can be any naturally occurring amino acid
  misc_feature (83)..(83): Xaa can be Arg or Lys
  misc_feature (84)..(85): Xaa can be any naturally occurring amino acid
  misc_feature (86)..(86): Xaa can be Tyr or Lys
  misc_feature (87)..(87): Xaa can be Tyr or Phe or Trp
  misc_feature (88)..(88): Xaa can be Asp or Glu or Ala or Asn
  misc_feature (89)..(90): Xaa can be any naturally occurring amino acid
  misc_feature (92)..(93): Xaa can be any naturally occurring amino acid
  misc_feature (94)..(94): Xaa can be any naturally occurring amino acid or can be omitted
  misc_feature (95)..(95): Xaa can be Arg or Lys
  misc_feature (97)..(97): Xaa can be Met or Val or Ile or Leu
  misc_feature (98)..(98): Xaa can be Val or Ile or Leu or Met or Phe
  misc_feature (99)..(99): Xaa can be Gln or Pro or Thr
  misc_feature (100)..(100): Xaa can be Asn or Ser
  misc_feature (101)..(101): Xaa can be His or Gln
XXXXEKPXXXXXXXXXXXXXXXXXXXXXXXXXXXXDHXLGXXXXXXXXXXXXXNXXXXXXXXXXXXXXXXXXXXXEXXXXXXXXXXXXXXGXXXXDXXXXX

SEQ ID NO: 4348 - protein, 26 aa, Artificial
  consensus
  misc_feature (1)..(1): Xaa can be Arg or Lys or Phe
  misc_feature (2)..(2): Xaa can be Trp or Phe
  misc_feature (3)..(3): Xaa can be any naturally occurring amino acid
  misc_feature (4)..(4): Xaa can be Gly or Asp
  misc_feature (5)..(5): Xaa can be Val or Ile or Met or Thr
  misc_feature (7)..(7): Xaa can be Phe or Ile
  misc_feature (8)..(8): Xaa can be any naturally occurring amino acid
  misc_feature (9)..(9): Xaa can be Leu or Val or Met or Ile
  misc_feature (10)..(10): Xaa can be Arg or Lys or Gln or Cys
  misc_feature (11)..(11): Xaa can be any naturally occurring amino acid
  misc_feature (12)..(12): Xaa can be Gly or Ala
  misc_feature (14)..(14): Xaa can be any naturally occurring amino acid
  misc_feature (15)..(15): Xaa can be Leu or Met or Val
  misc_feature (16)..(21): Xaa can be any naturally occurring amino acid
  misc_feature (22)..(22): Xaa can be Ile or Val or Ala
  misc_feature (23)..(23): Xaa can be any naturally occurring amino acid
  misc_feature (24)..(24): Xaa can be Ile or Leu or Val or Met
  misc_feature (25)..(25): Xaa can be any naturally occurring amino acid
  misc_feature (26)..(26): Xaa can be Phe or Tyr or Leu
XXXXXPXXXXXXKXXXXXXXXXXXXX

SEQ ID NO: 4349 - protein, 804 aa, Artificial
  consensus
  misc_feature (1)..(159): Xaa can be any naturally occurring amino acid
  misc_feature (161)..(162): Xaa can be any naturally occurring amino acid
  misc_feature (166)..(168): Xaa can be any naturally occurring amino acid
  misc_feature (170)..(171): Xaa can be any naturally occurring amino acid
  misc_feature (173)..(176): Xaa can be any naturally occurring amino acid
  misc_feature (178)..(182): Xaa can be any naturally occurring amino acid
  misc_feature (184)..(191): Xaa can be any naturally occurring amino acid
  misc_feature (193)..(194): Xaa can be any naturally occurring amino acid
  misc_feature (196)..(240): Xaa can be any naturally occurring amino acid
  misc_feature (242)..(254): Xaa can be any naturally occurring amino acid
  misc_feature (256)..(277): Xaa can be any naturally occurring amino acid
  misc_feature (279)..(282): Xaa can be any naturally occurring amino acid
  misc_feature (284)..(310): Xaa can be any naturally occurring amino acid
  misc_feature (312)..(314): Xaa can be any naturally occurring amino acid
  misc_feature (318)..(318): Xaa can be any naturally occurring amino acid
  misc_feature (320)..(320): Xaa can be any naturally occurring amino acid
  misc_feature (322)..(323): Xaa can be any naturally occurring amino acid
  misc_feature (325)..(327): Xaa can be any naturally occurring amino acid
  misc_feature (329)..(337): Xaa can be any naturally occurring amino acid
  misc_feature (339)..(342): Xaa can be any naturally occurring amino acid
  misc_feature (352)..(352): Xaa can be any naturally occurring amino acid
  misc_feature (354)..(354): Xaa can be any naturally occurring amino acid
  misc_feature (356)..(359): Xaa can be any naturally occurring amino acid
  misc_feature (362)..(362): Xaa can be any naturally occurring amino acid
  misc_feature (364)..(370): Xaa can be any naturally occurring amino acid
  misc_feature (372)..(384): Xaa can be any naturally occurring amino acid
  misc_feature (386)..(387): Xaa can be any naturally occurring amino acid
  misc_feature (389)..(391): Xaa can be any naturally occurring amino acid
  misc_feature (393)..(394): Xaa can be any naturally occurring amino acid
  misc_feature (396)..(399): Xaa can be any naturally occurring amino acid
  misc_feature (401)..(403): Xaa can be any naturally occurring amino acid
  misc_feature (406)..(407): Xaa can be any naturally occurring amino acid
  misc_feature (411)..(412): Xaa can be any naturally occurring amino acid
  misc_feature (414)..(418): Xaa can be any naturally occurring amino acid
  misc_feature (422)..(422): Xaa can be any naturally occurring amino acid
  misc_feature (424)..(432): Xaa can be any naturally occurring amino acid
  misc_feature (434)..(434): Xaa can be any naturally occurring amino acid
  misc_feature (437)..(437): Xaa can be any naturally occurring amino acid
  misc_feature (441)..(457): Xaa can be any naturally occurring amino acid
  misc_feature (461)..(474): Xaa can be any naturally occurring amino acid
  misc_feature (476)..(487): Xaa can be any naturally occurring amino acid
  misc_feature (489)..(491): Xaa can be any naturally occurring amino acid
  misc_feature (493)..(501): Xaa can be any naturally occurring amino acid
  misc_feature (503)..(503): Xaa can be any naturally occurring amino acid
  misc_feature (506)..(506): Xaa can be any naturally occurring amino acid
  misc_feature (511)..(514): Xaa can be any naturally occurring amino acid
  misc_feature (517)..(528): Xaa can be any naturally occurring amino acid
  misc_feature (530)..(559): Xaa can be any naturally occurring amino acid
  misc_feature (561)..(566): Xaa can be any naturally occurring amino acid
  misc_feature (569)..(569): Xaa can be any naturally occurring amino acid
  misc_feature (571)..(578): Xaa can be any naturally occurring amino acid
  misc_feature (580)..(580): Xaa can be any naturally occurring amino acid
  misc_feature (583)..(613): Xaa can be any naturally occurring amino acid
  misc_feature (617)..(617): Xaa can be any naturally occurring amino acid
  misc_feature (619)..(620): Xaa can be any naturally occurring amino acid
  misc_feature (622)..(624): Xaa can be any naturally occurring amino acid
  misc_feature (626)..(629): Xaa can be any naturally occurring amino acid
  misc_feature (631)..(634): Xaa can be any naturally occurring amino acid
  misc_feature (636)..(639): Xaa can be any naturally occurring amino acid
  misc_feature (641)..(662): Xaa can be any naturally occurring amino acid
  misc_feature (664)..(665): Xaa can be any naturally occurring amino acid
  misc_feature (667)..(668): Xaa can be any naturally occurring amino acid
  misc_feature (671)..(692): Xaa can be any naturally occurring amino acid
  misc_feature (694)..(804): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXGDLXXXKXXPXXXXLXXXXXLXXXXXXXXGXXRXXXXXXXXXXXXXXXXXXXXXXXXXXXXXXXXXXXXXXXXXXXXXYXXXXXXXXXXXXXLXXXXXXXXXXXXXXXXXXXXXXYXXXXPXXXXXXXXXXXXXXXXXXXXXXXXXXXRXXXEKPXGXDXXSXXXLXXXXXXXXXEXXXXRIDHYLGKEXVXNXXXXRFXNXXXXXXXWXXXXXXXXXXXXXEXXGXXXRXXYXXXXGXXXRDXXQNHXXQXXXXXAMEXPXXXXXXXXXRXEKXKVLXXXXXXXXXXXXXXXXXGQYXXXXXXXXXXXXXXYXXXXXXXXXXXXSXXXTXXXXXXXXXNXRWXGVPFXXXXGKXXXXXXXXXXXXFXXXXXXXXXXXXXXXXXXXXXXXXXXXXXXNXXXXXXQPXEXXXXXXXXKXPGXXXXXXXXXXXXXXXXXXXXXXXXXXXXXXXAYEXLXXDXXXGXXXXFXXXXEXXXXWXXXXXXXXXXXXXXXXXXXXXXYXXGXXGPXXXXXXXXXXXXXXXXXXXXXXWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 4350 - protein, 45 aa, Artificial
  consensus
  misc_feature (1)..(1): Xaa can be Gly or Ala
  misc_feature (3)..(3): Xaa can be any naturally occurring amino acid
  misc_feature (4)..(4): Xaa can be Ser or Ala
  misc_feature (5)..(5): Xaa can be Val or Ile
  misc_feature (10)..(11): Xaa can be any naturally occurring amino acid
  misc_feature (13)..(13): Xaa can be Ile or Leu
  misc_feature (14)..(14): Xaa can be any naturally occurring amino acid
  misc_feature (15)..(15): Xaa can be Ala or Ser
  misc_feature (17)..(26): Xaa can be any naturally occurring amino acid
  misc_feature (27)..(27): Xaa can be Val or Leu
  misc_feature (29)..(29): Xaa can be Ile or Val
  misc_feature (33)..(33): Xaa can be any naturally occurring amino acid
  misc_feature (37)..(39): Xaa can be any naturally occurring amino acid
  misc_feature (45)..(45): Xaa can be Met or Leu
XIXXXCSAHXXVXXXAXXXXXXXXXXXLXEATXNQVXXXGGYTGX

SEQ ID NO: 4351 - protein, 94 aa, Artificial
  consensus
  misc_feature (9)..(9): Xaa can be any naturally occurring amino acid
  misc_feature (11)..(17): Xaa can be any naturally occurring amino acid
  misc_feature (19)..(19): Xaa can be Met or Leu
  misc_feature (20)..(21): Xaa can be any naturally occurring amino acid
  misc_feature (22)..(22): Xaa can be Ala or Ser
  misc_feature (23)..(24): Xaa can be any naturally occurring amino acid
  misc_feature (25)..(25): Xaa can be Leu or Met
  misc_feature (26)..(26): Xaa can be Ile or Val
  misc_feature (27)..(28): Xaa can be any naturally occurring amino acid
  misc_feature (30)..(31): Xaa can be any naturally occurring amino acid
  misc_feature (35)..(35): Xaa can be any naturally occurring amino acid
  misc_feature (37)..(37): Xaa can be Ile or Leu
  misc_feature (41)..(41): Xaa can be any naturally occurring amino acid
  misc_feature (43)..(44): Xaa can be any naturally occurring amino acid
  misc_feature (46)..(47): Xaa can be any naturally occurring amino acid
  misc_feature (48)..(48): Xaa can be Asp or Glu
  misc_feature (49)..(57): Xaa can be any naturally occurring amino acid
  misc_feature (59)..(59): Xaa can be any naturally occurring amino acid
  misc_feature (63)..(63): Xaa can be any naturally occurring amino acid
  misc_feature (65)..(67): Xaa can be any naturally occurring amino acid
  misc_feature (70)..(80): Xaa can be any naturally occurring amino acid
  misc_feature (81)..(82): Xaa can be any naturally occurring amino acid or can be omitted
  misc_feature (84)..(84): Xaa can be Val or Ile
  misc_feature (85)..(85): Xaa can be Ile or Val or Leu
  misc_feature (91)..(91): Xaa can be any naturally occurring amino acid
GGDHLGPNXWXXXXXXXAXXXXXXXXXXYXXAGFXKXHLDXSXXCXXXXXXXXXXXXAXRAAXLXXXAEXXXXXXXXXXXXXYXXGTEVPXPGG

SEQ ID NO: 4352 - protein, 89 aa, Artificial
  consensus
  misc_feature (2)..(7): Xaa can be any naturally occurring amino acid
  misc_feature (9)..(9): Xaa can be any naturally occurring amino acid
  misc_feature (10)..(10): Xaa can be Ile or Met or Leu or Val
  misc_feature (11)..(11): Xaa can be Ala or Gly
  misc_feature (12)..(12): Xaa can be any naturally occurring amino acid
  misc_feature (14)..(14): Xaa can be any naturally occurring amino acid
  misc_feature (17)..(17): Xaa can be Gly or Ala
  misc_feature (19)..(19): Xaa can be Glu or Asp
  misc_feature (21)..(24): Xaa can be any naturally occurring amino acid
  misc_feature (25)..(55): Xaa can be Val or Ile
  misc_feature (26)..(27): Xaa can be any naturally occurring amino acid
  misc_feature (28)..(28): Xaa can be Tyr or Phe
  misc_feature (29)..(35): Xaa can be any naturally occurring amino acid
  misc_feature (37)..(45): Xaa can be any naturally occurring amino acid
  misc_feature (46)..(46): Xaa can be any naturally occurring amino acid or can be omitted
  misc_feature (47)..(47): Xaa can be Val or Ile
  misc_feature (48)..(48): Xaa can be Phe or Tyr
  misc_feature (57)..(59): Xaa can be any naturally occurring amino acid
  misc_feature (60)..(60): Xaa can be Ala or Ser
  misc_feature (61)..(63): Xaa can be any naturally occurring amino acid
  misc_feature (66)..(68): Xaa can be any naturally occurring amino acid
  misc_feature (69)..(69): Xaa can be Phe or Tyr or Trp
  misc_feature (70)..(70): Xaa can be any naturally occurring amino acid
  misc_feature (71)..(71): Xaa can be Ile or Val
  misc_feature (77)..(77): Xaa can be any naturally occurring amino acid
  misc_feature (82)..(82): Xaa can be any naturally occurring amino acid
  misc_feature (86)..(86): Xaa can be Leu or Ile
  misc_feature (86)..(88): Xaa can be Phe or Tyr
  misc_feature (86)..(88): Xaa can be any naturally occurring amino acid
GXXXXXXRXXXXVXQPXVXFXXXXXXXXXXXXXXXLXXXXXXXXXXXXEAHSTDYQXXXXXXXLVXXXXXXLKVGPXLTFAXREAXXXL

SEQ ID NO: 4353 - protein, 11 aa, Artificial
  consensus
  misc_feature (1)..(1): Xaa can be Tyr or Phe
  misc_feature (3)..(3): Xaa can be any naturally occurring amino acid
  misc_feature (7)..(7): Xaa can be Ile or Met or Val
XSXSDRXRYYW

SEQ ID NO: 4354 - protein, 459 aa, Artificial
  consensus
  misc_feature (1)..(29): Xaa can be any naturally occurring amino acid
  misc_feature (31)..(33): Xaa can be any naturally occurring amino acid
  misc_feature (36)..(36): Xaa can be any naturally occurring amino acid
  misc_feature (46)..(46): Xaa can be any naturally occurring amino acid
  misc_feature (50)..(60): Xaa can be any naturally occurring amino acid
  misc_feature (66)..(66): Xaa can be any naturally occurring amino acid
  misc_feature (70)..(70): Xaa can be any naturally occurring amino acid
  misc_feature (72)..(72): Xaa can be any naturally occurring amino acid
  misc_feature (79)..(79): Xaa can be any naturally occurring amino acid
  misc_feature (81)..(81): Xaa can be any naturally occurring amino acid
  misc_feature (84)..(86): Xaa can be any naturally occurring amino acid
  misc_feature (88)..(90): Xaa can be any naturally occurring amino acid
  misc_feature (92)..(102): Xaa can be any naturally occurring amino acid
  misc_feature (112)..(112): Xaa can be any naturally occurring amino acid
  misc_feature (114)..(117): Xaa can be any naturally occurring amino acid
  misc_feature (119)..(120): Xaa can be any naturally occurring amino acid
  misc_feature (123)..(131): Xaa can be any naturally occurring amino acid
  misc_feature (134)..(134): Xaa can be any naturally occurring amino acid
  misc_feature (138)..(138): Xaa can be any naturally occurring amino acid
  misc_feature (144)..(144): Xaa can be any naturally occurring amino acid
  misc_feature (147)..(147): Xaa can be any naturally occurring amino acid
  misc_feature (149)..(150): Xaa can be any naturally occurring amino acid
  misc_feature (152)..(153): Xaa can be any naturally occurring amino acid
  misc_feature (156)..(160): Xaa can be any naturally occurring amino acid
  misc_feature (162)..(162): Xaa can be any naturally occurring amino acid
  misc_feature (166)..(166): Xaa can be any naturally occurring amino acid
  misc_feature (168)..(170): Xaa can be any naturally occurring amino acid
  misc_feature (173)..(185): Xaa can be any naturally occurring amino acid
  misc_feature (194)..(194): Xaa can be any naturally occurring amino acid
  misc_feature (198)..(214): Xaa can be any naturally occurring amino acid
  misc_feature (216)..(219): Xaa can be any naturally occurring amino acid
  misc_feature (221)..(222): Xaa can be any naturally occurring amino acid
  misc_feature (224)..(226): Xaa can be any naturally occurring amino acid
  misc_feature (228)..(229): Xaa can be any naturally occurring amino acid
  misc_feature (232)..(234): Xaa can be any naturally occurring amino acid
  misc_feature (236)..(241): Xaa can be any naturally occurring amino acid
  misc_feature (243)..(243): Xaa can be any naturally occurring amino acid
  misc_feature (245)..(246): Xaa can be any naturally occurring amino acid
  misc_feature (256)..(261): Xaa can be any naturally occurring amino acid
  misc_feature (263)..(266): Xaa can be any naturally occurring amino acid
  misc_feature (268)..(269): Xaa can be any naturally occurring amino acid
  misc_feature (271)..(282): Xaa can be any naturally occurring amino acid
  misc_feature (291)..(293): Xaa can be any naturally occurring amino acid
  misc_feature (295)..(297): Xaa can be any naturally occurring amino acid
  misc_feature (300)..(300): Xaa can be any naturally occurring amino acid
  misc_feature (303)..(303): Xaa can be any naturally occurring amino acid
  misc_feature (311)..(311): Xaa can be any naturally occurring amino acid
  misc_feature (320)..(320): Xaa can be any naturally occurring amino acid
  misc_feature (322)..(322): Xaa can be any naturally occurring amino acid
  misc_feature (324)..(328): Xaa can be any naturally occurring amino acid
  misc_feature (330)..(344): Xaa can be any naturally occurring amino acid
  misc_feature (346)..(347): Xaa can be any naturally occurring amino acid
  misc_feature (349)..(351): Xaa can be any naturally occurring amino acid
  misc_feature (353)..(354): Xaa can be any naturally occurring amino acid
  misc_feature (356)..(358): Xaa can be any naturally occurring amino acid
  misc_feature (360)..(372): Xaa can be any naturally occurring amino acid
  misc_feature (374)..(374): Xaa can be any naturally occurring amino acid
  misc_feature (378)..(378): Xaa can be any naturally occurring amino acid
  misc_feature (383)..(397): Xaa can be any naturally occurring amino acid
  misc_feature (399)..(403): Xaa can be any naturally occurring amino acid
  misc_feature (405)..(406): Xaa can be any naturally occurring amino acid
  misc_feature (408)..(408): Xaa can be any naturally occurring amino acid
  misc_feature (411)..(411): Xaa can be any naturally occurring amino acid
  misc_feature (414)..(421): Xaa can be any naturally occurring amino acid
  misc_feature (423)..(427): Xaa can be any naturally occurring amino acid
  misc_feature (429)..(439): Xaa can be any naturally occurring amino acid
  misc_feature (441)..(442): Xaa can be any naturally occurring amino acid
  misc_feature (444)..(459): Xaa can be any naturally occurring amino acid
XXXXXXXXXXXXXXXXXXXXXXXXXXXXXGXXXGIXSVCSAHPLVXEAAXXXXXXXXXXXLIEATXNQVXQXGGYTGMXPXDFXXXVXXXAXXXXXXXXXXXLGGDHLGPNXWXXXXAXXAMXXXXXXXXXYVXAGFXKIHLDXSMXCXXDXXPLXXXXXAXRAAXLXXXAEXXXXXXXXXXXXXYVIGTEVPXPGGXXXXXXXXXXXXXXXXXTXXXXAXXTXXXHXXAFXXXGXXXXXXRXIXXVVQPGVEFDXXXXXXYXXXXAXXLXXXXXXXXXXXXEAHSTDYQXXXAXXXLVXDHXAILKVGPXLTFALREAXFXLXXXXXEXXXXXXXXXXXXXXXEXXMXXXPXXWXXXYXXXXXXXXXXXXXSXSDRXRYYWXXXXXXXXXXXXXXXLXXXXXPXXLXSQXLPXXXXXXXXGXXXXXPXXXXXXXXXXXLXXYXXXXXXXXXXXXXXXX

SEQ ID NO: 4355 - protein, 459 aa, Artificial
  consensus
  misc_feature (1)..(34): Xaa can be any naturally occurring amino acid
  misc_feature (36)..(38): Xaa can be any naturally occurring amino acid
  misc_feature (43)..(44): Xaa can be any naturally occurring amino acid
  misc_feature (46)..(48): Xaa can be any naturally occurring amino acid
  misc_feature (50)..(60): Xaa can be any naturally occurring amino acid
  misc_feature (62)..(62): Xaa can be any naturally occurring amino acid
  misc_feature (66)..(66): Xaa can be any naturally occurring amino acid
  misc_feature (70)..(72): Xaa can be any naturally occurring amino acid
  misc_feature (78)..(82): Xaa can be any naturally occurring amino acid
  misc_feature (84)..(86): Xaa can be any naturally occurring amino acid
  misc_feature (88)..(90): Xaa can be any naturally occurring amino acid
  misc_feature (92)..(103): Xaa can be any naturally occurring amino acid
  misc_feature (112)..(112): Xaa can be any naturally occurring amino acid
  misc_feature (114)..(120): Xaa can be any naturally occurring amino acid
  misc_feature (122)..(131): Xaa can be any naturally occurring amino acid
  misc_feature (133)..(134): Xaa can be any naturally occurring amino acid
  misc_feature (138)..(138): Xaa can be any naturally occurring amino acid
  misc_feature (140)..(140): Xaa can be any naturally occurring amino acid
  misc_feature (144)..(144): Xaa can be any naturally occurring amino acid
  misc_feature (146)..(147): Xaa can be any naturally occurring amino acid
  misc_feature (149)..(160): Xaa can be any naturally occurring amino acid
  misc_feature (162)..(162): Xaa can be any naturally occurring amino acid
  misc_feature (166)..(166): Xaa can be any naturally occurring amino acid
  misc_feature (168)..(170): Xaa can be any naturally occurring amino acid
  misc_feature (173)..(185): Xaa can be any naturally occurring amino acid
  misc_feature (187)..(188): Xaa can be any naturally occurring amino acid
  misc_feature (194)..(194): Xaa can be any naturally occurring amino acid
  misc_feature (198)..(214): Xaa can be any naturally occurring amino acid
  misc_feature (216)..(222): Xaa can be any naturally occurring amino acid
  misc_feature (224)..(226): Xaa can be any naturally occurring amino acid
  misc_feature (228)..(234): Xaa can be any naturally occurring amino acid
  misc_feature (236)..(241): Xaa can be any naturally occurring amino acid
  misc_feature (243)..(246): Xaa can be any naturally occurring amino acid
  misc_feature (248)..(248): Xaa can be any naturally occurring amino acid
  misc_feature (251)..(251): Xaa can be any naturally occurring amino acid
  misc_feature (253)..(253): Xaa can be any naturally occurring amino acid
  misc_feature (255)..(269): Xaa can be any naturally occurring amino acid
  misc_feature (271)..(282): Xaa can be any naturally occurring amino acid
  misc_feature (291)..(297): Xaa can be any naturally occurring amino acid
  misc_feature (300)..(305): Xaa can be any naturally occurring amino acid
  misc_feature (311)..(311): Xaa can be any naturally occurring amino acid
  misc_feature (316)..(316): Xaa can be any naturally occurring amino acid
  misc_feature (320)..(322): Xaa can be any naturally occurring amino acid
  misc_feature (324)..(347): Xaa can be any naturally occurring amino acid
  misc_feature (349)..(351): Xaa can be any naturally occurring amino acid
  misc_feature (353)..(354): Xaa can be any naturally occurring amino acid
  misc_feature (356)..(358): Xaa can be any naturally occurring amino acid
  misc_feature (360)..(372): Xaa can be any naturally occurring amino acid
  misc_feature (374)..(374): Xaa can be any naturally occurring amino acid
  misc_feature (378)..(378): Xaa can be any naturally occurring amino acid
  misc_feature (383)..(397): Xaa can be any naturally occurring amino acid
  misc_feature (399)..(459): Xaa can be any naturally occurring amino acid
XXXXXXXXXXXXXXXXXXXXXXXXXXXXXXXXXXIXXXCSAHXXVXXXAXXXXXXXXXXXLXEATXNQVXXXGGYTGXXXXXFXXXVXXXAXXXXXXXXXXXXGGDHLGPNXWXXXXXXXAXXXXXXXXXXYXXAGFXKXHLDXSXXCXXXXXXXXXXXXAXRAAXLXXXAEXXXXXXXXXXXXXYXXGTEVPXPGGXXXXXXXXXXXXXXXXXTXXXXXXXTXXXHXXXXXXXGXXXXXXRXXXXVXQPXVXFXXXXXXXXXXXXXXXLXXXXXXXXXXXXEAHSTDYQXXXXXXXLVXXXXXXLKVGPXLTFAXREAXXXLXXXXXXXXXXXXXXXXXXXXXXXXMXXXPXXWXXXYXXXXXXXXXXXXXSXSDRXRYYWXXXXXXXXXXXXXXXLXXXXXXXXXXXXXXXXXXXXXXXXXXXXXXXXXXXXXXXXXXXXXXXXXXXXXXXXXXXXX

SEQ ID NO: 4356 - protein, 33 aa, Artificial
  consensus
  misc_feature (1)..(1): Xaa can be Thr or Ser
  misc_feature (2)..(2): Xaa can be Gly or Ala
  misc_feature (3)..(5): Xaa can be any naturally occurring amino acid
  misc_feature (6)..(6): Xaa can be Leu or Val or Ile
  misc_feature (7)..(7): Xaa can be Asp or Asn
  misc_feature (8)..(8): Xaa can be any naturally occurring amino acid
  misc_feature (12)..(12): Xaa can be any naturally occurring amino acid
  misc_feature (15)..(15): Xaa can be any naturally occurring amino acid
  misc_feature (17)..(17): Xaa can be any naturally occurring amino acid
  misc_feature (20)..(20): Xaa can be Ile or Val
  misc_feature (21)..(21): Xaa can be Val or Ile or Met or Thr
  misc_feature (23)..(23): Xaa can be Ile or Val
  misc_feature (24)..(24): Xaa can be Tyr or Phe
  misc_feature (28)..(28): Xaa can be Ser or Ala
  misc_feature (29)..(29): Xaa can be Ser or Ala or Gly
  misc_feature (32)..(32): Xaa can be Thr or Ser
XXXXXXXXALGXGGXPXGRXXEXXGPEXXGKXT

SEQ ID NO: 4357 - protein, 36 aa, Artificial
  consensus
  misc_feature (1)..(1): Xaa can be Ala or Gly
  misc_feature (2)..(2): Xaa can be Phe or Tyr
  misc_feature (3)..(3): Xaa can be Ile or Val
  misc_feature (6)..(6): Xaa can be Glu or Asp
  misc_feature (7)..(7): Xaa can be His or Asn
  misc_feature (8)..(8): Xaa can be Ala or Ser
  misc_feature (9)..(9): Xaa can be any naturally occurring amino acid
  misc_feature (10)..(10): Xaa can be Asp or Glu
  misc_feature (11)..(12): Xaa can be any naturally occurring amino acid
  misc_feature (13)..(13): Xaa can be Tyr or Phe or Trp or Leu
  misc_feature (14)..(14): Xaa can be Ala or Ser
  misc_feature (15)..(16): Xaa can be any naturally occurring amino acid
  misc_feature (17)..(17): Xaa can be Leu or Ile
  misc_feature (19)..(19): Xaa can be Val or Ile or Ala
  misc_feature (20)..(23): Xaa can be any naturally occurring amino acid
  misc_feature (25)..(26): Xaa can be any naturally occurring amino acid
  misc_feature (27)..(27): Xaa can be Ser or Ala
  misc_feature (31)..(31): Xaa can be any naturally occurring amino acid
  misc_feature (34)..(34): Xaa can be any naturally occurring amino acid
  misc_feature (35)..(35): Xaa can be Ala or Gly
  misc_feature (36)..(36): Xaa can be Leu or Met
XXXDAXXXXXXXXXXXXGXXXXXLXXXQPDXGEXXX

SEQ ID NO: 4358 - protein, 39 aa, Artificial
  consensus
  misc_feature (2)..(2): Xaa can be Val or Ile or Leu or Met
  misc_feature (3)..(3): Xaa can be Ile or Val or Leu or Met
  misc_feature (4)..(4): Xaa can be Val or Ile
  misc_feature (5)..(5): Xaa can be Val or Ile
  misc_feature (9)..(9): Xaa can be Ala or Ser
  misc_feature (12)..(12): Xaa can be any naturally occurring amino acid
  misc_feature (14)..(14): Xaa can be Lys or Arg or Gln
  misc_feature (15)..(15): Xaa can be any naturally occurring amino acid
  misc_feature (17)..(17): Xaa can be Ile or Leu
  misc_feature (20)..(20): Xaa can be Glu or Asp
  misc_feature (21)..(21): Xaa can be Met or Ile
  misc_feature (22)..(22): Xaa can be Gly or Ser
  misc_feature (23)..(23): Xaa can be Asp or Glu
  misc_feature (24)..(26): Xaa can be any naturally occurring amino acid
  misc_feature (27)..(27): Xaa can be Gly or Ala
  misc_feature (28)..(29): Xaa can be any naturally occurring amino acid
  misc_feature (32)..(32): Xaa can be Leu or Met
  misc_feature (33)..(33): Xaa can be Met or Leu
  misc_feature (35)..(35): Xaa can be any naturally occurring amino acid
  misc_feature (36)..(36): Xaa can be Ala or Gly or Ser
  misc_feature (37)..(37): Xaa can be Leu or Met
  misc_feature (39)..(39): Xaa can be any naturally occurring amino acid
DXXXXDSVXALXPXXEXEGXXXXXXXXXXARXXSXXXRX

SEQ ID NO: 4359 - protein, 880 aa, Artificial
  consensus
  misc_feature (1)..(85): Xaa can be any naturally occurring amino acid
  misc_feature (88)..(89): Xaa can be any naturally occurring amino acid
  misc_feature (91)..(93): Xaa can be any naturally occurring amino acid
  misc_feature (96)..(97): Xaa can be any naturally occurring amino acid
  misc_feature (102)..(103): Xaa can be any naturally occurring amino acid
  misc_feature (105)..(106): Xaa can be any naturally occurring amino acid
  misc_feature (108)..(121): Xaa can be any naturally occurring amino acid
  misc_feature (124)..(125): Xaa can be any naturally occurring amino acid
  misc_feature (128)..(128): Xaa can be any naturally occurring amino acid
  misc_feature (132)..(132): Xaa can be any naturally occurring amino acid
  misc_feature (135)..(135): Xaa can be any naturally occurring amino acid
  misc_feature (137)..(137): Xaa can be any naturally occurring amino acid
  misc_feature (140)..(141): Xaa can be any naturally occurring amino acid
  misc_feature (154)..(155): Xaa can be any naturally occurring amino acid
  misc_feature (157)..(159): Xaa can be any naturally occurring amino acid
  misc_feature (161)..(162): Xaa can be any naturally occurring amino acid
  misc_feature (164)..(165): Xaa can be any naturally occurring amino acid
  misc_feature (168)..(169): Xaa can be any naturally occurring amino acid
  misc_feature (172)..(172): Xaa can be any naturally occurring amino acid
  misc_feature (181)..(181): Xaa can be any naturally occurring amino acid
  misc_feature (184)..(185): Xaa can be any naturally occurring amino acid
  misc_feature (189)..(192): Xaa can be any naturally occurring amino acid
  misc_feature (194)..(195): Xaa can be any naturally occurring amino acid
  misc_feature (200)..(200): Xaa can be any naturally occurring amino acid
  misc_feature (208)..(210): Xaa can be any naturally occurring amino acid
  misc_feature (212)..(212): Xaa can be any naturally occurring amino acid
  misc_feature (215)..(215): Xaa can be any naturally occurring amino acid
  misc_feature (217)..(217): Xaa can be any naturally occurring amino acid
  misc_feature (219)..(220): Xaa can be any naturally occurring amino acid
  misc_feature (222)..(222): Xaa can be any naturally occurring amino acid
  misc_feature (229)..(229): Xaa can be any naturally occurring amino acid
  misc_feature (231)..(231): Xaa can be any naturally occurring amino acid
  misc_feature (237)..(237): Xaa can be any naturally occurring amino acid
  misc_feature (241)..(243): Xaa can be any naturally occurring amino acid
  misc_feature (249)..(249): Xaa can be any naturally occurring amino acid
  misc_feature (254)..(254): Xaa can be any naturally occurring amino acid
  misc_feature (257)..(268): Xaa can be any naturally occurring amino acid
  misc_feature (274)..(274): Xaa can be any naturally occurring amino acid
  misc_feature (276)..(276): Xaa can be any naturally occurring amino acid
  misc_feature (278)..(278): Xaa can be any naturally occurring amino acid
  misc_feature (282)..(282): Xaa can be any naturally occurring amino acid
  misc_feature (284)..(287): Xaa can be any naturally occurring amino acid
  misc_feature (292)..(292): Xaa can be any naturally occurring amino acid
  misc_feature (295)..(295): Xaa can be any naturally occurring amino acid
  misc_feature (301)..(301): Xaa can be any naturally occurring amino acid
  misc_feature (307)..(307): Xaa can be any naturally occurring amino acid
  misc_feature (309)..(313): Xaa can be any naturally occurring amino acid
  misc_feature (315)..(324): Xaa can be any naturally occurring amino acid
  misc_feature (326)..(330): Xaa can be any naturally occurring amino acid
  misc_feature (337)..(337): Xaa can be any naturally occurring amino acid
  misc_feature (342)..(347): Xaa can be any naturally occurring amino acid
  misc_feature (349)..(358): Xaa can be any naturally occurring amino acid
  misc_feature (360)..(360): Xaa can be any naturally occurring amino acid
  misc_feature (363)..(365): Xaa can be any naturally occurring amino acid
  misc_feature (367)..(369): Xaa can be any naturally occurring amino acid
  misc_feature (371)..(379): Xaa can be any naturally occurring amino acid
  misc_feature (381)..(381): Xaa can be any naturally occurring amino acid
  misc_feature (383)..(383): Xaa can be any naturally occurring amino acid
  misc_feature (385)..(386): Xaa can be any naturally occurring amino acid
  misc_feature (388)..(397): Xaa can be any naturally occurring amino acid
  misc_feature (401)..(407): Xaa can be any naturally occurring amino acid
  misc_feature (409)..(880): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXALXXAXXXIEXXFGKGXXMXXGXXXXXXXXXXXXXXGSXXLDXALGXGGXPXGRXXEIYGPESSGKTTXXLXXXAXXQXXGGXXAFXDAEHALDPXYAXXLGVXXXXLXXSQPDXGEQALEIXXXLXRSXAXDXXVXDSVAALXPXAEIEGXMGDXXXGLQARXMSQAXRKXXXXXXXXXXXXIFINQXRXKXGVMXGXXXXPETTXGGXALKFYXSVRLDXRXXXXXKXXXXXXXXXXGXXXXXKVVKNKXAPPFXXXXXXIXXXXXXXXXXGXGIXXXGXXXDXXXXXXXXXKXGXWXXYXXXXXXXXXXGQGXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 4360 - protein, 100 aa, Artificial
  consensus
  misc_feature (1)..(1): Xaa can be Gly or Ala
  misc_feature (2)..(2): Xaa can be any naturally occurring amino acid
  misc_feature (3)..(3): Xaa can be Met or Ile or Val or Leu
  misc_feature (4)..(4): Xaa can be Leu or Ile or Met or Phe
  misc_feature (5)..(5): Xaa can be Gly or Ala
  misc_feature (6)..(6): Xaa can be any naturally occurring amino acid
  misc_feature (7)..(7): Xaa can be Leu or Ile or Val or Met or Cys
  misc_feature (8)..(8): Xaa can be Leu or Ile or Val or Met or Phe
  misc_feature (9)..(11): Xaa can be any naturally occurring amino acid
  misc_feature (13)..(13): Xaa can be Gly or Ala or Val or Ser
  misc_feature (14)..(16): Xaa can be any naturally occurring amino acid
  misc_feature (17)..(17): Xaa can be Ile or Val or Leu or Met
  misc_feature (18)..(18): Xaa can be Ala or Ser or Val or Gly
  misc_feature (19)..(31): Xaa can be any naturally occurring amino acid
  misc_feature (32)..(33): Xaa can be any naturally occurring amino acid or can be omitted
  misc_feature (34)..(34): Xaa can be Met or Leu or Val or Ile
  misc_feature (35)..(44): Xaa can be any naturally occurring amino acid
  misc_feature (45)..(45): Xaa can be any naturally occurring amino acid or can be omitted
  misc_feature (46)..(46): Xaa can be Leu or Val or Ile or Met
  misc_feature (47)..(47): Xaa can be Phe or Cys
  misc_feature (48)..(48): Xaa can be any naturally occurring amino acid
  misc_feature (49)..(49): Xaa can be Glu or Asp or Gln or Ile
  misc_feature (50)..(50): Xaa can be any naturally occurring amino acid
  misc_feature (51)..(51): Xaa can be Gly or Ala or Val
  misc_feature (52)..(53): Xaa can be any naturally occurring amino acid
  misc_feature (54)..(54): Xaa can be Leu or Ile or Val or Met or Thr
  misc_feature (55)..(55): Xaa can be Leu or Met or Val or Phe
  misc_feature (56)..(57): Xaa can be any naturally occurring amino acid
  misc_feature (58)..(58): Xaa can be Leu or Val or Ile
  misc_feature (59)..(74): Xaa can be any naturally occurring amino acid
  misc_feature (75)..(81): Xaa can be any naturally occurring amino acid or can be omitted
  misc_feature (82)..(82): Xaa can be Ile or Val or Leu or Met or Thr
  misc_feature (83)..(86): Xaa can be any naturally occurring amino acid
  misc_feature (87)..(87): Xaa can be Gly or Ala or Ile
  misc_feature (88)..(91): Xaa can be any naturally occurring amino acid
  misc_feature (91)..(92): Xaa can be His or Ala or Gly
  misc_feature (93)..(95): Xaa can be any naturally occurring amino acid
  misc_feature (96)..(96): Xaa can be Pro or Leu or Val or Ser
  misc_feature (97)..(97): Xaa can be Pro or Ser or Val
  misc_feature (98)..(98): Xaa can be any naturally occurring amino acid
  misc_feature (100)..(100): Xaa can be Gly or Ala or Ser or Asn
XXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXPX

SEQ ID NO: 4361 - protein, 112 aa, Artificial
  consensus
  misc_feature (1)..(1): Xaa can be Ile or Val oe Leu or Met
  misc_feature (2)..(2): Xaa can be Leu or Ile or Val or Ala or Thr
  misc_feature (3)..(5): Xaa can be any naturally occurring amino acid
  misc_feature (6)..(6): Xaa can be Gly or Ala or Leu or Cys
  misc_feature (7)..(7): Xaa can be Ala or Gly
  misc_feature (8)..(8): Xaa can be Gly or Thr
  misc_feature (10)..(13): Xaa can be any naturally occurring amino acid
  misc_feature (14)..(14): Xaa can be Val or Ile or Met or Leu or Thr
  misc_feature (15)..(15): Xaa can be Leu or Ile
  misc_feature (16)..(23): Xaa can be any naturally occurring amino acid
  misc_feature (24)..(24): Xaa can be Leu or Ile or Val or Met
  misc_feature (25)..(38): Xaa can be any naturally occurring amino acid
  misc_feature (39)..(42): Xaa can be any naturally occurring amino acid or can be omitted
  misc_feature (43)..(43): Xaa can be Phe or Tyr or Trp or Pro
  misc_feature (44)..(44): Xaa can be any naturally occurring amino acid
  misc_feature (45)..(45): Xaa can be Val or Leu or Ile or Phe or Ser
  misc_feature (46)..(46): Xaa can be Ala or Ser or Thr or Gly
  misc_feature (47)..(53): Xaa can be any naturally occurring amino acid
  misc_feature (54)..(54): Xaa can be Gly or Ala
  misc_feature (55)..(55): Xaa can be Ser or Gln
  misc_feature (56)..(56): Xaa can be any naturally occurring amino acid
  misc_feature (57)..(57): Xaa can be Thr or Val
  misc_feature (58)..(58): Xaa can be Val or Ile or Ala
  misc_feature (59)..(59): Xaa can be Ala or Ser or Gly or Thr
  misc_feature (60)..(65): Xaa can be any naturally occurring amino acid
  misc_feature (66)..(66): Xaa can be Ile or Met or Leu or Val
  misc_feature (67)..(87): Xaa can be any naturally occurring amino acid
  misc_feature (88)..(97): Xaa can be any naturally occurring amino acid or can be omitted
  misc_feature (99)..(99): Xaa can be Ser or Ala or Gly or Thr
  misc_feature (100)..(103): Xaa can be any naturally occurring amino acid
  misc_feature (104)..(104): Xaa can be His or Tyr or Trp or Ile
  misc_feature (105)..(105): Xaa can be any naturally occurring amino acid
  misc_feature (106)..(106): Xaa can be Asn or Thr or Pro
  misc_feature (107)..(107): Xaa can be Asp or His
  misc_feature (108)..(109): Xaa can be any naturally occurring amino acid
  misc_feature (110)..(110): Xaa can be Phe or Tyr
  misc_feature (111)..(111): Xaa can be Trp or Phe
  misc_feature (112)..(112): Xaa can be Leu or Met or Ile or Val or His
XXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXX

SEQ ID NO: 4362 - protein, 782 aa, Artificial
  consensus
  misc_feature (1)..(93): Xaa can be any naturally occurring amino acid
  misc_feature (95)..(96): Xaa can be any naturally occurring amino acid
  misc_feature (98)..(108): Xaa can be any naturally occurring amino acid
  misc_feature (110)..(145): Xaa can be any naturally occurring amino acid
  misc_feature (147)..(147): Xaa can be any naturally occurring amino acid
  misc_feature (149)..(150): Xaa can be any naturally occurring amino acid
  misc_feature (152)..(163): Xaa can be any naturally occurring amino acid
  misc_feature (165)..(167): Xaa can be any naturally occurring amino acid
  misc_feature (169)..(174): Xaa can be any naturally occurring amino acid
  misc_feature (176)..(176): Xaa can be any naturally occurring amino acid
  misc_feature (178)..(180): Xaa can be any naturally occurring amino acid
  misc_feature (182)..(188): Xaa can be any naturally occurring amino acid
  misc_feature (190)..(195): Xaa can be any naturally occurring amino acid
  misc_feature (197)..(209): Xaa can be any naturally occurring amino acid
  misc_feature (211)..(219): Xaa can be any naturally occurring amino acid
  misc_feature (221)..(254): Xaa can be any naturally occurring amino acid
  misc_feature (256)..(258): Xaa can be any naturally occurring amino acid
  misc_feature (261)..(261): Xaa can be any naturally occurring amino acid
  misc_feature (263)..(263): Xaa can be any naturally occurring amino acid
  misc_feature (265)..(277): Xaa can be any naturally occurring amino acid
  misc_feature (279)..(283): Xaa can be any naturally occurring amino acid
  misc_feature (285)..(381): Xaa can be any naturally occurring amino acid
  misc_feature (383)..(393): Xaa can be any naturally occurring amino acid
  misc_feature (395)..(396): Xaa can be any naturally occurring amino acid
  misc_feature (398)..(549): Xaa can be any naturally occurring amino acid
  misc_feature (551)..(554): Xaa can be any naturally occurring amino acid
  misc_feature (556)..(595): Xaa can be any naturally occurring amino acid
  misc_feature (597)..(598): Xaa can be any naturally occurring amino acid
  misc_feature (600)..(600): Xaa can be any naturally occurring amino acid
  misc_feature (603)..(607): Xaa can be any naturally occurring amino acid
  misc_feature (609)..(611): Xaa can be any naturally occurring amino acid
  misc_feature (613)..(646): Xaa can be any naturally occurring amino acid
  misc_feature (649)..(649): Xaa can be any naturally occurring amino acid
  misc_feature (653)..(661): Xaa can be any naturally occurring amino acid
  misc_feature (663)..(686): Xaa can be any naturally occurring amino acid
  misc_feature (688)..(690): Xaa can be any naturally occurring amino acid
  misc_feature (692)..(696): Xaa can be any naturally occurring amino acid
  misc_feature (698)..(698): Xaa can be any naturally occurring amino acid
  misc_feature (701)..(702): Xaa can be any naturally occurring amino acid
  misc_feature (705)..(782): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXXLXXXXXXXXXXXGXXXXXXXXXXXXXXXXXXXXXXXXXXXXXXXXXXXXGXGXXLXXXXXXXXXXXXGXXXGXXXXXXGXAXXXAXXXXXXXGXXXXXXAXXXXXXXXXXXXXFXXXXXXXXXPXXXXXXXXXXXXXXXXXXXXXXXXXXXXXXXXXXHXXXPPXPXPXXXXXXXXXXXXXGXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXPXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXAXXXXXXXXXXXXXXXXXXXXXXXXXXXXXXXXXXXXXXXXLXXGXGGXXXXXLXXXGXXXXXXXXXXXXXXXXXXXXXXXXXXXXXXXXXXGSXTVAXXXXXXXXXPXXXXXXXXXXXXXXXXXXXXXXXXAXXXGXXXXXHXNDXXFWXXXXXXXXXXXXXXXXXXXXXXXXXXXXXXXXXXXXXXXXXXXXXXXXXXXXXXXXXXXXXXXXXXXXXXXXXXXXXX

SEQ ID NO: 4363 - protein, 25 aa, Artificial
  consensus
  misc_feature (1)..(1): Xaa can be Leu or Ile
  misc_feature (2)..(2): Xaa can be Ser or Ala
  misc_feature (5)..(5): Xaa can be any naturally occurring amino acid
  misc_feature (7)..(7): Xaa can be any naturally occurring amino acid
  misc_feature (8)..(8): Xaa can be Ile or Val
  misc_feature (10)..(0 1): Xaa can be any naturally occurring amino acid
  misc_feature (11)..(11): Xaa can be Tyr or Phe
  misc_feature (13)..(15): Xaa can be any naturally occurring amino acid
  misc_feature (16)..(16): Xaa can be Leu or Met
  misc_feature (19)..(19): Xaa can be Leu or Ile
  misc_feature (22)..(22): Xaa can be Leu or Ile
XXSRXFXXDXXHXXXXVPXADXFNH

SEQ ID NO: 4364 - protein, 28 aa, Artificial
  consensus
  misc_feature (2)..(2): Xaa can be Val or Ile
  misc_feature (3)..(3): Xaa can be Phe or Tyr
  misc_feature (5)..(5): Xaa can be Thr or Ser
  misc_feature (8)..(10): Xaa can be any naturally occurring amino acid
  misc_feature (12)..(13): Xaa can be any naturally occurring amino acid
  misc_feature (16)..(16): Xaa can be any naturally occurring amino acid
  misc_feature (17)..(17): Xaa can be Arg or Lys
  misc_feature (21)..(24): Xaa can be any naturally occurring amino acid
  misc_feature (26)..(27): Xaa can be any naturally occurring amino acid
EXXNXYGXXXNXXLLXXYGFXXXXNXXD

SEQ ID NO: 4365 - protein, 612 aa, Artificial
  consensus
  misc_feature (1)..(65): Xaa can be any naturally occurring amino acid
  misc_feature (67)..(68): Xaa can be any naturally occurring amino acid
  misc_feature (70)..(94): Xaa can be any naturally occurring amino acid
  misc_feature (96)..(114): Xaa can be any naturally occurring amino acid
  misc_feature (116)..(118): Xaa can be any naturally occurring amino acid
  misc_feature (120)..(126): Xaa can be any naturally occurring amino acid
  misc_feature (128)..(128): Xaa can be any naturally occurring amino acid
  misc_feature (130)..(159): Xaa can be any naturally occurring amino acid
  misc_feature (161)..(162): Xaa can be any naturally occurring amino acid
  misc_feature (164)..(231): Xaa can be any naturally occurring amino acid
  misc_feature (234)..(234): Xaa can be any naturally occurring amino acid
  misc_feature (236)..(237): Xaa can be any naturally occurring amino acid
  misc_feature (239)..(240): Xaa can be any naturally occurring amino acid
  misc_feature (242)..(245): Xaa can be any naturally occurring amino acid
  misc_feature (248)..(248): Xaa can be any naturally occurring amino acid
  misc_feature (251)..(251): Xaa can be any naturally occurring amino acid
  misc_feature (255)..(361): Xaa can be any naturally occurring amino acid
  misc_feature (363)..(364): Xaa can be any naturally occurring amino acid
  misc_feature (366)..(366): Xaa can be any naturally occurring amino acid
  misc_feature (369)..(371): Xaa can be any naturally occurring amino acid
  misc_feature (373)..(374): Xaa can be any naturally occurring amino acid
  misc_feature (377)..(378): Xaa can be any naturally occurring amino acid
  misc_feature (382)..(385): Xaa can be any naturally occurring amino acid
  misc_feature (387)..(388): Xaa can be any naturally occurring amino acid
  misc_feature (390)..(612): Xaa can be any naturally occurring amino acid
XXXXXXXXXXXXXXXXXXXXXXXXXXXXXXXXXXXXXXXXXXXXXXXXXXXXXXXXXXXXXXXXXGXXVXXXXXXXXXXXXXXXXXXXXXXXXXSXXXXXXXXXXXXXXXXXXXAXXXEXXXXXXXSXWXXXXXXXXXXXXXXXXXXXXXXXXXXXXXXLXXTXXXXXXXXXXXXXXXXXXXXXXXXXXXXXXXXXXXXXXXXXXXXXXXXXXXXXXXXXXXXXXXXXXXXSRXFXXDXXHXXXXVPXADXFNHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXNXYGXXXNXXLLXXYGFXXXXNXXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 4366 - protein, 612 aa, Artificial
  consensus
  misc_feature (1)..(23): Xaa can be any naturally occurring amino acid
  misc_feature (25)..(65): Xaa can be any naturally occurring amino acid
  misc_feature (67)..(68): Xaa can be any naturally occurring amino acid
  misc_feature (70)..(70): Xaa can be any naturally occurring amino acid
  misc_feature (72)..(85): Xaa can be any naturally occurring amino acid
  misc_feature (87)..(94): Xaa can be any naturally occurring amino acid
  misc_feature (96)..(107): Xaa can be any naturally occurring amino acid
  misc_feature (109)..(109): Xaa can be any naturally occurring amino acid
  misc_feature (111)..(111): Xaa can be any naturally occurring amino acid
  misc_feature (113)..(114): Xaa can be any naturally occurring amino acid
  misc_feature (116)..(117): Xaa can be any naturally occurring amino acid
  misc_feature (120)..(126): Xaa can be any naturally occurring amino acid
  misc_feature (128)..(128): Xaa can be any naturally occurring amino acid
  misc_feature (130)..(131): Xaa can be any naturally occurring amino acid
  misc_feature (134)..(147): Xaa can be any naturally occurring amino acid
  misc_feature (149)..(158): Xaa can be any naturally occurring amino acid
  misc_feature (161)..(161): Xaa can be any naturally occurring amino acid
  misc_feature (164)..(183): Xaa can be any naturally occurring amino acid
  misc_feature (185)..(231): Xaa can be any naturally occurring amino acid
  misc_feature (234)..(234): Xaa can be any naturally occurring amino acid
  misc_feature (236)..(236): Xaa can be any naturally occurring amino acid
  misc_feature (239)..(239): Xaa can be any naturally occurring amino acid
  misc_feature (243)..(245): Xaa can be any naturally occurring amino acid
  misc_feature (248)..(248): Xaa can be any naturally occurring amino acid
  misc_feature (255)..(260): Xaa can be any naturally occurring amino acid
  misc_feature (262)..(262): Xaa can be any naturally occurring amino acid
  misc_feature (264)..(267): Xaa can be any naturally occurring amino acid
  misc_feature (269)..(345): Xaa can be any naturally occurring amino acid
  misc_feature (347)..(353): Xaa can be any naturally occurring amino acid
  misc_feature (355)..(355): Xaa can be any naturally occurring amino acid
  misc_feature (358)..(361): Xaa can be any naturally occurring amino acid
  misc_feature (363)..(364): Xaa can be any naturally occurring amino acid
  misc_feature (369)..(371): Xaa can be any naturally occurring amino acid
  misc_feature (373)..(374): Xaa can be any naturally occurring amino acid
  misc_feature (377)..(377): Xaa can be any naturally occurring amino acid
  misc_feature (382)..(385): Xaa can be any naturally occurring amino acid
  misc_feature (387)..(388): Xaa can be any naturally occurring amino acid
  misc_feature (390)..(422): Xaa can be any naturally occurring amino acid
  misc_feature (424)..(473): Xaa can be any naturally occurring amino acid
  misc_feature (475)..(542): Xaa can be any naturally occurring amino acid
  misc_feature (544)..(570): Xaa can be any naturally occurring amino acid
  misc_feature (572)..(576): Xaa can be any naturally occurring amino acid
  misc_feature (578)..(580): Xaa can be any naturally occurring amino acid
  misc_feature (582)..(584): Xaa can be any naturally occurring amino acid
  misc_feature (586)..(612): Xaa can be any naturally occurring amino acid
XXXXXXXXXXXXXXXXXXXXXXXGXXXXXXXXXXXXXXXXXXXXXXXXXXXXXXXXXXXXXXXXXGXXVXAXXXXXXXXXXXXXXKXXXXXXXXSXXXXXXXXXXXXGXLXLXXAXXYEXXXXXXXSXWXXYLXXXXXXXXXXXXXXPXXXXXXXXXXLLXGTXXXXXXXXXXXXXXXXXXXXIXXXXXXXXXXXXXXXXXXXXXXXXXXXXXXXXXXXXXXXXXXXXXXXSRXFXIDXYHGXXXVPXADLFNHXXXXXXVXFXXXXDXXXXXXXXXXXXXXXXXXXXXXXXXXXXXXXXXXXXXXXXXXXXXXXXXXXXXXXXXXXXXXXXXXXXXXXXXXXXXDXXXXXXXVXDVXXXXEXXNTYGXXXNXXLLXRYGFXXXXNXXDXXXXXXXXXXXXXXXXXXXXXXXXXXXXXXXXXYXXXXXXXXXXXXXXXXXXXXXXXXXXXXXXXXXXXXXXXXXXXXXXXXXXYXXXXXXXXXXXXXXXXXXXXXXXXXXXXXXXXXXXXXXXXXXXXXXXXXXXXXXXXXXXXXXXXXXXXLXXXXXXXXXXXXXXXXXXXXXXXXXXXLXXXXXLXXXEXXXLXXXXXXXXXXXXXXXXXXXXXXXXXXX

SEQ ID NO: 4367 - protein, 66 aa, Artificial
  consensus
  misc_feature (1)..(1): Xaa can be Ser or Ala
  misc_feature (2)..(2): Xaa can be any naturally occurring amino acid
  misc_feature (4)..(4): Xaa can be Ser or Ala
  misc_feature (6)..(6): Xaa can be any naturally occurring amino acid
  misc_feature (8)..(9): Xaa can be any naturally occurring amino acid
  misc_feature (10)..(10): Xaa can be Arg or Lys
  misc_feature (11)..(11): Xaa can be any naturally occurring amino acid
  misc_feature (17)..(17): Xaa can be any naturally occurring amino acid
  misc_feature (22)..(22): Xaa can be Asp or Glu
  misc_feature (23)..(23): Xaa can be Val or Leu
  misc_feature (26)..(26): Xaa can be Arg or Lys
  misc_feature (27)..(27): Xaa can be any naturally occurring amino acid
  misc_feature (29)..(29): Xaa can be Glu or Asp
  misc_feature (33)..(33): Xaa can be any naturally occurring amino acid
  misc_feature (35)..(38): Xaa can be any naturally occurring amino acid
  misc_feature (41)..(41): Xaa can be Lys or Arg
  misc_feature (44)..(44): Xaa can be Asp or Glu
  misc_feature (45)..(46): Xaa can be any naturally occurring amino acid
  misc_feature (48)..(48): Xaa can be Met or Leu
  misc_feature (64)..(64): Xaa can be any naturally occurring amino acid
XXAXDXGXXXXKRTRAXGEALXXLKXXFXINPXPXXXXRKXISXXXGXPEKNVRIWFQNRRAKXRK

SEQ ID NO: 4368 - protein, 107 aa, Artificial
  consensus
  misc_feature (1)..(1): Xaa can be Phe or Tyr
  misc_feature (3)..(3): Xaa can be Arg or Lys
  misc_feature (8)..(8): Xaa can be any naturally occurring amino acid
  misc_feature (10)..(10): Xaa can be any naturally occurring amino acid
  misc_feature (15)..(15): Xaa can be any naturally occurring amino acid
  misc_feature (17)..(18): Xaa can be any naturally occurring amino acid
  misc_feature (20)..(20): Xaa can be Ile or Leu
  misc_feature (26)..(26): Xaa can be any naturally occurring amino acid
  misc_feature (28)..(28): Xaa can be Met or Leu
  misc_feature (32)..(32): Xaa can be any naturally occurring amino acid
  misc_feature (34)..(34): Xaa can be any naturally occurring amino acid
  misc_feature (36)..(40): Xaa can be any naturally occurring amino acid
  misc_feature (43)..(43): Xaa can be any naturally occurring amino acid
  misc_feature (45)..(45): Xaa can be any naturally occurring amino acid
  misc_feature (50)..(51): Xaa can be any naturally occurring amino acid
  misc_feature (54)..(54): Xaa can be any naturally occurring amino acid
  misc_feature (71)..(71): Xaa can be any naturally occurring amino acid
  misc_feature (73)..(73): Xaa can be Ile or Val
  misc_feature (80)..(80): Xaa can be Mez or Ile
  misc_feature (94)..(94): Xaa can be Leu or Ile
  misc_feature (95)..(95): Xaa can be any naturally occurring amino acid
  misc_feature (98)..(98): Xaa can be any naturally occurring amino acid
  misc_feature (103)..(103): Xaa can be any naturally occurring amino acid
  misc_feature (105)..(107): Xaa can be Asp or Glu
XDXIPLNXNXNYYFXDXXSXTVGSWXRXKSGXLXRXXXXXIKXLXNLSPXXINXIMSNATDLMVLISKKNXEXNYFFSAXANNTKILFRIFFPXXSVXNCSLXLXXX

SEQ ID NO: 4369 - protein, 48 aa, Artificial
  consensus
  misc_feature (7)..(7): Xaa can be Asp or Glu
  misc_feature (16)..(16): Xaa can be any naturally occurring amino acid
  misc_feature (19)..(19): Xaa can be Phe or Tyr
  misc_feature (25)..(25): Xaa can be any naturally occurring amino acid
  misc_feature (28)..(28): Xaa can be any naturally occurring amino acid
  misc_feature (30)..(30): Xaa can be any naturally occurring amino acid
  misc_feature (33)..(34): Xaa can be any naturally occurring amino acid
  misc_feature (37)..(37): Xaa can be Arg or Lys
  misc_feature (40)..(40): Xaa can be any naturally occurring amino acid
  misc_feature (47)..(47): Xaa can be any naturally occurring amino acid
NQWSICXDFSEGRQVXDAXVGGSNXPHXLXGLXXSLXFMXSLILDYXS

SEQ ID NO: 4370 - protein, 559 aa, Artificial
  consensus
  misc_feature (1)..(70): Xaa can be any naturally occurring amino acid
  misc_feature (72)..(72): Xaa can be any naturally occurring amino acid
  misc_feature (74)..(74): Xaa can be any naturally occurring amino acid
  misc_feature (76)..(79): Xaa can be any naturally occurring amino acid
  misc_feature (85)..(85): Xaa can be any naturally occurring amino acid
  misc_feature (90)..(91): Xaa can be any naturally occurring amino acid
  misc_feature (94)..(95): Xaa can be any naturally occurring amino acid
  misc_feature (97)..(97): Xaa can be any naturally occurring amino acid
  misc_feature (101)..(101): Xaa can be any naturally occurring amino acid
  misc_feature (103)..(106): Xaa can be any naturally occurring amino acid
  misc_feature (109)..(109): Xaa can be any naturally occurring amino acid
  misc_feature (112)..(114): Xaa can be any naturally occurring amino acid
  misc_feature (116)..(116): Xaa can be any naturally occurring amino acid
  misc_feature (132)..(132): Xaa can be any naturally occurring amino acid
  misc_feature (135)..(160): Xaa can be any naturally occurring amino acid
  misc_feature (162)..(162): Xaa can be any naturally occurring amino acid
  misc_feature (164)..(168): Xaa can be any naturally occurring amino acid
  misc_feature (170)..(183): Xaa can be any naturally occurring amino acid
  misc_feature (185)..(185): Xaa can be any naturally occurring amino acid
  misc_feature (190)..(190): Xaa can be any naturally occurring amino acid
  misc_feature (192)..(192): Xaa can be any naturally occurring amino acid
  misc_feature (197)..(197): Xaa can be any naturally occurring amino acid
  misc_feature (199)..(200): Xaa can be any naturally occurring amino acid
  misc_feature (202)..(202): Xaa can be any naturally occurring amino acid
  misc_feature (208)..(208): Xaa can be any naturally occurring amino acid
  misc_feature (210)..(210): Xaa can be any naturally occurring amino acid
  misc_feature (214)..(214): Xaa can be any naturally occurring amino acid
  misc_feature (216)..(216): Xaa can be any naturally occurring amino acid
  misc_feature (218)..(222): Xaa can be any naturally occurring amino acid
  misc_feature (225)..(225): Xaa can be any naturally occurring amino acid
  misc_feature (227)..(227): Xaa can be any naturally occurring amino acid
  misc_feature (232)..(233): Xaa can be any naturally occurring amino acid
  misc_feature (236)..(236): Xaa can be any naturally occurring amino acid
  misc_feature (253)..(253): Xaa can be any naturally occurring amino acid
  misc_feature (255)..(255): Xaa can be any naturally occurring amino acid
  misc_feature (262)..(262): Xaa can be any naturally occurring amino acid
  misc_feature (276)..(277): Xaa can be any naturally occurring amino acid
  misc_feature (280)..(280): Xaa can be any naturally occurring amino acid
  misc_feature (285)..(285): Xaa can be any naturally occurring amino acid
  misc_feature (287)..(319): Xaa can be any naturally occurring amino acid
  misc_feature (321)..(324): Xaa can be any naturally occurring amino acid
  misc_feature (326)..(329): Xaa can be any naturally occurring amino acid
  misc_feature (331)..(335): Xaa can be any naturally occurring amino acid
  misc_feature (340)..(340): Xaa can be any naturally occurring amino acid
  misc_feature (342)..(344): Xaa can be any naturally occurring amino acid
  misc_feature (346)..(346): Xaa can be any naturally occurring amino acid
  misc_feature (352)..(358): Xaa can be any naturally occurring amino acid
  misc_feature (360)..(363): Xaa can be any naturally occurring amino acid
  misc_feature (370)..(370): Xaa can be any naturally occurring amino acid
  misc_feature (379)..(379): Xaa can be any naturally occurring amino acid
  misc_feature (382)..(382): Xaa can be any naturally occurring amino acid
  misc_feature (388)..(388): Xaa can be any naturally occurring amino acid
  misc_feature (391)..(391): Xaa can be any naturally occurring amino acid
  misc_feature (393)..(393): Xaa can be any naturally occurring amino acid
  misc_feature (396)..(397): Xaa can be any naturally occurring amino acid
  misc_feature (400)..(400): Xaa can be any naturally occurring amino acid
  misc_feature (403)..(403): Xaa can be any naturally occurring amino acid
  misc_feature (410)..(410): Xaa can be any naturally occurring amino acid
  misc_feature (412)..(416): Xaa can be any naturally occurring amino acid
  misc_feature (418)..(428): Xaa can be any naturally occurring amino acid
  misc_feature (430)..(434): Xaa can be any naturally occurring amino acid
  misc_feature (436)..(448): Xaa can be any naturally occurring amino acid
  misc_feature (450)..(457): Xaa can be any naturally occurring amino acid
  misc_feature (459)..(464): Xaa can be any naturally occurring amino acid
  misc_feature (466)..(481): Xaa can be any naturally occurring amino acid
  misc_feature (483)..(513): Xaa can be any naturally occurring amino acid
  misc_feature (515)..(515): Xaa can be any naturally occurring amino acid
  misc_feature (517)..(520): Xaa can be any naturally occurring amino acid
  misc_feature (522)..(529): Xaa can be any naturally occurring amino acid
  misc_feature (531)..(532): Xaa can be any naturally occurring amino acid
  misc_feature (534)..(539): Xaa can be any naturally occurring amino acid
  misc_feature (541)..(541): Xaa can be any naturally occurring amino acid
  misc_feature (543)..(547): Xaa can be any naturally occurring amino acid
  misc_feature (549)..(559): Xaa can be any naturally occurring amino acid
XXXXXXXXXXXXXXXXXXXXXXXXXXXXXXXXXXXXXXXXXXXXXXXXXXXXXXXXXXXXXXXXXXXXXXAXDXGXXXXKRTRAXGEALXXLKXXFXINPXPXXXXRKXISXXXGXPEKNVRIWFQNRRAKXRKXXXXXXXXXXXXXXXXXXXXXXXXXXTXNXXXXXTXXXXXXXXXXXXXXDXIPLNXNXNYYFXDXXSXTVGSWXRXKSGXLXRXXXXXIKXLXNLSPXXINXIMSNATDLMVLISKKNXEXNYFFSAXANNTKILFRIFFPXXSVXNCSLXLXXXXXXXXXXXXXXXXXXXXXXXXXXXXXXXXXNXXXXEXXXXAXXXXXELKLXVXXXPXFAVYFXXXXXXXDXXXXNQWSICXDFSEGRQVXDAXVGGSNXPHXLXGLXXSLXFMXSLILDYXSXXXXXPXXXXXXXXXXXPXXXXXPXXXXXXXXXXXXXPXXXXXXXXFXXXXXXSXXXXXXXXXXXXXXXXQXXXXXXXXXXXXXXXXXXXXXXXXXXXXXXXEXLXXXXDXXXXXXXXLXXLXXXXXXPXTXXXXXNXXXXXXXXXXX

SEQ ID NO: 4371 - protein, 196 aa, Artificial; identical to SEQ ID NO: 1959
  consensus
  misc_feature (2)..(4): Xaa can be any naturally occurring amino acid
  misc_feature (7)..(9): Xaa can be any naturally occurring amino acid
  misc_feature (11)..(16): Xaa can be any naturally occurring amino acid
  misc_feature (18)..(21): Xaa can be any naturally occurring amino acid
  misc_feature (23)..(23): Xaa can be any naturally occurring amino acid
  misc_feature (25)..(25): Xaa can be any naturally occurring amino acid
  misc_feature (29)..(29): Xaa can be any naturally occurring amino acid
  misc_feature (34)..(35): Xaa can be any naturally occurring amino acid
  misc_feature (41)..(43): Xaa can be any naturally occurring amino acid
  misc_feature (45)..(48): Xaa can be any naturally occurring amino acid
  misc_feature (49)..(52): Xaa can be any naturally occurring amino acid or can be omitted
  misc_feature (54)..(57): Xaa can be any naturally occurring amino acid
  misc_feature (59)..(60): Xaa can be any naturally occurring amino acid
  misc_feature (62)..(73): Xaa can be any naturally occurring amino acid
  misc_feature (75)..(75): Xaa can be any naturally occurring amino acid
  misc_feature (77)..(95): Xaa can be any naturally occurring amino acid
  misc_feature (97)..(98): Xaa can be any naturally occurring amino acid
  misc_feature (100)..(100): Xaa can be any naturally occurring amino acid
  misc_feature (102)..(103): Xaa can be any naturally occurring amino acid
  misc_feature (107)..(108): Xaa can be any naturally occurring amino acid
  misc_feature (110)..(110): Xaa can be any naturally occurring amino acid
  misc_feature (112)..(113): Xaa can be any naturally occurring amino acid
  misc_feature (115)..(124): Xaa can be any naturally occurring amino acid
  misc_feature (127)..(127): Xaa can be any naturally occurring amino acid
  misc_feature (129)..(139): Xaa can be any naturally occurring amino acid
  misc_feature (140)..(142): Xaa can be any naturally occurring amino acid or can be omitted
  misc_feature (144)..(146): Xaa can be any naturally occurring amino acid
  misc_feature (148)..(148): Xaa can be any naturally occurring amino acid
  misc_feature (150)..(153): Xaa can be any naturally occurring amino acid
  misc_feature (156)..(157): Xaa can be any naturally occurring amino acid
  misc_feature (160)..(160): Xaa can be any naturally occurring amino acid
  misc_feature (162)..(169): Xaa can be any naturally occurring amino acid
  misc_feature (171)..(172): Xaa can be any naturally occurring amino acid
  misc_feature (173)..(174): Xaa can be any naturally occurring amino acid or can be omitted
  misc_feature (176)..(178): Xaa can be any naturally occurring amino acid
  misc_feature (180)..(182): Xaa can be any naturally occurring amino acid
  misc_feature (186)..(186): Xaa can be any naturally occurring amino acid
  misc_feature (188)..(191): Xaa can be any naturally occurring amino acid
  misc_feature (193)..(195): Xaa can be any naturally occurring amino acid

SEQ ID NO: 4372 - protein, 243 aa, Artificial; identical to SEQ ID NO: 1960
  consensus
  misc_feature (1)..(7): Xaa can be any naturally occurring amino acid
  misc_feature (9)..(11): Xaa can be any naturally occurring amino acid
  misc_feature (14)..(16): Xaa can be any naturally occurring amino acid
  misc_feature (18)..(23): Xaa can be any naturally occurring amino acid
  misc_feature (25)..(28): Xaa can be any naturally occurring amino acid
  misc_feature (30)..(30): Xaa can be any naturally occurring amino acid
  misc_feature (32)..(32): Xaa can be any naturally occurring amino acid
  misc_feature (36)..(36): Xaa can be any naturally occurring amino acid
  misc_feature (41)..(42): Xaa can be any naturally occurring amino acid
  misc_feature (48)..(50): Xaa can be any naturally occurring amino acid
  misc_feature (52)..(59): Xaa can be any naturally occurring amino acid
  misc_feature (61)..(64): Xaa can be any naturally occurring amino acid
  misc_feature (66)..(67): Xaa can be any naturally occurring amino acid
  misc_feature (69)..(80): Xaa can be any naturally occurring amino acid
  misc_feature (82)..(82): Xaa can be any naturally occurring amino acid
  misc_feature (84)..(102): Xaa can be any naturally occurring amino acid
  misc_feature (104)..(105): Xaa can be any naturally occurring amino acid
  misc_feature (107)..(107): Xaa can be any naturally occurring amino acid
  misc_feature (109)..(110): Xaa can be any naturally occurring amino acid
  misc_feature (114)..(115): Xaa can be any naturally occurring amino acid
  misc_feature (117)..(117): Xaa can be any naturally occurring amino acid
  misc_feature (119)..(120): Xaa can be any naturally occurring amino acid
  misc_feature (122)..(131): Xaa can be any naturally occurring amino acid
  misc_feature (134)..(134): Xaa can be any naturally occurring amino acid
  misc_feature (136)..(149): Xaa can be any naturally occurring amino acid
  misc_feature (151)..(153): Xaa can be any naturally occurring amino acid
  misc_feature (155)..(155): Xaa can be any naturally occurring amino acid
  misc_feature (157)..(160): Xaa can be any naturally occurring amino acid
  misc_feature (163)..(164): Xaa can be any naturally occurring amino acid
  misc_feature (167)..(167): Xaa can be any naturally occurring amino acid
  misc_feature (169)..(176): Xaa can be any naturally occurring amino acid
  misc_feature (178)..(181): Xaa can be any naturally occurring amino acid
  misc_feature (183)..(185): Xaa can be any naturally occurring amino acid
  misc_feature (187)..(189): Xaa can be any naturally occurring amino acid
  misc_feature (193)..(193): Xaa can be any naturally occurring amino acid
  misc_feature (195)..(198): Xaa can be any naturally occurring amino acid
  misc_feature (200)..(202): Xaa can be any naturally occurring amino acid
  misc_feature (204)..(243): Xaa can be any naturally occurring amino acid

SEQ ID NO: 4373 - protein, 16 aa, Artificial
  consensus
  misc_feature (1)..(1): Xaa can be Phe or Tyr or Trp
  misc_feature (2)..(2): Xaa can be Ser or Thr
  misc_feature (3)..(3): Xaa can be Pro or Ser or Glu or Ala
  misc_feature (4)..(4): Xaa can be any naturally occurring amino acid
  misc_feature (6)..(6): Xaa can be any naturally occurring amino acid
  misc_feature (7)..(7): Xaa can be Leu or Val or Ile
  misc_feature (8)..(8): Xaa can be any naturally occurring amino acid
  misc_feature (10)..(10): Xaa can be Val or Ile or Leu
  misc_feature (11)..(11): Xaa can be Glu or Asp or Asn or Arg
  misc_feature (12)..(12): Xaa can be Tyr or His or Phe
  misc_feature (13)..(13): Xaa can be Ala or Gly or Ile or Ser
  misc_feature (14)..(15): Xaa can be any naturally occurring amino acid
  misc_feature (16)..(16): Xaa can be Ala or Ser or Gly
XXXXGXXXQXXXXXXX

SEQ ID NO: 4374 - protein, 74 aa, Artificial
  consensus
  misc_feature (1)..(1): Xaa can be Arg or Pro
  misc_feature (2)..(2): Xaa can be Pro or Ser
  misc_feature (3)..(3): Xaa can be Phe or Tyr or Leu or Met
  misc_feature (4)..(4): Xaa can be Gly or Ala
  misc_feature (5)..(7): Xaa can be any naturally occurring amino acid
  misc_feature (8)..(8): Xaa can be Leu or Ile or Val or Met or Thr
  misc_feature (9)..(10): Xaa can be any naturally occurring amino acid
  misc_feature (11)..(11): Xaa can be Gly or Ser or Ala
  misc_feature (12)..(17): Xaa can be any naturally occurring amino acid
  misc_feature (18)..(55): Xaa can be any naturally occurring amino acid or can be omitted
  misc_feature (56)..(56): Xaa can be Leu or Ile or Val
  misc_feature (57)..(57): Xaa can be Tyr or Phe or Trp
  misc_feature (58)..(60): Xaa can be any naturally occurring amino acid
  misc_feature (61)..(61): Xaa can be Pro or Ala
  misc_feature (62)..(62): Xaa can be Ser or Ala or Gly
  misc_feature (63)..(63): Xaa can be Gly or Ala
  misc_feature (64)..(69): Xaa can be any naturally occurring amino acid
  misc_feature (70)..(70): Xaa can be Ala or Gly
  misc_feature (71)..(73): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXG

SEQ ID NO: 4375 - protein, 501 aa, Artificial
  consensus
  misc_feature (1)..(126): Xaa can be any naturally occurring amino acid
  misc_feature (129)..(133): Xaa can be any naturally occurring amino acid
  misc_feature (137)..(137): Xaa can be any naturally occurring amino acid
  misc_feature (139)..(139): Xaa can be any naturally occurring amino acid
  misc_feature (141)..(141): Xaa can be any naturally occurring amino acid
  misc_feature (147)..(148): Xaa can be any naturally occurring amino acid
  misc_feature (150)..(158): Xaa can be any naturally occurring amino acid
  misc_feature (160)..(177): Xaa can be any naturally occurring amino acid
  misc_feature (179)..(212): Xaa can be any naturally occurring amino acid
  misc_feature (214)..(216): Xaa can be any naturally occurring amino acid
  misc_feature (218)..(225): Xaa can be any naturally occurring amino acid
  misc_feature (227)..(264): Xaa can be any naturally occurring amino acid
  misc_feature (266)..(270): Xaa can be any naturally occurring amino acid
  misc_feature (273)..(273): Xaa can be any naturally occurring amino acid
  misc_feature (275)..(280): Xaa can be any naturally occurring amino acid
  misc_feature (282)..(282): Xaa can be any naturally occurring amino acid
  misc_feature (284)..(325): Xaa can be any naturally occurring amino acid
  misc_feature (327)..(330): Xaa can be any naturally occurring amino acid
  misc_feature (334)..(339): Xaa can be any naturally occurring amino acid
  misc_feature (341)..(343): Xaa can be any naturally occurring amino acid
  misc_feature (345)..(383): Xaa can be any naturally occurring amino acid
  misc_feature (385)..(501): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYDXXXXXFSPXGXLXQVEYAXXAXXXXXXXXXGXXXXXXXXXXXXXXXXXXLXXXXXXXXXXXXXXXXXXXXXXXXXXXXXXXXXXGXXXDXXXXXXXXRXXXXXXXXXXXXXXXXXXXXXXXXXXXXXXXXXXXXXXTXXXXXRPXGXXXXXXGXDXXXXXXXXXXXXXXXXXXXXXXXXXXXXXXXXXXXXXXXXXXLXXXXPSGXXXXXXAXXXGXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 4376 - protein, 60 aa, Artificial; identical to SEQ ID NO: 1957
  consensus
  misc_feature (2)..(12): Xaa can be any naturally occurring amino acid
  misc_feature (13)..(13): Xaa can be any naturally occurring amino acid or can be omitted
  misc_feature (15)..(19): Xaa can be any naturally occurring amino acid
  misc_feature (21)..(21): Xaa can be any naturally occurring amino acid
  misc_feature (23)..(32): Xaa can be any naturally occurring amino acid
  misc_feature (34)..(44): Xaa can be any naturally occurring amino acid
  misc_feature (46)..(47): Xaa can be any naturally occurring amino acid
  misc_feature (49)..(59): Xaa can be any naturally occurring amino acid

SEQ ID NO: 4377 - protein, 1007 aa, Artificial; identical to SEQ ID NO: 249
  consensus
  misc_feature (1)..(42): Xaa can be any naturally occurring amino acid
  misc_feature (44)..(162): Xaa can be any naturally occurring amino acid
  misc_feature (164)..(187): Xaa can be any naturally occurring amino acid
  misc_feature (189)..(357): Xaa can be any naturally occurring amino acid
  misc_feature (359)..(377): Xaa can be any naturally occurring amino acid
  misc_feature (379)..(379): Xaa can be any naturally occurring amino acid
  misc_feature (381)..(383): Xaa can be any naturally occurring amino acid
  misc_feature (385)..(405): Xaa can be any naturally occurring amino acid
  misc_feature (407)..(437): Xaa can be any naturally occurring amino acid
  misc_feature (439)..(439): Xaa can be any naturally occurring amino acid
  misc_feature (441)..(448): Xaa can be any naturally occurring amino acid
  misc_feature (451)..(458): Xaa can be any naturally occurring amino acid
  misc_feature (460)..(463): Xaa can be any naturally occurring amino acid
  misc_feature (465)..(465): Xaa can be any naturally occurring amino acid
  misc_feature (467)..(469): Xaa can be any naturally occurring amino acid
  misc_feature (472)..(490): Xaa can be any naturally occurring amino acid
  misc_feature (492)..(500): Xaa can be any naturally occurring amino acid
  misc_feature (502)..(503): Xaa can be any naturally occurring amino acid
  misc_feature (505)..(508): Xaa can be any naturally occurring amino acid
  misc_feature (511)..(511): Xaa can be any naturally occurring amino acid
  misc_feature (513)..(517): Xaa can be any naturally occurring amino acid
  misc_feature (519)..(519): Xaa can be any naturally occurring amino acid
  misc_feature (521)..(522): Xaa can be any naturally occurring amino acid
  misc_feature (524)..(527): Xaa can be any naturally occurring amino acid
  misc_feature (529)..(534): Xaa can be any naturally occurring amino acid
  misc_feature (536)..(537): Xaa can be any naturally occurring amino acid
  misc_feature (539)..(549): Xaa can be any naturally occurring amino acid
  misc_feature (551)..(612): Xaa can be any naturally occurring amino acid
  misc_feature (614)..(1007): Xaa can be any naturally occurring amino acid

SEQ ID NO: 4378 - protein, 80 aa, Artificial
  consensus
  misc_feature (2)..(4): Xaa can be any naturally occurring amino acid
  misc_feature (6)..(6): Xaa can be any naturally occurring amino acid
  misc_feature (8)..(8): Xaa can be any naturally occurring amino acid
  misc_feature (9)..(9): Xaa can be Leu or Ile
  misc_feature (10)..(11): Xaa can be any naturally occurring amino acid
  misc_feature (13)..(13): Xaa can be any naturally occurring amino acid
  misc_feature (16)..(16): Xaa can be Thr or Val or Ser
  misc_feature (20)..(20): Xaa can be Leu or His or Met
  misc_feature (21)..(21): Xaa can be Leu or Ile
  misc_feature (22)..(22): Xaa can be Ala or Ser
  misc_feature (23)..(23): Xaa can be Lys or Arg
  misc_feature (24)..(24): Xaa can be Ala or Ser
  misc_feature (25)..(25): Xaa can be any naturally occurring amino acid
  misc_feature (26)..(26): Xaa can be Ala or Ser
  misc_feature (27)..(27): Xaa can be Gly or Thr
  misc_feature (30)..(30): Xaa can be any naturally occurring amino acid
  misc_feature (31)..(31): Xaa can be Val or Thr or Ala
  misc_feature (32)..(32): Xaa can be any naturally occurring amino acid
  misc_feature (33)..(33): Xaa can be Phe or Tyr
  misc_feature (34)..(36): Xaa can be any naturally occurring amino acid
  misc_feature (37)..(37): Xaa can be Ser or Asn or Ala
  misc_feature (38)..(38): Xaa can be Gly or Ala
  misc_feature (39)..(39): Xaa can be Ser or Ala or Pro
  misc_feature (40)..(40): Xaa can be any naturally occurring amino acid
  misc_feature (42)..(42): Xaa can be any naturally occurring amino acid
  misc_feature (32)..(43): Xaa can be Glu or Gln
  misc_feature (44)..(45): Xaa can be any naturally occurring amino acid
  misc_feature (48)..(48): Xaa can be any naturally occurring amino acid
  misc_feature (50)..(50): Xaa can be Ala or Ser or Pro
  misc_feature (51)..(51): Xaa can be any naturally occurring amino acid
  misc_feature (53)..(53): Xaa can be Val or Ala or Ile
  misc_feature (55)..(56): Xaa can be any naturally occurring amino acid
  misc_feature (58)..(59): Xaa can be any naturally occurring amino acid
  misc_feature (60)..(60): Xaa can be Ala or Gly or Ser
  misc_feature (61)..(64): Xaa can be any naturally occurring amino acid
  misc_feature (65)..(65): Xaa can be Pro or Arg
  misc_feature (66)..(66): Xaa can be any naturally occurring amino acid
  misc_feature (67)..(67): Xaa can be Ile or Leu or Val
  misc_feature (56)..(68): Xaa can be any naturally occurring amino acid
  misc_feature (70)..(70): Xaa can be Ile or Val or Met
  misc_feature (73)..(73): Xaa can be any naturally occurring amino acid
  misc_feature (74)..(74): Xaa can be Asp or Glu
  misc_feature (75)..(75): Xaa can be Ala or Thr or Ser
  misc_feature (76)..(76): Xaa can be any naturally occurring amino acid
  misc_feature (77)..(77): Xaa can be Gly or Ala
  misc_feature (78)..(79): Xaa can be any naturally occurring amino acid
GXXXPXGXXXXGXPGXGKTXXXXXXXXEAXXXXXXXXXXXFXXXXVGXGXXRXRXXFXXXXXXXXXXXFXDEXXXXXXXR

SEQ ID NO: 4379 - protein, 58 aa, Artificial
  consensus
  misc_feature (2)..(2): Xaa can be Leu or Ile
  misc_feature (3)..(3): Xaa can be Asn or His
  misc_feature (4)..(4): Xaa can be Gln or Ala
  misc_feature (5)..(5): Xaa can be any naturally occurring amino acid
  misc_feature (7)..(7): Xaa can be any naturally occurring amino acid
  misc_feature (8)..(8): Xaa can be Glu or Asp
  misc_feature (9)..(9): Xaa can be Met or Leu
  misc_feature (12)..(12): Xaa can be Phe or Ile
  misc_feature (13)..(21): Xaa can be any naturally occurring amino acid
  misc_feature (22)..(25): Xaa can be any naturally occurring amino acid or can be omitted
  misc_feature (26)..(26): Xaa can be Ala or Gly or Cys
  misc_feature (27)..(27): Xaa can be Ala or Gly
  misc_feature (30)..(33): Xaa can be any naturally occurring amino acid
  misc_feature (36)..(36): Xaa can be any naturally occurring amino acid
  misc_feature (38)..(38): Xaa can be Leu or Ile
  misc_feature (39)..(39): Xaa can be any naturally occurring amino acid
  misc_feature (41)..(41): Xaa can be Pro or Ala
  misc_feature (44)..(44): Xaa can be Phe or Leu
  misc_feature (46)..(46): Xaa can be Arg or Lys or Val or Met
  misc_feature (47)..(49): Xaa can be any naturally occurring amino acid
  misc_feature (50)..(50): Xaa can be Val or Ile
  misc_feature (51)..(52): Xaa can be any naturally occurring amino acid
  misc_feature (54)..(54): Xaa can be Asp or Thr or Asn or Glu
  misc_feature (55)..(56): Xaa can be any naturally occurring amino acid
  misc_feature (57)..(57): Xaa can be Gly or Glu or Asp
TXXXXLXXXDGXXXXXXXXXXXXXXXXTNXXXXLDXAXXRXGRXDXXXXXXXPXXXXR

SEQ ID NO: 4380 - protein, 86 aa, Artificial
  consensus
  misc_feature (1)..(1): Xaa can be Ala or Ser
  misc_feature (2)..(2): Xaa can be any naturally occurring amino acid
  misc_feature (5)..(5): Xaa can be any naturally occurring amino acid
  misc_feature (8)..(21): Xaa can be any naturally occurring amino acid
  misc_feature (22)..(22): Xaa can be any naturally occurring amino acid or can be omitted
  misc_feature (23)..23): Xaa can be Arg or Lys or Gln or Glu
  misc_feature (24)..(27): Xaa can be any naturally occurring amino acid
  misc_feature (28)..(28): Xaa can be Pro or Ala or Ser or Gln
  misc_feature (29)..(29): Xaa can be Arg or Thr
  misc_feature (30)..(30): Xaa can be Gly or Ser or Thr or Ala
  misc_feature (31)..(33): Xaa can be any naturally occurring amino acid
  misc_feature (34)..(34): Xaa can be any naturally occurring amino acid or can be omitted
  misc_feature (36)..(40): Xaa can be any naturally occurring amino acid
  misc_feature (41)..(41): Xaa can be Pro or Gln or Ala or Arg
  misc_feature (42)..(60): Xaa can be any naturally occurring amino acid
  misc_feature (36)..(69): Xaa can be any naturally occurring amino acid
  misc_feature (61)..(64): Xaa can be any naturally occurring amino acid or can be omitted
  misc_feature (65)..(65): Xaa can be Gly or Ala or Ser
  misc_feature (66)..(66): Xaa can be Gly or Glu
  misc_feature (67)..(68): Xaa can be any naturally occurring amino acid
  misc_feature (69)..(69): Xaa can be Ala or Ser or Gly
  misc_feature (71)..(79): Xaa can be any naturally occurring amino acid
  misc_feature (80)..(81): Xaa can be any naturally occurring amino acid or can be omitted
  misc_feature (83)..(85): Xaa can be any naturally occurring amino acid
XXHEXGHXXXXXXXXXXXXXXXXXXXXXXXXXXXGXXXXXXXXXXXXXXXXXXXXXXXXXXXXXXXXXXEXXXXXXXXXXXGXXXD

SEQ ID NO: 4381 - protein, 1305 aa, Artificial
  consensus
  misc_feature (1)..(495): Xaa can be any naturally occurring amino acid
  misc_feature (497)..(552): Xaa can be any naturally occurring amino acid
  misc_feature (554)..(554): Xaa can be any naturally occurring amino acid
  misc_feature (559)..(560): Xaa can be any naturally occurring amino acid
  misc_feature (562)..(562): Xaa can be any naturally occurring amino acid
  misc_feature (564)..(564): Xaa can be any naturally occurring amino acid
  misc_feature (566)..(567): Xaa can be any naturally occurring amino acid
  misc_feature (569)..(569): Xaa can be any naturally occurring amino acid
  misc_feature (571)..(571): Xaa can be any naturally occurring amino acid
  misc_feature (574)..(575): Xaa can be any naturally occurring amino acid
  misc_feature (577)..(582): Xaa can be any naturally occurring amino acid
  misc_feature (584)..(586): Xaa can be any naturally occurring amino acid
  misc_feature (588)..(588): Xaa can be any naturally occurring amino acid
  misc_feature (590)..(590): Xaa can be any naturally occurring amino acid
  misc_feature (593)..(593): Xaa can be any naturally occurring amino acid
  misc_feature (605)..(605): Xaa can be any naturally occurring amino acid
  misc_feature (607)..(607): Xaa can be any naturally occurring amino acid
  misc_feature (612)..(612): Xaa can be any naturally occurring amino acid
  misc_feature (617)..(618): Xaa can be any naturally occurring amino acid
  misc_feature (622)..(622): Xaa can be any naturally occurring amino acid
  misc_feature (624)..(624): Xaa can be any naturally occurring amino acid
  misc_feature (633)..(633): Xaa can be any naturally occurring amino acid
  misc_feature (638)..(638): Xaa can be any naturally occurring amino acid
  misc_feature (640)..(641): Xaa can be any naturally occurring amino acid
  misc_feature (644)..(646): Xaa can be any naturally occurring amino acid
  misc_feature (650)..(650): Xaa can be any naturally occurring amino acid
  misc_feature (658)..(658): Xaa can be any naturally occurring amino acid
  misc_feature (660)..(661): Xaa can be any naturally occurring amino acid
  misc_feature (663)..(669): Xaa can be any naturally occurring amino acid
  misc_feature (672)..(672): Xaa can be any naturally occurring amino acid
  misc_feature (684)..(684): Xaa can be any naturally occurring amino acid
  misc_feature (690)..(699): Xaa can be any naturally occurring amino acid
  misc_feature (701)..(702): Xaa can be any naturally occurring amino acid
  misc_feature (708)..(708): Xaa can be any naturally occurring amino acid
  misc_feature (710)..(710): Xaa can be any naturally occurring amino acid
  misc_feature (713)..(713): Xaa can be any naturally occurring amino acid
  misc_feature (724)..(726): Xaa can be any naturally occurring amino acid
  misc_feature (728)..(729): Xaa can be any naturally occurring amino acid
  misc_feature (732)..(733): Xaa can be any naturally occurring amino acid
  misc_feature (736)..(737): Xaa can be any naturally occurring amino acid
  misc_feature (740)..(741): Xaa can be any naturally occurring amino acid
  misc_feature (743)..(761): Xaa can be any naturally occurring amino acid
  misc_feature (763)..(764): Xaa can be any naturally occurring amino acid
  misc_feature (768)..(769): Xaa can be any naturally occurring amino acid
  misc_feature (774)..(774): Xaa can be any naturally occurring amino acid
  misc_feature (776)..(777): Xaa can be any naturally occurring amino acid
  misc_feature (782)..(783): Xaa can be any naturally occurring amino acid
  misc_feature (785)..(785): Xaa can be any naturally occurring amino acid
  misc_feature (787)..(799): Xaa can be any naturally occurring amino acid
  misc_feature (801)..(806): Xaa can be any naturally occurring amino acid
  misc_feature (808)..(824): Xaa can be any naturally occurring amino acid
  misc_feature (829)..(829): Xaa can be any naturally occurring amino acid
  misc_feature (832)..(846): Xaa can be any naturally occurring amino acid
  misc_feature (848)..(849): Xaa can be any naturally occurring amino acid
  misc_feature (851)..(851): Xaa can be any naturally occurring amino acid
  misc_feature (855)..(856): Xaa can be any naturally occurring amino acid
  misc_feature (858)..(858): Xaa can be any naturally occurring amino acid
  misc_feature (860)..(864): Xaa can be any naturally occurring amino acid
  misc_feature (866)..(888): Xaa can be any naturally occurring amino acid
  misc_feature (892)..(892): Xaa can be any naturally occurring amino acid
  misc_feature (896)..(905): Xaa can be any naturally occurring amino acid
  misc_feature (908)..(909): Xaa can be any naturally occurring amino acid
  misc_feature (911)..(914): Xaa can be any naturally occurring amino acid
  misc_feature (916)..(917): Xaa can be any naturally occurring amino acid
  misc_feature (919)..(920): Xaa can be any naturally occurring amino acid
  misc_feature (923)..(925): Xaa can be any naturally occurring amino acid
  misc_feature (927)..(927): Xaa can be any naturally occurring amino acid
  misc_feature (929)..(931): Xaa can be any naturally occurring amino acid
  misc_feature (933)..(957): Xaa can be any naturally occurring amino acid
  misc_feature (959)..(964): Xaa can be any naturally occurring amino acid
  misc_feature (967)..(967): Xaa can be any naturally occurring amino acid
  misc_feature (969)..(997): Xaa can be any naturally occurring amino acid
  misc_feature (999)..(1001): Xaa can be any naturally occurring amino acid
  misc_feature (1004)..(1305): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAXXXXXXXXXXXXXXXXXXXXXXXXXXXXXXXXXXXXXXXXXXXXXXXXXXXXXXXXFXDVAGXXEXKXEXXEXVXFLXXPXXXXXXGXXXPXGXLLXGPPGTGKTLLAXAXAGEAXVPFFXXSGSXFXEMFVGVGAXRVRDXFXXAKXXXPCIXFIDEIDAXGXXRXXXXXXXGGXDEREQTLNQLLXEMDGFXXXXXXXXXXIXXAATNRXDXLDXALLRPGRFDRXXXVXXPDXXGRXXILXXHXXXXXXXXXXXXXXXXXXXAXXTPGXXGADLXNXXNEAAXXAXRXXXXXXXXXXXXXAXXXXXXGXXXXXXXXXXXXXXXXXAYHEXGHXXXXXXXXXXXXXXXKXXIXPRGXXAXGXXXXXPXXXXXXXXXXXXXXXXXXXXXXXGGRXAEEXXXXXXXXXXGAXXDXXXXTXXAXXMVXXXGXSXXXGXXXXXXXXXXXXXXXXXXXXXXXXXSXXXXXXIDXEXXXXXXXXXXXXXXXXXXXXXXXXXXXXXLXXXETXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 4382 - protein, 26 aa, Artificial
  consensus
  misc_feature (1)..(1): Xaa can be Asp or Glu
  misc_feature (2)..(2): Xaa can be Phe or Tyr or Trp
  misc_feature (3)..(3): Xaa can be Ala or Ser or Pro or Cys
  misc_feature (5)..(8): Xaa can be any naturally occurring amino acid
  misc_feature (9)..(9): Xaa can be His or Glu
  misc_feature (10)..(12): Xaa can be any naturally occurring amino acid
  misc_feature (13)..(13): Xaa can be Gly or Ala
  misc_feature (14)..(23): Xaa can be any naturally occurring amino acid
  misc_feature (24)..(24): Xaa can be Gly or Ser or Asp or Lys or Arg
  misc_feature (25)..(25): Xaa can be any naturally occurring amino acid
  misc_feature (26)..(26): Xaa can be Arg or Gly or Pro
XXXGXXXXXXXXXXXXXXXXXXXXXX

SEQ ID NO: 4383 - protein, 16 aa, Artificial
  consensus
  misc_feature (1)..(1): Xaa can be Gly or Ser
  misc_feature (2)..(4): Xaa can be any naturally occurring amino acid
  misc_feature (5)..(5): Xaa can be Leu or Ile or Val
  misc_feature (6)..(6): Xaa can be Trp or Met or Ala or Phe or Tyr or Val
  misc_feature (7)..(7): Xaa can be any naturally occurring amino acid
  misc_feature (8)..(8): Xaa can be Gly or Ala or Ser
  misc_feature (9)..(9): Xaa can be Trp or Phe
  misc_feature (10)..(10): Xaa can be any naturally occurring amino acid
  misc_feature (11)..(11): Xaa can be Gly or Ala or Cys or Phe or Leu
  misc_feature (12)..(12): Xaa can be Phe or Tyr
  misc_feature (13)..(13): Xaa can be Asn or Thr or Asp
  misc_feature (14)..(14): Xaa can be any naturally occurring amino acid
  misc_feature (15)..(15): Xaa can be Gly or Ala or Met
  misc_feature (16)..(16): Xaa can be Ser or Thr or Gly or Asp or Ala
XXXXXXXXXXXXXXXX

SEQ ID NO: 4384 - protein, 22 aa, Artificial
  consensus
  misc_feature (1)..(1): Xaa can be Asp or Val or Asn or His
  misc_feature (2)..(2): Xaa can be Asp or Glu
  misc_feature (3)..(9): Xaa can be any naturally occurring amino acid
  misc_feature (11)..(13): Xaa can be any naturally occurring amino acid
  misc_feature (15)..(16): Xaa can be any naturally occurring amino acid
  misc_feature (17)..(17): Xaa can be Gly or Ser or Ala
  misc_feature (18)..(21): Xaa can be any naturally occurring amino acid
  misc_feature (22)..(22): Xaa can be Gly or Ala or Ser or Ile or Met
XXXXXXXXXHXXXGXXXXXXXX

SEQ ID NO: 4385 - protein, 754 aa, Artificial
  consensus
  misc_feature (1)..(121): Xaa can be any naturally occurring amino acid
  misc_feature (124)..(125): Xaa can be any naturally occurring amino acid
  misc_feature (127)..(129): Xaa can be any naturally occurring amino acid
  misc_feature (131)..(136): Xaa can be any naturally occurring amino acid
  misc_feature (138)..(139): Xaa can be any naturally occurring amino acid
  misc_feature (141)..(141): Xaa can be any naturally occurring amino acid
  misc_feature (143)..(165): Xaa can be any naturally occurring amino acid
  misc_feature (167)..(170): Xaa can be any naturally occurring amino acid
  misc_feature (172)..(232): Xaa can be any naturally occurring amino acid
  misc_feature (234)..(235): Xaa can be any naturally occurring amino acid
  misc_feature (238)..(245): Xaa can be any naturally occurring amino acid
  misc_feature (247)..(250): Xaa can be any naturally occurring amino acid
  misc_feature (252)..(259): Xaa can be any naturally occurring amino acid
  misc_feature (261)..(268): Xaa can be any naturally occurring amino acid
  misc_feature (270)..(276): Xaa can be any naturally occurring amino acid
  misc_feature (278)..(321): Xaa can be any naturally occurring amino acid
  misc_feature (323)..(324): Xaa can be any naturally occurring amino acid
  misc_feature (330)..(331): Xaa can be any naturally occurring amino acid
  misc_feature (334)..(336): Xaa can be any naturally occurring amino acid
  misc_feature (338)..(340): Xaa can be any naturally occurring amino acid
  misc_feature (342)..(347): Xaa can be any naturally occurring amino acid
  misc_feature (349)..(349): Xaa can be any naturally occurring amino acid
  misc_feature (351)..(407): Xaa can be any naturally occurring amino acid
  misc_feature (409)..(415): Xaa can be any naturally occurring amino acid
  misc_feature (417)..(419): Xaa can be any naturally occurring amino acid
  misc_feature (422)..(422): Xaa can be any naturally occurring amino acid
  misc_feature (425)..(425): Xaa can be any naturally occurring amino acid
  misc_feature (429)..(429): Xaa can be any naturally occurring amino acid
  misc_feature (432)..(461): Xaa can be any naturally occurring amino acid
  misc_feature (463)..(493): Xaa can be any naturally occurring amino acid
  misc_feature (495)..(497): Xaa can be any naturally occurring amino acid
  misc_feature (501)..(501): Xaa can be any naturally occurring amino acid
  misc_feature (504)..(517): Xaa can be any naturally occurring amino acid
  misc_feature (519)..(542): Xaa can be any naturally occurring amino acid
  misc_feature (545)..(545): Xaa can be any naturally occurring amino acid
  misc_feature (547)..(551): Xaa can be any naturally occurring amino acid
  misc_feature (553)..(555): Xaa can be any naturally occurring amino acid
  misc_feature (557)..(558): Xaa can be any naturally occurring amino acid
  misc_feature (560)..(563): Xaa can be any naturally occurring amino acid
  misc_feature (565)..(615): Xaa can be any naturally occurring amino acid
  misc_feature (617)..(653): Xaa can be any naturally occurring amino acid
  misc_feature (655)..(656): Xaa can be any naturally occurring amino acid
  misc_feature (658)..(658): Xaa can be any naturally occurring amino acid
  misc_feature (660)..(662): Xaa can be any naturally occurring amino acid
  misc_feature (664)..(667): Xaa can be any naturally occurring amino acid
  misc_feature (669)..(754): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLVXXMXXXGXXXXXXGXXRXKXXXXXXXXXXXXXXXXXXXXXXXGXXXXFXXXXXXXXXXXXXXXXXXXXXXXXXXXXXXXXXXXXXXXXXXXXXXXXXXXXXXXXXXXXXQXXFAXXXXXXXXGXXXXRXXXXXXXXFXXXXXXXXYXXXXXXXWXXXXXXXXXXXXXXXXXXXXXXXXXXXXXXXXXXXXXXXXXXXXGXXDFAGGXXVHXXXGXXXLXXXXXXGXRXXXXXXXXXXXXXXXXXXXXXXXXXXXXXXXXXXXXXXXXXXXXXXXXXXXXXXXXXHXXXXXXXGXXXLWXGWXGFNXGSXXXXXXXXXXXXXXXXXXXXXXXXXXXXXXTXXXXXXXXXXXXXXXXXXXXXXXXXXXXXXXGXXXGLVXITXXXXXXXXXXXXXXGXXXXXXXXXXXXXXXXXXXXXXXXDDXLXXXXXHXXXGXXGXXXXGXXXXXXXXXXXXXXXXXXXXXXXXXXXXXXXXXXXXXXXXXXXXXXXXXXXQXXXXXXXXXXXXXXXXXXXXXXXXXXXXXXXXXXXXXEXXGXDXXXHXXXXYXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 4386 - protein, 38 aa, Artificial
  consensus
  misc_feature (1)..(1): Xaa can be Val or Leu
  misc_feature (3)..(3): Xaa can be Val or Leu
  misc_feature (4)..(4): Xaa can be any naturally occurring amino acid
  misc_feature (7)..(7): Xaa can be any naturally occurring amino acid
  misc_feature (9)..(9): Xaa can be Asn or Gln
  misc_feature (10)..(11): Xaa can be any naturally occurring amino acid
  misc_feature (15)..(29): Xaa can be any naturally occurring amino acid
  misc_feature (30)..(30): Xaa can be any naturally occurring amino acid or can be omitted
  misc_feature (32)..(33): Xaa can be any naturally occurring amino acid
  misc_feature (35)..(35): Xaa can be any naturally occurring amino acid
  misc_feature (37)..(37): Xaa can be any naturally occurring amino acid
XFXXGLXGXXXQFEXXXXXXXXXXXXXXXXDXXGXGXS

SEQ ID NO: 4387 - protein, 15 aa, Artificial
  consensus
  misc_feature (2)..(2): Xaa can be Leu or Val
  misc_feature (3)..(3): Xaa can be Ile or Val
  misc_feature (5)..(5): Xaa can be any naturally occurring amino acid
  misc_feature (9)..(10): Xaa can be any naturally occurring amino acid
  misc_feature (11)..(11): Xaa can be Leu or Ile
  misc_feature (12)..(12): Xaa can be Ala or Ser
  misc_feature (13)..(14): Xaa can be any naturally occurring amino acid
VXXGXSMGXXXXXXL

SEQ ID NO: 4388 - protein, 38 aa, Artificial
  consensus
  misc_feature (1)..(1): Xaa can be Gly or Ala
  misc_feature (2)..(3): Xaa can be any naturally occurring amino acid
  misc_feature (5)..(7): Xaa can be any naturally occurring amino acid
  misc_feature (9)..(27): Xaa can be any naturally occurring amino acid
  misc_feature (28)..(30): Xaa can be any naturally occurring amino acid or can be omitted
  misc_feature (32)..(37): Xaa can be any naturally occurring amino acid
XXXDXXXPXXXXXXXXXXXXXXXXXXXXXXIXXXXXXH

SEQ ID NO: 4389 - protein, 655 aa, Artificial
  consensus
  misc_feature (1)..(64): Xaa can be any naturally occurring amino acid
  misc_feature (66)..(69): Xaa can be any naturally occurring amino acid
  misc_feature (71)..(145): Xaa can be any naturally occurring amino acid
  misc_feature (147)..(148): Xaa can be any naturally occurring amino acid
  misc_feature (151)..(151): Xaa can be any naturally occurring amino acid
  misc_feature (153)..(155): Xaa can be any naturally occurring amino acid
  misc_feature (159)..(174): Xaa can be any naturally occurring amino acid
  misc_feature (176)..(177): Xaa can be any naturally occurring amino acid
  misc_feature (179)..(179): Xaa can be any naturally occurring amino acid
  misc_feature (181)..(181): Xaa can be any naturally occurring amino acid
  misc_feature (183)..(239): Xaa can be any naturally occurring amino acid
  misc_feature (241)..(242): Xaa can be any naturally occurring amino acid
  misc_feature (244)..(244): Xaa can be any naturally occurring amino acid
  misc_feature (248)..(253): Xaa can be any naturally occurring amino acid
  misc_feature (255)..(269): Xaa can be any naturally occurring amino acid
  misc_feature (271)..(394): Xaa can be any naturally occurring amino acid
  misc_feature (396)..(398): Xaa can be any naturally occurring amino acid
  misc_feature (400)..(421): Xaa can be any naturally occurring amino acid
  misc_feature (423)..(428): Xaa can be any naturally occurring amino acid
  misc_feature (430)..(655): Xaa can be any naturally occurring amino acid
XXXXXXXXXXXXXXXXXXXXXXXXXXXXXXXXXXXXXXXXXXXXXXXXXXXXXXXXXXXXXXXXNXXXXVXXXXXXXXXXXXXXXXXXXXXXXXXXXXXXXXXXXXXXXXXXXXXXXXXXXXXXXXXXXXXXXXXXXXXXXXXXXFXXGLXGXXXQFEXXXXXXXXXXXXXXXXDXXGXGXSXXXXXXXXXXXXXXXXXXXXXXXXXXXXXXXXXXXXXXXXXXXXXXXXXXXXXXXXXVXXGXSMGXXXXXXLXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXPXXXXXXXXXXXXXXXXXXXXXXIXXXXXXHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 4390 - protein, 245 aa, Artificial
  consensus
  misc_feature (1)..(1): Xaa can be Gly or Lys
  misc_feature (2)..(2): Xaa can be any naturally occurring amino acid
  misc_feature (3)..(3): Xaa can be Val or Ile
  misc_feature (6)..(6): Xaa can be Val or Ile or Leu
  misc_feature (7)..(7): Xaa can be Gly or Ala or Ser
  misc_feature (8)..(8): Xaa can be any naturally occurring amino acid
  misc_feature (10)..(10): Xaa can be any naturally occurring amino acid
  misc_feature (12)..(12): Xaa can be any naturally occurring amino acid
  misc_feature (13)..(13): Xaa can be Asn or Thr
  misc_feature (14)..(29): Xaa can be any naturally occurring amino acid
  misc_feature (30)..(92): Xaa can be any naturally occurring amino acid or can be omitted
  misc_feature (93)..(93): Xaa can be Met or Leu
  misc_feature (94)..(123): Xaa can be any naturally occurring amino acid
  misc_feature (124)..(178): Xaa can be any naturally occurring amino acid or can be omitted
  misc_feature (179)..(179): Xaa can be Tyr or Phe
  misc_feature (181)..(185): Xaa can be any naturally occurring amino acid
  misc_feature (186)..(186): Xaa can be Phe or Trp
  misc_feature (187)..(188): Xaa can be any naturally occurring amino acid
  misc_feature (190)..(190): Xaa can be Ser or Thr
  misc_feature (191)..(197): Xaa can be any naturally occurring amino acid
  misc_feature (198)..(198): Xaa can be Leu or Met
  misc_feature (199)..(203): Xaa can be any naturally occurring amino acid
  misc_feature (204)..(204): Xaa can be Val or Leu
  misc_feature (205)..(208): Xaa can be any naturally occurring amino acid
  misc_feature (209)..(209): Xaa can be any naturally occurring amino acid or can be omitted
  misc_feature (211)..(215): Xaa can be any naturally occurring amino acid
  misc_feature (217)..(217): Xaa can be His or Arg
  misc_feature (218)..(239): Xaa can be any naturally occurring amino acid
  misc_feature (240)..(244): Xaa can be any naturally occurring amino acid or can be omitted
XXXLEXXXGXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXXXXXXCXXXXXXXXXXXXXXXXXXXXGXXXXXEXXXXXXXXXXXXXXXXXXXXXXXXXXXXG

SEQ ID NO: 4391 - protein, 608 aa, Artificial
  consensus
  misc_feature (1)..(245): Xaa can be any naturally occurring amino acid
  misc_feature (247)..(247): Xaa can be any naturally occurring amino acid
  misc_feature (251)..(251): Xaa can be any naturally occurring amino acid
  misc_feature (253)..(253): Xaa can be any naturally occurring amino acid
  misc_feature (255)..(255): Xaa can be any naturally occurring amino acid
  misc_feature (257)..(257): Xaa can be any naturally occurring amino acid
  misc_feature (259)..(337): Xaa can be any naturally occurring amino acid
  misc_feature (339)..(424): Xaa can be any naturally occurring amino acid
  misc_feature (426)..(430): Xaa can be any naturally occurring amino acid
  misc_feature (432)..(433): Xaa can be any naturally occurring amino acid
  misc_feature (435)..(442): Xaa can be any naturally occurring amino acid
  misc_feature (444)..(448): Xaa can be any naturally occurring amino acid
  misc_feature (450)..(454): Xaa can be any naturally occurring amino acid
  misc_feature (456)..(460): Xaa can be any naturally occurring amino acid
  misc_feature (463)..(489): Xaa can be any naturally occurring amino acid
  misc_feature (491)..(608): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXVLEXGXGXGXNXXXXXXXXXXXXXXXXXXXXXXXXXXXXXXXXXXXXXXXXXXXXXXXXXXXXXXXXXXXXXXXXXXXXXXXXXXXXXXXMXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXXXFXXCXXXXXXXXLXXXXXVXXXXXGXXXXXEHXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 4392 - protein, 51 aa, Artificial; identical to SEQ ID NO: 1954
  consensus
  misc_feature (2)..(7): Xaa can be any naturally occurring amino acid
  misc_feature (9)..(13): Xaa can be any naturally occurring amino acid
  misc_feature (19)..(19): Xaa can be any naturally occurring amino acid
  misc_feature (24)..(25): Xaa can be any naturally occurring amino acid
  misc_feature (31)..(32): Xaa can be any naturally occurring amino acid
  misc_feature (34)..(44): Xaa can be any naturally occurring amino acid
  misc_feature (48)..(50): Xaa can be any naturally occurring amino acid

SEQ ID NO: 4393 - protein, 94 aa, Artificial; identical to SEQ ID NO: 1955
  consensus
  misc_feature (2)..(3): Xaa can be any naturally occurring amino acid
  misc_feature (6)..(6): Xaa can be any naturally occurring amino acid
  misc_feature (9)..(10): Xaa can be any naturally occurring amino acid
  misc_feature (12)..(14): Xaa can be any naturally occurring amino acid
  misc_feature (16)..(16): Xaa can be any naturally occurring amino acid
  misc_feature (18)..(18): Xaa can be any naturally occurring amino acid
  misc_feature (21)..(21): Xaa can be any naturally occurring amino acid
  misc_feature (28)..(28): Xaa can be any naturally occurring amino acid
  misc_feature (30)..(32): Xaa can be any naturally occurring amino acid
  misc_feature (34)..(40): Xaa can be any naturally occurring amino acid
  misc_feature (48)..(48): Xaa can be any naturally occurring amino acid
  misc_feature (52)..(52): Xaa can be any naturally occurring amino acid
  misc_feature (55)..(56): Xaa can be any naturally occurring amino acid
  misc_feature (59)..(60): Xaa can be any naturally occurring amino acid
  misc_feature (65)..(65): Xaa can be any naturally occurring amino acid
  misc_feature (67)..(68): Xaa can be any naturally occurring amino acid
  misc_feature (70)..(70): Xaa can be any naturally occurring amino acid
  misc_feature (73)..(80): Xaa can be any naturally occurring amino acid
  misc_feature (82)..(82): Xaa can be any naturally occurring amino acid
  misc_feature (86)..(86): Xaa can be any naturally occurring amino acid

SEQ ID NO: 4394 - protein, 827 aa, Artificial; identical to SEQ ID NO: 1956
  consensus
  misc_feature (1)..(57): Xaa can be any naturally occurring amino acid
  misc_feature (59)..(75): Xaa can be any naturally occurring amino acid
  misc_feature (77)..(110): Xaa can be any naturally occurring amino acid
  misc_feature (112)..(117): Xaa can be any naturally occurring amino acid
  misc_feature (119)..(123): Xaa can be any naturally occurring amino acid
  misc_feature (129)..(129): Xaa can be any naturally occurring amino acid
  misc_feature (134)..(135): Xaa can be any naturally occurring amino acid
  misc_feature (141)..(142): Xaa can be any naturally occurring amino acid
  misc_feature (144)..(154): Xaa can be any naturally occurring amino acid
  misc_feature (158)..(160): Xaa can be any naturally occurring amino acid
  misc_feature (162)..(195): Xaa can be any naturally occurring amino acid
  misc_feature (197)..(198): Xaa can be any naturally occurring amino acid
  misc_feature (201)..(201): Xaa can be any naturally occurring amino acid
  misc_feature (204)..(205): Xaa can be any naturally occurring amino acid
  misc_feature (207)..(209): Xaa can be any naturally occurring amino acid
  misc_feature (211)..(211): Xaa can be any naturally occurring amino acid
  misc_feature (213)..(213): Xaa can be any naturally occurring amino acid
  misc_feature (216)..(216): Xaa can be any naturally occurring amino acid
  misc_feature (223)..(223): Xaa can be any naturally occurring amino acid
  misc_feature (225)..(227): Xaa can be any naturally occurring amino acid
  misc_feature (229)..(235): Xaa can be any naturally occurring amino acid
  misc_feature (243)..(243): Xaa can be any naturally occurring amino acid
  misc_feature (247)..(247): Xaa can be any naturally occurring amino acid
  misc_feature (250)..(251): Xaa can be any naturally occurring amino acid
  misc_feature (254)..(255): Xaa can be any naturally occurring amino acid
  misc_feature (260)..(260): Xaa can be any naturally occurring amino acid
  misc_feature (262)..(263): Xaa can be any naturally occurring amino acid
  misc_feature (265)..(265): Xaa can be any naturally occurring amino acid
  misc_feature (268)..(275): Xaa can be any naturally occurring amino acid
  misc_feature (277)..(277): Xaa can be any naturally occurring amino acid
  misc_feature (281)..(281): Xaa can be any naturally occurring amino acid
  misc_feature (290)..(304): Xaa can be any naturally occurring amino acid
  misc_feature (306)..(316): Xaa can be any naturally occurring amino acid
  misc_feature (319)..(322): Xaa can be any naturally occurring amino acid
  misc_feature (324)..(378): Xaa can be any naturally occurring amino acid
  misc_feature (380)..(385): Xaa can be any naturally occurring amino acid
  misc_feature (387)..(399): Xaa can be any naturally occurring amino acid
  misc_feature (402)..(407): Xaa can be any naturally occurring amino acid
  misc_feature (409)..(412): Xaa can be any naturally occurring amino acid
  misc_feature (414)..(416): Xaa can be any naturally occurring amino acid
  misc_feature (418)..(418): Xaa can be any naturally occurring amino acid
  misc_feature (420)..(426): Xaa can be any naturally occurring amino acid
  misc_feature (428)..(430): Xaa can be any naturally occurring amino acid
  misc_feature (432)..(434): Xaa can be any naturally occurring amino acid
  misc_feature (436)..(438): Xaa can be any naturally occurring amino acid
  misc_feature (440)..(451): Xaa can be any naturally occurring amino acid
  misc_feature (453)..(465): Xaa can be any naturally occurring amino acid
  misc_feature (468)..(478): Xaa can be any naturally occurring amino acid
  misc_feature (480)..(488): Xaa can be any naturally occurring amino acid
  misc_feature (490)..(492): Xaa can be any naturally occurring amino acid
  misc_feature (494)..(516): Xaa can be any naturally occurring amino acid
  misc_feature (518)..(520): Xaa can be any naturally occurring amino acid
  misc_feature (524)..(526): Xaa can be any naturally occurring amino acid
  misc_feature (528)..(537): Xaa can be any naturally occurring amino acid
  misc_feature (539)..(548): Xaa can be any naturally occurring amino acid
  misc_feature (550)..(551): Xaa can be any naturally occurring amino acid
  misc_feature (553)..(553): Xaa can be any naturally occurring amino acid
  misc_feature (555)..(562): Xaa can be any naturally occurring amino acid
  misc_feature (564)..(566): Xaa can be any naturally occurring amino acid
  misc_feature (568)..(576): Xaa can be any naturally occurring amino acid
  misc_feature (579)..(585): Xaa can be any naturally occurring amino acid
  misc_feature (587)..(589): Xaa can be any naturally occurring amino acid
  misc_feature (591)..(599): Xaa can be any naturally occurring amino acid
  misc_feature (601)..(610): Xaa can be any naturally occurring amino acid
  misc_feature (612)..(617): Xaa can be any naturally occurring amino acid
  misc_feature (619)..(639): Xaa can be any naturally occurring amino acid
  misc_feature (641)..(668): Xaa can be any naturally occurring amino acid
  misc_feature (670)..(671): Xaa can be any naturally occurring amino acid
  misc_feature (673)..(685): Xaa can be any naturally occurring amino acid
  misc_feature (688)..(709): Xaa can be any naturally occurring amino acid
  misc_feature (712)..(718): Xaa can be any naturally occurring amino acid
  misc_feature (720)..(720): Xaa can be any naturally occurring amino acid
  misc_feature (722)..(736): Xaa can be any naturally occurring amino acid
  misc_feature (738)..(756): Xaa can be any naturally occurring amino acid
  misc_feature (758)..(770): Xaa can be any naturally occurring amino acid
  misc_feature (773)..(827): Xaa can be any naturally occurring amino acid

SEQ ID NO: 4395 - protein, 1209 aa, Artificial; identical to SEQ ID NO: 171
  consensus
  misc_feature (1)..(558): Xaa can be any naturally occurring amino acid
  misc_feature (560)..(577): Xaa can be any naturally occurring amino acid
  misc_feature (579)..(580): Xaa can be any naturally occurring amino acid
  misc_feature (584)..(585): Xaa can be any naturally occurring amino acid
  misc_feature (588)..(593): Xaa can be any naturally occurring amino acid
  misc_feature (595)..(595): Xaa can be any naturally occurring amino acid
  misc_feature (597)..(597): Xaa can be any naturally occurring amino acid
  misc_feature (599)..(779): Xaa can be any naturally occurring amino acid
  misc_feature (781)..(783): Xaa can be any naturally occurring amino acid
  misc_feature (785)..(1017): Xaa can be any naturally occurring amino acid
  misc_feature (1019)..(1020): Xaa can be any naturally occurring amino acid
  misc_feature (1022)..(1023): Xaa can be any naturally occurring amino acid
  misc_feature (1026)..(1081): Xaa can be any naturally occurring amino acid
  misc_feature (1083)..(1090): Xaa can be any naturally occurring amino acid
  misc_feature (1092)..(1093): Xaa can be any naturally occurring amino acid
  misc_feature (1098)..(1137): Xaa can be any naturally occurring amino acid
  misc_feature (1139)..(1209): Xaa can be any naturally occurring amino acid

SEQ ID NO: 4396 - protein, 33 aa, Artificial; identical to SEQ ID NO: 228
  consensus
  misc_feature (2)..(11): Xaa can be any naturally occurring amino acid
  misc_feature (13)..(13): Xaa can be any naturally occurring amino acid
  misc_feature (15)..(15): Xaa can be any naturally occurring amino acid
  misc_feature (19)..(28): Xaa can be any naturally occurring amino acid
  misc_feature (30)..(32): Xaa can be any naturally occurring amino acid

SEQ ID NO: 4397 - protein, 104 aa, Artificial; identical to SEQ ID NO: 229
  consensus
  misc_feature (1)..(7): Xaa can be any naturally occurring amino acid
  misc_feature (9)..(9): Xaa can be any naturally occurring amino acid
  misc_feature (11)..(12): Xaa can be any naturally occurring amino acid
  misc_feature (14)..(15): Xaa can be any naturally occurring amino acid
  misc_feature (20)..(20): Xaa can be any naturally occurring amino acid
  misc_feature (27)..(27): Xaa can be any naturally occurring amino acid
  misc_feature (30)..(30): Xaa can be any naturally occurring amino acid
  misc_feature (32)..(32): Xaa can be any naturally occurring amino acid
  misc_feature (39)..(39): Xaa can be any naturally occurring amino acid
  misc_feature (41)..(45): Xaa can be any naturally occurring amino acid
  misc_feature (48)..(64): Xaa can be any naturally occurring amino acid
  misc_feature (66)..(67): Xaa can be any naturally occurring amino acid
  misc_feature (69)..(70): Xaa can be any naturally occurring amino acid
  misc_feature (72)..(73): Xaa can be any naturally occurring amino acid
  misc_feature (75)..(76): Xaa can be any naturally occurring amino acid
  misc_feature (78)..(81): Xaa can be any naturally occurring amino acid
  misc_feature (84)..(104): Xaa can be any naturally occurring amino acid

SEQ ID NO: 4398 - DNA, 1971 bp, Ashbya gossypii
  CDS (1)..(1971)
atgcgccggtccgcccggacgcgtagcgtgcatacatacatacatataactactgccgaactccgcgacgcatcgctcgcgcttcggcgcgtggctggtcgccgatcgttttggtgcgcttggggaagctcttgcattcccgttgtgccggcgcccccggattccaacaaccccgtcatgcgactgtctaaacgcatgactgccatcagatggtacagtatagcgcgtgataccgcgagcgtatccattttgccgtcccgggagctgacggtggcaatagctccaacaaccggcggcattgtggttatacgagttcaacagtataaaaggggccgcggtggcaaatggtacgatcgggtttttgcgtgggcgttgtgtaagcggcaacggacataccgaatgacagtttcgcagcttttgaaacagagggtccggtacgccccatacctatccaaagtacggagagcagaggagctgttgcctctgtttaagcatgggcagtatatcgggtggtccgggttcacgggcgtgggcgcgcccaaagtgatccccacggcgcttgcagaccatgtggagaagaacgggctacagggccagctggcattcaatcttttcgtgggcgcgtcggctgggccggaggagaacaggtgggcggacctggacatgattttgcggcgcgcgccgcaccaggtcggcaagccgatcgcgcgcgcgatcaacgatgggcgcatcaagttcttcgacaagcacctgtcgatgtttccgcaggacctgacgtacgggtactacacccgggagcggacggacggcaagatcctggactacgcgatcgtggaagcgacggcgatcaaggaggacggctcgattgtgctgggcccgtcggtgggcggctcgccggagttcatgtctgcggcggacaagctgatcgtggaggtcaacaccgcgacgccgtcgttcgaggggctgcatgacatcgacatgccggtgctgccaccgcaccgcgtgccgtacccatacacgcgggtggacgagcgcagcgggctggacgcggtgccggtggaccctgcgcgcgtggtcgcgctagtggagagcaccgagcgcgacaaggtggggcccaacacgccctcggacgaggggtcgcgcgcgattgcggggcatctggtggagttcttcgagaacgaggtcaggcacgggcggctgccagccaacctgctgccgctgcagagcggcatcggcaacattgcgaacgcggtgatcgaggggcttgcaggcgcctcattccggaacctgacagtttggaccgaggtgttgcaggactcgttcctggatctgttcgagaacggctccctagaattcgcgaccgccaccagtatccgcctgaccgaggccggcttcgagaagttctttgccaactgggacgaatactcctccaagctgtgcttgcgctcccaggtcgtgtccaacagcccagagatgatccgccggctcggtgtcatcgcaatgaatacgcctgtggaggtcgacatctacgcgcacgcgaactcgaccaacgtgtctggctctcggatgctcaacgggctcggcggctccgcggacttcctccggaacgcaaagctgtccatcatgcatgcgccttctgccagacctagcaagaccgatcctaccggcatctcgaccatcgtgcccatggcatcccatgtcgaccagcttgagcatgacctagacgtcctagtcacggatcagggtctggccgacctgcgtggtctctgtccgcgggagcgcgcgcgcgagattatccgccagtgcgcacatccagactacaagccaattttgactgactacctagacagagctgagcattatgcgcagcgctcgcgctcgatgcacgagcctcatattttgcagcaagctctcagattccatacccatctcgctgaaaaaggcaccatgaaggtcccttcgtgggactaa

SEQ ID NO: 4399 - protein, 656 aa, Ashbya gossypii
MRRSARTRSVHTYIHITTAELRDASLALRRVAGRRSFWCAWGSSCIPVVPAPPDSNNPVMRLSKRMTAIRWYSIARDTASVSILPSRELTVAIAPTTGGIVVIRVQQYKRGRGGKWYDRVFAWALCKRQRTYRMTVSQLLKQRVRYAPYLSKVRRAEELLPLFKHGQYIGWSGFTGVGAPKVIPTALADHVEKNGLQGQLAFNLFVGASAGPEENRWADLDMILRRAPHQVGKPIARAINDGRIKFFDKHLSMFPQDLTYGYYTRERTDGKILDYAIVEATAIKEDGSIVLGPSVGGSPEFMSAADKLIVEVNTATPSFEGLHDIDMPVLPPHRVPYPYTRVDERSGLDAVPVDPARVVALVESTERDKVGPNTPSDEGSRAIAGHLVEFFENEVRHGRLPANLLPLQSGIGNIANAVIEGLAGASFRNLTVWTEVLQDSFLDLFENGSLEFATATSIRLTEAGFEKFFANWDEYSSKLCLRSQVVSNSPEMIRRLGVIAMNTPVEVDIYAHANSTNVSGSRMLNGLGGSADFLRNAKLSIMHAPSARPSKTDPTGISTIVPMASHVDQLEHDLDVLVTDQGLADLRGLCPRERAREIIRQCAHPDYKPILTDYLDRAEHYAQRSRSMHEPHILQQALRFHTHLAEKGTMKVPSWD

SEQ ID NO: 4400 - DNA, 1290 bp, Leptospira interrogans
  CDS (1)..(1290)
atgagatttaaaaccaacaatccattcatttcagcagacttggctgtttcttccgtaaaatcaggacaaagagtttttgtccacagtgttgctgccgcacctactcttttaatccaagccttaacctctcgcgcaaacgaactgactaatgtcgaaatgatccatcttcacaccgaaggtaaagctccttatgcagaacctggtatggaaggaaaattttttacgaattctttatttgtagcagcgaacactcgaaaagcagtcgaagaaggcagaggagattatattccaattttcttaagtgaatgcccttccttatttcgaaaaggaatccttcctatagacgtcgcgttgatacaagtttcccctcccgacaaacatggattttgttccctcggagtttcggtcgatattagcaaagcagcgacggaaacggcaaaaacagtcatcgcacaagtaaacgtgaacatgcctcgtactcatggagacggaatcattcctataaataaaattcattcttttgtagaagggcaccttcccttacacgaacatttttcagaagaaccttcagatatagaacttgccatcggcaaaaacgtagcctgcttagtcgaagacgaggccacgttacaaatgggaatcggagccattccaaacgcagtacttacttgtctgacttctcataaggatttgggaatccatacagaaatgttttcggatggcgtgatggaactcgttcaaaaaggaatcataacaggaattcacaagaaaaaacatcctggcaaaattgtttccggctttgtgatgggaactagaaaactttatgattttatagatgataatccagaagtttcaatgttagatattggttatatcaacgatcctcatgtgatccgaaaaaacccaaaagtcacagcgatcaattccgcagttgaagtagatttaaccggtcaagtttgtgcagatacgatcggtacaagacagtattccggagtaggaggtcaaatggattttatccgaggagcttcgctttccgaaggaggcaaaccaatcatcgccctcccttccaccacgtctaaaggagaatctagaatcgtttctttattaaaaccgggagcaaacgtagtaacgaccagagctcacgtccattttatcgtaaccgaatacggaatcgcaaatttatacggaaaaaatttaagacaaagagccaaagaactaatttcaatcgcacatccaaatcacagagaaaatctagaaaaagaggcattggcccgttttcggattttttaa

SEQ ID NO: 4401 - protein, 429 aa, Leptospira interrogans
MRFKTNNPFISADLAVSSVKSGQRVFVHSVAAAPTLLIQALTSRANELTNVEMIHLHTEGKAPYAEPGMEGKFFTNSLFVAANTRKAVEEGRGDYIPIFLSECPSLFRKGILPIDVALIQVSPPDKHGFCSLGVSVDISKAATETAKTVIAQVNVNMPRTHGDGIIPINKIHSFVEGHLPLHEHFSEEPSDIELAIGKNVACLVEDEATLQMGIGAIPNAVLTCLTSHKDLGIHTEMFSDGVMELVQKGIITGIHKKKHPGKIVSGFVMGTRKLYDFIDDNPEVSMLDIGYINDPHVIRKNPKVTAINSAVEVDLTGQVCADTIGTRQYSGVGGQMDFIRGASLSEGGKPIIALPSTTSKGESRIVSLLKPGANVVTTRAHVHFIVTEYGIANLYGKNLRQRAKELISIAHPNHRENLEKEALARFRIF

SEQ ID NO: 4402 - DNA, 1335 bp, Thermus thermophilus
  CDS (1)..(1335)
atgagctaccgcaagaagctcacctcccccgaggacgccgtgggcctgatccgctcggggatgcgggtcttcgtctccggcaacgccgccacccccacgcccctcctcaaggccctcgccgcccgcaaggacgagctggaaaacgtggagctcgtccacctcctgcagatgggggaagaccccttcgcctctttggagatggagggacacttccgaaggcgctccctcttcgtgggccccgccgaccgggaggcggtgaaccagggccgggccgactacgtgcccgtcatgctccaccaggtgccctggctcttcaagcggggcatcctccccttggacgccgccatcgtccaggtctccccgcccgacgagcacggcttctgctccttgggggtggaggtgatcgccacgaaggccgcggtggagaccgcccccatcgtcatcgccatggtgaaccccaggatgccgaggaccctgggggacaccttcgtccacgtctcccgcttcaccgccatcgtggaggtggactggcccctgcccgagctcaagcgggaggggtttggcgaggtggagcggaggatcggggagcacgtggcgggcctcattgaggacggggccaccctgcagatgggcatcggggccatccccgacgcggtcttggcgagcctggagggccggagggacctcggggtccacacggagatgatctcggacggggtcctcgaggcctgggaaaagggcctcatcaccggggcgaaaaagtccctccaccccgggaagatcgtgggcaccttcgtcctgggctcggagaggctctaccgcttcgtccacgacaaccccctctttgagctccaccccgccgactacgtgaacgaccccttcgtcatcgcccaaaaccgcaagatggtggccatcaactcggccattgaggtggacctcacgggccaggtggtggcggactccatcggcacccggatctactccggcttcggcggccagctggacttcatccggggggcggcgcggagcgagggaggcaggcccatcatcgccctgccctccaccgccaagggccaaagccgcatcgtccccttcctcaagccgggcgcgggggtggtcaccacccgggccgacgtgcactacgtggtcaccgagtggggcgtggccgagctcttcggccgctccctaagggaaagggccaaagccctcatcgccatcgcccacccggacttccgcgaggccctcctccagggcgcctgggagcggggcctcctcccccggggctaccccggcgtggacctgaaggggctggaggaaaagcgcgggaggccgtaa

SEQ ID NO: 4403 - protein, 444 aa, Thermus thermophilus
MSYRKKLTSPEDAVGLIRSGMRVFVSGNAATPTPLLKALAARKDELENVELVHLLQMGEDPFASLEMEGHFRRRSLFVGPADREAVNQGRADYVPVMLHQVPWLFKRGILPLDAAIVQVSPPDEHGFCSLGVEVIATKAAVETAPIVIAMVNPRMPRTLGDTFVHVSRFTAIVEVDWPLPELKREGFGEVERRIGEHVAGLIEDGATLQMGIGAIPDAVLASLEGRRDLGVHTEMISDGVLEAWEKGLITGAKKSLHPGKIVGTFVLGSERLYRFVHDNPLFELHPADYVNDPFVIAQNRKMVAINSAIEVDLTGQVVADSIGTRIYSGFGGQLDFIRGAARSEGGRPIIALPSTAKGQSRIVPFLKPGAGVVTTRADVHYVVTEWGVAELFGRSLRERAKALIAIAHPDFREALLQGAWERGLLPRGYPGVDLKGLEEKRGRP

SEQ ID NO: 4404 - DNA, 1560 bp, Rhodopseudomonas palustris
  CDS (1)..(1560)
atggtcaacgccgagcgcatccttgctcctcacctccgctccaaggtcatgaccgcagctgacgctgccgcgctgattccgtccggcgcgcatgtcggcatgagcggcttcaccggcgccggttatccgaagctgctgccgctggcgctcgccgagcgcatcaacgcgcatcacgcccgcggccagaagttcaaggtcagcgtctggactggcgcctcgacggcgcccgagctcgacggcgcactcgccaaggtcgacggcatcgagatgcggctgccttatcagtccgacccgacctgccgtaagcgcatcaacgccgggcggatggaatacatcgacatccatctgtcccacgtcgctcagcacgcctggttcggcttcctcggtaagctcgacattgctgtggtcgaagtcgccggcatccgcgaggacggcagcctgatcccgtcgtcgtcgatcggcaacaacaagacctggctcgatctcgccgacaaggtcatcctcgaggtcaacgcttggcaggacatccgcctcgaaggcatgcacgacgtctattacggcacgcagctgccgccgaaccgcaagccgattccgatcatcgcctccggtgaccgcatcggtgagcagtatctgcgctgcgattccgccaagatcgtcgcgatcgtcgagaccaacctgcccgatcgcaactcggcgttctcgccgcccgacgacacctcgcaggcgatcgccggccacatcctggatttcctcggccacgaggtgaagaagggccggctgccgcacaacctgttgccgttgcaatcgggcgtcggcaacgtcgccaatgcggtgatggccggcctcgaagatggcccgttcgacaatctcaccgcctataccgaagtgctgcaggacggcatgctgcacctgttgcgcaagggaaagctggctcacgcctcggcgaccgcgttgtcgctgtcaccggaaggctacgatgaattcctgcgcaatctcgacttctatcgcgagcgcatcgtgctgcgtcagcaggagatttccaaccatccggaagtgatccgccggctcggcgtgatcgccatgaacggcatgatcgaggccgacatctacggcaacgtcaactcgacccacgtgatgggcaccagcatcatgaacggcatcggcggctccggcgacttcgcccgcaacagcttcctgtcgttctttatgacgccgtcagccgccaagggcggcaagatctcgtgcatcgtgccgatgacctcgcatgtcgaccacaccgagcacgacgttcaggtgatcgtcaccgagcaggggctcgccgatctgcgcggcctgtcgccgaagcagcgtgccaaggtgatcatcgagaactgcgcgcacccgaccttccggccggccttgaaggaatacttcaagcgcgcgctggaatattctccgggcctgcacaccccgcacattctcgacgaagcgctgactttcctgccaaactggatggccaacaaggccgcccgcgaagcctggcgcgacgacgccgtggtgcaggcagacgcctggcggtag

SEQ ID NO: 4405 - protein, 519 aa, Rhodopseudomonas palustris
MVNAERILAPHLRSKVMTAADAAALIPSGAHVGMSGFTGAGYPKLLPLALAERINAHHARGQKFKVSVWTGASTAPELDGALAKVDGIEMRLPYQSDPTCRKRINAGRMEYIDIHLSHVAQHAWFGFLGKLDIAVVEVAGIREDGSLIPSSSIGNNKTWLDLADKVILEVNAWQDIRLEGMHDVYYGTQLPPNRKPIPIIASGDRIGEQYLRCDSAKIVAIVETNLPDRNSAFSPPDDTSQAIAGHILDFLGHEVKKGRLPHNLLPLQSGVGNVANAVMAGLEDGPFDNLTAYTEVLQDGMLHLLRKGKLAHASATALSLSPEGYDEFLRNLDFYRERIVLRQQEISNHPEVIRRLGVIAMNGMIEADIYGNVNSTHVMGTSIMNGIGGSGDFARNSFLSFFMTPSAAKGGKISCIVPMTSHVDHTEHDVQVIVTEQGLADLRGLSPKQRAKVIIENCAHPTFRPALKEYFKRALEYSPGLHTPHILDEALTFLPNWMANKAAREAWRDDAVVQADAWR

SEQ ID NO: 4406 - DNA, 1554 bp, Corynebacterium diphtheriae
  CDS (1)..(1554)
atggcatgcactgcggcagacgttgttgaggaggatttaatgtctgatcgtattgcgaatgctcagcttcgtggcaaggttatgtcggctgaagaggctgcgcagtttgtcaatcacggtgacaaagtaggcgtgtccggcttcaccggcgctggttacccgaaggctttgcctaccgctatcgcagagcgtgctaaggaagcacacgcgcgtggcgacgaatacatgatcgacctgtttaccggtgcatccactgcacctgactgtgacggtgtgctcgcagaggctgatgccctgcgcttccgtaccccataccagtccgatccaatcttgcgctccaagattaacgacggcaccaccttgtacgccgactaccacctgtccgagtccggtatctacgttgagcagggcttctttgggcagatgaatgtggctatcgttgaggcagttcgcatcaccgaagaaggccacatcgtgccatcctcctcagtgggtaacaacgtggaatacctcgacaacgccgagaagatcatcatcgaggtcaactcttggcagtccgaggaactcgaaggcatggcggatatttaccgcatgaacaagctgcctaaccgccagccaattccgattaccgaggctggccagcgtatcggtaccacctacatcgacatcgacctgtccaaggttgttgccgtcgtagaaaccgatgcccctgaccgcaacgcaccgtttaagccactggatgaaacctccaagcagatcgctggacacttccttgacttcctcgaaggcgaggtcgcagctggccgcctgacttacgacggctacgtcatgcagtccggtgtgggcaacgtgccaaacgctgtgatggcaggcctgctggattccaagttcgaaaacatcaaggcctacaccgaggtgatccaggacggcatggtcgacctgatcgacgccggtaagatgactgtcgcctccgcaacctccttctcgctgtctcctgagtacgcagagcgcatgaacgcagaggcaaagaactacgcccagaagatcatcctgcgcccacagcagatctccaaccacccagaggttgtccgccgcctcggtctgatctgcaccaacggtcttatcgaagccgacatctacggcaacgttaactccaccaacgtcaccggctcccgcatgatgaacggtgtcggcggttccgcagacttcacccgcaacggcttcatcagctcctttatcaccccatcggttgccaagggcggcgacatctccgcattcgtgccattcgtctcccacgtagaccacaccgagcaagatgtgaaggttctcatctccgagtacggttacgccgacctccgtggtctagccccacgtcagcgtgtagaaaagatcatcgctatcgcacaccctgactatcgaccacttctgcaggactactacgatcgcgccctggcttttgccaaggaaaagaagatcatgcagaccccgcacctgttgggtgaagcgctgagcttccaccagcgtttccaagagactggttccatgaagaagtaa

SEQ ID NO: 4407 - protein, 517 aa, Corynebacterium diphtheriae
MACTAADVVEEDLMSDRIANAQLRGKVMSAEEAAQFVNHGDKVGVSGFTGAGYPKALPTAIAERAKEAHARGDEYMIDLFTGASTAPDCDGVLAEADALRFRTPYQSDPILRSKINDGTTLYADYHLSESGIYVEQGFFGQMNVAIVEAVRITEEGHIVPSSSVGNNVEYLDNAEKIIIEVNSWQSEELEGMADIYRMNKLPNRQPIPITEAGQRIGTTYIDIDLSKVVAVVETDAPDRNAPFKPLDETSKQIAGHFLDFLEGEVAAGRLTYDGYVMQSGVGNVPNAVMAGLLDSKFENIKAYTEVIQDGMVDLIDAGKMTVASATSFSLSPEYAERMNAEAKNYAQKIILRPQQISNHPEVVRRLGLICTNGLIEADIYGNVNSTNVTGSRMMNGVGGSADFTRNGFISSFITPSVAKGGDISAFVPFVSHVDHTEQDVKVLISEYGYADLRGLAPRQRVEKIIAIAHPDYRPLLQDYYDRALAFAKEKKIMQTPHLLGEALSFHQRFQETGSMKK

SEQ ID NO: 4408 - DNA, 1488 bp, Bdellovibrio bacteriovorus
  CDS (1)..(1488)
atgcaccctgaaagagttaaacacagcgaactaagcaaaaaaatcatgaccgcccaagaggcggccgccttcatcaaagatggaatggtcgtcggcgccagcggcttcaccaaaggtggcgacagcaaagtcgtgctgaaagctctggcacagcgagcctctgtagatccactgaaaatcacactgatgaccggagcttccctgggccacggcattgacggccgcctggccgaagccaaagcgctttcgcgccgactgccttttcaggccgatcccattctcagaaacagcattaactccggcgaggttatgttcgtcgatcagcacttgggtgaaactgccgacttactggcaaacggcttcctgcctccggtggatattgccgtgctggaggtggcgcaggttctggaaaatggtcacgtcctgcccacaacctccgttggcaacaatctggcttatgcccagcacgccaaacacatcatactggaagtcaacgtcacgatcccacttgaaattcgtggcttccacgacattttctataccggcctttccccgcaccgctcgatcattccggtgacggatgccggatcgatcatcggcactgataccatgccaatggatcctgaaaaagtgatcggcattgtcttttctgatgccaaagacagcccggcagaactggtcgcacccgacacaaaaaccagcgccattgccggtcacctcatggatttcttcaatcacgaaatcaaaatgggccgcatgactccgtccctgcacccgcttcaggccggcatcggcaaagtggccaacgcggttttaagcggctttgttcacgggcagtttgaaaatctgacgatgtattcggaagtcctgcaagacagcacctttgaactgattgattctggcaaaatgacttttgcttcagcctgctctttggcggtttcgcaaagctgctatgaaaagttttttgccaatctggaaaagtaccgtggcaaaattctgctcagaccacagaacatcagtaacgcggccgaagtcatccgccgtctggggctgatcgcaatcaacaccgccatcgaatttgatatctatggcaacgtcaactcgacccatattgccggatcaaaaatgatgaatgggattggtggttccggggactttgcccgaaactcttacatgagtatttttgtgactcaggcggcttccaagaacaacaccatttcacacgtggtgccgatggcttcgcacgtggacagcaatgagcacgacgtcgacattcttgtcacagatcagggattggcggatttgcgtggactggcgccgcgtgagcgcgccaaggtcatcattcaaaactgctgtcatcccgagttccgggatgctttgaatgagtactatcaagaagccctggctcgtggcggtcagacccctcacgtgctaagcaaagccctgtcctggcatcagaagctgcaggacacaggcagcatgaaataa

SEQ ID NO: 4409 - protein, 495 aa, Bdellovibrio bacteriovorus
MHPERVKHSELSKKIMTAQEAAAFIKDGMVVGASGFTKGGDSKVVLKALAQRASVDPLKITLMTGASLGHGIDGRLAEAKALSRRLPFQADPILRNSINSGEVMFVDQHLGETADLLANGFLPPVDIAVLEVAQVLENGHVLPTTSVGNNLAYAQHAKHIILEVNVTIPLEIRGFHDIFYTGLSPHRSIIPVTDAGSIIGTDTMPMDPEKVIGIVFSDAKDSPAELVAPDTKTSAIAGHLMDFFNHEIKMGRMTPSLHPLQAGIGKVANAVLSGFVHGQFENLTMYSEVLQDSTFELIDSGKMTFASACSLAVSQSCYEKFFANLEKYRGKILLRPQNISNAAEVIRRLGLIAINTAIEFDIYGNVNSTHIAGSKMMNGIGGSGDFARNSYMSIFVTQAASKNNTISHVVPMASHVDSNEHDVDILVTDQGLADLRGLAPRERAKVIIQNCCHPEFRDALNEYYQEALARGGQTPHVLSKALSWHQKLQDTGSMK

SEQ ID NO: 4410 - DNA, 1509 bp, Corynebacterium glutamicum
  CDS (1)..(1509)
atgtctgatcgcattgcttcagaaaagctgcgctccaagctcatgtccgccgacgaggcggcacagtttgttaaccacggtgacaaggttggtttctccggcttcaccggcgctggctacccaaaggcactgcctacggcaatcgctaaccgggctaaagaagcacacggtgcaggcaacgactacgcaatcgacctgttcactggcgcatcgaccgcccctgactgcgatggcgtacttgcagaagctgacgctatccgctggcgcatgccatacgcatctgatccaatcatgcgtaacaagatcaactccggctccatgggatactccgatatccacctgtcccactccggccagcaggttgaagagggcttcttcggccagctcaacgtagctgtcattgaaatcacccgcatcactgaagagggctacatcatcccttcttcctccgtgggtaacaacgttgagtggctcaacgctgcagagaaggtcatcctcgaggttaactcttggcagtctgaagacctcgaaggtatgcacgacatctggtctgttcctgccctgccaaaccgcattgccgtgccaatcaacaagccaggcgaccgcatcggtaagacctacatcgagttcgacaccgacaaggttgttgctgttgttgagaccaacaccgcagaccgcaacgcaccattcaagcctgtcgacgacatctctaagaagatcgctggcaacttcctcgacttcctggaaagcgaagttgctgcaggtcgcctgtcctacgacggctacatcatgcagtccggcgtgggcaacgtgccaaacgcggtgatggcaggcctgctggaatccaagtttgagaacatccaggcctacaccgaagttatccaggacggcatggtggacctcatcgacgccggcaagatgaccgttgcatccgcaacttccttctccctgtctcctgagtacgcagagaagatgaacaacgaggctaagcgttaccgcgagtccattatcctgcgcccacagcagatctctaaccacccagaggtcatccgccgcgttggcctgatcgccaccaacggtctcatcgaggctgacatttacggcaacgtcaactccaccaacgtttctggctcccgcgtcatgaacggcatcggcggctccggcgacttcacccgtaacggctacatctccagcttcatcaccccttcagaggcaaagggcggcgcaatctctgcgatcgttcctttcgcatcccacatcgaccacaccgagcacgatgtcatggttgttatctctgagtacggttacgcagaccttcgtggtctggctccacgtgagcgcgttgccaagatgatcggcctggctcaccctgattaccgcccactgctcgaggagtactacgctcgcgcaacctccggtgacaacaagtacatgcagacccctcatgatcttgcaaccgcgtttgatttccacatcaacctggctaagaacggctccatgaaggcatag

SEQ ID NO: 4411 - protein, 502 aa, Corynebacterium glutamicum
MSDRIASEKLRSKLMSADEAAQFVNHGDKVGFSGFTGAGYPKALPTAIANRAKEAHGAGNDYAIDLFTGASTAPDCDGVLAEADAIRWRMPYASDPIMRNKINSGSMGYSDIHLSHSGQQVEEGFFGQLNVAVIEITRITEEGYIIPSSSVGNNVEWLNAAEKVILEVNSWQSEDLEGMHDIWSVPALPNRIAVPINKPGDRIGKTYIEFDTDKVVAVVETNTADRNAPFKPVDDISKKIAGNFLDFLESEVAAGRLSYDGYIMQSGVGNVPNAVMAGLLESKFENIQAYTEVIQDGMVDLIDAGKMTVASATSFSLSPEYAEKMNNEAKRYRESIILRPQQISNHPEVIRRVGLIATNGLIEADIYGNVNSTNVSGSRVMNGIGGSGDFTRNGYISSFITPSEAKGGAISAIVPFASHIDHTEHDVMVVISEYGYADLRGLAPRERVAKMIGLAHPDYRPLLEEYYARATSGDNKYMQTPHDLATAFDFHINLAKNGSMKA

SEQ ID NO: 4412 - DNA, 27 bp, Primer
atgacaatttctaatttgttaaagcag

SEQ ID NO: 4413 - DNA, 23 bp, Primer
ctagtcaactggttcccagctgt

SEQ ID NO: 4414 - DNA, 1224 bp, Escherichia coli; identical to SEQ ID NO: 1403
  CDS (285)..(1166)

SEQ ID NO: 4415 - protein, 293 aa, Escherichia coli; identical to SEQ ID NO: 514

SEQ ID NO: 4416 - DNA, 882 bp, Yersinia pestis; identical to SEQ ID NO: 525
  CDS (1)..(882)

SEQ ID NO: 4417 - protein, 293 aa, Yersinia pestis; identical to SEQ ID NO: 526

SEQ ID NO: 4418 - DNA, 882 bp, Salmonella typhimurium; identical to SEQ ID NO: 1407
  CDS (1)..(882)

SEQ ID NO: 4419 - protein, 293 aa, Salmonella typhimurium; identical to SEQ ID NO: 524

SEQ ID NO: 4420 - DNA, 882 bp, Escherichia coli; identical to SEQ ID NO: 519
  CDS (1)..(882)

SEQ ID NO: 4421 - protein, 293 aa, Escherichia coli; identical to SEQ ID NO: 520

SEQ ID NO: 4422 - DNA, 864 bp, Vibrio cholerae; identical to SEQ ID NO: 531
  CDS (1)..(864)

SEQ ID NO: 4423 - protein, 287 aa, Vibrio cholerae; identical to SEQ ID NO: 532

SEQ ID NO: 4424 - DNA, 879 bp, Buchnera aphidicola str. APS (Acyrthosiphon pisum); identical to SEQ ID NO: 1413
  CDS (1)..(879)

SEQ ID NO: 4425 - protein, 292 aa, Buchnera aphidicola str. APS (Acyrthosiphon pisum); identical to SEQ ID NO: 528

SEQ ID NO: 4426 - DNA, 852 bp, Haemophilus influenzae; identical to SEQ ID NO: 533
  CDS (1)..(852)

SEQ ID NO: 4427 - protein, 283 aa, Haemophilus influenzae; identical to SEQ ID NO: 534

SEQ ID NO: 4428 - DNA, 879 bp, Buchnera aphidicola str. Sg (Schizaphis graminum); identical to SEQ ID NO: 537
  CDS (1)..(879)

SEQ ID NO: 4429 - protein, 292 aa, Buchnera aphidicola str. Sg (Schizaphis graminum); identical to SEQ ID NO: 538

SEQ ID NO: 4430 - DNA, 861 bp, Pasteurella multocida; identical to SEQ ID NO: 535
  CDS (1)..(861)

SEQ ID NO: 4431 - protein, 286 aa, Pasteurella multocida; identical to SEQ ID NO: 536

SEQ ID NO: 4432 - DNA, 882 bp, Escherichia coli; identical to SEQ ID NO: 1421
  CDS (1)..(882): r means g or a

SEQ ID NO: 4433 - protein, 293 aa, Escherichia coli; identical to SEQ ID NO: 1422
  misc_feature (288)..(288): Xaa can be Ala or Thr

SEQ ID NO: 4434 - DNA, 870 bp, Haemophilus ducreyi; identical to SEQ ID NO: 539
  CDS (1)..(870)

SEQ ID NO: 4435 - protein, 289 aa, Haemophilus ducreyi; identical to SEQ ID NO: 540

SEQ ID NO: 4436 - DNA, 777 bp, Vibrio vulnificus; identical to SEQ ID NO: 1425
  CDS (1)..(777)

SEQ ID NO: 4437 - protein, 258 aa, Vibrio vulnificus; identical to SEQ ID NO: 530

SEQ ID NO: 4438 - DNA, 879 bp, Xanthomonas axonopodis (pv. citri); identical to SEQ ID NO: 543
  CDS (1)..(879)

SEQ ID NO: 4439 - protein, 292 aa, Xanthomonas axonopodis (pv. citri); identical to SEQ ID NO: 544

SEQ ID NO: 4440 - DNA, 879 bp, Xanthomonas campestris (pv. campestris); identical to SEQ ID NO: 541
  CDS (1)..(879)

SEQ ID NO: 4441 - protein, 292 aa, Xanthomonas campestris (pv. campestris); identical to SEQ ID NO: 542

SEQ ID NO: 4442 - DNA, 22 bp, Primer
atgatgcgaatcgcgctcttcc

SEQ ID NO: 4443 - DNA, 24 bp, Primer
ttacttcaggtattcacccgtacg

SEQ ID NO: 4444 - protein, 17 aa, Artificial
  consensus
  misc_feature (2)..(2): Xaa can be Ile or Val
  misc_feature (3)..(3): Xaa can be any naturally occurring amino acid
  misc_feature (11)..(11): Xaa can be any naturally occurring amino acid
  misc_feature (15)..(16): Xaa can be any naturally occurring amino acid
HXXLPPISSFXNLIXXA

SEQ ID NO: 4445 - protein, 68 aa, Artificial
  consensus
  misc_feature (1)..(1): Xaa can be Ser or Thr
  misc_feature (2)..(6): Xaa can be any naturally occurring amino acid
  misc_feature (8)..(9): Xaa can be any naturally occurring amino acid
  misc_feature (11)..(11): Xaa can be any naturally occurring amino acid
  misc_feature (16)..(16): Xaa can be any naturally occurring amino acid
  misc_feature (19)..(19): Xaa can be Ile or Val
  misc_feature (21)..(21): Xaa can be any naturally occurring amino acid
  misc_feature (28)..(28): Xaa can be Ser or Thr
  misc_feature (32)..(32): Xaa can be Ser or Ala
  misc_feature (36)..(36): Xaa can be any naturally occurring amino acid
  misc_feature (39)..(39): Xaa can be any naturally occurring amino acid
  misc_feature (45)..(45): Xaa can be any naturally occurring amino acid
  misc_feature (48)..(48): Xaa can be any naturally occurring amino acid
  misc_feature (54)..(54): Xaa can be any naturally occurring amino acid
  misc_feature (58)..(58): Xaa can be any naturally occurring amino acid
XXXXXXKXXKXRKKKXCPXCXNFYANLXTHKXTHLXPEXRPHKCXICXRGFARXNDLXRHKKRHWKDE

SEQ ID NO: 4446 - protein, 108 aa, Artificial
  consensus
  misc_feature (6)..(6): Xaa can be His or Tyr
  misc_feature (7)..(7): Xaa can be any naturally occurring amino acid
  misc_feature (9)..(9): Xaa can be any naturally occurring amino acid
  misc_feature (11)..(11): Xaa can be any naturally occurring amino acid
  misc_feature (12)..(12): Xaa can be Phe or Tyr
  misc_feature (22)..(22): Xaa can be any naturally occurring amino acid
  misc_feature (26)..(26): Xaa can be Glu or Asp
  misc_feature (27)..(27): Xaa can be Ile or Val or Met
  misc_feature (30)..(30): Xaa can be any naturally occurring amino acid
  misc_feature (32)..(32): Xaa can be any naturally occurring amino acid
  misc_feature (33)..(33): Xaa can be Arg or Lys
  misc_feature (34)..(34): Xaa can be any naturally occurring amino acid
  misc_feature (36)..(36): Xaa can be any naturally occurring amino acid
  misc_feature (39)..(40): Xaa can be any naturally occurring amino acid
  misc_feature (44)..(44): Xaa can be any naturally occurring amino acid
  misc_feature (54)..(54): Xaa can be Phe or Tyr
  misc_feature (68)..(68): Xaa can be any naturally occurring amino acid
  misc_feature (72)..(72): Xaa can be any naturally occurring amino acid
  misc_feature (73)..(73): Xaa can be Asp or Glu
  misc_feature (75)..(76): Xaa can be any naturally occurring amino acid
  misc_feature (77)..(77): Xaa can be Val or Ile
  misc_feature (78)..(78): Xaa can be any naturally occurring amino acid
  misc_feature (80)..(80): Xaa can be Arg or Lys
  misc_feature (86)..(86): Xaa can be Leu or Met
  misc_feature (87)..(87): Xaa can be any naturally occurring amino acid
  misc_feature (89)..(89): Xaa can be any naturally occurring amino acid
  misc_feature (93)..(93): Xaa can be Val or Met
  misc_feature (97)..(97): Xaa can be any naturally occurring amino acid
  misc_feature (102)..(102): Xaa can be any naturally occurring amino acid
  misc_feature (106)..(106): Xaa can be any naturally occurring amino acid
QLKSLXXIXGXXKCPFNSTLIXLDMXXYPXKXXXLXFEXXNCHXTGVFSRCDTXKNHLKALHFEYPPXTKKXXRXXXXGXCKHCGXXFXNVDXWLNXHVGKXCGYXYH

SEQ ID NO: 4447 - protein, 490 aa, Artificial
  consensus
  misc_feature (1)..(128): Xaa can be any naturally occurring amino acid
  misc_feature (130)..(131): Xaa can be any naturally occurring amino acid
  misc_feature (139)..(139): Xaa can be any naturally occurring amino acid
  misc_feature (143)..(144): Xaa can be any naturally occurring amino acid
  misc_feature (146)..(201): Xaa can be any naturally occurring amino acid
  misc_feature (203)..(211): Xaa can be any naturally occurring amino acid
  misc_feature (213)..(213): Xaa can be any naturally occurring amino acid
  misc_feature (215)..(215): Xaa can be any naturally occurring amino acid
  misc_feature (217)..(224): Xaa can be any naturally occurring amino acid
  misc_feature (226)..(268): Xaa can be any naturally occurring amino acid
  misc_feature (270)..(271): Xaa can be any naturally occurring amino acid
  misc_feature (273)..(273): Xaa can be any naturally occurring amino acid
  misc_feature (278)..(278): Xaa can be any naturally occurring amino acid
  misc_feature (281)..(281): Xaa can be any naturally occurring amino acid
  misc_feature (283)..(283): Xaa can be any naturally occurring amino acid
  misc_feature (290)..(290): Xaa can be any naturally occurring amino acid
  misc_feature (294)..(294): Xaa can be any naturally occurring amino acid
  misc_feature (298)..(298): Xaa can be any naturally occurring amino acid
  misc_feature (301)..(301): Xaa can be any naturally occurring amino acid
  misc_feature (307)..(307): Xaa can be any naturally occurring amino acid
  misc_feature (310)..(310): Xaa can be any naturally occurring amino acid
  misc_feature (316)..(316): Xaa can be any naturally occurring amino acid
  misc_feature (320)..(320): Xaa can be any naturally occurring amino acid
  misc_feature (331)..(382): Xaa can be any naturally occurring amino acid
  misc_feature (388)..(389): Xaa can be any naturally occurring amino acid
  misc_feature (391)..(391): Xaa can be any naturally occurring amino acid
  misc_feature (393)..(394): Xaa can be any naturally occurring amino acid
  misc_feature (398)..(398): Xaa can be any naturally occurring amino acid
  misc_feature (404)..(404): Xaa can be any naturally occurring amino acid
  misc_feature (408)..(409): Xaa can be any naturally occurring amino acid
  misc_feature (412)..(412): Xaa can be any naturally occurring amino acid
  misc_feature (414)..(416): Xaa can be any naturally occurring amino acid
  misc_feature (418)..(418): Xaa can be any naturally occurring amino acid
  misc_feature (421)..(422): Xaa can be any naturally occurring amino acid
  misc_feature (426)..(426): Xaa can be any naturally occurring amino acid
  misc_feature (436)..(436): Xaa can be any naturally occurring amino acid
  misc_feature (450)..(450): Xaa can be any naturally occurring amino acid
  misc_feature (454)..(455): Xaa can be any naturally occurring amino acid
  misc_feature (457)..(460): Xaa can be any naturally occurring amino acid
  misc_feature (462)..(462): Xaa can be any naturally occurring amino acid
  misc_feature (468)..(469): Xaa can be any naturally occurring amino acid
  misc_feature (471)..(471): Xaa can be any naturally occurring amino acid
  misc_feature (475)..(475): Xaa can be any naturally occurring amino acid
  misc_feature (479)..(479): Xaa can be any naturally occurring amino acid
  misc_feature (484)..(484): Xaa can be any naturally occurring amino acid
  misc_feature (488)..(488): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHXXLPPISSFXNLIXXAXXXXXXXXXXXXXXXXXXXXXXXXXXXXXXXXXXXXXXXXXXXXXXXXXXXXXXXXLXXXXXXXXXSXSXSXXXXXXXXPXXXXXXXXXXXXXXXXXXXXXXXXXXXXXXXXXXXXXXXXXXXKXXKXRKKKXCPXCXNFYANLXTHKXTHLXPEXRPHKCXICXRGFARXNDLXRHKKRHWKDEXXXXXXXXXXXXXXXXXXXXXXXXXXXXXXXXXXXXXXXXXXXXXXXXXXXXQLKSLXXIXGXXKCPXNSTLIXLDMXXYPXKXXXLXFEXXNCHXTGVFSRCDTXKNHLKALHFEYPPXTKKXXRXXXXGXCKHCGXXFXNVDXWLNXHVGKXCGYXYH

SEQ ID NO: 4448 - protein, 37 aa, Artificial
  consensus
  misc_feature (1)..(1): Xaa can be Ile or Val or Leu or Cys
  misc_feature (2)..(2): Xaa can be Ile or Val or Leu
  misc_feature (3)..(10): Xaa can be any naturally occurring amino acid
  misc_feature (12)..(28): Xaa can be any naturally occurring amino acid
  misc_feature (29)..(29): Xaa can be Ala or Ser or Cys
  misc_feature (30)..(31): Xaa can be any naturally occurring amino acid
  misc_feature (32)..(32): Xaa can be Val or Ile or Leu
  misc_feature (33)..(33): Xaa can be Ile or Val
  misc_feature (35)..(35): Xaa can be Glu or His or Gln or Met
  misc_feature (36)..(36): Xaa can be Val or Ile or Leu or Met
XXXXXXXXXXGXXXXXXXXXXXXXXXXXXXXXXXXXN

SEQ ID NO: 4449 - protein, 46 aa, Artificial
  consensus
  misc_feature (1)..(1): Xaa can be Leu or Ile or Met
  misc_feature (3)..(3): Xaa can be any naturally occurring amino acid
  misc_feature (5)..(5): Xaa can be Ile or Val or Phe
  misc_feature (7)..(7): Xaa can be any naturally occurring amino acid
  misc_feature (8)..(8): Xaa can be Ile or Val
  misc_feature (9)..(10): Xaa can be any naturally occurring amino acid
  misc_feature (11)..(11): Xaa can be Ala or Met
  misc_feature (12)..(12): Xaa can be Val or Ile or Leu or Ala
  misc_feature (13)..(13): Xaa can be Leu or Met or Cys
  misc_feature (14)..(24): Xaa can be any naturally occurring amino acid
  misc_feature (25)..(29): Xaa can be any naturally occurring amino acid or can be omitted
  misc_feature (30)..(30): Xaa can be Thr or Ser or Gly
  misc_feature (32)..(32): Xaa can be Val or Met or Ile
  misc_feature (33)..(34): Xaa can be any naturally occurring amino acid
  misc_feature (35)..(35): Xaa can be Asp or Glu or Thr or Asn
  misc_feature (36)..(39): Xaa can be any naturally occurring amino acid
  misc_feature (40)..(40): Xaa can be Leu or Met or Ala
  misc_feature (41)..(43): Xaa can be any naturally occurring amino acid
  misc_feature (44)..(44): Xaa can be Gly or Glu or Asp
  misc_feature (45)..(45): Xaa can be any naturally occurring amino acid
  misc_feature (32)..(46): Xaa can be Leu or Ile or Val or Met or Ala
XQXGXGXXXXXXXXXXXXXXXXXXXXXXXXEXXXXXXXXXXXXXXX

SEQ ID NO: 4450 - protein, 50 aa, Artificial
  consensus
  misc_feature (1)..(1): Xaa can be Ile or Val or Leu or Tyr
  misc_feature (2)..(6): Xaa can be any naturally occurring amino acid
  misc_feature (7)..(7): Xaa can be Ile or Val or Leu or Met or Pro
  misc_feature (8)..(8): Xaa can be any naturally occurring amino acid
  misc_feature (9)..(9): Xaa can be Arg or Lys or Asp or Gln
  misc_feature (10)..(13): Xaa can be any naturally occurring amino acid
  misc_feature (14)..(14): Xaa can be Ile or Val or Met or Thr
  misc_feature (15)..(16): Xaa can be any naturally occurring amino acid
  misc_feature (18)..(19): Xaa can be any naturally occurring amino acid
  misc_feature (20)..(20): Xaa can be Ile or Leu or Val
  misc_feature (21)..(21): Xaa can be Glu or Gln or Gly
  misc_feature (22)..(22): Xaa can be any naturally occurring amino acid
  misc_feature (24)..(24): Xaa can be Ile or Leu
  misc_feature (25)..(25): Xaa can be any naturally occurring amino acid
  misc_feature (26)..(26): Xaa can be Gly or Ala
  misc_feature (27)..(29): Xaa can be any naturally occurring amino acid
  misc_feature (30)..(30): Xaa can be Ser or Ala
  misc_feature (31)..(32): Xaa can be any naturally occurring amino acid
  misc_feature (33)..(33): Xaa can be Val or Ile
  misc_feature (34)..(39): Xaa can be any naturally occurring amino acid
  misc_feature (40)..(40): Xaa can be any naturally occurring amino acid or can be omitted
  misc_feature (42)..(42): Xaa can be any naturally occurring amino acid
  misc_feature (45)..(46): Xaa can be any naturally occurring amino acid
  misc_feature (48)..(48): Xaa can be Phe or Tyr
  misc_feature (49)..(49): Xaa can be any naturally occurring amino acid
XXXXXXXXXXXXXXXXNXXXXXDXXXXXXXXXXXXXXXXXGXGGXXDXXR

SEQ ID NO: 4451 - protein, 38 aa, Artificial
  consensus
  misc_feature (1)..(1): Xaa can be Val or Leu or Ala or Thr
  misc_feature (2)..(3): Xaa can be any naturally occurring amino acid
  misc_feature (4)..(4): Xaa can be Ile or Leu or Val or Phe
  misc_feature (5)..(5): Xaa can be Val or Ile
  misc_feature (6)..(6): Xaa can be Thr or Ser
  misc_feature (7)..(7): Xaa can be Glu or Asp
  misc_feature (8)..(8): Xaa can be any naturally occurring amino acid
  misc_feature (10)..(10): Xaa can be any naturally occurring amino acid
  misc_feature (11)..(11): Xaa can be Ala or Val or Ile
  misc_feature (12)..(12): Xaa can be any naturally occurring amino acid
  misc_feature (13)..(13): Xaa can be Leu or Val
  misc_feature (14)..(14): Xaa can be Arg or Lys or Phe or Tyr
  misc_feature (15)..(15): Xaa can be Gly or Ala
  misc_feature (16)..(20): Xaa can be any naturally occurring amino acid
  misc_feature (21)..(21): Xaa can be Arg or Lys
  misc_feature (22)..(24): Xaa can be any naturally occurring amino acid
  misc_feature (25)..(25): Xaa can be Ile or Leu or Met or Val
  misc_feature (26)..(26): Xaa can be Ile or Leu or Thr
  misc_feature (27)..(29): Xaa can be any naturally occurring amino acid
  misc_feature (30)..(30): Xaa can be any naturally occurring amino acid or can be omitted
  misc_feature (31)..(31): Xaa can be His or Ala
  misc_feature (32)..(33): Xaa can be any naturally occurring amino acid
  misc_feature (34)..(34): Xaa can be Tyr or Phe or His
  misc_feature (35)..(35): Xaa can be Arg or Lys or Gln
  misc_feature (36)..(37): Xaa can be any naturally occurring amino acid
XXXXXXXXGXXXXXXXXXXXXXXXXXXXXXXXXXXXXL

SEQ ID NO: 4452 - protein, 688 aa, Artificial
  consensus
  misc_feature (1)..(166): Xaa can be any naturally occurring amino acid
  misc_feature (168)..(172): Xaa can be any naturally occurring amino acid
  misc_feature (174)..(186): Xaa can be any naturally occurring amino acid
  misc_feature (188)..(231): Xaa can be any naturally occurring amino acid
  misc_feature (233)..(233): Xaa can be any naturally occurring amino acid
  misc_feature (235)..(241): Xaa can be any naturally occurring amino acid
  misc_feature (243)..(245): Xaa can be any naturally occurring amino acid
  misc_feature (247)..(247): Xaa can be any naturally occurring amino acid
  misc_feature (249)..(253): Xaa can be any naturally occurring amino acid
  misc_feature (255)..(255): Xaa can be any naturally occurring amino acid
  misc_feature (259)..(279): Xaa can be any naturally occurring amino acid
  misc_feature (281)..(281): Xaa can be any naturally occurring amino acid
  misc_feature (283)..(292): Xaa can be any naturally occurring amino acid
  misc_feature (294)..(299): Xaa can be any naturally occurring amino acid
  misc_feature (301)..(301): Xaa can be any naturally occurring amino acid
  misc_feature (303)..(310): Xaa can be any naturally occurring amino acid
  misc_feature (312)..(314): Xaa can be any naturally occurring amino acid
  misc_feature (316)..(316): Xaa can be any naturally occurring amino acid
  misc_feature (318)..(318): Xaa can be any naturally occurring amino acid
  misc_feature (320)..(330): Xaa can be any naturally occurring amino acid
  misc_feature (332)..(342): Xaa can be any naturally occurring amino acid
  misc_feature (344)..(355): Xaa can be any naturally occurring amino acid
  misc_feature (357)..(365): Xaa can be any naturally occurring amino acid
  misc_feature (367)..(370): Xaa can be any naturally occurring amino acid
  misc_feature (372)..(391): Xaa can be any naturally occurring amino acid
  misc_feature (393)..(415): Xaa can be any naturally occurring amino acid
  misc_feature (418)..(418): Xaa can be any naturally occurring amino acid
  misc_feature (420)..(420): Xaa can be any naturally occurring amino acid
  misc_feature (422)..(424): Xaa can be any naturally occurring amino acid
  misc_feature (428)..(446): Xaa can be any naturally occurring amino acid
  misc_feature (449)..(449): Xaa can be any naturally occurring amino acid
  misc_feature (452)..(455): Xaa can be any naturally occurring amino acid
  misc_feature (457)..(459): Xaa can be any naturally occurring amino acid
  misc_feature (461)..(498): Xaa can be any naturally occurring amino acid
  misc_feature (500)..(504): Xaa can be any naturally occurring amino acid
  misc_feature (506)..(511): Xaa can be any naturally occurring amino acid
  misc_feature (513)..(513): Xaa can be any naturally occurring amino acid
  misc_feature (515)..(518): Xaa can be any naturally occurring amino acid
  misc_feature (520)..(522): Xaa can be any naturally occurring amino acid
  misc_feature (524)..(524): Xaa can be any naturally occurring amino acid
  misc_feature (526)..(527): Xaa can be any naturally occurring amino acid
  misc_feature (529)..(530): Xaa can be any naturally occurring amino acid
  misc_feature (534)..(536): Xaa can be any naturally occurring amino acid
  misc_feature (538)..(541): Xaa can be any naturally occurring amino acid
  misc_feature (544)..(544): Xaa can be any naturally occurring amino acid
  misc_feature (548)..(548): Xaa can be any naturally occurring amino acid
  misc_feature (551)..(551): Xaa can be any naturally occurring amino acid
  misc_feature (553)..(567): Xaa can be any naturally occurring amino acid
  misc_feature (569)..(578): Xaa can be any naturally occurring amino acid
  misc_feature (580)..(582): Xaa can be any naturally occurring amino acid
  misc_feature (585)..(587): Xaa can be any naturally occurring amino acid
  misc_feature (589)..(589): Xaa can be any naturally occurring amino acid
  misc_feature (591)..(600): Xaa can be any naturally occurring amino acid
  misc_feature (603)..(603): Xaa can be any naturally occurring amino acid
  misc_feature (605)..(605): Xaa can be any naturally occurring amino acid
  misc_feature (611)..(612): Xaa can be any naturally occurring amino acid
  misc_feature (614)..(615): Xaa can be any naturally occurring amino acid
  misc_feature (618)..(620): Xaa can be any naturally occurring amino acid
  misc_feature (622)..(625): Xaa can be any naturally occurring amino acid
  misc_feature (628)..(632): Xaa can be any naturally occurring amino acid
  misc_feature (634)..(635): Xaa can be any naturally occurring amino acid
  misc_feature (637)..(688): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXSXXXXXXXXXXXXXAXXXXXXXXXXXXXXXXXXXXXXXXXXXXXXXXXXXXXXXXXXXXRXPXXXXXXXRXXXNXGXXXXXDXHLSXXXXXXXXXXXXXXXXXXXXXDXAXXXXXXXXXXGXXXXXXSXGXXXXXXXXAXXXIXEXNXXXXXXXXXXXDXXXXXXXXXXXRXXXXXXXXXXXXGXXXXXXXXXKXXXXVXXXXXXXXXXXXXXXXXXXXIXXXXXXXXXXXXXXXXXXXXXXXLQXGXGXXXNAVXXXXXXXXXXXXXXXXXXXEVXQDXXXXLXXXGXXXXXXXXXXXXXXXXXXXXXXXXXXXXXXXXXXXXXXRXXXXXNXXXXXXRXGXXXXNXXXEXDXXGXXNSTXXXGXXXXNGXGGSXDFXRXXXXXXXXXXXXXXXSXXXXXXXXXXIXXXVPXXXHXDXXXXXXXXXXTEXGXADLRGXXPXXRAXXXIXXXXHPXXXXXLXXYXXXXXXXXXXXXXXXXXXXXXXXXXXXXXXXXXXXXXXXXXXXXXXXXXXXX

SEQ ID NO: 4453 - protein, 16 aa, Artificial
  consensus
  misc_feature (1)..(1): Xaa can be Gly or Asp or Asn
  misc_feature (2)..(3): Xaa can be any naturally occurring amino acid
  misc_feature (4)..(4): Xaa can be Val or Ile or Leu or Gln
  misc_feature (5)..(5): Xaa can be Gly or Ala
  misc_feature (6)..(6): Xaa can be any naturally occurring amino acid
  misc_feature (7)..(7): Xaa can be Ser or Gly
  misc_feature (8)..(8): Xaa can be Gly or Pro
  misc_feature (9)..(9): Xaa can be Phe or Ala
  misc_feature (10)..(10): Xaa can be Thr or Val or Asp or Gly
  misc_feature (11)..(12): Xaa can be any naturally occurring amino acid
  misc_feature (13)..(13): Xaa can be Gly or Ala
  misc_feature (14)..(15): Xaa can be any naturally occurring amino acid
  misc_feature (16)..(16): Xaa can be Lys or Arg
XXXXXXXXXXXXXXXX

SEQ ID NO: 4454 - protein, 59 aa, Artificial
  consensus
  misc_feature (1)..(1): Xaa can be Leu or Val or Ile or Met
  misc_feature (2)..(3): Xaa can be any naturally occurring amino acid
  misc_feature (4)..(4): Xaa can be Gly or Cys
  misc_feature (5)..(5): Xaa can be Ala or Ser or Gly or Leu
  misc_feature (6)..(6): Xaa can be Ser or Ile or Arg
  misc_feature (7)..(7): Xaa can be any naturally occurring amino acid
  misc_feature (8)..(8): Xaa can be Gly or Ala or Ser or Arg
  misc_feature (9)..(11): Xaa can be any naturally occurring amino acid
  misc_feature (12)..(12): Xaa can be Asp or Glu or Arg
  misc_feature (13)..(20): Xaa can be any naturally occurring amino acid
  misc_feature (21)..(21): Xaa can be Ile or Leu or Val
  misc_feature (22)..(23): Xaa can be any naturally occurring amino acid
  misc_feature (24)..(26): Xaa can be any naturally occurring amino acid or can be omitted
  misc_feature (28)..(28): Xaa can be any naturally occurring amino acid
  misc_feature (30)..(30): Xaa can be any naturally occurring amino acid
  misc_feature (31)..(31): Xaa can be Gln or Asn or Ala or Thr
  misc_feature (32)..(39): Xaa can be any naturally occurring amino acid
  misc_feature (40)..(40): Xaa can be Ile or Val or Ala
  misc_feature (42)..(42): Xaa can be any naturally occurring amino acid
  misc_feature (43)..(43): Xaa can be Gly or Arg
  misc_feature (44)..(46): Xaa can be any naturally occurring amino acid
  misc_feature (47)..(47): Xaa can be Phe or Tyr or Met
  misc_feature (48)..(48): Xaa can be any naturally occurring amino acid
  misc_feature (50)..(50): Xaa can be any naturally occurring amino acid
  misc_feature (51)..(51): Xaa can be His or Gly
  misc_feature (52)..(52): Xaa can be Leu or Ile
  misc_feature (53)..(53): Xaa can be Ser or Ala or Gly
  misc_feature (54)..(58): Xaa can be any naturally occurring amino acid
  misc_feature (59)..(59): Xaa can be Leu or Ile or Val or Ala
XXXXXXXXXXXXXXXXXXXXXXXXXXRXPXXXXXXXXXXXNXXXXXXXDXXXXXXXXXX

SEQ ID NO: 4455 - protein, 50 aa, Artificial
  consensus
  misc_feature (1)..(1): Xaa can be Ala or Val or Thr
  misc_feature (2)..(2): Xaa can be Ile or Val or Leu or Cys
  misc_feature (3)..(3): Xaa can be Ile or Leu or Val
  misc_feature (4)..(4): Xaa can be Glu or Gly
  misc_feature (5)..(7): Xaa can be any naturally occurring amino acid
  misc_feature (8)..(8): Xaa can be Ile or Val or Leu
  misc_feature (9)..(10): Xaa can be any naturally occurring amino acid
  misc_feature (11)..(11): Xaa can be any naturally occurring amino acid or can be omitted
  misc_feature (13)..(13): Xaa can be any naturally occurring amino acid
  misc_feature (14)..(14): Xaa can be Ile or Leu or Val
  misc_feature (15)..(15): Xaa can be Val or Ile or Leu or Tyr or Trp
  misc_feature (16)..(19): Xaa can be any naturally occurring amino acid
  misc_feature (20)..(20): Xaa can be Val or Ile or Cys or Gly
  misc_feature (22)..(29): Xaa can be any naturally occurring amino acid
  misc_feature (30)..(30): Xaa can be Ala or Ser or Cys
  misc_feature (31)..(32): Xaa can be any naturally occurring amino acid
  misc_feature (33)..(33): Xaa can be Val or Ile or Leu
  misc_feature (34)..(34): Xaa can be Ile or Val
  misc_feature (35)..(35): Xaa can be Ile or Val or Leu
  misc_feature (37)..(37): Xaa can be Val or Leu or Ile
  misc_feature (39)..(45): Xaa can be any naturally occurring amino acid
  misc_feature (46)..(46): Xaa can be any naturally occurring amino acid or can be omitted
  misc_feature (47)..(47): Xaa can be Gly or Ala
  misc_feature (48)..(48): Xaa can be Leu or Ile or Met or Phe
  misc_feature (99)..(49): Xaa can be any naturally occurring amino acid
XXXXXXXXXXXGXXXXXXXXGXXXXXXXXXXXXXXEXNXXXXXXXXXXXD

SEQ ID NO: 4456 - protein, 35 aa, Artificial
  consensus
  misc_feature (1)..(1): Xaa can be Leu or Met
  misc_feature (3)..(3): Xaa can be Ser or Ala or Phe
  misc_feature (5)..(5): Xaa can be Ile or Val or Phe
  misc_feature (7)..(7): Xaa can be any naturally occurring amino acid
  misc_feature (8)..(8): Xaa can be Ile or Val or Leu
  misc_feature (9)..(9): Xaa can be any naturally occurring amino acid
  misc_feature (12)..(12): Xaa can be Val or Leu or Ile
  misc_feature (13)..(13): Xaa can be Leu or Met or Ile
  misc_feature (14)..(14): Xaa can be any naturally occurring amino acid
  misc_feature (15)..(15): Xaa can be Gly or Ala or Arg
  misc_feature (16)..(26): Xaa can be any naturally occurring amino acid
  misc_feature (27)..(28): Xaa can be any naturally occurring amino acid or can be omitted
  misc_feature (29)..(29): Xaa can be Tyr or Phe or Trp
  misc_feature (30)..(30): Xaa can be Thr or Ser or Gly
  misc_feature (33)..(33): Xaa can be Leu or Ile or Val
  misc_feature (35)..(35): Xaa can be Asp or Glu or Asn
XQXGXGXXXNAXXXXXXXXXXXXXXXXXXXEVXQX

SEQ ID NO: 4457 - protein, 62 aa, Artificial
  consensus
  misc_feature (1)..(1): Xaa can be Tyr or Phe or Leu
  misc_feature (2)..(4): Xaa can be any naturally occurring amino acid
  misc_feature (5)..(5): Xaa can be Leu or Ile or Val
  misc_feature (6)..(6): Xaa can be any naturally occurring amino acid
  misc_feature (7)..(7): Xaa can be Leu or Met
  misc_feature (9)..(11): Xaa can be any naturally occurring amino acid
  misc_feature (12)..(12): Xaa can be Ile or Val or Leu or Tyr
  misc_feature (13)..(13): Xaa can be Ser or Ala
  misc_feature (15)..(15): Xaa can be any naturally occurring amino acid
  misc_feature (16)..(16): Xaa can be Pro or Ala
  misc_feature (17)..(17): Xaa can be Glu or Ser
  misc_feature (18)..(18): Xaa can be any naturally occurring amino acid
  misc_feature (19)..(19): Xaa can be Ile or Val or Ala
  misc_feature (20)..(20): Xaa can be Arg or Asp
  misc_feature (22)..(22): Xaa can be Leu or Met or Val or Ile or Phe
  misc_feature (24)..(24): Xaa can be any naturally occurring amino acid v
  misc_feature (25)..(25): Xaa can be Ile or Leu or Val
  misc_feature (26)..(27): Xaa can be any naturally occurring amino acid
  misc_feature (29)..(30): Xaa can be any naturally occurring amino acid
  misc_feature (31)..(31): Xaa can be Leu or Ile or Val
  misc_feature (32)..(32): Xaa can be Glu or Gly
  misc_feature (33)..(33): Xaa can be any naturally occurring amino acid
  misc_feature (35)..(35): Xaa can be Ile or Leu
  misc_feature (36)..(36): Xaa can be Tyr or Phe or His
  misc_feature (37)..(37): Xaa can be Gly or Ala
  misc_feature (38)..(39): Xaa can be any naturally occurring amino acid
  misc_feature (43)..(43): Xaa can be any naturally occurring amino acid
  misc_feature (44)..(44): Xaa can be Val or Ile or Leu
  misc_feature (45)..(45): Xaa can be any naturally occurring amino acid
  misc_feature (47)..(47): Xaa can be Thr or Ser or Val or Ala
  misc_feature (48)..(48): Xaa can be any naturally occurring amino acid
  misc_feature (49)..(49): Xaa can be Met or Leu or Ile or Val
  misc_feature (50)..(50): Xaa can be Met or Ile or Leu or Gln
  misc_feature (53)..(53): Xaa can be Ile or Val or Leu
  misc_feature (57)..(57): Xaa can be Gly or Ala or Val
  misc_feature (60)..(60): Xaa can be any naturally occurring amino acid
  misc_feature (62)..(62): Xaa can be Asn or Ser
XXXXXXXRXXXXXNXXXXXXRXGXXXXNXXXXXDXXXXXNSTXXXGXXXXNGXGGSXDFXRX

SEQ ID NO: 4458 - protein, 54 aa, Artificial
  consensus
  misc_feature (3)..(5): Xaa can be any naturally occurring amino acid
  misc_feature (7)..(7): Xaa can be Val or Leu or Ile or Thr or His
  misc_feature (9)..(10): Xaa can be any naturally occurring amino acid
  misc_feature (11)..(11): Xaa can be Glu or Met or Asn
  misc_feature (12)..(12): Xaa can be His or Gln
  misc_feature (13)..(13): Xaa can be Asp or Ser
  misc_feature (14)..(14): Xaa can be Val or Leu or Thr or Ala
  misc_feature (15)..(15): Xaa can be any naturally occurring amino acid
  misc_feature (16)..(16): Xaa can be Val or Ile or Cys
  misc_feature (17)..(17): Xaa can be Leu or Ile or Val or Phe
  misc_feature (18)..(18): Xaa can be Val or Ile
  misc_feature (19)..(19): Xaa can be Thr or Ser
  misc_feature (20)..(20): Xaa can be Glu or Asp
  misc_feature (21)..(21): Xaa can be any naturally occurring amino acid
  misc_feature (23)..(23): Xaa can be any naturally occurring amino acid
  misc_feature (24)..(24): Xaa can be Ala or Val
  misc_feature (26)..(26): Xaa can be Leu or Val
  misc_feature (28)..(28): Xaa can be Gly or Ala
  misc_feature (29)..(29): Xaa can be Leu or Lys
  misc_feature (30)..(30): Xaa can be any naturally occurring amino acid
  misc_feature (32)..(33): Xaa can be any naturally occurring amino acid
  misc_feature (34)..(34): Xaa can be Arg or Lys
  misc_feature (35)..(37): Xaa can be any naturally occurring amino acid
  misc_feature (38)..(38): Xaa can be Ile or Met or Leu or Val
  misc_feature (39)..(39): Xaa can be Ile or Leu
  misc_feature (40)..(42): Xaa can be any naturally occurring amino acid
  misc_feature (43)..(43): Xaa can be any naturally occurring amino acid or can be omitted
  misc_feature (44)..(44): Xaa can be His or Ala
  misc_feature (45)..(46): Xaa can be any naturally occurring amino acid
  misc_feature (47)..(47): Xaa can be Tyr or Phe
  misc_feature (48)..(48): Xaa can be Arg or Lys or Gln
  misc_feature (49)..(50): Xaa can be any naturally occurring amino acid
  misc_feature (52)..(53): Xaa can be any naturally occurring amino acid
VPXXXHXDXXXXXXXXXXXXXGXXDXRXXXPXXXXXXXXXXXXXXXXXXXLXXY

SEQ ID NO: 4459 - protein, 679 aa, Artificial
  consensus
  misc_feature (1)..(142): Xaa can be any naturally occurring amino acid
  misc_feature (144)..(166): Xaa can be any naturally occurring amino acid
  misc_feature (168)..(170): Xaa can be any naturally occurring amino acid
  misc_feature (172)..(172): Xaa can be any naturally occurring amino acid
  misc_feature (177)..(178): Xaa can be any naturally occurring amino acid
  misc_feature (180)..(181): Xaa can be any naturally occurring amino acid
  misc_feature (183)..(184): Xaa can be any naturally occurring amino acid
  misc_feature (186)..(186): Xaa can be any naturally occurring amino acid
  misc_feature (188)..(208): Xaa can be any naturally occurring amino acid
  misc_feature (212)..(231): Xaa can be any naturally occurring amino acid
  misc_feature (233)..(233): Xaa can be any naturally occurring amino acid
  misc_feature (235)..(235): Xaa can be any naturally occurring amino acid
  misc_feature (237)..(244): Xaa can be any naturally occurring amino acid
  misc_feature (247)..(247): Xaa can be any naturally occurring amino acid
  misc_feature (249)..(253): Xaa can be any naturally occurring amino acid
  misc_feature (255)..(255): Xaa can be any naturally occurring amino acid
  misc_feature (259)..(279): Xaa can be any naturally occurring amino acid
  misc_feature (281)..(281): Xaa can be any naturally occurring amino acid
  misc_feature (283)..(284): Xaa can be any naturally occurring amino acid
  misc_feature (286)..(288): Xaa can be any naturally occurring amino acid
  misc_feature (290)..(290): Xaa can be any naturally occurring amino acid
  misc_feature (292)..(292): Xaa can be any naturally occurring amino acid
  misc_feature (294)..(299): Xaa can be any naturally occurring amino acid
  misc_feature (301)..(301): Xaa can be any naturally occurring amino acid
  misc_feature (303)..(310): Xaa can be any naturally occurring amino acid
  misc_feature (312)..(314): Xaa can be any naturally occurring amino acid
  misc_feature (316)..(316): Xaa can be any naturally occurring amino acid
  misc_feature (318)..(318): Xaa can be any naturally occurring amino acid
  misc_feature (320)..(327): Xaa can be any naturally occurring amino acid
  misc_feature (329)..(329): Xaa can be any naturally occurring amino acid
  misc_feature (332)..(340): Xaa can be any naturally occurring amino acid
  misc_feature (342)..(342): Xaa can be any naturally occurring amino acid
  misc_feature (344)..(353): Xaa can be any naturally occurring amino acid
  misc_feature (355)..(355): Xaa can be any naturally occurring amino acid
  misc_feature (357)..(362): Xaa can be any naturally occurring amino acid
  misc_feature (364)..(365): Xaa can be any naturally occurring amino acid
  misc_feature (367)..(370): Xaa can be any naturally occurring amino acid
  misc_feature (372)..(376): Xaa can be any naturally occurring amino acid
  misc_feature (378)..(385): Xaa can be any naturally occurring amino acid
  misc_feature (387)..(391): Xaa can be any naturally occurring amino acid
  misc_feature (394)..(398): Xaa can be any naturally occurring amino acid
  misc_feature (400)..(402): Xaa can be any naturally occurring amino acid
  misc_feature (405)..(406): Xaa can be any naturally occurring amino acid
  misc_feature (409)..(414): Xaa can be any naturally occurring amino acid
  misc_feature (418)..(418): Xaa can be any naturally occurring amino acid
  misc_feature (420)..(420): Xaa can be any naturally occurring amino acid
  misc_feature (422)..(424): Xaa can be any naturally occurring amino acid
  misc_feature (428)..(429): Xaa can be any naturally occurring amino acid
  misc_feature (431)..(438): Xaa can be any naturally occurring amino acid
  misc_feature (440)..(446): Xaa can be any naturally occurring amino acid
  misc_feature (449)..(449): Xaa can be any naturally occurring amino acid
  misc_feature (452)..(455): Xaa can be any naturally occurring amino acid
  misc_feature (457)..(459): Xaa can be any naturally occurring amino acid
  misc_feature (461)..(464): Xaa can be any naturally occurring amino acid
  misc_feature (467)..(468): Xaa can be any naturally occurring amino acid
  misc_feature (470)..(472): Xaa can be any naturally occurring amino acid
  misc_feature (474)..(493): Xaa can be any naturally occurring amino acid
  misc_feature (496)..(496): Xaa can be any naturally occurring amino acid
  misc_feature (498)..(499): Xaa can be any naturally occurring amino acid
  misc_feature (502)..(502): Xaa can be any naturally occurring amino acid
  misc_feature (505)..(506): Xaa can be any naturally occurring amino acid
  misc_feature (511)..(511): Xaa can be any naturally occurring amino acid
  misc_feature (513)..(514): Xaa can be any naturally occurring amino acid
  misc_feature (516)..(518): Xaa can be any naturally occurring amino acid
  misc_feature (520)..(520): Xaa can be any naturally occurring amino acid
  misc_feature (524)..(526): Xaa can be any naturally occurring amino acid
  misc_feature (530)..(530): Xaa can be any naturally occurring amino acid
  misc_feature (532)..(532): Xaa can be any naturally occurring amino acid
  misc_feature (534)..(537): Xaa can be any naturally occurring amino acid
  misc_feature (540)..(540): Xaa can be any naturally occurring amino acid
  misc_feature (544)..(544): Xaa can be any naturally occurring amino acid
  misc_feature (547)..(547): Xaa can be any naturally occurring amino acid
  misc_feature (550)..(558): Xaa can be any naturally occurring amino acid
  misc_feature (560)..(569): Xaa can be any naturally occurring amino acid
  misc_feature (572)..(573): Xaa can be any naturally occurring amino acid
  misc_feature (576)..(578): Xaa can be any naturally occurring amino acid
  misc_feature (580)..(580): Xaa can be any naturally occurring amino acid
  misc_feature (583)..(583): Xaa can be any naturally occurring amino acid
  misc_feature (587)..(591): Xaa can be any naturally occurring amino acid
  misc_feature (594)..(594): Xaa can be any naturally occurring amino acid
  misc_feature (596)..(596): Xaa can be any naturally occurring amino acid
  misc_feature (603)..(603): Xaa can be any naturally occurring amino acid
  misc_feature (605)..(606): Xaa can be any naturally occurring amino acid
  misc_feature (608)..(610): Xaa can be any naturally occurring amino acid
  misc_feature (613)..(614): Xaa can be any naturally occurring amino acid
  misc_feature (616)..(616): Xaa can be any naturally occurring amino acid
  misc_feature (619)..(619): Xaa can be any naturally occurring amino acid
  misc_feature (621)..(623): Xaa can be any naturally occurring amino acid
  misc_feature (625)..(626): Xaa can be any naturally occurring amino acid
  misc_feature (628)..(630): Xaa can be any naturally occurring amino acid
  misc_feature (632)..(643): Xaa can be any naturally occurring amino acid
  misc_feature (646)..(646): Xaa can be any naturally occurring amino acid
  misc_feature (648)..(649): Xaa can be any naturally occurring amino acid
  misc_feature (651)..(653): Xaa can be any naturally occurring amino acid
  misc_feature (655)..(660): Xaa can be any naturally occurring amino acid
  misc_feature (662)..(662): Xaa can be any naturally occurring amino acid
  misc_feature (664)..(679): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXXXXXXXXXGXXXGXSGFTXXGXXKXXPXAXXXXXXXXXXXXXXXXXXXXXGASXXXXXXXXXXXXXXXXXXXXRXPXQXXXXXXXXINXGXXXXXDXHLSXXXXXXXXXXXXXXXXXXXXXDXAXXEXXXIXEXGXXXXXXSXGXXXXXXXXAXXXIXEXNXXXXXXXXGXHDXXXXXXXXXPXRXXXXXXXXXXRXGXXXXXXDXXKXXXXVXXXXXDXXXXXXXXDXXXXXIAXXXXXFXXXEVXXGRXXXXXXPLQXGXGXXXNAVXXGXXXXXXXXFXXXXXXXEVXQDXXXXLXXXGXXXXASXXSXXXSXXXXXXXXXXXXXXXXXXXXLRXQXXSNXPEXXRRLGXIXXNXXXEXDIYXXXNSTXVXGXXXXNGXGGSXDFXRNXXXXXXXXXSXXXXXXXXXXISXXVPXXXHXDHXEHDXXXXXTEXGXADLRGLXPXXRXXXIIXXCXHPXYXXXLXXYXXXAXXXXXXXXXXXXPHXLXXAXXXHXXXXXXGXMXXXXXXXXXXXXXXXX

SEQ ID NO: 4460 - protein, 679 aa, Artificial
  consensus
  misc_feature (1)..(231): Xaa can be any naturally occurring amino acid
  misc_feature (233)..(233): Xaa can be any naturally occurring amino acid
  misc_feature (235)..(245): Xaa can be any naturally occurring amino acid
  misc_feature (247)..(253): Xaa can be any naturally occurring amino acid
  misc_feature (255)..(292): Xaa can be any naturally occurring amino acid
  misc_feature (294)..(301): Xaa can be any naturally occurring amino acid
  misc_feature (303)..(316): Xaa can be any naturally occurring amino acid
  misc_feature (318)..(318): Xaa can be any naturally occurring amino acid
  misc_feature (320)..(330): Xaa can be any naturally occurring amino acid
  misc_feature (332)..(342): Xaa can be any naturally occurring amino acid
  misc_feature (344)..(355): Xaa can be any naturally occurring amino acid
  misc_feature (357)..(416): Xaa can be any naturally occurring amino acid
  misc_feature (418)..(418): Xaa can be any naturally occurring amino acid
  misc_feature (420)..(420): Xaa can be any naturally occurring amino acid
  misc_feature (422)..(424): Xaa can be any naturally occurring amino acid
  misc_feature (427)..(446): Xaa can be any naturally occurring amino acid
  misc_feature (449)..(449): Xaa can be any naturally occurring amino acid
  misc_feature (451)..(494): Xaa can be any naturally occurring amino acid
  misc_feature (496)..(500): Xaa can be any naturally occurring amino acid
  misc_feature (502)..(507): Xaa can be any naturally occurring amino acid
  misc_feature (509)..(509): Xaa can be any naturally occurring amino acid
  misc_feature (511)..(514): Xaa can be any naturally occurring amino acid
  misc_feature (516)..(520): Xaa can be any naturally occurring amino acid
  misc_feature (522)..(526): Xaa can be any naturally occurring amino acid
  misc_feature (530)..(532): Xaa can be any naturally occurring amino acid
  misc_feature (534)..(537): Xaa can be any naturally occurring amino acid
  misc_feature (540)..(540): Xaa can be any naturally occurring amino acid
  misc_feature (544)..(544): Xaa can be any naturally occurring amino acid
  misc_feature (547)..(547): Xaa can be any naturally occurring amino acid
  misc_feature (549)..(573): Xaa can be any naturally occurring amino acid
  misc_feature (576)..(578): Xaa can be any naturally occurring amino acid
  misc_feature (580)..(580): Xaa can be any naturally occurring amino acid
  misc_feature (582)..(594): Xaa can be any naturally occurring amino acid
  misc_feature (596)..(597): Xaa can be any naturally occurring amino acid
  misc_feature (599)..(599): Xaa can be any naturally occurring amino acid
  misc_feature (601)..(603): Xaa can be any naturally occurring amino acid
  misc_feature (605)..(623): Xaa can be any naturally occurring amino acid
  misc_feature (625)..(626): Xaa can be any naturally occurring amino acid
  misc_feature (628)..(679): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXPXXXXXXXXXXXNXXXXXXXDXXXXXXXXXXXXXXXXXXXXXXXXXXXXXXXXXXXXXXGXXXXXXXXGXXXXXXXXXXXXXXEXNXXXXXXXXXXXDXXXXXXXXXXXRXXXXXXXXXXXXGXXXXXXXXXXXXXXXXXXXXXXXXXXXXXXXXXXXXXXXXXXXXXXXXXXXXXXXXXXXXQXGXGXXXNAXXXXXXXXXXXXXXXXXXXXEVXQXXXXXXXXXXXXXXXXXXXXXXXXXXXXXXXXXXXXXXXXXXXXRXXXXXNXXXXXXRXGXXXXNXXXXXDXXXXXNSTXXXGXXXXNGXGGSXDFXRXXXXXXXXXXXXXXXXXXXXXXXXXVPXXXHXDXXXXXXXXXXXXXGXXDXRXXXPXXXXXXXXXXXXXXXXXXXLXXYXXXXXXXXXXXXXXXXXXXXXXXXXXXXXXXXXXXXXXXXXXXXXXXXXXXX

SEQ ID NO: 4461 - protein, 136 aa, Artificial; identical to SEQ ID NO: 545
  consensus
  misc_feature (2)..(4): Xaa can be any naturally occurring amino acid
  misc_feature (6)..(8): Xaa can be any naturally occurring amino acid
  misc_feature (12)..(12): Xaa can be any naturally occurring amino acid
  misc_feature (14)..(16): Xaa can be any naturally occurring amino acid
  misc_feature (19)..(20): Xaa can be any naturally occurring amino acid
  misc_feature (23)..(24): Xaa can be any naturally occurring amino acid
  misc_feature (26)..(33): Xaa can be any naturally occurring amino acid
  misc_feature (35)..(36): Xaa can be any naturally occurring amino acid
  misc_feature (38)..(41): Xaa can be any naturally occurring amino acid
  misc_feature (43)..(43): Xaa can be any naturally occurring amino acid
  misc_feature (46)..(47): Xaa can be any naturally occurring amino acid
  misc_feature (49)..(51): Xaa can be any naturally occurring amino acid
  misc_feature (53)..(59): Xaa can be any naturally occurring amino acid
  misc_feature (62)..(63): Xaa can be any naturally occurring amino acid
  misc_feature (65)..(65): Xaa can be any naturally occurring amino acid
  misc_feature (67)..(71): Xaa can be any naturally occurring amino acid
  misc_feature (78)..(83): Xaa can be any naturally occurring amino acid
  misc_feature (85)..(85): Xaa can be any naturally occurring amino acid
  misc_feature (87)..(87): Xaa can be any naturally occurring amino acid
  misc_feature (93)..(94): Xaa can be any naturally occurring amino acid
  misc_feature (96)..(98): Xaa can be any naturally occurring amino acid
  misc_feature (104)..(105): Xaa can be any naturally occurring amino acid
  misc_feature (108)..(109): Xaa can be any naturally occurring amino acid
  misc_feature (111)..(112): Xaa can be any naturally occurring amino acid
  misc_feature (117)..(117): Xaa can be any naturally occurring amino acid
  misc_feature (120)..(120): Xaa can be any naturally occurring amino acid
  misc_feature (122)..(122): Xaa can be any naturally occurring amino acid
  misc_feature (126)..(126): Xaa can be any naturally occurring amino acid
  misc_feature (132)..(134): Xaa can be any naturally occurring amino acid
  misc_feature (136)..(136): Xaa can be any naturally occurring amino acid

SEQ ID NO: 4462 - protein, 46 aa, Artificial; identical to SEQ ID NO: 546
  consensus
  misc_feature (1)..(1): Xaa can be any naturally occurring amino acid
  misc_feature (3)..(5): Xaa can be any naturally occurring amino acid
  misc_feature (8)..(9): Xaa can be any naturally occurring amino acid
  misc_feature (11)..(12): Xaa can be any naturally occurring amino acid
  misc_feature (14)..(14): Xaa can be any naturally occurring amino acid
  misc_feature (17)..(17): Xaa can be any naturally occurring amino acid
  misc_feature (20)..(20): Xaa can be any naturally occurring amino acid
  misc_feature (23)..(24): Xaa can be any naturally occurring amino acid
  misc_feature (27)..(29): Xaa can be any naturally occurring amino acid
  misc_feature (31)..(33): Xaa can be any naturally occurring amino acid
  misc_feature (35)..(36): Xaa can be any naturally occurring amino acid
  misc_feature (40)..(40): Xaa can be any naturally occurring amino acid
  misc_feature (43)..(43): Xaa can be any naturally occurring amino acid
  misc_feature (46)..(46): Xaa can be any naturally occurring amino acid

SEQ ID NO: 4463 - protein, 301 aa, Artificial; identical to SEQ ID NO: 547
  consensus
  misc_feature (1)..(3): Xaa can be any naturally occurring amino acid
  misc_feature (5)..(6): Xaa can be any naturally occurring amino acid
  misc_feature (10)..(10): Xaa can be any naturally occurring amino acid
  misc_feature (13)..(13): Xaa can be any naturally occurring amino acid
  misc_feature (16)..(30): Xaa can be any naturally occurring amino acid
  misc_feature (32)..(38): Xaa can be any naturally occurring amino acid
  misc_feature (41)..(42): Xaa can be any naturally occurring amino acid
  misc_feature (44)..(46): Xaa can be any naturally occurring amino acid
  misc_feature (50)..(50): Xaa can be any naturally occurring amino acid
  misc_feature (52)..(54): Xaa can be any naturally occurring amino acid
  misc_feature (57)..(58): Xaa can be any naturally occurring amino acid
  misc_feature (61)..(61): Xaa can be any naturally occurring amino acid
  misc_feature (68)..(70): Xaa can be any naturally occurring amino acid
  misc_feature (73)..(74): Xaa can be any naturally occurring amino acid
  misc_feature (78)..(79): Xaa can be any naturally occurring amino acid
  misc_feature (81)..(81): Xaa can be any naturally occurring amino acid
  misc_feature (84)..(85): Xaa can be any naturally occurring amino acid
  misc_feature (88)..(89): Xaa can be any naturally occurring amino acid
  misc_feature (91)..(94): Xaa can be any naturally occurring amino acid
  misc_feature (97)..(97): Xaa can be any naturally occurring amino acid
  misc_feature (100)..(101): Xaa can be any naturally occurring amino acid
  misc_feature (105)..(107): Xaa can be any naturally occurring amino acid
  misc_feature (109)..(109): Xaa can be any naturally occurring amino acid
  misc_feature (117)..(121): Xaa can be any naturally occurring amino acid
  misc_feature (131)..(131): Xaa can be any naturally occurring amino acid
  misc_feature (134)..(136): Xaa can be any naturally occurring amino acid
  misc_feature (142)..(142): Xaa can be any naturally occurring amino acid
  misc_feature (146)..(147): Xaa can be any naturally occurring amino acid
  misc_feature (149)..(150): Xaa can be any naturally occurring amino acid
  misc_feature (158)..(158): Xaa can be any naturally occurring amino acid
  misc_feature (160)..(160): Xaa can be any naturally occurring amino acid
  misc_feature (164)..(164): Xaa can be any naturally occurring amino acid
  misc_feature (171)..(171): Xaa can be any naturally occurring amino acid
  misc_feature (174)..(199): Xaa can be any naturally occurring amino acid
  misc_feature (201)..(206): Xaa can be any naturally occurring amino acid
  misc_feature (209)..(210): Xaa can be any naturally occurring amino acid
  misc_feature (213)..(213): Xaa can be any naturally occurring amino acid
  misc_feature (216)..(217): Xaa can be any naturally occurring amino acid
  misc_feature (219)..(219): Xaa can be any naturally occurring amino acid
  misc_feature (225)..(225): Xaa can be any naturally occurring amino acid
  misc_feature (229)..(229): Xaa can be any naturally occurring amino acid
  misc_feature (234)..(234): Xaa can be any naturally occurring amino acid
  misc_feature (236)..(236): Xaa can be any naturally occurring amino acid
  misc_feature (240)..(241): Xaa can be any naturally occurring amino acid
  misc_feature (248)..(248): Xaa can be any naturally occurring amino acid
  misc_feature (251)..(254): Xaa can be any naturally occurring amino acid
  misc_feature (256)..(264): Xaa can be any naturally occurring amino acid
  misc_feature (267)..(267): Xaa can be any naturally occurring amino acid
  misc_feature (269)..(269): Xaa can be any naturally occurring amino acid
  misc_feature (271)..(278): Xaa can be any naturally occurring amino acid
  misc_feature (281)..(282): Xaa can be any naturally occurring amino acid
  misc_feature (287)..(288): Xaa can be any naturally occurring amino acid
  misc_feature (291)..(291): Xaa can be any naturally occurring amino acid
  misc_feature (294)..(301): Xaa can be any naturally occurring amino acid

SEQ ID NO: 4464 - DNA, 723 bp, Escherichia coli; identical to SEQ ID NO: 417
  CDS (1)..(723)

SEQ ID NO: 4465 - protein, 240 aa, Escherichia coli; identical to SEQ ID NO: 418

SEQ ID NO: 4466 - DNA, 723 bp, Listeria innocua; identical to SEQ ID NO: 453
  CDS (1)..(723)

SEQ ID NO: 4467 - protein, 240 aa, Listeria innocua; identical to SEQ ID NO: 454

SEQ ID NO: 4468 - DNA, 798 bp, Yersinia pestis; identical to SEQ ID NO: 2052
  CDS (1)..(798)

SEQ ID NO: 4469 - protein, 265 aa, Yersinia pestis; identical to SEQ ID NO: 452

SEQ ID NO: 4470 - DNA, 744 bp, Salmonella enterica subsp. enterica serovar Typhi; identical to SEQ ID NO: 2054
  CDS (1)..(744)

SEQ ID NO: 4471 - protein, 247 aa, Salmonella enterica subsp. enterica serovar Typhi; identical to SEQ ID NO: 460

SEQ ID NO: 4472 - DNA, 714 bp, Listeria innocua; identical to SEQ ID NO: 455
  CDS (1)..(714)

SEQ ID NO: 4473 - protein, 237 aa, Listeria innocua; identical to SEQ ID NO: 456

SEQ ID NO: 4474 - DNA, 723 bp, Listeria monocytogenes; identical to SEQ ID NO: 457
  CDS (1)..(723)

SEQ ID NO: 4475 - protein, 240 aa, Listeria monocytogenes; identical to SEQ ID NO: 458

SEQ ID NO: 4476 - DNA, 729 bp, Listeria monocytogenes; identical to SEQ ID NO: 429
  CDS (1)..(729)

SEQ ID NO: 4477 - protein, 242 aa, Listeria monocytogenes; identical to SEQ ID NO: 430

SEQ ID NO: 4478 - DNA, 729 bp, Listeria innocua; identical to SEQ ID NO: 2062
  CDS (1)..(729)

SEQ ID NO: 4479 - protein, 242 aa, Listeria innocua; identical to SEQ ID NO: 432

SEQ ID NO: 4480 - DNA, 729 bp, Bacillus subtilis; identical to SEQ ID NO: 421
  CDS (1)..(729)

SEQ ID NO: 4481 - protein, 242 aa, Bacillus subtilis; identical to SEQ ID NO: 422

SEQ ID NO: 4482 - DNA, 747 bp, Bacillus halodurans; identical to SEQ ID NO: 445
  CDS (1)..(747)

SEQ ID NO: 4483 - protein, 248 aa, Bacillus halodurans; identical to SEQ ID NO: 446

SEQ ID NO: 4484 - DNA, 723 bp, Bacillus halodurans; identical to SEQ ID NO: 433
  CDS (1)..(723)

SEQ ID NO: 4485 - protein, 240 aa, Bacillus halodurans; identical to SEQ ID NO: 434

SEQ ID NO: 4486 - DNA, 714 bp, Bacillus halodurans; identical to SEQ ID NO: 427
  CDS (1)..(714)

SEQ ID NO: 4487 - protein, 237 aa, Bacillus halodurans; identical to SEQ ID NO: 428

SEQ ID NO: 4488 - DNA, 811 bp, Corynebacterium glutamicum; identical to SEQ ID NO: 2072

SEQ ID NO: 4489 - protein, 269 aa, Corynebacterium glutamicum; identical to SEQ ID NO: 462

SEQ ID NO: 4490 - DNA, 732 bp, Bacillus subtilis; identical to SEQ ID NO: 425
  CDS (1)..(732)

SEQ ID NO: 4491 - protein, 243 aa, Bacillus subtilis; identical to SEQ ID NO: 426

SEQ ID NO: 4492 - DNA, 744 bp, Caulobacter crescentus; identical to SEQ ID NO: 2076
  CDS (1)..(744)

SEQ ID NO: 4493 - protein, 247 aa, Caulobacter crescentus; identical to SEQ ID NO: 442

SEQ ID NO: 4494 - DNA, 711 bp, Streptococcus pneumoniae; identical to SEQ ID NO: 2078
  CDS (1)..(711)

SEQ ID NO: 4495 - protein, 236 aa, Streptococcus pneumoniae; identical to SEQ ID NO: 436

SEQ ID NO: 4496 - DNA, 729 bp, Streptococcus pneumoniae; identical to SEQ ID NO: 2080
  CDS (1)..(729)

SEQ ID NO: 4497 - protein, 242 aa, Streptococcus pneumoniae; identical to SEQ ID NO: 438

SEQ ID NO: 4498 - DNA, 708 bp, Streptococcus pneumoniae; identical to SEQ ID NO: 2082
  CDS (1)..(708)

SEQ ID NO: 4499 - protein, 235 aa, Streptococcus pneumoniae; identical to SEQ ID NO: 450

SEQ ID NO: 4500 - DNA, 717 bp, Escherichia coli; identical to SEQ ID NO: 423
  CDS (1)..(717)

SEQ ID NO: 4501 - protein, 238 aa, Escherichia coli [sequence omitted]

SEQ ID NO: 4502 - DNA, 708 bp, Lactococcus lactis subsp. lactis; identical to SEQ ID NO: 443
  CDS (1)..(708)

SEQ ID NO: 4503 - protein, 235 aa, Lactococcus lactis subsp. lactis; identical to SEQ ID NO: 444

SEQ ID NO: 4504 - DNA, 756 bp, Escherichia coli; identical to SEQ ID NO: 439
  CDS (1)..(756)

SEQ ID NO: 4505 - protein, 251 aa, Escherichia coli; identical to SEQ ID NO: 440

SEQ ID NO: 4506 - DNA, 732 bp, Clostridium acetobutylicum; identical to SEQ ID NO: 2090
  CDS (1)..(732)

SEQ ID NO: 4507 - protein, 243 aa, Clostridium acetobutylicum; identical to SEQ ID NO: 448

SEQ ID NO: 4508 - DNA, 747 bp, Bordetella parapertussis; identical to SEQ ID NO: 2092
  CDS (1)..(747)

SEQ ID NO: 4509 - protein, 248 aa, Bordetella parapertussis; identical to SEQ ID NO: 510

SEQ ID NO: 4510 - DNA, 747 bp, Bordetella bronchiseptica; identical to SEQ ID NO: 2094
  CDS (1)..(747)

SEQ ID NO: 4511 - protein, 248 aa, Bordetella bronchiseptica; identical to SEQ ID NO: 508

SEQ ID NO: 4512 - DNA, 738 bp, Bacillus cereus; identical to SEQ ID NO: 503
  CDS (1)..(738)

SEQ ID NO: 4513 - protein, 245 aa, Bacillus cereus; identical to SEQ ID NO: 504

SEQ ID NO: 4514 - DNA, 732 bp, Bacillus anthracis; identical to SEQ ID NO: 2098
  CDS (1)..(732)

SEQ ID NO: 4515 - protein, 243 aa, Bacillus anthracis; identical to SEQ ID NO: 502

SEQ ID NO: 4516 - DNA, 738 bp, Bacillus anthracis; identical to SEQ ID NO: 499
  CDS (1)..(738)

SEQ ID NO: 4517 - protein, 245 aa, Bacillus anthracis; identical to SEQ ID NO: 500

SEQ ID NO: 4518 - DNA, 765 bp, Streptomyces avermitilis; identical to SEQ ID NO: 2102
  CDS (1)..(765)

SEQ ID NO: 4519 - protein, 254 aa, Streptomyces avermitilis; identical to SEQ ID NO: 498

SEQ ID NO: 4520 - DNA, 756 bp, Enterococcus faecalis; identical to SEQ ID NO: 2104
  CDS (25)..(756)

SEQ ID NO: 4521 - protein, 243 aa, Enterococcus faecalis; identical to SEQ ID NO: 496

SEQ ID NO: 4522 - DNA, 708 bp, Enterococcus faecalis; identical to SEQ ID NO: 2106
  CDS (1)..(708)

SEQ ID NO: 4523 - protein, 235 aa, Enterococcus faecalis; identical to SEQ ID NO: 494

SEQ ID NO: 4524 - DNA, 675 bp, Shigella flexneri; identical to SEQ ID NO: 2108
  CDS (1)..(675)

SEQ ID NO: 4525 - protein, 224 aa, Shigella flexneri; identical to SEQ ID NO: 506

SEQ ID NO: 4526 - DNA, 723 bp, Shigella flexneri; identical to SEQ ID NO: 491
  CDS (1)..(723)

SEQ ID NO: 4527 - protein, 240 aa, Shigella flexneri; identical to SEQ ID NO: 492

SEQ ID NO: 4528 - DNA, 927 bp, Pseudomonas putida; identical to SEQ ID NO: 2112
  CDS (1)..(927)

SEQ ID NO: 4529 - protein, 308 aa, Pseudomonas putida; identical to SEQ ID NO: 490

SEQ ID NO: 4530 - DNA, 711 bp, Lactobacillus plantarum; identical to SEQ ID NO: 487
  CDS (1)..(711)

SEQ ID NO: 4531 - protein, 236 aa, Lactobacillus plantarum; identical to SEQ ID NO: 488

SEQ ID NO: 4532 - DNA, 699 bp, Streptococcus mutans; identical to SEQ ID NO: 485
  CDS (1)..(699)

SEQ ID NO: 4533 - protein, 232 aa, Streptococcus mutans; identical to SEQ ID NO: 486

SEQ ID NO: 4534 - DNA, 699 bp, Streptococcus agalactiae; identical to SEQ ID NO: 2118
  CDS (1)..(699)

SEQ ID NO: 4535 - protein, 232 aa, Streptococcus agalactiae; identical to SEQ ID NO: 484

SEQ ID NO: 4536 - DNA, 747 bp, Oceanobacillus iheyensis; identical to SEQ ID NO: 481
  CDS (1)..(747)

SEQ ID NO: 4537 - protein, 248 aa, Oceanobacillus iheyensis; identical to SEQ ID NO: 482

SEQ ID NO: 4538 - DNA, 756 bp, Escherichia coli O6; identical to SEQ ID NO: 479
  CDS (1)..(756)

SEQ ID NO: 4539 - protein, 251 aa, Escherichia coli O6; identical to SEQ ID NO: 480

SEQ ID NO: 4540 - DNA, 699 bp, Escherichia coli O6; identical to SEQ ID NO: 477
  CDS (1)..(699)

SEQ ID NO: 4541 - protein, 232 aa, Escherichia coli O6; identical to SEQ ID NO: 478

SEQ ID NO: 4542 - DNA, 765 bp, Streptomyces sp; identical to SEQ ID NO: 2126
  CDS (1)..(765)

SEQ ID NO: 4543 - protein, 254 aa, Streptomyces sp; identical to SEQ ID NO: 468

SEQ ID NO: 4544 - DNA, 714 bp, Streptococcus mutans; identical to SEQ ID NO: 2128
  CDS (1)..(714)

SEQ ID NO: 4545 - protein, 237 aa, Streptococcus mutans; identical to SEQ ID NO: 476

SEQ ID NO: 4546 - DNA, 762 bp, Streptomyces griseus; identical to SEQ ID NO: 2130
  CDS (1)..(762)

SEQ ID NO: 4547 - protein, 253 aa, Streptomyces griseus; identical to SEQ ID NO: 466

SEQ ID NO: 4548 - DNA, 726 bp, Clostridium perfringens; identical to SEQ ID NO: 471
  CDS (1)..(726)

SEQ ID NO: 4549 - protein, 241 aa, Clostridium perfringens; identical to SEQ ID NO: 472

SEQ ID NO: 4550 - DNA, 726 bp, Streptococcus pyogenes; identical to SEQ ID NO: 469
  CDS (1)..(726)

SEQ ID NO: 4551 - protein, 241 aa, Streptococcus pyogenes; identical to SEQ ID NO: 470

SEQ ID NO: 4552 - DNA, 705 bp, Pseudomonas fluorescens; identical to SEQ ID NO: 463
  CDS (1)..(705)

SEQ ID NO: 4553 - protein, 234 aa, Pseudomonas fluorescens; identical to SEQ ID NO: 464

SEQ ID NO: 4554 - DNA, 765 bp, Streptomyces coelicolor; identical to SEQ ID NO: 2138
  CDS (1)..(765)

SEQ ID NO: 4555 - protein, 254 aa, Streptomyces coelicolor; identical to SEQ ID NO: 474

SEQ ID NO: 4556 - DNA, 23 bp, artificial sequence
  primer
atgggacacaagcccttataccg

SEQ ID NO: 4557 - DNA, 23 bp, artificial sequence
  primer
ttatcgcgatgattttcgctgcg

SEQ ID NO: 4558 - DNA, 1350 bp, Escherichia coli K12
  CDS (1)..(1350)
atgctggataaaattgttattgccaaccgcggcgagattgcattgcgtattcttcgtgcctgtaaagaactgggcatcaagactgtcgctgtgcactccagcgcggatcgcgatctaaaacacgtattactggcagatgaaacggtctgtattggccctgctccgtcagtaaaaagttatctgaacatcccggcaatcatcagcgccgctgaaatcaccggcgcagtagcaatccatccgggttacggcttcctctccgagaacgccaactttgccgagcaggttgaacgctccggctttatcttcattggcccgaaagcagaaaccattcgcctgatgggcgacaaagtatccgcaatcgcggcgatgaaaaaagcgggcgtcccttgcgtaccgggttctgacggcccgctgggcgacgatatggataaaaaccgtgccattgctaaacgcattggttatccggtgattatcaaagcctccggcggcggcggcggtcgcggtatgcgcgtagtgcgcggcgacgctgaactggcacaatccatctccatgacccgtgcggaagcgaaagctgctttcagcaacgatatggtttacatggagaaatacctggaaaatcctcgccacgtcgagattcaggtactggctgacggtcagggcaacgctatctatctggcggaacgtgactgctccatgcaacgccgccaccagaaagtggtcgaagaagcgccagcaccgggcattaccccggaactgcgtcgctacatcggcgaacgttgcgctaaagcgtgtgttgatatcggctatcgcggtgcaggtactttcgagttcctgttcgaaaacggcgagttctatttcatcgaaatgaacacccgtattcaggtagaacacccggttacagaaatgatcaccggcgttgacctgatcaaagaacagctgcgtatcgctgccggtcaaccgctgtcgatcaagcaagaagaagttcacgttcgcggccatgcggtggaatgtcgtatcaacgccgaagatccgaacaccttcctgccaagtccgggcaaaatcacccgtttccacgcacctggcggttttggcgtacgttgggagtctcatatctacgcgggctacaccgtaccgccgtactatgactcaatgatcggtaagctgatttgctacggtgaaaaccgtgacgtggcgattgcccgcatgaagaatgcgctgcaggagctgatcatcgacggtatcaaaaccaacgttgatctgcagatccgcatcatgaatgacgagaacttccagcatggtggcactaacatccactatctggagaaaaaactcggtcttcaggaaaaataa

SEQ ID NO: 4559 - protein, 449 aa, Escherichia coli K12
MLDKIVIANRGEIALRILRACKELGIKTVAVHSSADRDLKHVLLADETVCIGPAPSVKSYLNIPAIISAAEITGAVAIHPGYGFLSENANFAEQVERSGFIFIGPKAETIRLMGDKVSAIAAMKKAGVPCVPGSDGPLGDDMDKNRAIAKRIGYPVIIKASGGGGGRGMRVVRGDAELAQSISMTRAEAKAAFSNDMVYMEKYLENPRHVEIQVLADGQGNAIYLAERDCSMQRRHQKVVEEAPAPGITPELRRYIGERCAKACVDIGYRGAGTFEFLFENGEFYFIEMNTRIQVEHPVTEMITGVDLIKEQLRIAAGQPLSIKQEEVHVRGHAVECRINAEDPNTFLPSPGKITRFHAPGGFGVRWESHIYAGYTVPPYYDSMIGKLICYGENRDVAIARMKNALQELIIDGIKTNVDLQIRIMNDENFQHGGTNIHYLEKKLGLQEK

SEQ ID NO: 4560 - DNA, 7367 bp, Gallus gallus (chicken)
  CDS (154)..(7128)
catcgccgcgcccccagcaccgccgctgccctgcaccaggccgggggcccgcggcgcctccaccgcgcccggcaccctgagttcattttggaagtggataactgctcagattgcaagaataacaagagtgctgagagctcaatttggggagccatggaagagtcttcccaacctgctaaacccctggagatgaaccctcactctcgctttattattggttccgtgtcagaggataactcagaagatgagacgagctccttggtgaaacttgacctgctggaggagaaagagaggtctctgtcccctgtttctgtctgctcggattccctttcggatttgggacttcctagtgctcaagatggtttggcaaaccatatgaggcccagcatgtctggtttgcacctcgtaaagcaaggccgggacaggaagaaagttgacgtgcagcgggatttcactgtggcttctccagcagaatttgttactcgttttggagggaacagagttattgagaaggtcctgatagccaacaatgggattgcagcagtgaaatgcatgaggtcgatccggcgctggtcctatgagatgttccgaaacgagcgggcaatcagatttgttgtcatggtgactcctgaggacctgaaagcaaatgcagagtacattaaaatggcagatcactacgtgccagttccaggaggaccaaacaacaacaactatgcaaatgtggaactcattctcgatattgcaaaacgcattccagtgcaggctgtttgggctggctggggccatgcctccgagaacccaaaactaccagaacttctccacaaaaatgggattgctttcatgggtcctccaagccaagcaatgtgggctttaggagataaaattgcgtcgtcaatagtggctcagactgctggcatcccaactcttccttggaatggcagtggtcttcgagtggattggcaggagaatgatcttcagaagcgtatcctgaatgttcctcaggagctgtatgaaaaaggctatgtgaaagatgcagacgatggcctgcgggctgctgaggaagttggctaccctgtcatgatcaaggcctctgaaggaggaggagggaagggaattaggaaagtcaataatgcggatgacttccccaacctatttagacaggttcaggctgaagtcccaggctctccgatctttgtaatgaggctagccaaacagtcccgccacttggaggtgcagatcctggcagaccagtatggcaatgccatctctctctttggtcgggattgctccgtgcaacgcaggcatcagaagattattgaagaagcacctgcttctattgcaacttcggtggtatttgagcacatggaacagtgtgcagtgaagcttgcaaaaatggtggggtatgtgagtgcgggcactgtggaatacctgtacagccaggatggcagcttctactttctggagttgaatccccgtctgcaagtggagcacccctgcaccgagatggtagctgatgttaatcttcctgcagcacagctccagattgccatggggattccactccaccgtatcaaggatatccgagtgatgtatggtgtttccccatggggagatggatctattgattttgagaattcagcccatgtcccctgtccacgtggccatgttattgctgcacgtatcaccagtgagaatcctgatgagggatttaagcccagttctggtacagtccaggaactgaatttccgcagcaataagaatgtttggggctatttcagtgttgctgctgcaggagggctgcatgaatttgctgattctcagtttggtcactgcttctcttggggagagaatcgtgaagaagccatctcaaacatggtggtggctttgaaggagctgtccatccgaggggatttccgaaccactgttgaatacttgataaaactgttggaaacagaaagcttccagcagaaccgcattgacactggctggttggatcggcttattgctgagaaagtgcaggctgaaaggcctgataccatgctaggagtggtatgtggagctcttcatgtggctgatgtgagctttcgaaacagcgtctcaaacttcctgcactctttagaaaggggccaagtcctgcctgctcatactttgctaaacactgtggatgtggaactcatctatgaaggacggaaatatgtgttgaaggtgacccgacagtctcccaattcctacgtggtcatcatgaacagctcttgtgtggaagttgatgtgcacagactgagcgatggagggctgctcctatcttacgatggtagcagctacaccacctacatgaaagaagaagtggacaggtatcgcatcactataggtaacaagacctgtgtgtttgaaaaggaaaatgatccttctattctgcgctcaccttcggctgggaagcttatccagtatgtggtggaggatgggggacacgtgtttgcaggccaatgctttgcagaaatagaggtgatgaaaatggtgatgacactaacagcaggagagtcaggctgcatccattatgtcaaacgccccggggcagtgctggatccaggctgtgtgattgccaaactccagctggatgatcccagcagggttcagcaggctgaactgcacacaggcaccttgccacagatccagagcacagcacttcgaggcgaaaaactccatcgcatcttccattatgtcctggataacctggtcaacgtgatgaatgggtactgcctgccagagccctactttagcagcaaggtgaagggctgggttgagcgactaatgaagacactgagagatccatctttgcctctgctggaacttcaggacatcatgaccagtgtttctggacggattccacccaatgtggagaagtccatcaagaaggagatggcccaatatgccagcaacatcacgtcagtcctttgccagtttcccagccaacagattgccaatatcttggatagccatgcagccaccttgaaccgcaaatcagagcgtgaggtctttttcatgaacactcagagtattgtgcagcttgtacagaggtaccggagtggtattcggggtcacatgaaagcagtggtcatggatttgctccgtcaatatctgaaggtggagactcagtttcagcatggtcactatgacaagtgtgtctttgcccttcgggaagagaataaaagcgacatgaatgctgtattgaactacatcttctcacatgctcaggtcaccaagaagaacctgcttgtcacaatgctcattgaccagctctgtggccgtgaccccaccctgacagatgagctgatcaatattctgacagagctgacccagctcagcaagacaaccaacgccaaagtggcgctgcgggcacggcaggttctcattgcttcccatttgccgtcctacgagctgcgtcacaaccaggtggagtccatcttcctatctgctattgacatgtatggacaccagttctgcattgagaacctgcagaaactcattttgtcagagacatccatctttgatgtgctacccaactttttctaccacagtaatcaggtggtgagaatggcagctttggaggtgtacgttcgaagggcgtacattgcctacgagctgaacagcgtccagcaccgccagctgaaggacaacacctgcgtggtggagttccagttcatgctgcccacctcccacccaaacagaatgtccttctcttccaacctcaatcactacgggatggtccacgtagccagtgtgagtgacgtgctgctggacaactcgttcactcccccgtgccagcggatgggagggatggtctctttccgcacgtttgaagattttgtcagaatctttgatgaagtgatgagttgtttttgcgactctcctccccagagcccaaccttccctgaagctggccatgcttccctctatgatgaagacaaggctgcccgtgaggagcccattcacattcttaatgtcgctattaaaactgatggggacgtggatgatgatgggctggcagccatgttcagagagttcacacaaagcaagaaatcagtcctgattgagcatggcatccggaggctgacattccttgtggcacagaagagggaatttccaaagttcttcacgttccgtgccagggataagtttgaagaagacagaatctaccgccatctggagccagctctggctttccagctggagctgaaccgaatgcggaactttgacctcactgccattccatgtgccaaccataaaatgcatctctacctgggagcagctaaagttgaagtaggaacagaagtgacagactacaggttctttgtgagggccattataaggcattcagaccttgttaccaaggaagcctccttcgagtacctgcaaaacgagggagagcgattgcttttggaagccatggatgagttggaggtggcatttaataataccaacgtgcgcacggactgcaatcacatcttcttaaattttgtgcctactgtcatcatggacccatccaagatcgaggaatccgtgcggagcatggtgatgcgctacgggagccgcctgtggaagctccgcgtcctccaggccgagctgaagatcaacattcggctgacaccgacaggaaaggccatccccattcgtctcttcctgaccaacgagtcgggctactacctggacatcagcctgtacaaagaggtgacggattccaggacagggcagattatgttccaggcctatggggataaacagggaccacttcacgggatgctgataaataccccatacgtgaccaaggaccttcttcagtccaagagattccaggcacagtctttagggacatcctatgtctatgacattcctgagatgtttcggcagtctttaattaaactctgggattctatgaatgaacatgcattcctgccaacaccgccgctgccgtctgacatactgacatacactgaattggtgctggatgatcagggccagctcgtgcacatgaacaggctgccaggaggaaacgagattgggatggtagcctggaaaatgaccctcaagaccccggagtatcccgaaggccgtgatatcatcgtcattggcaatgacattacgtaccggataggttcttttgggcctcaggaggacgtgctgttcctgagggcttcagagcttgctcgaactcatggcatcccccgcatctacgtggctgccaacagcggagccaggattggtttggctgaggagatccggcacatgttccatgttgcgtgggaagatccagatgacccatacaaaggatacaagtacttgtatctgacacctcaagactataagaaagtcagcgctctgaactcagttcactgtgaacacgtggaggacaacggagagtccaggtataagataacagatattatcggaaaggaagacggacttggaatagagaacctcagaggatctggcatgattgctggagaatcatctttagcctacgagagtattatcaccatcaacttggttacgtgtcgggcaattggaattggagcttacctcgttcggttagggcagaggactatccaggttgagaactctcacataatcctgactggctgtggagccctcaacaaggtgctgggacgggaggtgtacacctccaacaaccagctgggcgggatccagatcatgcacaacaacggggtgacccacggcaccgtgtgcgacgattttgaaggagtctacactatcctgctgtggctttcctacatgcccaagagcgtatacagccctgttcctatcctcaaggtcaaggatcctatagacagaaccatagacttcgttcctaccaagactccctatgatcctcgctggatgctggctggacgcccaaatccaagtcaaaaagggcaatggcagagcggtttctttgacaatggctcgttcctggagatcatgcagccctgggcacagacggttgtggttggcagagcaaggctgggaggaatacctgtaggagtagttgccgtagaaaccagaacagtggagctgagcatccctgctgatcccgccaacctggactcggaggccaagataatccagcaggctggtcaggtgtggttccccgactctgcctttaagacagcccaggccatcaacgacttcaacagagaagggctgcctctgatggtctttgccaactggagaggcttctctggtggcatgaaagacatgtacgaccaggtgctcaagtttggtgcctacatcgtggacggcctgcgggagtaccggcagcccgtgctcatctacatcccaccgcaggcggagctcaggggcggctcctgggctgtcatcgaccccaccatcaaccccaggcacatggagatgtacgcggaccgtgaaagcagagggggaatcctggagccggaggggacggtggaaatcaagttccgcaggaaggacctggtgaagacaatgaggagagtggaccccgtctacatgcggctggccgagcggctgggtacccctgagctgagtgctgccgaccgaaaagacctggagagcaaactgaaggagcgggaggaattcctgattcccatttaccaccaggtggccatgcagtttgctgacctgcacgacacacccggccgcatgcaggagaagggtgccatcacggacattctggactggaaaacgtctcggaccttcttctactggaggctgagacgtcttcttctggaagatgtggtcaaaaagaagatccatgatgccaaccctgagctgaccgacgggcagatccaggccatgctgcgacgctggtttgtggaagtggaggggacggtaaaggcgtacctgtgggacagcaataaggacctggtggagtggctggagaagcagctgatggaggaggagggggttcgctcggttgtggatgagaacattaagtacatctccagggattacatcctgaagcagatccgcagcctggtccaggccaatcccgaggttgccatggattcgatcgtgcacatgacccagcatatatcacccacccagcgagccgagatcgtgcggatcctctccacaatggactctccttcttcaacgtaagagcatcgatttcctgtactcccccctgctcggtacagtggaggggaagaaaaaaagaaaaaaagctcagaattgccctttgtctgctcaactgcgaccgctgtaccgagacggggaggctcagggaaacgctggaagagtgacagttttagttttttcaaaccagactgaccagaggaagtcgctttggccggagacacgaggaagatgtataaacacgggccctgcaggattgagtt

SEQ ID NO: 4561 - protein, 2324 aa, Gallus gallus (chicken)
MEESSQPAKPLEMNPHSRFIIGSVSEDNSEDETSSLVKLDLLEEKERSLSPVSVCSDSLSDLGLPSAQDGLANHMRPSMSGLHLVKQGRDRKKVDVQRDFTVASPAEFVTRFGGNRVIEKVLIANNGIAAVKCMRSIRRWSYEMFRNERAIRFVVMVTPEDLKANAEYIKMADHYVPVPGGPNNNNYANVELILDIAKRIPVQAVWAGWGHASENPKLPELLHKNGIAFMGPPSQAMWALGDKIASSIVAQTAGIPTLPWNGSGLRVDWQENDLQKRILNVPQELYEKGYVKDADDGLRAAEEVGYPVMIKASEGGGGKGIRKVNNADDFPNLFRQVQAEVPGSPIFVMRLAKQSRHLEVQILADQYGNAISLFGRDCSVQRRHQKIIEEAPASIATSVVFEHMEQCAVKLAKMVGYVSAGTVEYLYSQDGSFYFLELNPRLQVEHPCTEMVADVNLPAAQLQIAMGIPLHRIKDIRVMYGVSPWGDGSIDFENSAHVPCPRGHVIAARITSENPDEGFKPSSGTVQELNFRSNKNVWGYFSVAAAGGLHEFADSQFGHCFSWGENREEAISNMVVALKELSIRGDFRTTVEYLIKLLETESFQQNRIDTGWLDRLIAEKVQAERPDTMLGVVCGALHVADVSFRNSVSNFLHSLERGQVLPAHTLLNTVDVELIYEGRKYVLKVTRQSPNSYVVIMNSSCVEVDVHRLSDGGLLLSYDGSSYTTYMKEEVDRYRITIGNKTCVFEKENDPSILRSPSAGKLIQYVVEDGGHVFAGQCFAEIEVMKMVMTLTAGESGCIHYVKRPGAVLDPGCVIAKLQLDDPSRVQQAELHTGTLPQIQSTALRGEKLHRIFHYVLDNLVNVMNGYCLPEPYFSSKVKGWVERLMKTLRDPSLPLLELQDIMTSVSGRIPPNVEKSIKKEMAQYASNITSVLCQFPSQQIANILDSHAATLNRKSEREVFFMNTQSIVQLVQRYRSGIRGHMKAVVMDLLRQYLKVETQFQHGHYDKCVFALREENKSDMNAVLNYIFSHAQVTKKNLLVTMLIDQLCGRDPTLTDELINILTELTQLSKTTNAKVALRARQVLIASHLPSYELRHNQVESIFLSAIDMYGHQFCIENLQKLILSETSIFDVLPNFFYHSNQVVRMAALEVYVRRAYIAYELNSVQHRQLKDNTCVVEFQFMLPTSHPNRMSFSSNLNHYGMVHVASVSDVLLDNSFTPPCQRMGGMVSFRTFEDFVRIFDEVMSCFCDSPPQSPTFPEAGHASLYDEDKAAREEPIHILNVAIKTDGDVDDDGLAAMFREFTQSKKSVLIEHGIRRLTFLVAQKREFPKFFTFRARDKFEEDRIYRHLEPALAFQLELNRMRNFDLTAIPCANHKMHLYLGAAKVEVGTEVTDYRFFVRAIIRHSDLVTKEASFEYLQNEGERLLLEAMDELEVAFNNTNVRTDCNHIFLNFVPTVIMDPSKIEESVRSMVMRYGSRLWKLRVLQAELKINIRLTPTGKAIPIRLFLTNESGYYLDISLYKEVTDSRTGQIMFQAYGDKQGPLHGMLINTPYVTKDLLQSKRFQAQSLGTSYVYDIPEMFRQSLIKLWDSMNEHAFLPTPPLPSDILTYTELVLDDQGQLVHMNRLPGGNEIGMVAWKMTLKTPEYPEGRDIIVIGNDITYRIGSFGPQEDVLFLRASELARTHGIPRIYVAANSGARIGLAEEIRHMFHVAWEDPDDPYKGYKYLYLTPQDYKKVSALNSVHCEHVEDNGESRYKITDIIGKEDGLGIENLRGSGMIAGESSLAYESIITINLVTCRAIGIGAYLVRLGQRTIQVENSHIILTGCGALNKVLGREVYTSNNQLGGIQIMHNNGVTHGTVCDDFEGVYTILLWLSYMPKSVYSPVPILKVKDPIDRTIDFVPTKTPYDPRWMLAGRPNPSQKGQWQSGFFDNGSFLEIMQPWAQTVVVGRARLGGIPVGVVAVETRTVELSIPADPANLDSEAKIIQQAGQVWFPDSAFKTAQAINDFNREGLPLMVFANWRGFSGGMKDMYDQVLKFGAYIVDGLREYRQPVLIYIPPQAELRGGSWAVIDPTINPRHMEMYADRESRGGILEPEGTVEIKFRRKDLVKTMRRVDPVYMRLAERLGTPELSAADRKDLESKLKEREEFLIPIYHQVAMQFADLHDTPGRMQEKGAITDILDWKTSRTFFYWRLRRLLLEDVVKKKIHDANPELTDGQIQAMLRRWFVEVEGTVKAYLWDSNKDLVEWLEKQLMEEEGVRSVVDENIKYISRDYILKQIRSLVQANPEVAMDSIVHMTQHISPTQRAEIVRILSTMDSPSST

SEQ ID NO: 4562 - DNA, 7038 bp, Rattus norvegicus (Norway rat)
  CDS (1)..(7038)
atggatgaaccatctccgttggccaaaaccctggagctgaaccagcactcccgattcataattgggtccgtgtctgaagacaactcagaagatgagatcagtaacctggtaaagctggacctagaggagaaggagggctccctgtcaccagcctctgtcagctcagatacactttctgatttgggaatctctgccttacaggatggtttggcctttcacatgaggtccagcatgtccggcttgcacctagtaaaacaaggtcgagacagaaagaaaatagactctcaacgagatttcactgtggcttcgccagcagaatttgttactcgttttgggggaaataaagtgattgagaaggttcttatcgccaacaatggtattgcagcagtgaaatgcatgcgatctatccggcggtggtcttatgaaatgttccgcaatgaacgtgccatccggtttgttgtcatggttacacccgaagaccttaaagccaatgcagaatacattaagatggcggatcactatgttccagtgcctggaggagcaaacaacaacaattatgcaaatgtggaattgattcttgatattgcgaaaaggatacctgtacaggcagtgtgggctggctggggtcatgcctccgagaaccccaagctcccggagctactcttaaaaaatggcattgctttcatgggccctccgagtcaggccatgtgggcgttgggggataagattgcatcgtctattgtggctcaaactgcaggtatccccactcttccctggagtggcagtggtcttcgagtggattggcaagaaaatgatttttcgaaacgcatcttaaatgttccacaggatctgtatgagaaaggctatgtgaaggatgtggatgatggactgaaggcagccgaggaggttggctatccagtgatgatcaaggcctcagagggaggaggagggaagggaatcagaaaagttaacaatgcagatgacttccctaacctcttcagacaggttcaagctgaagtccctggatcacctatatttgtaatgagattagcaaaacagtctcgtcatctggaggtccagattctggcggatcagtatggcaatgcaatttctttgtttggtcgtgactgctctgtacaacgcaggcatcagaagatcattgaagaagctcctgctgctattgctaccccagcagtatttgaacacatggaacagtgtgctgtaaaacttgccaaaatggttggttatgtgagcgctgggactgtggaatacttgtacagccaggacggaagcttctacttcttggaactgaaccctcggctacaggttgaacatccttgtacagagatggtggctgatgtcaatcttcctgcagcacagctccagattgccatggggatccctctatttaggatcaaggatattcgtatgatgtatggggtatctccttggggtgatgctcccattgattttgaaaattctgctcatgttccttgcccaaggggccatgtgattgctgctcggatcaccagtgaaaacccagatgaggggtttaagcccagctctggaacagttcaggaacttaattttcgcagcaataagaatgtttggggttatttcagtgttgctgctgctgggggacttcatgaatttgctgattctcagttcggtcactgcttttcctggggagaaaacagagaagaagcaatttcaaatatggtggtggcattgaaggagctgtctattcggggtgactttcgaactacagtagaatacctcatcaagctgctggagacagaaagctttcagttgaacagaatcgacactggctggctggacagactgattgcagagaaagtgcaggcagagcgtcctgacaccatgttgggagttgtgtgtggggctcttcatgtggcagatgtgaacctgagaaatagcatctctaacttccttcactccttagagaggggtcaagtccttcctgctcacacacttctgaacacagtagatgttgaacttatctatgaaggaatcaaatatgtacttaaggtgactcggcagtctcccaactcctacgtggtgataatgaacggctcgtgtgtggaagtggacgtgcaccggctgagtgatggtggactgctcttgtcctacgatggcagcagttacaccacatacatgaaggaggaggtagacagataccgaatcacaattggcaataaaacctgtgtgtttgagaaggaaaatgacccgtctgtaatgcgctccccgtctgctgggaagttaatccagtatattgtggaagatggaggccatgtgtttgctggccagtgctatgcagagattgaggtaatgaagatggtaatgactttgacagctgtagaatctggctgcatccattatgtcaagcgacctggagcagcacttgacccaggctgtgtgatagccaaaatgcagctggacaatcccagtaaagttcaacaggctgagcttcacacgggcagtctgccccagatccagagcacagctctccgaggcgaaaagctccatcgagttttccactatgtcctggataacctggtcaatgtgatgaatggatactgccttccagaccctttcttcagcagcaaggtaaaggactgggtagaacggttaatgaagactctgagagacccctccctgcctcttctagaattgcaggatatcatgaccagtgtctctggccggatccccctcaacgtggagaagtctattaagaaggaaatggctcagtatgctagcaacatcacatcggtcctgtgtcagtttcccagccagcagattgccaacatcctagatagtcatgcagctacactgaaccggaaatcggagcgggaagtcttcttcatgaacacccagagcattgtccagctggtgcagaggtaccgaagtggcatccgtggccacatgaaggctgtggtgatggatctgctccggcagtacctgcgggtggagacacagtttcagaatggccactacgacaaatgtgtattcgcccttcgggaagagaacaaaagtgacatgaacaccgtactgaactacatcttctcccacgcccaggtcaccaagaagaatctcctggtgacaatgcttattgatcagttgtgtggccgggaccctacacttactgatgagctgctaaacatcctcacagagctaactcagctcagcaaaaccaccaacgccaaagtggcactgcgggctcgccaggttcttattgcctcccatttgccatcgtacgacgttcgccataaccaagtagagtccatcttcttatcagccatcgacatgtatggacaccagttttgcattgagaacctgcagaaactcatcctatcagaaacatctattttcgatgtcctcccaaactttttttaccacagcaaccaggtggtgaggatggcggctctggaggtatatgttcgaagagcttatatcgcctatgagctcaacagtgtacagcatcgccagcttaaggacaacacctgtgtggtagaatttcagttcatgctgcccacatctcatccaaacagagggaacatccccacgctaaacagaatgtcctttgcctccaacctcaaccactacggcatgactcatgtagctagtgtcagcgatgttctgttggacaacgccttcacaccaccttgtcaacgcatgggcgggatggtctctttccggacctttgaagatttcgtcaggatctttgatgaagtaatgggctgcttctgcgactccccaccccaaagccccacattcccagagtccggtcacacttcactctatgatgaggacaaggtccccagggacgaaccaatacatattctgaatgtggctatcaagactgatggcgatattgaggatgacaggcttgcagctatgttcagagagttcacccaacagaataaagctactctggttgagcatgggatccggcgacttacgttcctagttgcacaaaaggatttcagaaaacaagtcaactgtgaggtggatcagagatttcatagagaattccccaaatttttcacattccgagcaagggataagtttgaggaggaccgcatttatcgacatctggagcctgctctggctttccagttagagctgaaccggatgagaaattttgaccttactgccattccatgcgctaatcacaagatgcacctgtaccttggggctgctaaggtggaagtaggcacagaagtgactgactacaggttctttgttcgtgcgatcatcaggcactctgatctggtcacgaaggaagcttcttttgaatatctacaaaatgaaggagagcgactgctcctggaagccatggatgaattggaagttgctttcaataacacaaatgttcgcacagactgtaaccatatattcctcaactttgtgcccacagtcatcatggacccatcaaagattgaagaatctgtgcggagcatggtaatgcgctatggaagccggctgtggaaattgcgggtcctccaggcagaactgaaaatcaacattcgcctgacaacaactggaaaagcgattcccatccgcctcttcctgacaaacgagtctggctactacttggacatcagcctgtataaggaagtgactgactccaggacagcacagatcatgtttcaggcgtatggagacaagcagggaccactgcatggaatgttaatcaatactccgtatgtgaccaaagaccttcttcaatcaaagaggtttcaggcacagtccttgggaacaacgtatatatatgatatcccagagatgtttcggcagtcgctcatcaagctctgggagtccatgtccactcaagcatttcttccttcaccccctttgccttccgacatactgacgtatactgaactggtgttggatgatcaaggccagcttgtccatatgaacagacttccaggaggaaacgagattggcatggtagcctggaaaatgagccttaaaagccctgaatatccagatggccgagatgtcattgtcatcggcaatgacattacatatcggattggctcctttgggcctcaggaagatttgctgtttctcagagcttctgaacttgccagagcagaaggcatcccacgcatctacgtagcagccaacagtggagctagaattggactggcagaagaaatccgtcatatgttccacgtggcctgggtagactctgaggatccttacaagggatacaagtatttatatctgacaccccaggattataaaagagtgagtgctctcaattctgtccactgtgaacatgtggaagatgaaggagaatccaggtacaagataacagacattatcgggaaagaagaaggacttggagcagagaaccttcggggttctggaatgattgctggggaatcctcattggcttatgatgagatcatcaccatcagcctggttacatgccgggccattggtattggggcttaccttgtccggctgggacaaagaaccatccaggttgagaactctcacttaattctaacaggagccggtgccctcaacaaagtccttggtcgggaagtatacacctccaacaatcagcttgggggcatccagataatgcacaacaacggagttacccattgcactgtttgtgatgactttgagggagtgttcacagtcttacactggctgtcatacatgcctaagaacgtgcacagttcagttcctctcctgaattccaaggatcctatagatagaatcatcgagtttgttcccacaaaggccccgtatgatcctcggtggatgctggcaggccgtcctcacccaacccagaaaggccaatggttgagtggattttttgattatggctctttctcagaaatcatgcagccctgggcgcagaccgtggtagttggcagagccaggttggggggaatacctgtgggagtagttgctgtagaaacccgaaccgtggagctcagtgtaccagctgatcctgcaaacctggattctgaagccaagataatccagcaggccggccaagtttggtttccagactctgcatttaagacctatcaagctatcaaggactttaaccgtgaagggctacctctaatggtctttgccaactggagaggcttctctggtgggatgaaagatatgtatgaccaggtgctcaagtttggtgcttatattgtggatggcttgcgggaatgttcccagcctgtgatggtctacattcccccacaggctgagcttcggggtggttcttgggttgtgatcgacccaaccatcaatcctcggcacatggagatgtatgctgaccgggaaagcaggggatccgttctggaaccagaagggacagtagaaatcaaattccgcaaaaaggatctggtgaaaaccatgcgtcgcgtagacccagtctacatccgcttggctgagcgactgggcaccccagagctaagccccactgagcggaaggagctggagagcaagttgaaggagcgggaggagttcctaattcccatttaccatcaggtagctgtgcagtttgctgacttgcacgacaccccaggccggatgcaggagaagggtgtcattaatgatatcttagattggaaaacatcccgcaccttcttctactggcgactgaggcgtctcctgctggaagacctggtcaagaagaaaatccacagtgccaaccctgagctgaccgatggccagatccaggccatgttgagacgctggtttgtggaagtggaaggcacagtgaaggcttacgtctgggacaataataaggatctggtggaatggctggagaagcagctgacagaggaagatggtgtccgctctgtgatagaggagaacatcaaatacatcagcagggactatgtcctcaagcagatccgcagcttggtgcaggccaatccagaagttgccatggactccatcgtccacatgacccagcacatctcccccactcagcgagcagaggttgtaaggatcctttccactatggactccccttctacgtag

SEQ ID NO: 4563 - protein, 2345 aa, Rattus norvegicus (Norway rat)
MDEPSPLAKTLELNQHSRFIIGSVSEDNSEDEISNLVKLDLEEKEGSLSPASVSSDTLSDLGISALQDGLAFHMRSSMSGLHLVKQGRDRKKIDSQRDFTVASPAEFVTRFGGNKVIEKVLIANNGIAAVKCMRSIRRWSYEMFRNERAIRFVVMVTPEDLKANAEYIKMADHYVPVPGGANNNNYANVELILDIAKRIPVQAVWAGWGHASENPKLPELLLKNGIAFMGPPSQAMWALGDKIASSIVAQTAGIPTLPWSGSGLRVDWQENDFSKRILNVPQDLYEKGYVKDVDDGLKAAEEVGYPVMIKASEGGGGKGIRKVNNADDFPNLFRQVQAEVPGSPIFVMRLAKQSRHLEVQILADQYGNAISLFGRDCSVQRRHQKIIEEAPAAIATPAVFEHMEQCAVKLAKMVGYVSAGTVEYLYSQDGSFYFLELNPRLQVEHPCTEMVADVNLPAAQLQIAMGIPLFRIKDIRMMYGVSPWGDAPIDFENSAHVPCPRGHVIAARITSENPDEGFKPSSGTVQELNFRSNKNVWGYFSVAAAGGLHEFADSQFGHCFSWGENREEAISNMVVALKELSIRGDFRTTVEYLIKLLETESFQLNRIDTGWLDRLIAEKVQAERPDTMLGVVCGALHVADVNLRNSISNFLHSLERGQVLPAHTLLNTVDVELIYEGIKYVLKVTRQSPNSYVVIMNGSCVEVDVHRLSDGGLLLSYDGSSYTTYMKEEVDRYRITIGNKTCVFEKENDPSVMRSPSAGKLIQYIVEDGGHVFAGQCYAEIEVMKMVMTLTAVESGCIHYVKRPGAALDPGCVIAKMQLDNPSKVQQAELHTGSLPQIQSTALRGEKLHRVFHYVLDNLVNVMNGYCLPDPFFSSKVKDWVERLMKTLRDPSLPLLELQDIMTSVSGRIPLNVEKSIKKEMAQYASNITSVLCQFPSQQIANILDSHAATLNRKSEREVFFMNTQSIVQLVQRYRSGIRGHMKAVVMDLLRQYLRVETQFQNGHYDKCVFALREENKSDMNTVLNYIFSHAQVTKKNLLVTMLIDQLCGRDPTLTDELLNILTELTQLSKTTNAKVALRARQVLIASHLPSYDVRHNQVESIFLSAIDMYGHQFCIENLQKLILSETSIFDVLPNFFYHSNQVVRMAALEVYVRRAYIAYELNSVQHRQLKDNTCVVEFQFMLPTSHPNRGNIPTLNRMSFASNLNHYGMTHVASVSDVLLDNAFTPPCQRMGGMVSFRTFEDFVRIFDEVMGCFCDSPPQSPTFPESGHTSLYDEDKVPRDEPIHILNVAIKTDGDIEDDRLAAMFREFTQQNKATLVEHGIRRLTFLVAQKDFRKQVNCEVDQRFHREFPKFFTFRARDKFEEDRIYRHLEPALAFQLELNRMRNFDLTAIPCANHKMHLYLGAAKVEVGTEVTDYRFFVRAIIRHSDLVTKEASFEYLQNEGERLLLEAMDELEVAFNNTNVRTDCNHIFLNFVPTVIMDPSKIEESVRSMVMRYGSRLWKLRVLQAELKINIRLTTTGKAIPIRLFLTNESGYYLDISLYKEVTDSRTAQIMFQAYGDKQGPLHGMLINTPYVTKDLLQSKRFQAQSLGTTYIYDIPEMFRQSLIKLWESMSTQAFLPSPPLPSDILTYTELVLDDQGQLVHMNRLPGGNEIGMVAWKMSLKSPEYPDGRDVIVIGNDITYRIGSFGPQEDLLFLRASELARAEGIPRIYVAANSGARIGLAEEIRHMFHVAWVDSEDPYKGYKYLYLTPQDYKRVSALNSVHCEHVEDEGESRYKITDIIGKEEGLGAENLRGSGMIAGESSLAYDEIITISLVTCRAIGIGAYLVRLGQRTIQVENSHLILTGAGALNKVLGREVYTSNNQLGGIQIMHNNGVTHCTVCDDFEGVFTVLHWLSYMPKNVHSSVPLLNSKDPIDRIIEFVPTKAPYDPRWMLAGRPHPTQKGQWLSGFFDYGSFSEIMQPWAQTVVVGRARLGGIPVGVVAVETRTVELSVPADPANLDSEAKIIQQAGQVWFPDSAFKTYQAIKDFNREGLPLMVFANWRGFSGGMKDMYDQVLKFGAYIVDGLRECSQPVMVYIPPQAELRGGSWVVIDPTINPRHMEMYADRESRGSVLEPEGTVEIKFRKKDLVKTMRRVDPVYIRLAERLGTPELSPTERKELESKLKEREEFLIPIYHQVAVQFADLHDTPGRMQEKGVINDILDWKTSRTFFYWRLRRLLLEDLVKKKIHSANPELTDGQIQAMLRRWFVEVEGTVKAYVWDNNKDLVEWLEKQLTEEDGVRSVIEENIKYISRDYVLKQIRSLVQANPEVAMDSIVHMTQHISPTQRAEVVRILSTMDSPST

SEQ ID NO: 4564 - DNA, 6270 bp, Cyclotella cryptica
  CDS (1)..(6270)
atggctctccgtaggggcctttacgctgctgcagcgactgccatcttggtcacggcttcagtgaccgcttttgctcctcagcattcgacattcaccccccaatcgctctcggcggcacccacgcgcaacgtcttcggccagatcaaaagcgccttcttcaaccatgatgttgccacctctcgaaccattcttcacgccgcgacactagatgaaactgttctttccgcttcagactccgtcgccaaatctgtcgaagactacgtgaaatcccgtggtggaaatcgcgtcattcgtaaagtcctcatcgccaacaacggcatggccgcgacaaagtccatcctctccatgcgtcaatgggcctacatggaattcggggacgaacgtgccatccagttcgttgcgatggcgactcccgaggatttgaaggcgaacgccgaatttattcgcttggcggattctttcgtcgaggtaccgggaggaaagaacttgaacaactacgccaacgtcgatgtcattacccgcatcgctaaggagcagggggttgatgccgtttggcctggatggggtcatgcatctgagaatccgaagctccctaatgcgcttgacaaattgggaatcaagttcattggaccaactgggcctgtcatgagcgttttgggagacaagattgctgcgaacattctagcacagacagcgaaagtcccctccattccctggagtggatcctttggtggaccagacgatggaccccttcaggcggatctgaccgaggagggtactatcccaatggaaatctttaacaagggattagtaacctctgctgatgaagccgtcattgtggcgaacaagattggctgggagaacggaatcatgatcaaggcttctgagggtggaggaggaaagggtatacgctttgtcgacaatgaggccgacttacggaacgcgttcgttcaggtgtccaatgaagtgattggctctcctattttcctcatgcagttgtgtaagaacgctcgtcacatcgaagtgcaaattgttggcgaccagcacggaaatgctgtagcgttgaacggtcgagattgctccactcagcgtcgcttccagaagatcttcgaggaaggtcctccgtccattgtaccgaaagaaacattccacgagatggaacttgcggctcaacggttgactcaaaacattgggtatcaaggtgctggaactgtggaatacttgtacaacgccgctgacaataagtttttcttccttgagttgaacccccgtctccaagtggagcatcctgtgactgaaggaattaccggcgctaatcttcctgccactcagcttcaagttgctatgggtattcctctcttcaacattcctgacattcgccgtctctatggaagagaggatgcttacggaacggatcccattgattttcttcaagaacgttaccgcgaactcgactctcatgtaattgctgcccgcatcactgctgaaaaccccgatgaaggattcaaacccacctcaggctcaattgagcgaatcaaatttcaatccaccccaaatgtttggggatatttctctgttggtgctaacggtggaatccatgaatttgccgactctcagtttggccatcttttcgctaagggtccgaaccgtgagcaagcccgcaaggcattggttttggctcttaaggagatggaagtgcgcggagacattcgtaactctgttgaatacctagtcaagttgctcgaaactgaagctttcaagaagaacactatcgacacgtcttggttagatggcattattaaggagaagtccgttaaagttgagatgccctctcacttagtggttgtcggagccgctgttttcaaggccttcgaacatgttaaggtggccactgaagaagttaaggaatcgtttcgaaaaggacaagtctccactgcagggattccaggcataaactcgttcaacatcgaagttgcgtacttagacacgaagtacccattccacgtagaacggatctctccagatgtttacaggtttaccttggacgggaacacgattgatgtggaagttacccaaaccgctgaaggagcacttttggcaacctttggaggagagactcatcgtatctttggtatggacgaaccacttggccttcgactgtcattggacggggcaactgtcctaatgccaacaatttttgacccctctgaactccgcactgatgtgactggaaaggttgttcgttacctccaagacaatggagcaactgttgaagcgggccagccctatgtcgaggttgaagcgatgaagatgatcatgccaatcaaggctactgagtctggaaaaattactcacaacctaagtgctggatctgtaatctctgctggtgaccttcttgcttctctcgaacttaaggatccctctagggttaagaaaatagaaactttttcgggcaaattggacattatggaatcgaaggttgacttagaaccgcagaaagcagtcatgaatgtcctctctgggttcaacttagaccctgaggcagttgcgcagcaagcaattgacagtgctaccgacagctctgccgcagccgatcttcttgtccaagtattagacgaattctatcgcgttgaatctcagtttgatggtgtcatcgctgatgatgttgtccgcactctcaccaaagcgaacaccgagacacttgatgttgtcatctccgagaacttggcccaccagcagctcaagaggcgtagtcagcttctcctcgctatgatccgtcaacttgacacgtttcaagacagatttggcagagaagttccggatgctgtcattgaagcattgagtaggctttctaccttgaaagacaaatcttacggtgaaatcattcttgcggctgaggagagagtccgcgaagccaaggtgccgtccttcgaagtgcgtcgtgctgatttgcgtgcaaagcttgctgacccggagacagatttgattgacctgagtaagagctcaacactctcagcaggggttgaccttctcacaaatctttttgatgacgaagatgaatctgtccgcgctgctgctatggaagtatatactcgccgtgtctaccgtacctacaacatccccgagctaactgttggagttgagaatggccgcctctcatgtagcttctccttccaatttgctgatgtcccggcgaaagaccgtgtcacccgccaagggttcttctcagttatcgacgacgcttcaaagttcgcgcaacagcttcctgagattctcaactcgtttggatcaaagatcgcaggggatgcaagcaaagaaggccctgtcaatgttttgcaggttggtgctctctcgggagatatcagtattgaggacctcgagaaagctacttccgctaacaaggacaagttgaatatgcttggtgtccgcactgtgacggctcttatcccaaggggaaagaaggacccaagctattattcattcccccaatgcagtggcttcaaggaggatcctcttcgcagaggcatgcgcccaacctttcatcatctcctggaactcggacggctggaggaaaactttgctcttgaacgaattcctgcagttggacgcaacgtacagatttatgttggttccgagaagacggcaaggcgaaatgcagctcaagttgttttcttgagagctatctcacatactcctggcctaactaccttctctggtgcacgccgagctcttctccaggggcttgacgaattggaacgtgctcaagcaaactcaaaggtcagtgtccagtcatcgtctcgcatctaccttcactctctcccagaacagtctgatgcaactcccgaggagattgctaaagaattcgaaggtgtcattgacaagctaaagagtcgattggcccaacgtcttacgaaactgcgtgtggatgagattgaaaccaaggttcgcgtgactgtccaggatgaagacggtagtcccagggttgtgcctgtacgccttgtggcttcttcaatgcaaggcgaatggcttaaaacatctgcttacattgatcgtccggacccggtcactggagtcacccgtgaacggtgcgtgattggagaaggcattgacgaggtttgtgaacttgagtcgtatgactctaccagtaccatccaaacaaagcgctcaattgcaagacgtgtgggatctacctacgcttatgactaccttggactccttgaggtcagcttgcttggagaatgggataagtatctcagcagtctctcaggaccggacacccctaccatcccgtcgaatgtttttgaagctcaagagttacttgaaggacctgatggcgagcttgtcaccgggaaacgtgaaattggaacaaataaggttggtatggttgcatgggtggtaacaatgaaaacacctgaatatcctgagggtcgacaggttgttgtaattgtgaacgatgtcactgtacaaagtggttcatttggagttgaggaggatgaagttttcttcaaggcctccaaatatgctcgcgaaaataagctcccccgtgtctacattgcgtgcaactctggtgctagaattggtttggtggatgatctcaagccaaagttccagatcaaattcattgatgaggcgagtccatctaagggttttgagtacctttatcttgatgatgcaacgtacaaatctcttccagaagggtcggtaaatgtaaggaaggtccctgaaggctgggctatcactgatatcattggaacgaacgaaggaattggggttgagaaccttcaaggaagtggcaaaattgctggcgagacatcaagggcatatgatgaaatcttcaccttgagttacgtcacaggtagaagtgttggtattggagcttaccttgtccgtctcggccagcgtattattcagatgaaacaaggacccatgattctcacaggctatggtgccctgaataagcttctcggccgtgaagtgtacaactcaaacgaccaacttggtggtcctcaagtcatgttcccaaacggctgctctcatgaaattgtagatgatgaccaacaaggcatccagtccattatccaatggctaagctttgttcccaagacaactgatgctgtgtcacccgtccgtgaatgtgccgaccctgtcaacagggatgttcaatggcgccctacccccactccttatgatccacgcctcatgctctcaggaactgacgaggaactcggtttttttgacacaggaagctggaaggaatatcttgctggctgggggaagagtgttgttattggccgcggtcgccttggtggcattcctatgggtgctattgccgtggagacccggcttgttgagaagattatccctgcagatccagcagaccccaactcccgcgaagctgtcatgccccaggctggacaagttcttttccctgactcatcctacaagacagcccaagctctccgcgactttaataacgagggcctccctgtgatgattttcggcaactggcgtggatttagtggtggaagtcgtgacatgtctggtgaaatcctcaaatttggatccatgattgtcgattcactccgagagtacaaacatcctatttacatatacttccctccatatggtgaacttcgaggaggatcgtgggttgtggtggaccccactatcaatgaggacaagatgaccatgttctcagatcctgatgctcgtggtggtattctcgaacctgctggtattgtagaaatcaagttccgcttggcagaccagctgaaagccatgcaccgcattgatccccagctgaagatgctagattcagagcttgagtcgacagacgacacagatgtcgctgctcaagaagcaatcaaagagcagattgctgcaagagaggagcttcttaaacccgtctatcttcaggctgctactgaatttgctgatctccacgacaagacgggacggatgaaggcgaagggtgttatcaaagaagcagttccatgggctcgctctcgtgaatacttcttttatcttgctaagcgccgcatttttcaagacaactatgtgttgcaaatcactgctgctgatccttcgttagactctaaggctgctcttgaggtgttgaagaacatgtgcactgcagactgggatgacaacaaagccgttcttgactattatctgtccagcgatggagacatcacagccaagattagcgagatgaagaaggcagctatcaaggcacagatcgagcagcttcagaaagctttggagggttga

SEQ ID NO: 4565 - protein, 2089 aa, Cyclotella cryptica
MALRRGLYAAAATAILVTASVTAFAPQHSTFTPQSLSAAPTRNVFGQIKSAFFNHDVATSRTILHAATLDETVLSASDSVAKSVEDYVKSRGGNRVIRKVLIANNGMAATKSILSMRQWAYMEFGDERAIQFVAMATPEDLKANAEFIRLADSFVEVPGGKNLNNYANVDVITRIAKEQGVDAVWPGWGHASENPKLPNALDKLGIKFIGPTGPVMSVLGDKIAANILAQTAKVPSIPWSGSFGGPDDGPLQADLTEEGTIPMEIFNKGLVTSADEAVIVANKIGWENGIMIKASEGGGGKGIRFVDNEADLRNAFVQVSNEVIGSPIFLMQLCKNARHIEVQIVGDQHGNAVALNGRDCSTQRRFQKIFEEGPPSIVPKETFHEMELAAQRLTQNIGYQGAGTVEYLYNAADNKFFFLELNPRLQVEHPVTEGITGANLPATQLQVAMGIPLFNIPDIRRLYGREDAYGTDPIDFLQERYRELDSHVIAARITAENPDEGFKPTSGSIERIKFQSTPNVWGYFSVGANGGIHEFADSQFGHLFAKGPNREQARKALVLALKEMEVRGDIRNSVEYLVKLLETEAFKKNTIDTSWLDGIIKEKSVKVEMPSHLVVVGAAVFKAFEHVKVATEEVKESFRKGQVSTAGIPGINSFNIEVAYLDTKYPFHVERISPDVYRFTLDGNTIDVEVTQTAEGALLATFGGETHRIFGMDEPLGLRLSLDGATVLMPTIFDPSELRTDVTGKVVRYLQDNGATVEAGQPYVEVEAMKMIMPIKATESGKITHNLSAGSVISAGDLLASLELKDPSRVKKIETFSGKLDIMESKVDLEPQKAVMNVLSGFNLDPEAVAQQAIDSATDSSAAADLLVQVLDEFYRVESQFDGVIADDVVRTLTKANTETLDVVISENLAHQQLKRRSQLLLAMIRQLDTFQDRFGREVPDAVIEALSRLSTLKDKSYGEIILAAEERVREAKVPSFEVRRADLRAKLADPETDLIDLSKSSTLSAGVDLLTNLFDDEDESVRAAAMEVYTRRVYRTYNIPELTVGVENGRLSCSFSFQFADVPAKDRVTRQGFFSVIDDASKFAQQLPEILNSFGSKIAGDASKEGPVNVLQVGALSGDISIEDLEKATSANKDKLNMLGVRTVTALIPRGKKDPSYYSFPQCSGFKEDPLRRGMRPTFHHLLELGRLEENFALERIPAVGRNVQIYVGSEKTARRNAAQVVFLRAISHTPGLTTFSGARRALLQGLDELERAQANSKVSVQSSSRIYLHSLPEQSDATPEEIAKEFEGVIDKLKSRLAQRLTKLRVDEIETKVRVTVQDEDGSPRVVPVRLVASSMQGEWLKTSAYIDRPDPVTGVTRERCVIGEGIDEVCELESYDSTSTIQTKRSIARRVGSTYAYDYLGLLEVSLLGEWDKYLSSLSGPDTPTIPSNVFEAQELLEGPDGELVTGKREIGTNKVGMVAWVVTMKTPEYPEGRQVVVIVNDVTVQSGSFGVEEDEVFFKASKYARENKLPRVYIACNSGARIGLVDDLKPKFQIKFIDEASPSKGFEYLYLDDATYKSLPEGSVNVRKVPEGWAITDIIGTNEGIGVENLQGSGKIAGETSRAYDEIFTLSYVTGRSVGIGAYLVRLGQRIIQMKQGPMILTGYGALNKLLGREVYNSNDQLGGPQVMFPNGCSHEIVDDDQQGIQSIIQWLSFVPKTTDAVSPVRECADPVNRDVQWRPTPTPYDPRLMLSGTDEELGFFDTGSWKEYLAGWGKSVVIGRGRLGGIPMGAIAVETRLVEKIIPADPADPNSREAVMPQAGQVLFPDSSYKTAQALRDFNNEGLPVMIFGNWRGFSGGSRDMSGEILKFGSMIVDSLREYKHPIYIYFPPYGELRGGSWVVVDPTINEDKMTMFSDPDARGGILEPAGIVEIKFRLADQLKAMHRIDPQLKMLDSELESTDDTDVAAQEAIKEQIAAREELLKPVYLQAATEFADLHDKTGRMKAKGVIKEAVPWARSREYFFYLAKRRIFQDNYVLQITAADPSLDSKAALEVLKNMCTADWDDNKAVLDYYLSSDGDITAKISEMKKAAIKAQIEQLQKALEG

SEQ ID NO: 4566 - DNA, 7360 bp, Triticum aestivum (common wheat)
  CDS (159)..(6932)
atctctttcaacttggataccaggccgttgcctccgccgccgccgcctgcctgcctctcctggatctccatctctccttcgcggcgcggcattccgtcgaacgcctccgcggcgcgcctccgggcggactcacgtgctgaaggttggagggggcaataatggtggaatctgaccagataaacgggaggatgtcctcggtcgacgagttctgtaaagcgctcgggggcgactcgccgatacacagcgtgctggttgccaacaatgggatggctgcggtcaagttcatgcgcagcatccgcacctgggccttggagacctttgggaacgagaaggccattctcttggtggctatggcaactccagaggacctcaggattaatgcggagcacataagaatcgccgaccagttcttagaagttcctggtgggacgaataacaacaactatgcaaatgtacagctcatagtggagatagcagagagaactcgggtttctgcagtttggcctggctggggtcatgcttctgagaacccagaacttccagacgcgctcatggaaaagggaatcatttttcttgggccaccatcagccgcgatgggggcactaggcgataagattggttcttctcttattgcacaagcagcaggagttccaactcttccatggagcgggtcacatgtgaaagttccgcaagaaacctgccactcaatacctgaggagatctataagaacgcttgtgtttcaactacagacgaagcagtcgctagttgtcaggtggtggggtatcctgcaatgatcaaggcatcatggggtgggggtggtaaaggaataaggaaggtacacaatgatgatgaggtcagagcattgtttaagcaagtgcaaggagaggtccccggatcgcctatatttattatgaaggtggcatctcagagccgacatctagaggttcagttgctctgtgacaagcatggcaacgtggcagcactgcacagtcgagactgtagtgttcaaagaaggcaccaaaagatcattgaggagggaccaattacagttgctcctccagaaacaattaaagagcttgagcaggcggcaaggcgactagctaaatgtgtgcaatatcagggtgctgctacagtggaatatctgtacagcatggaaacaggcgaatactatttcctggagcttaatccaaggttgcaggtagaacaccctgtgaccgaatggattgctgaaattaacttacctgcatctcaagttgtagtaggaatgggcataccactctacaatattccagagatcagacgcttttatggaatagaacatggaggtggctatcacgcttggaaggaaatatcagctgtagcaactaaatttgatttggacaaagcacagtctgtaaagccaaagggtcattgtgtagcagttagagttactagcgaggatccagatgatgggtttaagcctaccagtggaagagtggaagagctgaactttaaaagcaaacccaatgtttgggcctacttctccgttaagtccggaggtgcaattcatgagttctctgattcccagtttggtcatgtttttgcttttggggaatctaggtcattggcaatagccaatatggtacttgggttaaaagagatccaaattcgtggagagatacgcactaatgttgactacactgtggatctcttgaatgctgcagagtaccgagaaaataagattcacactggttggctagacagcagaatagctatgcgtgttagagcagagaggcccccatggtacctttcagttgttggtggagctctatatgaagcatcaagcaggagctcgagcgttgtaaccgattatgttggttatctcagtaaaggtcaaataccaccaaagcacatctctcttgtcaatttgactgtgacactgaatatagatgggggcaaatatacgattgagacagtacgaggtggaccccgtagctacaaattaagaattaatgaatcagaggttgaagcagagatacattctctgcgagatggcggactcttaatgcagttggatggaaacagtcatgtaatttacgccgagacagaagctgctggcacgcgccttctaatcaatgggagaacatgcttattacagaaagagcatgatccttccaggttgttggctgatacaccgtgcaaacttcttcggtttttggtcgcggatggttctcatgtggttgctgatacgccatatgctgaggtggaggttatgaaaatgtgcatgccactgttactaccggcctctggtgtcattcactttgtcatgcctgagggtcaggccatgcaggcaagtgatctgatagcaaggttggatcttgatgacccatcttctgtgagaagagctgaaccatttcatggcacctttccaaaacttggacctcctactgctatttctggcaaagttcaccaaaagtttgctgcaagtgtgaattctgcccacatgatccttgcaggatatgaacataacatcaatcatgttgtacaagatttgctaaactgcctagacagccctgagctccctttcctacagtggcaagaactcatgtccgttttggcaacccgactcccgaaagatcttaggaatgagttggatgctaagtacaaggagtatgagttgaatgctgacttccggaagagcaaggatttccctgccaagttgctaaggggagtcattgaggctaatcttgcatactgttccgagaaggatagggttactagtgagaggcttgtagagccacttatgagcctggtcaagtcatatgagggtggaagagaaagccatgctcgtgcggttgtcaagtctctgtttgaggagtatttatctgttgaagaactcttcagcgatgacattcagtctgatgtgatagaacgtctacgacttcaacatgcaaaagaccttgagaaggtcgtatatattgtgttctcccaccagggcgtgaaaagtaaaaataaattaatacttcggcttatggaagcattggtctatccaaatccatctgcgtacagggaccagttgattcgcttttctgcccttaaccatacagcatactctgggctggcgcttaaagcaagccaacttcttgagcacactaaattgagtgaactccgcacaagcatagcaagaagcctttcagagctggagatgtttactgaggaaggagagcggatttcaacacctaggaggaagatggctatcaatgaaaggatggaagatttagtatgtgccccggttgcagttgaagacgcccttgtggctttgtttgatcacagtgatcctactcttcagcggagagttgttgagacatacatacgcagattgtatcagcattatcttgtaaggggcagtgtccggatgcaatggcacaggtctggtctaattgctttatgggaattctctgaggaacatattgaacaaagaaatgggcaatctgcgtcacttctaaagccacaagtagaggatccaattggcaggcgatggggtgtaatggttgtaatcaagtctcttcagcttctgtcaactgcaattgaagctgcattaaaggagacttcacattacggagcaggtgttggaggtgtctcaaatggtaatcctataaattctaacagtagcaatatgctgcatattgctttggttggtatcaacaatcagatgagcactcttcaagacagtggtgatgaggatcaagcgcaagaaaggatcaacaaactctccaagattttgaaggataacactataacatcacatctcaatggtgctggtgttagggttgtcagctgcattatccaaagagatgaagggcgttcaccaatgcgccactccttcaaatggtcatctgacaagttatattatgaggaggacccgatgctccgccatgtggaacctcctttgtccaccttccttgaattggacaaagtgaatttagaaggttacaatgacgcgaaatacaccccatcacgtgatcgccagtggcacatgtacacactagtaaagaacaagaaagatccgagatcaaatgaccaaaggatgtttcttcgtaccatagtcagacagccaagtgtgaccaatgggtttttgtttggaagtattgataatgaagttcaagcctcatcatcattcacatctaacagcatactcagatcattgatggcagcgctagaagaaatagagttgcgcgctcacagtgagactgggatgtcaggccactcccacatgtatctgtgcataatgagagaacagcggttgtttgatctaattccatcttcaaggatgacgaatgaagttggtcaagatgagaagacagcatgcacattattgaagcatatgggtatgatatatatgagcatgtggtgtcaggatgcatcgctttctgtgtgccagtgggaagtgaagctatggttggattgtgatgggcaggctaatggtgcttggagagttgttgttaccagtgtaactgggcatacctgcactgttgatatttaccgagaagtggaggaccccaatacacatcagcttttctaccgctctgccacacccacagctggtcctttgcatggcattgcattgcatgagccatacaaacctttggatgctattgacctgaaacgtgccgctgctaggaaaaatgaaaccacatactgctatgatttcccattggcatttgaaacagcattgaagaagtcatgggaatctggtatttcacatgttgcagaatctaacgagcataaccagcggtatgctgaagtgacagagcttatatttgctgattcaactggatcatggggtactcctttggttccagttgagcgtcctccaggtagcaacaattttggtgttgttgcttggaacatgaagctctccacaccagaatttccaggcggccgggagattatagttgttgcaaatgatgtgacatttaaagctgggtcttttggtcctagagaagatgcattctttgatgctgtcaccaatcttgcttgtgagaggaaaattcctctaatttacttgtcagcaactgctggtgctaggctcggtgtagcagaggaaataaaggcgtgcttccatgttggatggtctgatgaccagagccctgaacgtggttttcactacatttacctcactgaacaagattattcacgtctaagctcttcagttatagcccatgagctaaaagtaccggaaagcggagaaaccagatgggttgttgataccattgttgggaaagaggacggacttggttgtgagaatctacatggaagtggtgccattgccagtgcctactctaaggcatacagagagacctttactctgacatttgtgactgggcgagctattggaattggggcttatcttgctcggttaggaatgcggtgtatacaacgtcttgatcaaccaattattttgactgggtattctgcactgaacaagctcctggggcgcgaggtgtatagctctcagatgcaactgggtggccccaaaatcatggctacaaatggagttgtccatctcactgtgtcagatgatcttgaaggtgtttctgctatcttgaaatggctcagctatgttcctccctatgttggcggtcctcttcctattgtgaaatctcttgatccaccagagagagctgtaacatatttcccagagaattcatgtgatgcccgtgccgccatctgtggcatccaggacactcaaggaggcaagtggttggatggtatgtttgacagagaaagctttgtggaaacattagaaggatgggccaaaactgttattactggaagggcaaagctaggtgggattccagttggtatcatagctgtggaaaccgagacagtgatgcaagtaatccctgctgaccctggtcagcttgattctgccgagcgtgtagtccctcaagctggacaggtgtggttcccagattcggccgcaaaaacgggccaggcactgctggatttcaaccgtgaagagctcccattgttcatacttgctaactggagaggcttttctggtgggcaaagggatctgtttgaaggaatccttcaggctggctctatgattgttgagaatctgaggacgtataagcagcctgcttttgtgtacataccaaaggctggagagctgcgtggaggtgcatgggttgtggtggacagcaagatcaatcctgagcacattgagatgtatgccgagaggactgcgagagggaatgtccttgaggcaccaggactcattgagatcaagttcaagccaaatgaactggaagagagtatgctaaggcttgaccctgagttgatcagcctcaatgccaaactcctcaaagaaactagtgctagccctagtccttgggaaacggcggcggcggcggagaccatcaggaggagcatggctgctcggaggaagcagctgatgcccatatatactcaggttgccacccggtttgctgagttgcacgacacctctgcgagaatggctgccaaaggcgtgatcagtaaggtggtggactgggaggagtcccgagccttcttctacaggagactgcgaaggaggcttgccgaggactcgctcgccaaacaagtcagagaagccgccggcgagcagcagatgcccactcacagatcggccttggaatgcatcaagaaatggtacctggcctctcagggaggagacggcgagaagtggggagacgatgaagccttcttcgcctggaaagatgatcctgacaagtatggcaagtatcttgaggagctgaaagccgagagagcgtctacactgctgtcgcatctcgctgaaacctctgatgccaaggccttgcccaacggtctatcgctcctcctcagcaaaatggatcctgcaaagagggagcaggttatggatggcctcaggcagcttcttggttgatgactggcccaccctttgataacgggagcatccattcagccagcataaaccggccttgcttgttgccaccaagcaagtcctgtctatggtggactgggtaccaacggaagcgcagacgacgacaagcaaattttacttgcgtggcgagctacaggagggggaggtttttcaactgaaacacattgtttgcacataggtaggaggcatctcatctcaggacaatttgtatgtttattgttattacagataggtacacacaaagcatatgtatgctggatagatattcggtgtgagttgttgcaatgcaagattcatcatcttaatttacgagatacgtgtgatggtcgatgtgatagtcctagtttcctcggtggcgaggaacgctgagtttccttttgctgcagttatgtgatgtataccctgagaac

SEQ ID NO: 4567 - protein, 2257 aa, Triticum aestivum (common wheat)
MVESDQINGRMSSVDEFCKALGGDSPIHSVLVANNGMAAVKFMRSIRTWALETFGNEKAILLVAMATPEDLRINAEHIRIADQFLEVPGGTNNNNYANVQLIVEIAERTRVSAVWPGWGHASENPELPDALMEKGIIFLGPPSAAMGALGDKIGSSLIAQAAGVPTLPWSGSHVKVPQETCHSIPEEIYKNACVSTTDEAVASCQVVGYPAMIKASWGGGGKGIRKVHNDDEVRALFKQVQGEVPGSPIFIMKVASQSRHLEVQLLCDKHGNVAALHSRDCSVQRRHQKIIEEGPITVAPPETIKELEQAARRLAKCVQYQGAATVEYLYSMETGEYYFLELNPRLQVEHPVTEWIAEINLPASQVVVGMGIPLYNIPEIRRFYGIEHGGGYHAWKEISAVATKFDLDKAQSVKPKGHCVAVRVTSEDPDDGFKPTSGRVEELNFKSKPNVWAYFSVKSGGAIHEFSDSQFGHVFAFGESRSLAIANMVLGLKEIQIRGEIRTNVDYTVDLLNAAEYRENKIHTGWLDSRIAMRVRAERPPWYLSVVGGALYEASSRSSSVVTDYVGYLSKGQIPPKHISLVNLTVTLNIDGGKYTIETVRGGPRSYKLRINESEVEAEIHSLRDGGLLMQLDGNSHVIYAETEAAGTRLLINGRTCLLQKEHDPSRLLADTPCKLLRFLVADGSHVVADTPYAEVEVMKMCMPLLLPASGVIHFVMPEGQAMQASDLIARLDLDDPSSVRRAEPFHGTFPKLGPPTAISGKVHQKFAASVNSAHMILAGYEHNINHVVQDLLNCLDSPELPFLQWQELMSVLATRLPKDLRNELDAKYKEYELNADFRKSKDFPAKLLRGVIEANLAYCSEKDRVTSERLVEPLMSLVKSYEGGRESHARAVVKSLFEEYLSVEELFSDDIQSDVIERLRLQHAKDLEKVVYIVFSHQGVKSKNKLILRLMEALVYPNPSAYRDQLIRFSALNHTAYSGLALKASQLLEHTKLSELRTSIARSLSELEMFTEEGERISTPRRKMAINERMEDLVCAPVAVEDALVALFDHSDPTLQRRVVETYIRRLYQHYLVRGSVRMQWHRSGLIALWEFSEEHIEQRNGQSASLLKPQVEDPIGRRWGVMVVIKSLQLLSTAIEAALKETSHYGAGVGGVSNGNPINSNSSNMLHIALVGINNQMSTLQDSGDEDQAQERINKLSKILKDNTITSHLNGAGVRVVSCIIQRDEGRSPMRHSFKWSSDKLYYEEDPMLRHVEPPLSTFLELDKVNLEGYNDAKYTPSRDRQWHMYTLVKNKKDPRSNDQRMFLRTIVRQPSVTNGFLFGSIDNEVQASSSFTSNSILRSLMAALEEIELRAHSETGMSGHSHMYLCIMREQRLFDLIPSSRMTNEVGQDEKTACTLLKHMGMIYMSMWCQDASLSVCQWEVKLWLDCDGQANGAWRVVVTSVTGHTCTVDIYREVEDPNTHQLFYRSATPTAGPLHGIALHEPYKPLDAIDLKRAAARKNETTYCYDFPLAFETALKKSWESGISHVAESNEHNQRYAEVTELIFADSTGSWGTPLVPVERPPGSNNFGVVAWNMKLSTPEFPGGREIIVVANDVTFKAGSFGPREDAFFDAVTNLACERKIPLIYLSATAGARLGVAEEIKACFHVGWSDDQSPERGFHYIYLTEQDYSRLSSSVIAHELKVPESGETRWVVDTIVGKEDGLGCENLHGSGAIASAYSKAYRETFTLTFVTGRAIGIGAYLARLGMRCIQRLDQPIILTGYSALNKLLGREVYSSQMQLGGPKIMATNGVVHLTVSDDLEGVSAILKWLSYVPPYVGGPLPIVKSLDPPERAVTYFPENSCDARAAICGIQDTQGGKWLDGMFDRESFVETLEGWAKTVITGRAKLGGIPVGIIAVETETVMQVIPADPGQLDSAERVVPQAGQVWFPDSAAKTGQALLDFNREELPLFILANWRGFSGGQRDLFEGILQAGSMIVENLRTYKQPAFVYIPKAGELRGGAWVVVDSKINPEHIEMYAERTARGNVLEAPGLIEIKFKPNELEESMLRLDPELISLNAKLLKETSASPSPWETAAAAETIRRSMAARRKQLMPIYTQVATRFAELHDTSARMAAKGVISKVVDWEESRAFFYRRLRRRLAEDSLAKQVREAAGEQQMPTHRSALECIKKWYLASQGGDGEKWGDDEAFFAWKDDPDKYGKYLEELKAERASTLLSHLAETSDAKALPNGLSLLLSKMDPAKREQVMDGLRQLLG

SEQ ID NO: 4568 - DNA, 1476 bp, Methanobacterium thermoautotrophicum
  CDS (1)..(1476)
atgttcagtaaaatccttgttgcaaaccgtggtgaaatagcaataagagttatgcgtgcctgcagggaacttggaataaagagcgtggctgtttactctgaagcagacaaaaacgcccttttcacaagatacgccgatgaggcatatgagataggaaaaccagccccatcacagagctacctcaggatcgacaggatactggaggtggccgagaaggcaggcgccgaagccatccacccgggctacggtttcctcgcagagaacccccgcctcggagaggaatgtgaaaaacagggaatcaaactcataggtcccaagggctcagttatagaggccatgggggataaaataacctcaaagaagctcatgaagaaggccggtgtacccgtgatccccggtaccgatcagggcgtcagtgaccctgatgaagccgccaggatagctgattccataggttaccccgtcattataaaggcatctgcaggcgggggcgggatcggtatgcgggctgtctacgaggaggatgaactcataagggccatggagtccacccagtcggtggctgcatcagccttcggggaccccaccgtgtacatcgagaagtaccttgaaaggccacggcacatcgaattccaggtcatggcagatgaatcaggcaacgtgatacaccttgcagacagggagtgctcgatacagaggaggcaccagaaactgatagaggaggcaccgtcccccataatgacaccggaactcagggagaggatgggatccgctgcagttaaggccgctgaatatataggctatgaaaacgcaggtacagttgagttcctttactccaacggggacttctacttccttgagatgaacaccaggatacaggtggaacatcccataacagaggttatcacaggagtcgaccttgtcaaggaacagataagggtcgcctccggagaggaacttcgcttcacccagaaggatataaacatcagggggcatgccatcgagtgccgtataaacgcagagaacccccttgcagatttcgcgccaaaccccggtaagatcacaggttacagatccccagggggtataggtgtgagggttgacagcggcgtttacatgaactatgagataccccccttctatgattccatgatatcaaaactcatagtgtggggtatggaccgccaggaggccataaaccggatgaagagggccctcagtgagtacataatactgggggttaaaaccaccatacccttccacaaggccataatgaggaacgaggcattcaggcgaggcgaactccatacacacttcgttgacgaatacagaaggggtatagacgccgagatgcgaaaaatcgttaaggaggaccaggagatggttgaacgtctccagtcaacatttctcccatcaaagaaggttgccgccatatcagcggcgataggaacctacatgcattcaaggagggggtga

SEQ ID NO: 4569 - protein, 491 aa, Methanobacterium thermoautotrophicum
MFSKILVANRGEIAIRVMRACRELGIKSVAVYSEADKNALFTRYADEAYEIGKPAPSQSYLRIDRILEVAEKAGAEAIHPGYGFLAENPRLGEECEKQGIKLIGPKGSVIEAMGDKITSKKLMKKAGVPVIPGTDQGVSDPDEAARIADSIGYPVIIKASAGGGGIGMRAVYEEDELIRAMESTQSVAASAFGDPTVYIEKYLERPRHIEFQVMADESGNVIHLADRECSIQRRHQKLIEEAPSPIMTPELRERMGSAAVKAAEYIGYENAGTVEFLYSNGDFYFLEMNTRIQVEHPITEVITGVDLVKEQIRVASGEELRFTQKDINIRGHAIECRINAENPLADFAPNPGKITGYRSPGGIGVRVDSGVYMNYEIPPFYDSMISKLIVWGMDRQEAINRMKRALSEYIILGVKTTIPFHKAIMRNEAFRRGELHTHFVDEYRRGIDAEMRKIVKEDQEMVERLQSTFLPSKKVAAISAAIGTYMHSRRG

SEQ ID NO: 4570 - DNA, 1353 bp, Bacillus subtilis
  CDS (1)..(1353)
atgattaaaaagctattgatcgccaacagaggagaaattgctgtcagaatcatcagagcctgcagagagctcggaattgagactgtcgctgtttattcagaagctgataaagatgcccttcatgttcaaatggccgatgaagctttttgtatcggaccgaaagcatcaaaagacagctatttaaacgttacaaatattgtgagtgttgcaaagctgactggcacggacgccattcatccgggatacggatttttagctgaaaatgctgatttcgctgaattatgtgaagaagtgaatgtcacgtttgtcggcccgagccctgacgccatttcaaaaatgggaacaaaagacgttgcgcgggaaacgatgaaacaggccggcgtgccaatcgtaccgggttcacagggaattatagaaaatgtggaagaagcggtttcgcttgctaatgaaattgggtatcctgtaattataaaagccaccgcaggcggaggcggaaaaggaattagggttgcccgcactgaagaggaactgattaatggcattaagattacacagcaggaagcggcaactgcatttcggaatccaggtgtatacatcgaaaaatacatagaagattttcgccacgttgagatccaagtgcttgctgataactacggaaatacgatccatttgggcgaacgcgactgctcgatccaaagacgcctgcaaaagcttttggaagaatcaccatctcctgcccttgattcagaaatcagggagcaaatgggagatgcagcggtaaaggctgccaaagcggttggctatacaggtgctggaacagttgaatttatctatgactacaatgaacagcgctattacttcatggaaatgaacacgagaatccaggtggagcacccagtcacagaaatggtgacgggaactgacctgatcaaggaacaaatcaaagtggcttcaggaatggaactgagcctcaagcaagaagatgttgaatttgaaggctgggccatcgaatgccgaatcaacgcagaaaacccaagcaaaaatttcatgccgtcacctggtgaaattaaaatgtacctgcctcctggcggtcttggtgtccgtgtcgattcagctgcgtaccctggctattccatcccaccgtactatgacagcatgattgcaaaggtaatcacatacggaaaaacgagagatgaagcgattgcccgcatgaagcgcgcattgagcgaattcgtcatcgaaggcattgagacaacaatccctttccatttaaaactgcttgaacacgaaacatttgtgagcggagagtttaataccaaatttttagaaacatatgatgtaatgggctcataa

SEQ ID NO: 4571 - protein, 450 aa, Bacillus subtilis
MIKKLLIANRGEIAVRIIRACRELGIETVAVYSEADKDALHVQMADEAFCIGPKASKDSYLNVTNIVSVAKLTGTDAIHPGYGFLAENADFAELCEEVNVTFVGPSPDAISKMGTKDVARETMKQAGVPIVPGSQGIIENVEEAVSLANEIGYPVIIKATAGGGGKGIRVARTEEELINGIKITQQEAATAFRNPGVYIEKYIEDFRHVEIQVLADNYGNTIHLGERDCSIQRRLQKLLEESPSPALDSEIREQMGDAAVKAAKAVGYTGAGTVEFIYDYNEQRYYFMEMNTRIQVEHPVTEMVTGTDLIKEQIKVASGMELSLKQEDVEFEGWAIECRINAENPSKNFMPSPGEIKMYLPPGGLGVRVDSAAYPGYSIPPYYDSMIAKVITYGKTRDEAIARMKRALSEFVIEGIETTIPFHLKLLEHETFVSGEFNTKFLETYDVMGS

SEQ ID NO: 4572 - DNA, 1419 bp, Aquifex aeolicus
  CDS (1)..(1419)
atgttcaataaagttctcgtggcaaacagaggagaaatagcggtaaggataataagggcttgtaaggaactcggtattccgacggtggcaatatacaacgaggttgaatccaccgcaaggcacgtaaagctcgcggatgaagcctacatgatagggacggacccgttagacacttacctcaacaaacagaggattataaaccttgcccttgaagttggagcggacgcaattcacccgggatacggatttttggcagaaaatgcagaattcgccaaaatgtgcgaggaagccgggataaccttcataggtccccactggaaagtaatagaacttatgggagacaaagcccgctcaaaggaagttatgaaaaaagcgggtgtcccggtagtccccggctcagacggagttttaaagagcctagaagaggcaaaagctttagcgagggaaatcggatatcccgttctcctcaaggcaaccgcgggcggtggtggtagaggaataaggatatgtagaaacgaggaagaactcgtcaaaaactacgagcaggcgtcaagggaggcggaaaaagccttcggaaggggagaccttttactcgaaaagttcatagaaaacccaaagcacatagagtatcaggttcttggagacaagcacgggaacgtaatacacctcggtgaaagagattgttcaatacagaggagaaatcaaaagctcgtagaaatagcaccctctcttatccttactccagaaaagagggagtactacggaaacatagtcacgaaagccgcaaaggaaataggctactacaacgcaggaactatggagttcatagcggatcaggaaggaaacctttacttcatagagatgaacacgagaatacaggttgagcaccccgtaagcgaaatggttacgggcatagacatagtaaagtggcagataaagatagcagccggagaacctcttaccattaaacaagaagacgttaagttcaacggatacgccatagagtgcagaataaacgccgaggaccccaaaaagaactttgccccctccacgggagtaattgaaaggtactacgttcccggaggtttcggaataagagttgaacatgctgctgcaagaggttttgaagttaccccctactacgactccatgattgcaaaacttataacctgggcacccacttgggatgaagcggtagagagaatgagagcagttcttgagacttatgaaataaccggcgtaaaaacgactatacctctactcataaacataatgaaagaaaaggacttcaaagccggaaagtttacgacaaagtatttagaagaacaccctgaagtatttgagtacgaagaacacaaggacaaggaggattttgcggcactaatttctgcggctatagccgcttaccacggtttataa

SEQ ID NO: 4573 - protein, 472 aa, Aquifex aeolicus
MFNKVLVANRGEIAVRIIRACKELGIPTVAIYNEVESTARHVKLADEAYMIGTDPLDTYLNKQRIINLALEVGADAIHPGYGFLAENAEFAKMCEEAGITFIGPHWKVIELMGDKARSKEVMKKAGVPVVPGSDGVLKSLEEAKALAREIGYPVLLKATAGGGGRGIRICRNEEELVKNYEQASREAEKAFGRGDLLLEKFIENPKHIEYQVLGDKHGNVIHLGERDCSIQRRNQKLVEIAPSLILTPEKREYYGNIVTKAAKEIGYYNAGTMEFIADQEGNLYFIEMNTRIQVEHPVSEMVTGIDIVKWQIKIAAGEPLTIKQEDVKFNGYAIECRINAEDPKKNFAPSTGVIERYYVPGGFGIRVEHAAARGFEVTPYYDSMIAKLITWAPTWDEAVERMRAVLETYEITGVKTTIPLLINIMKEKDFKAGKFTTKYLEEHPEVFEYEEHKDKEDFAALISAAIAAYHGL

SEQ ID NO: 4574 - DNA, 1377 bp, Pseudomonas aeruginosa
  CDS (1)..(1377)
atgcacaagcgactgaacaagctgctggtggccaatcgcggcgagatcgccgtgcgcatcatccgcgccgcgcaggcactgggcattcccacggtagcggtgtgcagcgaggcggatcgcgattcgctggccgcgcggctggccgatgaggtacgcctgatcggccctgcgcgggccgaccggagctacctggatatcgaggcgattctcatggcggcgcgggaaaccggtgccgactcgatccatcccggctacggtttcctctccgagaaccccgccttcgccgaagcggtgcaggcggccggcctggtcttcgtcggtccggaggcgcagaccatccgccgcatgggcgacaaggccgaggcgcggcgtaccgcgatggccgccggggtgccggtggtgccgggctcgcccggcgagctgggcgacctcgacgcggcgctggcttgcgccgaagaggtcggctatccgctgctggtcaaggcctccgccggcggcggcgggcgtggcatccgtatcgcccacgacgccgacgaactgcgtcgggaattccccatcgcccagcgcgaggcgcaggccgccttcggttcgccggcggtgtacctggagcgcttcatccgccaggcacggcacatcgaagtgcagatcctcggcgatggcgagcgcgcggtgcatctgttcgaacgcgaatgctcgctgcagcggcggcgccagaaggtcttcgaggaggcaccttcggcggcgctggacggcgcgcagcgccaggccctctgcgagagcgcggtgcgcctggcgcagagtctcggctatcgtggcgcgggcaccctggaatacctgttcgacgcgcacagcggcgagttcttcttcatcgagatgaacacccgtatccaggtcgagcatccggtcagcgagatggtcaccggcatcgacctggtccaggccatgctgcgcatcgccgccggcgaggcgctgccctggcgccaggaggacattcgcctgaacggcgcggcgctggagatgcggatcaacgccgaagatccggcgcgcaatttcttccccagccccggcaccgtggagcgcctggaatggccgcagggcgagggcgtgcgagtggacagccacctgtatcccggctaccgggtgccgccgtactacgattcgttgctggccaagctgatcgtccatggtcgcgaccgcgacgaagcgttcgcccgcgcgcgccaggcgctggagcgcaccgtgctggccggcatggccactaccctgccgctgcaccgctggctgctcgccgatgcgcgggtacaggccgcgcagttcgataccgctaccctggaaacctggctcgccgagcggaccgccgccgcgcaggaggtttga

SEQ ID NO: 4575 - protein, 458 aa, Pseudomonas aeruginosa
MHKRLNKLLVANRGEIAVRIIRAAQALGIPTVAVCSEADRDSLAARLADEVRLIGPARADRSYLDIEAILMAARETGADSIHPGYGFLSENPAFAEAVQAAGLVFVGPEAQTIRRMGDKAEARRTAMAAGVPVVPGSPGELGDLDAALACAEEVGYPLLVKASAGGGGRGIRIAHDADELRREFPIAQREAQAAFGSPAVYLERFIRQARHIEVQILGDGERAVHLFERECSLQRRRQKVFEEAPSAALDGAQRQALCESAVRLAQSLGYRGAGTLEYLFDAHSGEFFFIEMNTRIQVEHPVSEMVTGIDLVQAMLRIAAGEALPWRQEDIRLNGAALEMRINAEDPARNFFPSPGTVERLEWPQGEGVRVDSHLYPGYRVPPYYDSLLAKLIVHGRDRDEAFARARQALERTVLAGMATTLPLHRWLLADARVQAAQFDTATLETWLAERTAAAQEV

SEQ ID NO: 4576 - DNA, 3453 bp, Bacillus halodurans
  CDS (1)..(3453)
atggacggattaaagaacataaagaaagtgttagttgcaaaccgaggcgaaattgccatccgtatttttcgcgcgtgtacggaattacatattcgtacagtagctatttactcaaaagaggacacaggcgcttaccatcgctataaggcagatgaagcttacttagtaggggaagggaaaaaaccaatcgaggcttatctcgatattgaaggcattatcgaaattgccaaacgtcatggtgtggatgccattcaccctggttatggatttttatctgaaaatatcgaattcgcgaaacgctgccatgaggaaggcattatcttcatcggacctgagcttgaacacttggtcatgtttggggataaagttcaagcccgtgagcaagcgattaaggccaatttaccagtcattcctggaagtgatggtcccgtttctagcctagaggatgtgaaagcttttgcggacaagcatggctatccgttcatcattaaagctgctcttggtggtgggggacgcggcatgcgaatcgttcgttctgaaaatgatgttcaggaatcatatgagcgggcaaagtcagaagcgaaagctgcttttgggaacgacgaagtatatgtggagaaatttatcgaaaacccgaaacatattgaagtacaaattcttgccgataaacacggcaacaccttgcacttgtatgagcgcgattgctctgtccaacggcgccatcaaaaagttgtggaagttgccccaagtgtatcattatctgaagatgtccgtgagcgcatctgtcaagcggccgttcagctagcggaaaacgttaattatgtaaatgctggtacggttgagtttcttgttgaccgagaaggaaatttttacttcatcgaagtgaacccacggattcaggtagagcatacgattacggaaatggttacaggaatcgatatcgtgcaatcccagctctttattgctgacggagagcatttgcatggggacaggcttgggattccgaagcaggaagagatcgtttgccatggatacgcgattcaatctcgcgtgacgacagaagatccaagcaacgggtttttgcctgacactggccgtattaacgcctatcgttccggtggtggattcggtgtacgtcttgacgcagggaacggattccaaggagctgttattacaccgtactatgattcgttgctcgtaaaagtgtcaacatgggcgctgacgtttgaaggggctgctgcaaaaatgctgcgaaaccttcgcgagttccgaattcgtggaattaaaacaaacattgcgtttcttgaaaatgtcgttcagcatcgccagtttttatccggtgaatacaatacgtcctttattgaccaaacacctgaactgtttgtgttccctaaacggaaagaccgggggacgaagatgctttcatttattggtgagacgattgtcaacgggtatcctgggcttgaaaaaacgaaaaaaccggtgtttgacaagcctccggttccaaagttaaagctatccgaaccgataccagacggaacgaagcaaatacttgatcagcacgggccagaaggattggcgaagtgggtcaaggaacaaaagcatgttctgttgacggatacgacgttccgcgacgcccatcagtcgctcttagcaacgcgcgttcggacacatgatttaaaacaaattgcagaaccgacagcaaggctactgccaaacttgttttccatggaaatgtggggaggcgcgacgtttgatgtggccatgcgtttccttcatgaagatccgtgggagcgtctgttaatcttgaggaaaaaagcacctaatgttttgtttcaaatgttgcttcgcgcctccaacgcagtcggatacaaaaattatccagacaatttgatccgtgaatttgtcgataagtcagcgaatgctgggattgatgtgttccgcatcttcgatagcttaaactgggttgaaggtatgaagttagccattgaagcggttggggaagcaaataaaattgctgaagctacgatttgttatacgggtgacattttagattcgagcagaccgaagtacgatttggcgtactataaaaaattagcgaaagaactagaagcagcaggtgcacacattcttggaattaaagatatggcaggactcttaaagccagaagctgcttaccaactagtggcagaattaaaggatacggtgacgatccccgttcaccttcatacacatgatacgagcggtaatggtatctttacgtatgctcgggccattgaagcgggcgtcgatatcgttgacgtggctgtaagttcaatggcaggtctcacatcacagccgagcgcgaatagcttatactatgcactagcggactctgaacgtcaaccgaatgtgaacattaccgcactagagcaattagctgaattctgggaagagacgcggaagttttatgctggattcgaaagtggtatgaacgcaccacacactgaggtatacgagcatgaaatgccaggtggacagtatagtaacctacagcagcaagcgaaagcagtaggtctcggtcatcgttggaacgaagtgaagaaaatgtaccggacggtgaacgacatgtttggagatgtcgtcaaagtaacgccatcatctaaagtagtcggtgatatggccttgtacatggtgcaaaacgacctgaccgaggaagaggtttatgagaatggtcataagcttgacttccctgattcagttgttgagttttttgaaggacagctaggtcaaccgtaccaagggtttccaaagaaattgcaggaaatcatcctgaaaggacggaaaccaattacgaatcgccctggtgaaaatatggagccaatccaatttgaggcgattaaagaagagctatataacaagttggatcgtcaagtgacgagccatgacattctatcatatgctctttatccaaaagtctttatggaatttgaacggttccgtcaaacattcggagatgtctcggttcttgatacacctaccttcttctatggtttacgtccaggtgaggaaattgaagtggaaatcgaacaagggaaaacattaattgtaaaatttatttccctttccaagccacaggatgatggaaaccggatcgtttactttgaattgaacggtcaaccacgggaagtgttgattaaagaccaaagcgtgaagacgagcattatttctcgtccaaaggccgataaatcaaatcctaatcatatcggagcgtccatgccaggaacggttgtgaaggctcttgttgaaaagggtgacaaagtgaagcaaggagatcatctcatgatcacggaagctatgaagatggaaacgactgtacaagccccatttgatggagaagttgttgccttgcatgtgaaagacggagatgcgattcaaacaggtgatttactaatcgaagtgaaagagctataa

SEQ ID NO: 4577 - protein, 1150 aa, Bacillus halodurans
MDGLKNIKKVLVANRGEIAIRIFRACTELHIRTVAIYSKEDTGAYHRYKADEAYLVGEGKKPIEAYLDIEGIIEIAKRHGVDAIHPGYGFLSENIEFAKRCHEEGIIFIGPELEHLVMFGDKVQAREQAIKANLPVIPGSDGPVSSLEDVKAFADKHGYPFIIKAALGGGGRGMRIVRSENDVQESYERAKSEAKAAFGNDEVYVEKFIENPKHIEVQILADKHGNTLHLYERDCSVQRRHQKVVEVAPSVSLSEDVRERICQAAVQLAENVNYVNAGTVEFLVDREGNFYFIEVNPRIQVEHTITEMVTGIDIVQSQLFIADGEHLHGDRLGIPKQEEIVCHGYAIQSRVTTEDPSNGFLPDTGRINAYRSGGGFGVRLDAGNGFQGAVITPYYDSLLVKVSTWALTFEGAAAKMLRNLREFRIRGIKTNIAFLENVVQHRQFLSGEYNTSFIDQTPELFVFPKRKDRGTKMLSFIGETIVNGYPGLEKTKKPVFDKPPVPKLKLSEPIPDGTKQILDQHGPEGLAKWVKEQKHVLLTDTTFRDAHQSLLATRVRTHDLKQIAEPTARLLPNLFSMEMWGGATFDVAMRFLHEDPWERLLILRKKAPNVLFQMLLRASNAVGYKNYPDNLIREFVDKSANAGIDVFRIFDSLNWVEGMKLAIEAVGEANKIAEATICYTGDILDSSRPKYDLAYYKKLAKELEAAGAHILGIKDMAGLLKPEAAYQLVAELKDTVTIPVHLHTHDTSGNGIFTYARAIEAGVDIVDVAVSSMAGLTSQPSANSLYYALADSERQPNVNITALEQLAEFWEETRKFYAGFESGMNAPHTEVYEHEMPGGQYSNLQQQAKAVGLGHRWNEVKKMYRTVNDMFGDVVKVTPSSKVVGDMALYMVQNDLTEEEVYENGHKLDFPDSVVEFFEGQLGQPYQGFPKKLQEIILKGRKPITNRPGENMEPIQFEAIKEELYNKLDRQVTSHDILSYALYPKVFMEFERFRQTFGDVSVLDTPTFFYGLRPGEEIEVEIEQGKTLIVKFISLSKPQDDGNRIVYFELNGQPREVLIKDQSVKTSIISRPKADKSNPNHIGASMPGTVVKALVEKGDKVKQGDHLMITEAMKMETTVQAPFDGEVVALHVKDGDAIQTGDLLIEVKEL

SEQ ID NO: 4578 - DNA, 1347 bp, Agrobacterium tumefaciens
  CDS (1)..(1347)
atggtttcgaagatccttatagccaaccgcggcgaaatcgcgctgcgcgtcctgcgcgccgcgaaagagcttggcattccgaccgtcgccgtgcattccacggcagatgcggatgcgatgcatgtgcgccttgccgacgaaagtgtgtgcatcggcccgccgccctcgcgtgacagctacctcaacatccaccagatcgttgcggcctgcgaaatcacaggtgcggatgccgttcaccccggttacggcttcctgtcggaaaacgccaagttcgccgatattctcgacgcccacggcatcaccttcatcgggccgaccgccgaacatatccgcatcatgggcgacaagatcaccgccaagcagacggcacaggaactcggcattcccgtggttccgggttcggatggcgaagtgaagcctgaaaatgcgctggaaatcgcccggacgatcggcttcccggtcctcatcaaggcgacggcaggcggtggcggccgcggcatgaaggtggcgaagaccgaagccgatctggaagatgcagttgcgactgcccgttccgaagcggcagcagccttcggcaacgatgccgtctatatggaaaaatacctcggcaagccgcgccatatcgaagtgcaggttttcggcgatggcgaaggcaatgccgttcaccttggcgagcgcgattgctcgcttcagcgccgccaccagaaggtgctggaagaagccaattcaccggctctcacagtcgaacagcgcatgaaaatcggcgaaatttgcgccgacgcgatgcgcaagctgaaatatcgcggcgccggcaccatcgagttcctgtatgaaaacggcgagttctatttcatcgaaatgaacacccgtctgcaggtggagcatccagtgacggaagcgatcactggcatggacctcgtgcaggaacagatcagggtcgcttctggtcagggcctgtcggtcacacaggctgatatcgaatttcatggccatgccatcgaatgccgtatcaatgccgaagacccgcgcaccttcgttccgtcgccgggcacactgacctatttccacacgccgggcggccttggcgttcgcgtcgattcgggtgcctatcagggctacaagatcccgccctattacgacagcatgatcggcaagctgatcgttcacggtcgcgaccgtgacgagtgcatccgtcgcctgcgtcgggcgctggacgaattcgtcgtcgatggcatcaagaccacgctgccgcttttccaggatctccttcagaacgaggatattctgaacggcgattacgacattcactggctggagaagtatctggccggtgacgcgtctcactaa

SEQ ID NO: 4579 - protein, 448 aa, Agrobacterium tumefaciens
MVSKILIANRGEIALRVLRAAKELGIPTVAVHSTADADAMHVRLADESVCIGPPPSRDSYLNIHQIVAACEITGADAVHPGYGFLSENAKFADILDAHGITFIGPTAEHIRIMGDKITAKQTAQELGIPVVPGSDGEVKPENALEIARTIGFPVLIKATAGGGGRGMKVAKTEADLEDAVATARSEAAAAFGNDAVYMEKYLGKPRHIEVQVFGDGEGNAVHLGERDCSLQRRHQKVLEEANSPALTVEQRMKIGEICADAMRKLKYRGAGTIEFLYENGEFYFIEMNTRLQVEHPVTEAITGMDLVQEQIRVASGQGLSVTQADIEFHGHAIECRINAEDPRTFVPSPGTLTYFHTPGGLGVRVDSGAYQGYKIPPYYDSMIGKLIVHGRDRDECIRRLRRALDEFVVDGIKTTLPLFQDLLQNEDILNGDYDIHWLEKYLAGDASH

SEQ ID NO: 4580 - DNA, 1731 bp, Agrobacterium tumefaciens
  CDS (1)..(1731)
atgaaaaaagtgctgattgccaatcgcggcgagatcgcggtgcgcatcatccgggcctgtcgcgattacggcctgcaatcggtcgccgtttatgccgaccccgatcaggacgcgcttttcgtccggctggcggatgaagcctatgcgctggagggcgtgcgtcccgccgagacctatctcgatatcagcaagctgatcgcgattgccaaacgcgccggtgctgatgccgtgcatcccggttatggtttcctgtccgaacgcgccgaatttgcccaggctgtcatcgatgccggactgatctggatcggtcccgaccctgatgtcatcgaggcattgggcgacaaggtcatggcgcggcgcatcgccaccggtgttggcgcaccgctggttgccggcagcgatggccccgtttcttccgccgccgaagtcaccgcctttgccgaacagcacggcctgcccgtcgccatcaaggcggcccatggcggcggtggacgcggcctgaaagtcgcgtggaagatggaagagatcgcagagctctatgaatccgccgtgcgcgaggcgaccgtcgccttcggccgcggcgagtgttttctggaacgtttcctcgatcggccgcgtcatatcgaggcgcaggttattgctgacaagcacggcaatgtgctggtgctcggcacccgcgattgctcgctgcaacgccggaaccagaagctgatcgaagaagcacccgcccccttcctgtcggatgaacaacggcagaagatccatgatgccgccaaggcgatctgcgctgcagccggttattccggcgccggcaccgtcgaattcctgctcggtgtcgatggcacgatttccttccttgaggtcaatacccgcctgcaggtggaacatcccgttaccgaggaaaccaccggcattgatctcgtcatcgagcagtttcgtattgccgaaggccataagcttcgtgtgcttgaaacgccggaaccgcgtggccattcgatggagttccgtatcaatgccgaagatccgggccgcggctttctgccgacaccaggcttgatctcggttttcgatgcgccttccggtccgggcattcgcatggatagcggcgtcatcagcggctcaagcattcccggcgtgttcgattcgctgatggcaaagctcatcgtcaccggggttgaccgcgatcaggttctgcgccgtgcccgccgtgcgctgagggaattccgcatcgagggcatcgctaccgttctgccgttccaccgcgccgcgatcgagacggaggatttcatcggtactgacgggttcaaggttcacacccgctggatcgaaaccgatttcgccgccatgcccgatgcgatggagcgaccggcaccggccgacgacccttctatcacccgcacctatctcgagatagacggcaagcgtgtttcggttggcctgcccagcattctgctctccagcctcggcactgtcagcggtggcaatgcatccgctcccagtgctgcggtcgagaaaaaggaaggcgaaatgaccgcccccgtttccggcaccctgcaatctttcaaggtgaaggacggtgaaacggtttccgaaggtgatcttctggccgtcatggaagccatgaagatggagacgcagattgtcgccaccagggccggaaaggtccgcttgatcgtcaaggaaggcgattatctgcaggcgggagcaacccttatcgatatagccggctaa

SEQ ID NO: 4581 - protein, 576 aa, Agrobacterium tumefaciens
MKKVLIANRGEIAVRIIRACRDYGLQSVAVYADPDQDALFVRLADEAYALEGVRPAETYLDISKLIAIAKRAGADAVHPGYGFLSERAEFAQAVIDAGLIWIGPDPDVIEALGDKVMARRIATGVGAPLVAGSDGPVSSAAEVTAFAEQHGLPVAIKAAHGGGGRGLKVAWKMEEIAELYESAVREATVAFGRGECFLERFLDRPRHIEAQVIADKHGNVLVLGTRDCSLQRRNQKLIEEAPAPFLSDEQRQKIHDAAKAICAAAGYSGAGTVEFLLGVDGTISFLEVNTRLQVEHPVTEETTGIDLVIEQFRIAEGHKLRVLETPEPRGHSMEFRINAEDPGRGFLPTPGLISVFDAPSGPGIRMDSGVISGSSIPGVFDSLMAKLIVTGVDRDQVLRRARRALREFRIEGIATVLPFHRAAIETEDFIGTDGFKVHTRWIETDFAAMPDAMERPAPADDPSITRTYLEIDGKRVSVGLPSILLSSLGTVSGGNASAPSAAVEKKEGEMTAPVSGTLQSFKVKDGETVSEGDLLAVMEAMKMETQIVATRAGKVRLIVKEGDYLQAGATLIDIAG

SEQ ID NO: 4582 - DNA, 1350 bp, Yersinia pestis
  CDS (1)..(1350)
atgcttgataaaatcgtaatcgctaaccgcggtgagattgcgctgcggatcctacgggcttgtaaggagctggggatcaagactgtcgccgttcactctgttgcggatcgtgacctgaaacacgtattactggctgacgagactgtttgtatcggtcctgcgccttcagttaaaagctatctgaacatcccggcaatcatttcggctgctgagatcaccggcgcagtggctgttcaccccggctatggtttcctgtctgaaaatgctgattttgccgaacaggtagagcgttccggtttcattttcattggcccacgagccgaaaccattcgcctgatgggcgataaagtttccgctattagcgcaatgaaaaaagccggtgtgccatgcgtacccggttctgatggcccattaagcgacgataccaccaagaacaaagcctttgccaaacgtatcggttatccggtcattatcaaggcatctggcggcggcggtggccgtggtatgcgtgtggttcgtcacgacaaagatctggaagaatccattaacatgacccgtgcggaagcgaaagctgctttcaataacgacatggtttatatggagaaataccttgagaacccgcgccatatcgaggttcagattttggctgatggtcagggtaatgctatctatctggccgaacgcgattgctctatgcagcgccgccaccagaaagtggttgaagaagcacctgcaccaggtatcaccagcgaaatgcgccgttatatcggtgagcgctgcgcgaaagcctgtatggaaatcggttatcgcggtgcaggtacctttgagttcttgtatgaaaacggtgagttctatttcattgaaatgaacacccgtattcaagttgaacacacggttaccgaaatgatcaccggtattgatttgatcaaagagcagctccgtatcgcggctggccaacctctctccatcaaacaagatgaagtgaaagtgcatggccacgctgttgaatgccgtattaacgccgaagatccaaataccttcctgccaagtccgggtaaaattacccgcttccatgcaccgggcggtttcggtgttcgttgggaatctcatatttacgcaggctatactgtgcctccgtattatgattccatgattggtaagctgatcacttacggtgaaaaccgtgacgtggcgattgctcgtatgaaaaatgccttggcagagctcattatcgatggcatcaaaaccaacgttgagttacagcaacgcattatgaatgacgaaaacttccagcacggtgggactaatatccactatctggagaaaaaactcgggttgcaagaaacctga

SEQ ID NO: 4583 - protein, 449 aa, Yersinia pestis
MLDKIVIANRGEIALRILRACKELGIKTVAVHSVADRDLKHVLLADETVCIGPAPSVKSYLNIPAIISAAEITGAVAVHPGYGFLSENADFAEQVERSGFIFIGPRAETIRLMGDKVSAISAMKKAGVPCVPGSDGPLSDDTTKNKAFAKRIGYPVIIKASGGGGGRGMRVVRHDKDLEESINMTRAEAKAAFNNDMVYMEKYLENPRHIEVQILADGQGNAIYLAERDCSMQRRHQKVVEEAPAPGITSEMRRYIGERCAKACMEIGYRGAGTFEFLYENGEFYFIEMNTRIQVEHTVTEMITGIDLIKEQLRIAAGQPLSIKQDEVKVHGHAVECRINAEDPNTFLPSPGKITRFHAPGGFGVRWESHIYAGYTVPPYYDSMIGKLITYGENRDVAIARMKNALAELIIDGIKTNVELQQRIMNDENFQHGGTNIHYLEKKLGLQET

SEQ ID NO: 4584 - DNA, 1365 bp, Listeria monocytogenes
  CDS (1)..(1365)
atgattaaaaaagtactggtagcgaaccgtggagaaatcgctgtccgtatcattcgcgctgcaaaagaacttggagtggagacagtggcgatttattcggaagcagatagagaagcgctacatattcagctggcggatgaagcttattgtgtaggtcccgcggcaacaaaagatagttatttaaatatgtcaaacattattagccttgctgttttaacgaactgtgatgctattcatcctggctatggtttcttagccgaaaatgcagatttcgctgagttatgcgaagactgcaatattacttttatcgggccaagcgcttccgctatttcgcaaatgggaacaaaagatgttgcccgtgaaactatgcgtaaagcaggtgttccaatcgttcctggttcacaaggaatcgttgccgatgtggaagatggtaaaaaaatcgccaaaaaaatcggttatccggtgatcattaaagcaacagctggcggtggcggtaaaggtattcgtgtagcagaaaatgaagaaaaattaatctctggtattcatacgacgcaacaagaagcagaagcagcatttggagatccaggcgtttatcttgaaaaatacattcaagatttccgccacgtagaaattcaagtacttgctgataaccatggtaacgtgattcatttaggagagcgtgattgtagtattcaacgtcgcttgcaaaagctaattgaagaatcaccatcacctgccattgatgaaaaaacacgccaaaaaatgggtaaagcggccgttaaagctgccaaagccgtgaattattctggtgcaggtacaattgaatttatttatgatcatcatgaaaataatttctactttatggaaatgaatactcgtatccaagtagaacaccctgtaacggaacttgttaccggaattgatttagtcaaacaacaatttttagttgcttcaggtgaagagctacaaattaaacaagcagatgtgaaattaacaggttgggcaatggagtgtcgtattaacgctgaaaatccggagaaaaactttatgccagctccaggagaaattaaattttatcttcctccaggtggcttaggcgttcgaattgactcggcagcatatccaaactacaaaattccgccatattatgattcgatgattgctaaagtaatctgttatgcagaaacacgtgaagaagttattcaaaaaatgaaacgagcgttgtctgaatttgccattgatggcattccttcaaccattccattccatttacgcgtgttagataatgatgtatttttatcaggcgacttcaatacaaaattcttggagcaaaatgatgtaatgaatctttctaaggagggctaa

SEQ ID NO: 4585 - protein, 454 aa, Listeria monocytogenes
MIKKVLVANRGEIAVRIIRAAKELGVETVAIYSEADREALHIQLADEAYCVGPAATKDSYLNMSNIISLAVLTNCDAIHPGYGFLAENADFAELCEDCNITFIGPSASAISQMGTKDVARETMRKAGVPIVPGSQGIVADVEDGKKIAKKIGYPVIIKATAGGGGKGIRVAENEEKLISGIHTTQQEAEAAFGDPGVYLEKYIQDFRHVEIQVLADNHGNVIHLGERDCSIQRRLQKLIEESPSPAIDEKTRQKMGKAAVKAAKAVNYSGAGTIEFIYDHHENNFYFMEMNTRIQVEHPVTELVTGIDLVKQQFLVASGEELQIKQADVKLTGWAMECRINAENPEKNFMPAPGEIKFYLPPGGLGVRIDSAAYPNYKIPPYYDSMIAKVICYAETREEVIQKMKRALSEFAIDGIPSTIPFHLRVLDNDVFLSGDFNTKFLEQNDVMNLSKEG

SEQ ID NO: 4586 - DNA, 3525 bp, Agrobacterium tumefaciens
  CDS (1)..(3525)
atggttttgctgctttattccgcagtgcagcagaattctgttttggcgtgtggggagaccgtcttgaagatatcgaaaatacttgttgccaaccgatccgaaattgcgatccgcgttttccgggcagcgaacgagcttgggatcaaaaccgttgcgatttgggcggaagaggacaagctgtctttgcaccgcttcaaggcggatgaatcctatcaggtcggcaggggtccgcatctcgccaaggatatgggaccgatcgagagttatctttcgatcgaggaggttatccgcgtggccaagctctccggagcggatgcgatccatcccggttatggtcttctgtccgaaagccctgagttcgtggaggcctgcaacaaggccggcatcaccttcatcgggccgacaccggacacgatgcgccagctcggcaacaaggtcgccgcccgcaatctggcgatttcggttgatgtccccgttgttcccgccaccaatcctctgcctgacgatatcgcggaagtggagcgtatggccgaggaaatcggttatcccgtcatgctcaaggcctcctggggcggcggtggccgcggcatgcgcgccattcgcaaaaaggaagatctcgcccgtgaggtgacggaagccaagcgcgaggcgaaggccgccttcggcaaggacgaggtttatctggaaaagctcgtcgagcgcgcccgccatgtcgagagccagattctcggcgatacgcatggcaatgtcgtgcatctgttcgagcgggattgttcgatccagagacgcaatcaaaaggtcgtcgagcgcgcgccagcaccgtatctgtccgaagcgcagcgccaggaactggccgcctattccctgaagatcgcagccgcgaccaactacatcggcgccggcactgtcgaatatctgatggatgccgataccggcaaattctacttcatcgaggtcaatccgcgtatccaggtggagcataccgttaccgaagtcgtgaccggcatcgatatcgtcaaggcgcagatccatattctcgaaggagcggccatcggcacggcggaatccggcgtgcccaagcaggaagatatccgcctcaacggccatgcgctgcagtgccgcatcacgacggaagacccggaacacaatttcattccggactatggccgtattaccgcctatcgctcggcttccggtttcggcatccgtctggatgggggcacgtcctataccggcgccgtcatcacccgttattacgatccgctgctcgtcaaggtcacggcctgggcgccggagccggatgaagcgatcagccgcatggatcgcgcgttgcgcgaatttcgtatccgcggcgttgcgaccaacctgaccttcctcgaagccatcatcggtcacgacagtttccgcaacaacacctatacgacgcgcttcatcgattcgacgccggagttgttcgcgcaggtcaagcgtcaggaccgcgccaccaagcttctgacctatctggccgatgtgaccgtcaatggtcacccagaaaccaagggtcgtgcgaagcctgcggacaaggcggcaaagcccatcgtgccctatatcgatgcgccgacgcctgacggcaccaagcaattgctggacaagcttggccctaagggctttgcggactggatgcgcaacgaaaagcgcgtgctggtcacggatacgaccatgcgcgacggacaccagtcgctgctggccacccgcgtccgtacccatgatatcgcccgcgttgccagcgtttattccaaggcgcttccgcagcttctgtcgctggaatgctggggcggtgcgaccttcgacgtctcaatgcgcttcctgaccgaagacccgtgggagcgcctgtcactcattcgcgaaggtgcgccgaacctgctgttgcagatgcttctgcgtggtgccaacggcgtcggttacaagaactatcccgataatgtcgtgaagtatttcgtccgtcaggcggcaaggggcggcgtcgatctttttcgcgtcttcgactgcctgaactgggtggagaatatgcgggtgtcgatggatgcgattgccgaggagaacaagctctgcgaggcaaccatctgctacaccggcgatctcttgaattcggcacgtccgaaatatgatctcaaatattataccaacctcgcggtcgagctggaaaaggccggcgcccatatcatcgccgtcaaggatatggcgggcctgctgaaaccggccgccgccaaggttctgttcaaggcgttgcgcgaggcgaccggtctgccgatccacttccacacccatgatacgtcgggcatttccgccgcgaccgttcttgcggccgtggatgccggcgtcgacgccgtcgatgccgcgatggatgccttctccggcaatacgtcgcagccctgcctcggctcgatcgtggaggcgctctccggatcggaacgcgatacgggtctcgataccgaatggattcgccgcatttccttctattgggaagccgtgcgcaatcaatatgcggcgttcgagagtgacctcaaagggcctgcctcggaagtctatctgcatgaaatgccgggtggccagttcaccaacctcaaggaacaggcacgttcgctgggtctcgaaagccgctggcacgaggtggcgcaggcctatgccgatgccaacaggatgttcggcgatatcgtcaaggtgacgccgtcctccaaggtagtcggcgacatggcgctgatgatggtgagccaggacctgacggtggccgatgtcgaaaaccctgaccgtgaagtgtccttcccggactcggtggtatcgatgctgaagggcgatctcggtcaatcgccgggcggctggccggaagcgctgcagaagaaggcgctgaagggtgaaaagccttacacggttcgtccgggttcgcttctggaagatgccgatctcgatgccgaacggaaggtgatcgagaccaagctggagcgcaaggtcgatgacttcgagtttgcctcctatctgatgtatccgaaggtgttcaccgatttcgcgctgaccgccgagacatacggcccggtctccgtgctgcccacccatgcctatttctatggcatggaggatggcgaagagctgtttgcggatatcgagcgcggcaagacgcttgtcatcgtcaatcaggcttcgtccggcattgacgataagggcatggtgacggtgttcttcgagatcaacggccagccgcgccgcatcaaggtgccggatcgcgcccatggcgcttccggctctgcggtgcgccgcaaggcagaacccggcaatgcgtcccatatcggcgcgccgatgcctggtgtcatcagccgcgtcttcatcaaccagggtcaggaggtcaaggccggcgacgtgctgctctcgatcgaggccatgaagatggaaacggcgctgcatgccgaacgcgacggcaagatcgctgaagttctggtgaagcccggtgaccagatcgacgccaaggatttgttgatctcttacgccgaataa

SEQ ID NO: 4587 - protein, 1174 aa, Agrobacterium tumefaciens
MVLLLYSAVQQNSVLACGETVLKISKILVANRSEIAIRVFRAANELGIKTVAIWAEEDKLSLHRFKADESYQVGRGPHLAKDMGPIESYLSIEEVIRVAKLSGADAIHPGYGLLSESPEFVEACNKAGITFIGPTPDTMRQLGNKVAARNLAISVDVPVVPATNPLPDDIAEVERMAEEIGYPVMLKASWGGGGRGMRAIRKKEDLAREVTEAKREAKAAFGKDEVYLEKLVERARHVESQILGDTHGNVVHLFERDCSIQRRNQKVVERAPAPYLSEAQRQELAAYSLKIAAATNYIGAGTVEYLMDADTGKFYFIEVNPRIQVEHTVTEVVTGIDIVKAQIHILEGAAIGTAESGVPKQEDIRLNGHALQCRITTEDPEHNFIPDYGRITAYRSASGFGIRLDGGTSYTGAVITRYYDPLLVKVTAWAPEPDEAISRMDRALREFRIRGVATNLTFLEAIIGHDSFRNNTYTTRFIDSTPELFAQVKRQDRATKLLTYLADVTVNGHPETKGRAKPADKAAKPIVPYIDAPTPDGTKQLLDKLGPKGFADWMRNEKRVLVTDTTMRDGHQSLLATRVRTHDIARVASVYSKALPQLLSLECWGGATFDVSMRFLTEDPWERLSLIREGAPNLLLQMLLRGANGVGYKNYPDNVVKYFVRQAARGGVDLFRVFDCLNWVENMRVSMDAIAEENKLCEATICYTGDLLNSARPKYDLKYYTNLAVELEKAGAHIIAVKDMAGLLKPAAAKVLFKALREATGLPIHFHTHDTSGISAATVLAAVDAGVDAVDAAMDAFSGNTSQPCLGSIVEALSGSERDTGLDTEWIRRISFYWEAVRNQYAAFESDLKGPASEVYLHEMPGGQFTNLKEQARSLGLESRWHEVAQAYADANRMFGDIVKVTPSSKVVGDMALMMVSQDLTVADVENPDREVSFPDSVVSMLKGDLGQSPGGWPEALQKKALKGEKPYTVRPGSLLEDADLDAERKVIETKLERKVDDFEFASYLMYPKVFTDFALTAETYGPVSVLPTHAYFYGMEDGEELFADIERGKTLVIVNQASSGIDDKGMVTVFFEINGQPRRIKVPDRAHGASGSAVRRKAEPGNASHIGAPMPGVISRVFINQGQEVKAGDVLLSIEAMKMETALHAERDGKIAEVLVKPGDQIDAKDLLISYAE

SEQ ID NO: 4588 - DNA, 1992 bp, Agrobacterium tumefaciens
  CDS (1)..(1992)
atgttctcgaaaatactgatcgccaaccgtggcgaaatcgcctgccgcatcatccgcaccgcagccagtatgggcatccgcaccgtcgcggtctattcggatgccgaccgcgacgccatgcatgtggcgctggccgatgaggccatcgccatcggccccgcacctgcgcgcgcctcctatctcgacggcgaaaagatcattgccgccgcaaaggcaagcggcgcagaggccatccatccgggctatggttttctttcagaaaatgccggtttcgccgaagcctgcgcttctgcgggcctcgttttcatcggccctccaccagaagcaatccgcgccatgggcggaaaaagcgaagctaaggcgctgatggcaacggcaggcgttcccatcgttcccggttatcacggcgatgaacaggccgagaaacgactggcaagcgaggcggacaagatcggttacccggtgctgctgaaagcctcggcaggcggcggcggcaagggcatgcgcgtcgtccggcagaagcacgactttgctgcggagcttgccggcgccaaacgcgaagcactggccgccttcggcaatgaccgcatgctgatcgaaaaatacctggagcggccgcgccatgtggaagtgcaggttttcgccgatggccacggcaattgtgtttcgctttttgaacgcgactgctcgatccagcgccggcaccagaaggtgatagaggaagcccccgcccccggcctgcccgatgacttgcggcaacgcatgtatgacgcggcaaccgccgccgcccgtgccatcgattatcgcggcgcgggaacgatagaattcctccttgatccatccggcttctatttcatggaaatgaacacgcgccttcaggtcgagcatccggtgacggaatatattaccggtctcgatctggtcgaatggcagctgcgcgttgcgaatggagaagccctgcctaaagactgggccgatctccgcatcaacggccatgccatcgaggcacgcatttatgccgaagacccggcgcatgatttcctcccgtcgattggcacgatcagccacctcgtctttcccgatgaaggtcctcacctccggatcgacagcggcatccgcgccggcgacgccatcaccgtgcattacgatccgatgatcgccaagctgatcgtctgggatcatgaccgacccgccgccgtgcggcgtctaaaggtggcgcttgaaaagctggcaatttgcggcgtcaccagcaatgccacctttctggcgcggcttgcggggctcgaaactttcgcagcggccgatctggataccggcttcatcgcccgcaacgaggcagacctttttgctccgcaggccgtgggcgacaatgagatcgcactggcggcactcggcttccttctcagccgtaaaaacgcgagcaccaacccgcaagcgcaggccgaccctcatagtccctggaataccgccaacgccttccgactgaatgcgccggcgcgtgagacgctgcatttcaccatgcagaaccggccgatcgaccttggcgtagcccatgaggcagacagcttttcgctggagatgggcggacacacgatccgcgcttatggcgacctctctgacaacggccgctttcgcgcgaccatcaacgaccggacatggaaaggctatttctttgcagagagtgatagctacgcactttttctgcacggcgaacactatcgcatcagccagccagacccggtcgatatcgcagattcttctggccatacgggcggtctggaggcgcccatgccgggcgttatccgcgccgtgctcagccagagtggcgcggcggtcgagaccggtgatgcacttgtcgtgatggaagcgatgaagatggagcataccatccgcgcacccgcgaaaggcatcgtcaccgccgtcaactgcgccgaaggcgacatggtcgtcgccggtgcggtgctggtggatttcgagccggagggcatctga

SEQ ID NO: 4589 - protein, 663 aa, Agrobacterium tumefaciens
MFSKILIANRGEIACRIIRTAASMGIRTVAVYSDADRDAMHVALADEAIAIGPAPARASYLDGEKIIAAAKASGAEAIHPGYGFLSENAGFAEACASAGLVFIGPPPEAIRAMGGKSEAKALMATAGVPIVPGYHGDEQAEKRLASEADKIGYPVLLKASAGGGGKGMRVVRQKHDFAAELAGAKREALAAFGNDRMLIEKYLERPRHVEVQVFADGHGNCVSLFERDCSIQRRHQKVIEEAPAPGLPDDLRQRMYDAATAAARAIDYRGAGTIEFLLDPSGFYFMEMNTRLQVEHPVTEYITGLDLVEWQLRVANGEALPKDWADLRINGHAIEARIYAEDPAHDFLPSIGTISHLVFPDEGPHLRIDSGIRAGDAITVHYDPMIAKLIVWDHDRPAAVRRLKVALEKLAICGVTSNATFLARLAGLETFAAADLDTGFIARNEADLFAPQAVGDNEIALAALGFLLSRKNASTNPQAQADPHSPWNTANAFRLNAPARETLHFTMQNRPIDLGVAHEADSFSLEMGGHTIRAYGDLSDNGRFRATINDRTWKGYFFAESDSYALFLHGEHYRISQPDPVDIADSSGHTGGLEAPMPGVIRAVLSQSGAAVETGDALVVMEAMKMEHTIRAPAKGIVTAVNCAEGDMVVAGAVLVDFEPEGI

SEQ ID NO: 4590 - DNA, 2037 bp, Brucella melitensis
  CDS (1)..(2037)
atgaggaagcgcgggatgaggaaaagtgtgaagcggttttccgcccgcatcccgcgaggaaaaaatgtgatgtttcagaaaatactgattgccaatcgcggagaaatcgcctgccgggtcattcgcacggcgcgcaagcttggcattgccacggtggcgatttattccgatgcggatgcacgggcgttgcatgtggaaatggccgacgaggcggtgcgtgtcggcccggctgcatccgcgcaaagctatctgaacgtcgatgcgatcatcaaggccgcgaaggaaacaggcgcggaggcgatccatccgggctatggcttcctttcggaaaacccggctttcgtggatgcggtcgaagaagcgggcctcatcttcatcggcccatcggccaaggccatccgcgccatggggctgaaggatgccgccaaggcgctgatggaaaaggcaggcgtgccggtcgtgccgggctatcacggcgacaatcaggatggcgcctttctcaaaagcgaggcggaccggatcacctatcccgtcctcatcaaggcgcgggctggcggcggcggcaagggcatgcgccgggtcgatagcgctgccgattttgctgcggcgctggaaagtgcccggcgcgaggcggaagcctcgttcggcgatggcgcggtgctggtcgaaaaatatatggcgaaaccgcgccatatcgaagtgcaggtctttggcgataatcacggcaatgccgtgcatctgttcgagcgcgattgctcactgcaacgccgccaccagaaggtgatcgaagaagcgccagcgcccggcatgacggaagaaatgcgtgccgccatgggcgaagcggcggtgaaggcggccttgaccattggctattccggcgcgggcacggtggaattcatcgccgatgtgtcggagggcctcaggcccgaccgcttcttcttcatggaaatgaacacgcgcttgcaggtggaacatccggtgacggaagcaatcaccggcctcgaccttgtcgaatggcaattgcgtgtggcctccggcgaagcgctgccgaagcgtcaggacgaactgtccataaacggctgggctttcgaggcgcggctttatgcggaagacccggcgcgcgatttcctgcccgcgaccggcaagcttgcgctctttgtcccgcctgaaaatgcgcgtgtcgattccggcgtgcgcaccggcgatacgatcacgccgttctacgatcccatgatcgccaagatcatcacgcatggagccacgcgcgacgaggcgctgaaccggctggacgcggccctgaacaagacccgcattgccgggcttgtcaccaatcgtcagttcctgtcggcgctctgtaatctcgaagctttccgcaccggcgatgtcgataccgggctgatcgggcgcgagacggcggcgcttttcaccgatgcacagccttcggacatcgcctttgcgctggccgcacttggcgcactcgatcttctggatgcgccagaaaaaagcgatccatggtcgggcctgcgtgggttccgcctgtggggcgaggcatcgcgctcggttctcatcgagcatcatggcgagcgccgcacggtcagcttcacggccaggggcgacaggcatttcggctttgctttcggcaccatggacattcgcgcgcacaagaacggactggttcgctttgccattgatggtcgcgtgtcggaagcatcggtctcacgcatcgggcatgatgtgacggtgcaaatcgaagggcacgacaccatattccatcatgtgctggcgacaggcgcggaggaggatgcctccagcgaaagccgcatcctgtcgccgatgccggggctggtgcggctggtttccgtcgtggaaggtgcgagcgtcgccaagggcgatccgctggtgacgatggaagccatgaagatggaactgtcactgaccgcgccgcgcgatggcaaggttgcctccgtgacagttgcggcaggcgatcaggtcaatgaaggcgcattgctagtcgagctggaggagcaacatggctga

SEQ ID NO: 4591 - protein, 678 aa, Brucella melitensis
MRKRGMRKSVKRFSARIPRGKNVMFQKILIANRGEIACRVIRTARKLGIATVAIYSDADARALHVEMADEAVRVGPAASAQSYLNVDAIIKAAKETGAEAIHPGYGFLSENPAFVDAVEEAGLIFIGPSAKAIRAMGLKDAAKALMEKAGVPVVPGYHGDNQDGAFLKSEADRITYPVLIKARAGGGGKGMRRVDSAADFAAALESARREAEASFGDGAVLVEKYMAKPRHIEVQVFGDNHGNAVHLFERDCSLQRRHQKVIEEAPAPGMTEEMRAAMGEAAVKAALTIGYSGAGTVEFIADVSEGLRPDRFFFMEMNTRLQVEHPVTEAITGLDLVEWQLRVASGEALPKRQDELSINGWAFEARLYAEDPARDFLPATGKLALFVPPENARVDSGVRTGDTITPFYDPMIAKIITHGATRDEALNRLDAALNKTRIAGLVTNRQFLSALCNLEAFRTGDVDTGLIGRETAALFTDAQPSDIAFALAALGALDLLDAPEKSDPWSGLRGFRLWGEASRSVLIEHHGERRTVSFTARGDRHFGFAFGTMDIRAHKNGLVRFAIDGRVSEASVSRIGHDVTVQIEGHDTIFHHVLATGAEEDASSESRILSPMPGLVRLVSVVEGASVAKGDPLVTMEAMKMELSLTAPRDGKVASVTVAAGDQVNEGALLVELEEQHG

SEQ ID NO: 4592 - DNA, 1344 bp, Nostoc sp. PCC 7120
  CDS (1)..(1344)
atgaagtttgacaaaatattaattgccaatcggggagaaatagcgctgcgcattctccgcgcctgtgaggaaatggggattgcgacgatcgcagttcattcgactgttgaccggaatgctcttcatgtccaacttgctgacgaagcggtttgtattggcgaacctgctagcgctaaaagttatttgaatattcccaatattattgctgcggctttaacgcgcaatgccagtgctattcatcctgggtatggctttttatctgaaaatgccaaatttgcggaaatctgtgctgaccatcacattgcattcattggccccaccccagaagctatccgcctcatgggggacaaatccactgccaaggaaaccatgcaaaaagctggtgtaccgacagtaccgggtagtgaaggtttggtagagacagagcaagaaggattagaactggcgaaagatattggctacccagtgatgatcaaagccacggctggtggtggcggccggggtatgcgactggtgcgatcgccagatgaatttgtcaaactgttcttagccgcccaaggtgaagctggtgcagcctttggtaatgctggcgtttatatagaaaaatttattgaacgtccgcgccacattgaatttcaaattttggctgataattacggcaatgtgattcacttgggtgagagggattgctcaattcagcgtcgtaaccaaaagttactagaagaagcccccagcccagccttggactcagacctaagggaaaaaatgggacaagcggcggtgaaagcggctcagtttatcaattacaccggggcaggtactatcgagtttttgctagatagatccggtcagttttactttatggagatgaacacccggattcaagtagaacatcccgtaactgagatggttactggagtggatttattggttgagcaaatcagaattgcccaaggggaaagacttagactaactcaagaccaagtagttttacgcggtcatgcgatcgaatgtcgcatcaatgccgaagacccagaccacgatttccgcccagcacccggacgcattagcggttatcttccccctggcggccctggcgtgcggattgactcccacgtttacacggattaccaaattccgccctactacgattccttaattggtaaattgatcgtttggggccctgatcgcgctactgctattaaccgcatgaaacgcgccctcagggaatgcgccatcactggattacctacaaccattgggtttcatcaaagaattatggaaaatccccaatttttacaaggtaatgtgtctactagttttgtgcaggagatgaataaatag

SEQ ID NO: 4593 - protein, 447 aa, Nostoc sp. PCC 7120
MKFDKILIANRGEIALRILRACEEMGIATIAVHSTVDRNALHVQLADEAVCIGEPASAKSYLNIPNIIAAALTRNASAIHPGYGFLSENAKFAEICADHHIAFIGPTPEAIRLMGDKSTAKETMQKAGVPTVPGSEGLVETEQEGLELAKDIGYPVMIKATAGGGGRGMRLVRSPDEFVKLFLAAQGEAGAAFGNAGVYIEKFIERPRHIEFQILADNYGNVIHLGERDCSIQRRNQKLLEEAPSPALDSDLREKMGQAAVKAAQFINYTGAGTIEFLLDRSGQFYFMEMNTRIQVEHPVTEMVTGVDLLVEQIRIAQGERLRLTQDQVVLRGHAIECRINAEDPDHDFRPAPGRISGYLPPGGPGVRIDSHVYTDYQIPPYYDSLIGKLIVWGPDRATAINRMKRALRECAITGLPTTIGFHQRIMENPQFLQGNVSTSFVQEMNK

SEQ ID NO: 4594 - DNA, 1350 bp, Salmonella enterica subsp. enterica serovar Typhi
  CDS (1)..(1350)
atgttggataaaattgtcatcgccaaccgcggcgagatcgcactacgtattcttcgagcctgtaaagaactcggcatcaagaccgtcgctgtgcactcaagcgcggatcgcgatttaaaacacgtattgctggcggatgagacggtctgtattggcccggcaccgtccgtaaaaagttatctgaacatcccggctatcattagcgccgctgaaatcaccggcgcggtggcaatccacccgggttacggcttcctttctgagaacgccaattttgccgagcaggttgaacgctccggctttatctttatcggcccgaaagcggacaccatccgcctgatgggcgataaagtgtccgcgattaccgcgatgaaaaaagcgggcgtgccgaccgtaccaggatctgacggcccactgggcgacgatatgaatgcgaaccgcgctcatgccaaacgtattggctatccggtgatcatcaaagcgtccggcggcggcggcggccgcggtatgcgcgtggttcgtagcgatgctgaactggcgcagtccatctccatgactaaagcggaagcgaaagcagctttcagcaacgacatggtatacatggaaaaatacctggaaaatccacgccacatcgaaattcaggtgctggcggacggccagggcaacgctatctatctggcggaacgcgactgctccatgcagcgtcgccaccagaaagtggttgaagaagccccggcgccaggcattacgccggaactgcgtcgctatatcggcgaacgctgcgcgaaagcgtgcgtagacatcggctatcgcggcgcaggaacgttcgaattcctgttcgaaaacggcgagttctatttcatcgaaatgaacacccgtattcaggttgaacacccggtaactgaaatgattaccggcgtcgatttgatcaaagagcagttgcgcatcgcggcgggtcagccactgtcgatcacacaggacgaagttgtcgttcgaggccatgcggtagaatgccgtatcaatgccgaagatccgaacaccttcctgccaagccctggcaaaatcacgcgcttccatgcgcctggcggctttggcgttcgctgggaatctcatatctacgcgggctacacggtgccgccgtactatgattccatgatcggcaaactcatctgctacggtgaaaaccgcgacgtggcgattgcccgtatgaaaaatgccctgcaggaactgattatcgatggtatcaaaaccaatatcgatctgcagacccgcatcatgaatgacgagcacttccagcacggtggaaccaacatccactatctggagaaaaaactcggtcttcaggaaaagtaa

SEQ ID NO: 4595 - protein, 449 aa, Salmonella enterica subsp. enterica serovar Typhi
MLDKIVIANRGEIALRILRACKELGIKTVAVHSSADRDLKHVLLADETVCIGPAPSVKSYLNIPAIISAAEITGAVAIHPGYGFLSENANFAEQVERSGFIFIGPKADTIRLMGDKVSAITAMKKAGVPTVPGSDGPLGDDMNANRAHAKRIGYPVIIKASGGGGGRGMRVVRSDAELAQSISMTKAEAKAAFSNDMVYMEKYLENPRHIEIQVLADGQGNAIYLAERDCSMQRRHQKVVEEAPAPGITPELRRYIGERCAKACVDIGYRGAGTFEFLFENGEFYFIEMNTRIQVEHPVTEMITGVDLIKEQLRIAAGQPLSITQDEVVVRGHAVECRINAEDPNTFLPSPGKITRFHAPGGFGVRWESHIYAGYTVPPYYDSMIGKLICYGENRDVAIARMKNALQELIIDGIKTNIDLQTRIMNDEHFQHGGTNIHYLEKKLGLQEK

SEQ ID NO: 4596 - DNA, 1350 bp, Pseudomonas aeruginosa
  CDS (1)..(1350)
atgttggaaaaagtgctgatcgccaaccgcggcgaaatcgccttgcgcatccttcgcgcatgcaaggagctggggatcaagacggtggcggtacactccaccgccgaccgcgagttgatgcacctgtcgctcgccgacgaatcggtgtgcatcggtccggccccggccacccagtcgtacctgcagatcccggcgatcatcgccgcggccgaggtcaccggcgccaccgcgatccaccccggctacggcttcctcgccgagaacgccgacttcgccgagcagatcgaacgctccggcttcaccttcgtcggcccgaccgccgaggtgatccgcctgatgggcgacaaggtctcggccaaggacgccatgaagcgcgccggcgtccccaccgtgccgggctccgacggcccgctgccggaagatgaagaaaccgccctggcgatcgcccgcgaggtcggctacccggtgatcatcaaggccgccggcggcggcggcgggcgcggcatgcgtgtggtctacgacgaatccgagctgatcaagtcggccaagctgacccgcaccgaggccggcgcggcgttcggcaacccgatggtctacctggagaagttcctgaccaacccgcgccacgtggaagtccaggtgctttccgacggccagggcaacgccatccacctcggcgaccgcgactgctccctgcagcgccgccaccagaaggtgatcgaagaggcgccggcccccggcatcgacgagaaggctcgccaggaagtcttcgcccgctgcgtccaggcctgcatcgagatcggctaccgcggcgccggcaccttcgagttcctctacgagaacggccgcttctacttcatcgagatgaacactcgcgtgcaggtggagcacccggtatctgagatggtcaccggtgtcgacatcgtcaaggagatgctgcgcatcgcctccggcgagaagctctcgatccgccaggaggacgtggtcatccgcggccatgcgctggagtgccggatcaacgccgaagacccgaagaccttcatgcccagcccgggcaaggtcaagcacttccacgcccccggcggcaacggcgtgcgcgtcgactcgcacctctacagcggctacagcgtgccgccgaactacgactcgctggtcggcaaggtcatcacctacggtgccgaccgcgacgaggcgctggcgcggatgcgcaatgccctggacgagttgatcgtcgacggtatcaagaccaataccgaactgcacaaggacctggtgcgcgacgccgccttctgcaagggcggggtgaacatccattacctggagaagaaactgggtatggacaagcactga

SEQ ID NO: 4597 - protein, 449 aa, Pseudomonas aeruginosa
MLEKVLIANRGEIALRILRACKELGIKTVAVHSTADRELMHLSLADESVCIGPAPATQSYLQIPAIIAAAEVTGATAIHPGYGFLAENADFAEQIERSGFTFVGPTAEVIRLMGDKVSAKDAMKRAGVPTVPGSDGPLPEDEETALAIAREVGYPVIIKAAGGGGGRGMRVVYDESELIKSAKLTRTEAGAAFGNPMVYLEKFLTNPRHVEVQVLSDGQGNAIHLGDRDCSLQRRHQKVIEEAPAPGIDEKARQEVFARCVQACIEIGYRGAGTFEFLYENGRFYFIEMNTRVQVEHPVSEMVTGVDIVKEMLRIASGEKLSIRQEDVVIRGHALECRINAEDPKTFMPSPGKVKHFHAPGGNGVRVDSHLYSGYSVPPNYDSLVGKVITYGADRDEALARMRNALDELIVDGIKTNTELHKDLVRDAAFCKGGVNIHYLEKKLGMDKH

SEQ ID NO: 4598 - DNA, 1965 bp, Mycobacterium tuberculosis
  CDS (1)..(1965)
atgtttgacaccgtactagtggccaaccgcggtgagatcgcggttcgggtgattcggacgctgcgccggctaggcatccggtcggtcgcggtctacagcgaccccgacgtcgatgcccgccacgtcttggaggcggacgctgcggtgcggctggggcccgccccagcacgcgaaagctacctcgatatcggcaaggtgctcgatgctgcggcgcgcaccggagcccaggcgatccatccgggctacgggtttcttgccgagaatgccgatttcgctgcggcgtgtgaacgcgcccgggtggtgttcctgggtccgccggcgcgcgcgatcgaggtgatgggcgacaagatcgccgccaagaacgcggtcgccgctttcgatgttccggtggtgcccggtgtggcgcgcgccgggctgacggacgacgcgctggtcaccgctgccgctgaggtgggctatccggtgctgatcaaaccgtcggccggcggcggcggcaaagggatgcggttagtgcaagatccggcgcggctgcctgaggcgctggtgagtgcccggcgcgaagccatgtcttcgttcggggacgatacgctattcctggagcggtttgtgttgcggcccaggcacatcgaagtgcaggtgcttgccgacgctcacggcaacgtggtgcatctgggtgagcgtgagtgcagcctccagcggcgccaccagaaggttatcgaggaggcgccgtcgccactgcttgacccgcagacccgcgagcgcatcggggtcgcggcctgcaacaccgcccgctgcgtggactacgtcggcgccggcacggtggagttcatcgtctccgcgcagcgccccgacgagttctttttcatggagatgaatacccggctgcaggtggaacacccggtcaccgaggcgattactggattggacctggtcgagtggcagttgcgggtgggtgcgggcgaaaagttgggcttcgcccaaaacgacatcgagctgcgtgggcacgcgatcgaggctcgggtgtatgcggaggatcccgcgcgggaattcctgcccaccggcggccgggtgctggcggtgttcgaacccgccggccccggggtgcgggtggattcgtcactgctaggcggcacggtggtcggcagtgattacgacccgttgctcaccaaggtgattgcgcacggggccgatcgcgaggaagcgctggatcggctggaccaggcgctggcgcggactgcggtgctgggagtgcagaccaatgtcgagttccttcgctttctgctcgccgacgagcgggtgcgggtcggggatttggacaccgctgtactggacgagcgatcggccgatttcactgcgcggccggcgcctgacgacgtgctagctgccggcggcctctaccgccagtgggccctggcccggcgcgcacagggcgacctgtgggccgcgccgtccggatggcgcggcgggggccatatggcaccggtccgcaccgccatgcgcaccccgctgcgcagcgagaccgtttcggtgtgggggccacccgagtcggcgcaggttcaggttggcgatggtgagatcgattgtgcgagcgtgcaggtcacccgagaacagatgagcgtgacgataagcgggctgcgccgggattatcggtgggcagaggctgaccggcacctgtggatcgccgacgagcgcgggacttggcacctgcgcgaggccgaggagcacaagattcaccgcgccgtgggtgcgcggccggcggaggtcgtcagccctatgcctggcagcgtgatcgccgtgcaggtcgagtccggctcccagatctctgcgggtgatgtggtggtggtggtggaagcgatgaagatggagcactcgctggaggcgccggtttcgggacgggtacaggtgttggtgtccgttggcgatcaggtgaaagtcgaacaggtactggcgaggatcaaggactag

SEQ ID NO: 4599 - protein, 654 aa, Mycobacterium tuberculosis
MFDTVLVANRGEIAVRVIRTLRRLGIRSVAVYSDPDVDARHVLEADAAVRLGPAPARESYLDIGKVLDAAARTGAQAIHPGYGFLAENADFAAACERARVVFLGPPARAIEVMGDKIAAKNAVAAFDVPVVPGVARAGLTDDALVTAAAEVGYPVLIKPSAGGGGKGMRLVQDPARLPEALVSARREAMSSFGDDTLFLERFVLRPRHIEVQVLADAHGNVVHLGERECSLQRRHQKVIEEAPSPLLDPQTRERIGVAACNTARCVDYVGAGTVEFIVSAQRPDEFFFMEMNTRLQVEHPVTEAITGLDLVEWQLRVGAGEKLGFAQNDIELRGHAIEARVYAEDPAREFLPTGGRVLAVFEPAGPGVRVDSSLLGGTVVGSDYDPLLTKVIAHGADREEALDRLDQALARTAVLGVQTNVEFLRFLLADERVRVGDLDTAVLDERSADFTARPAPDDVLAAGGLYRQWALARRAQGDLWAAPSGWRGGGHMAPVRTAMRTPLRSETVSVWGPPESAQVQVGDGEIDCASVQVTREQMSVTISGLRRDYRWAEADRHLWIADERGTWHLREAEEHKIHRAVGARPAEVVSPMPGSVIAVQVESGSQISAGDVVVVVEAMKMEHSLEAPVSGRVQVLVSVGDQVKVEQVLARIKD

SEQ ID NO: 4600 - DNA, 1338 bp, Deinococcus radiodurans
  CDS (1)..(1338)
atgttcaagaaaatcctgatcgccaaccgtggcgagatcgccctgcgcgtcatccggacggcgcgggaaatgggcatccagacggtcgtggtgtattccaccgccgacgaaaagagcctgccggtgctgctcgccgacgaatcggtctgcgtggggccgcccgcttcaaatcagagctacctcaacatccccaacatcctctcggcggcgctgatgaccggcgccgaggcgattcaccccggctacggcttcatggccgagaaccccgacttcgccgagatgtgccgcgagcacggcatcgtgtttatcgggccgacgccggaaagtatgcgggcgctgggcagcaaagcgggcggacgcgaaatcgccgcacagagcaatgtgcccaccgtgccgggcactggcgtgctggaaagcgtggacgctgcgctgctcgccgccaagcagatcggctacccggtgctgctcaaggccagcgcgggcggcggcggacgcggccagaaagtgattcgcacccaggaagagctgcaaaagggcttcaatcaggcgcaggaagaagcgcggctgtacttcggcgacccggcgatcatcatggagaaattcctggaggagttccgccacatcgaggtgcaggtgatgggcgacggccaggggcacgtcatccacatcggcgagcgcgactgttcgattcagcgccgcaaccagaagctgatcgaggaagcgccctccacgctgcccgagtcgctgcgtcaggaaatcctcgccgccggggtgcgcctcgcccagttcgtgaactacgcgggcgccggcacgctggaattcatcatggaccgcgacggcaactactacttcatggagatgaacacccgcattcaggtcgagcactgcgtgtcggaaatgatttccagcctcgacctcgtgcgcctgcaaatcgaaattgccgccggcctgggcctcaacattcagcaggacgacgtgaagttgcacggccacgccatcgagtgccgcatcaacgccgaggaccccgacaaggacttccgcccggcagccggcaaaatcgacgacgcgcacttcgcgggcggagcgggcgtgcgggtggacacccacgtctacagcggctactcgatcccgccgcactacgactcgctgatcggcaaactgatcgtgtggcacgaggaccgcgacaaggcggtgtcgcgcatgaaacgggcgctggaagaaaccgtgattcaggggccgaagacgaccattccgctctacatcaagatcatggacaacccgttctacaaacgcggcgcggtgatgaccaacttcctgaagacgcgcatggagatgtag

SEQ ID NO: 4601 - protein, 445 aa, Deinococcus radiodurans
MFKKILIANRGEIALRVIRTAREMGIQTVVVYSTADEKSLPVLLADESVCVGPPASNQSYLNIPNILSAALMTGAEAIHPGYGFMAENPDFAEMCREHGIVFIGPTPESMRALGSKAGGREIAAQSNVPTVPGTGVLESVDAALLAAKQIGYPVLLKASAGGGGRGQKVIRTQEELQKGFNQAQEEARLYFGDPAIIMEKFLEEFRHIEVQVMGDGQGHVIHIGERDCSIQRRNQKLIEEAPSTLPESLRQEILAAGVRLAQFVNYAGAGTLEFIMDRDGNYYFMEMNTRIQVEHCVSEMISSLDLVRLQIEIAAGLGLNIQQDDVKLHGHAIECRINAEDPDKDFRPAAGKIDDAHFAGGAGVRVDTHVYSGYSIPPHYDSLIGKLIVWHEDRDKAVSRMKRALEETVIQGPKTTIPLYIKIMDNPFYKRGAVMTNFLKTRMEM

SEQ ID NO: 4602 - DNA, 1446 bp, Campylobacter jejuni
  CDS (1)..(1446)
atgaatcaaatccataaaattctcatagcaaatagagctgaaatagctgttagagtaatccgtgcttgtagagatttacatattaaaagtgttgcagtttttacagagcctgatcgtgaatgtttgcatgtaaaaatcgcagatgaggcttatcgcataggaacggatgctataagaggatatttagatgttgctcgtattgtcgagattgctaaggcttgtggtgctgatgcgattcatcctggttatggatttttaagtgagaattacgaatttgctaaggcttgtgaagatgctggaattatttttataggtccaaaatctgaagtaatccataagatgggaaataaaaatatcgctcgtaagttaatggctaaaaatggcatacctattgttccagggactgaaaaattaaattcctatagcatggaagaaattaaaatttttgctgagaagattggttatcctgttattttaaaagcttcaggtggtggaggtggacgcggaattcgcgttgttcataaagaacaagatcttgaaaatgcctttgaatcttgcaaaagagaagctttaacatactttaataatgatgaagtatttatggaaaaatatgtagttaatcccagacatatagaatttcaaattttaggagataactacggaaatattatccatctttgtgaaagggattgttctattcaaagaagacatcaaaaggtaattgagatagcaccttgccctggaatttcagataatcttagaaaaaccatgggtgttacagctgtggcagctgctaaggctgtaggttatacaaatgctggaactatagagtttttgcttgatgattataatcgcttttattttatggaaatgaatacaagaattcaagttgagcatccaattactgaagaaattacaggtattgatcttattgtaagacaaattcgtattgcagcaggagaaattttggacttagaacaaagcgatattaaacctaggggttttgctattgaagctagaattactgctgaaaatgtatggaaaaattttattccaagtcctggaaaaataggagaatactacccagctcttggaccatctgttagggttgatagtcatatttataaagactatactgtgccgccttattatgattccatgcttgcaaagcttattattaaagcaacaagttatgatttagcggttaataaacttgagcgtgctttgaaggaatttgtgattgatgatattagaacaacaataccatttttaattgccattacaaaaacaagagaatttagaagggggtatttagacacctctttcatagaaacacatatgcaagaattattagaaaaaacagaagatcgtcatcaagaaaataaagaagaagttatagctgcaatagctgctacgcttaaaaaaatacgagaaagtagggaataa

SEQ ID NO: 4603 - protein, 481 aa, Campylobacter jejuni
MNQIHKILIANRAEIAVRVIRACRDLHIKSVAVFTEPDRECLHVKIADEAYRIGTDAIRGYLDVARIVEIAKACGADAIHPGYGFLSENYEFAKACEDAGIIFIGPKSEVIHKMGNKNIARKLMAKNGIPIVPGTEKLNSYSMEEIKIFAEKIGYPVILKASGGGGGRGIRVVHKEQDLENAFESCKREALTYFNNDEVFMEKYVVNPRHIEFQILGDNYGNIIHLCERDCSIQRRHQKVIEIAPCPGISDNLRKTMGVTAVAAAKAVGYTNAGTIEFLLDDYNRFYFMEMNTRIQVEHPITEEITGIDLIVRQIRIAAGEILDLEQSDIKPRGFAIEARITAENVWKNFIPSPGKIGEYYPALGPSVRVDSHIYKDYTVPPYYDSMLAKLIIKATSYDLAVNKLERALKEFVIDDIRTTIPFLIAITKTREFRRGYLDTSFIETHMQELLEKTEDRHQENKEEVIAAIAATLKKIRESRE

SEQ ID NO: 4604 - DNA, 3288 bp, Pseudomonas aeruginosa
  CDS (1)..(3288)
atgaccgctcccttcaacgccttgctgatcgccaaccgcggcgagatcgccattcgcatcgcccgcgcctgcgccgacctgggtatccgctcggtggcggtgttcgcggaagacgatgccgcgtccctgcacgtgcgcaaggccgatgtcgcgctgccgctggccggccgtggcgtggcggcctatctcgacatggatcggctggtcgcgctggccctggagcagggctgcgaggcgatccatccgggctacggtttcctcgccgagaacggcgaattcgcccgtcgctgccagcgcgcgggcatccacttcgtcgggccgcaagcggaagtgctcgacctgttcggcgacaaggctgccgcgcgcgccctggccgagcgcctggaggtgccgctggtggccgggatcaaccgtgcggtcagcgtcgaagaggccgaggcgttcctggaagggctgggcgatggcgccgcggtgatgctcaaggcccttgccggcggcggcggacgtggcatgcgcgcggtggaggaggttgcgcaactggccgatgcctaccgccgctgccgtgccgaggcgcaggcggcgttcggccgggacgagttatacgtcgagcaacgggtagcgcgggcgcggcacatcgaggtgcaggtgctcggcgacggcagcggtgcggtcagccacctctgggagcgcgattgcagcctgcaacggcgccagcagaagctgctggagatcgcccccagcccggacctgccggaggccactcgcgaggcgctgatcgattgcgccctgcgcatggccggcgcggtgcgctatcgggggatcggtaccttcgagttcctggtcgacgacgagcgccccgggcgcttctatttcatggaagccaatccgcgcatccaggtggagcacaccgtcaccgaggaagtcaccggggtcgacctgctgcacgcccagttgcgtctcgccgccggcatggagcttgccgccctcggcctggagcgaccgccggcgatcggcggctgcgcggtgcaactgcggatcaacctggagaccctggcggccgacggcagcgcccgtccggcggtgggcactatcggcgcctacgaaccgcccagcggtcccggcctgcgggtggacggctacggctatgccggctatcgggtcagccccagctacgattcgctgctggccaagctggtcgtgcgtggtgcggattatcccgccgcgttgcgccgggcctaccgggcgctctgcgaattccgcctggagggcgtggcgagcaacctggatctgctgcgcaaccttctgctgcatccggcggtacaggccaaccgggtcgacacccgcttcgtcgaaagccacctggagacactgctggcgcctatcccggcgagccatccgcggctccgcgccgagtgcccgctcgccgaggacgccgcgcctgcgcgggtcgaggcgccactcggcagcctgccgctgtctgcgccgagcagcggggtgctggtggccctggaagtggccgatggcgaacgggtgcgtgccggccagcgggtcgcgatcctggaagcgatgaagatggaattcgaggtcaaggcacccggcggcggtatcgtccggcgactcgcggcgagcctcggggagcctctggaggagggcgcgacgctgctgttcctcgaaccgacggaggatgacgacgagcaggcaccgaccgaacaggcgctggacctggcgcatatccgcgccgatctcgccgaggtactcgagcgccaggcagcgctgggcgacgagcgtcgtccgcaggcgctggccaggcggcgcaagaccggacagcgtaccgcgcgggagaacgtgctcgacctgctggacgagggcagcttcagcgaatatggcggtttcgccctggccgcccagcgtcgccggcgctccgccgaggagttgctggagctgagccccgccgatggcctggtcgccggcaccggtacggtgggggccgccagcttcggcgtgcaggccgcgcgttgcctggtactggcctacgactacacggtgttcgccggcacccagggggtgatgaaccacaagaagaccgaccgcctgctcggcctggccgaacagtggcgcttgccgctggtgctgttcgccgagggcggcggcgggcgcccgggcgataccgatttcgtcggcgtcgccggcctcgattgccataccttcgtcggcatggcccggctctccgggctggtgccgctggtgggagtggtctccggtcgctgcttcgccggcaatgccgcgttgctgggctgctgcgatgtgatcatcgccacccgcgacgccaccatcggcatggccggcccggcgatgatcgagggcggcggcctgggccgttttgccgccgaggaggtcggtccgacgggcgtgcaggggcccaacggagtgatcgacgtactggtggaggacgaggccgaagcggtcgcggtggccaggcgctacctcggctatttccagggcccgctgcccgactggagttgcgccgaccagcgcgagttgcgccacctggtgccggagaaccgcctgcgtgcctacgacatccgccaggcgatcgaggtcctggccgaccggggcagcgtgctggaactgcggcgccagttcgctcccggcctggtcaccgcgctgctgcgcatcgagggccgggcgttcggcctgatcgccaacaaccctggccatctcggcggcgccatcgatgccgcggctggcgacaaggccgcgcgcttcatgcagttgtgcgacgccttcgacatcccgatcgtctcgctctgcgacacccctggcttcatggtcggcccggaggcggaaaaacaggccacggtgcgccacgtctcgcggatgttcgtcagcgccgccagcctgacggtgccgttcttcaccgtggtcctgcgcaagggctacggactgggagcccaggccatggcggcgggcagcttccattcgccgctgttcaccgtcgcctggcccagcggcgagttcggcgccatgggcctggaaggcgcggtgcggctgggcttcgccaaggagctggcggccgaggaagacccccagcggcgcgaggcgctgttccgcggcatggtggacaaggcctaccgcaacggcaaggcgctgaacatggccagctacctggagatcgacgcggtgatcgacccggcggagacccgcgcctggctcctgcgcggcctggccgtcgccggagaaccggcgccgagggcggggcgcaagcggccgttcgtggatacctggtag

SEQ ID NO: 4605 - protein, 1095 aa, Pseudomonas aeruginosa
MTAPFNALLIANRGEIAIRIARACADLGIRSVAVFAEDDAASLHVRKADVALPLAGRGVAAYLDMDRLVALALEQGCEAIHPGYGFLAENGEFARRCQRAGIHFVGPQAEVLDLFGDKAAARALAERLEVPLVAGINRAVSVEEAEAFLEGLGDGAAVMLKALAGGGGRGMRAVEEVAQLADAYRRCRAEAQAAFGRDELYVEQRVARARHIEVQVLGDGSGAVSHLWERDCSLQRRQQKLLEIAPSPDLPEATREALIDCALRMAGAVRYRGIGTFEFLVDDERPGRFYFMEANPRIQVEHTVTEEVTGVDLLHAQLRLAAGMELAALGLERPPAIGGCAVQLRINLETLAADGSARPAVGTIGAYEPPSGPGLRVDGYGYAGYRVSPSYDSLLAKLVVRGADYPAALRRAYRALCEFRLEGVASNLDLLRNLLLHPAVQANRVDTRFVESHLETLLAPIPASHPRLRAECPLAEDAAPARVEAPLGSLPLSAPSSGVLVALEVADGERVRAGQRVAILEAMKMEFEVKAPGGGIVRRLAASLGEPLEEGATLLFLEPTEDDDEQAPTEQALDLAHIRADLAEVLERQAALGDERRPQALARRRKTGQRTARENVLDLLDEGSFSEYGGFALAAQRRRRSAEELLELSPADGLVAGTGTVGAASFGVQAARCLVLAYDYTVFAGTQGVMNHKKTDRLLGLAEQWRLPLVLFAEGGGGRPGDTDFVGVAGLDCHTFVGMARLSGLVPLVGVVSGRCFAGNAALLGCCDVIIATRDATIGMAGPAMIEGGGLGRFAAEEVGPTGVQGPNGVIDVLVEDEAEAVAVARRYLGYFQGPLPDWSCADQRELRHLVPENRLRAYDIRQAIEVLADRGSVLELRRQFAPGLVTALLRIEGRAFGLIANNPGHLGGAIDAAAGDKAARFMQLCDAFDIPIVSLCDTPGFMVGPEAEKQATVRHVSRMFVSAASLTVPFFTVVLRKGYGLGAQAMAAGSFHSPLFTVAWPSGEFGAMGLEGAVRLGFAKELAAEEDPQRREALFRGMVDKAYRNGKALNMASYLEIDAVIDPAETRAWLLRGLAVAGEPAPRAGRKRPFVDTW

SEQ ID NO: 4606 - DNA, 1368 bp, Lactococcus lactis subsp. lactis
  CDS (1)..(1368)
atgtttaataaaattttgattgccaatcgtggcgaaattgctgtaagaattattcgtgcagctcgtgaattaggagtgggtacagttgccatttattcaactgcagaccgcgatgctttacatgttcatttagctgacgaagcaatttgtgtgggcccagctagaagtactgagtcttatcttaatatgaataatattctgtcagctgctgtggcaactggcgcacaagcgattcacccaggttttggattcctttctgagaattcaaaatttgctcgtctttgtgaagaaatgaatattaaatttatcggtccgtcagcaaaagttatggatatgatgggtgataaaatcaatgctcgtgcagaaatgattaaagctggtgttcctgtaacaccgggttctgagggcgaagttcataccactgatgaagcagtaaaaattgctgaagaaattggctatccaatcatgcttaaagcatcagctggtggtggtggtaaaggaattcgtaaggttaataatgttgaggaacttgttccagcatttgaggcagcacaagcggaagcacaagcagcttttggtaatggagccatgttcatcgaacgaatgattttcccagcgcgtcatattgaggttcaaatcttaggagatagtcaaggaaatgtgattcatcttggtgaacgtgattgttcattgcaaagaaataatcaaaaagttcttgaagaatctccgtcagttgcaattggacacactttacgaaatgaaataacagctgcggctgttaaagctgctcagcatgtttcttatgaaaatgcgggaaccattgagttcttacttgatgaatcttctggtaagttttatttcatggaaatgaacacacgtgttcaagttgaacatccggtcacagagtttgtatcaggtgttgatattgtaaaagaacagattcgtgtagccaatggcaatgaattgtctgtcaagcaagaagatgtgacttttagtggacatgcgattgaatgtcgaattaatgcggaaaatcctaaatttaattttgcaccaagtccaggaaaaattactaatcttttcttgccaagtggtggagttggtttgcgggttgatagcgctatgtacagtggttacagtattccgccatattatgatagtatgattgctaaagtcattgttcatggtgaaaatcgttttgaagcactgatgaaaatgcaacgcgcccttcttgaatttgacgttgaaggggtcattacaaatgttgatttccaactagaattaatttctgacccacatgttgtggcaggagattatgatacaagcttcttaggaaatgttttcttaccagaatatcaaaaagaagattaa

SEQ ID NO: 4607 - protein, 455 aa, Lactococcus lactis subsp. lactis
MFNKILIANRGEIAVRIIRAARELGVGTVAIYSTADRDALHVHLADEAICVGPARSTESYLNMNNILSAAVATGAQAIHPGFGFLSENSKFARLCEEMNIKFIGPSAKVMDMMGDKINARAEMIKAGVPVTPGSEGEVHTTDEAVKIAEEIGYPIMLKASAGGGGKGIRKVNNVEELVPAFEAAQAEAQAAFGNGAMFIERMIFPARHIEVQILGDSQGNVIHLGERDCSLQRNNQKVLEESPSVAIGHTLRNEITAAAVKAAQHVSYENAGTIEFLLDESSGKFYFMEMNTRVQVEHPVTEFVSGVDIVKEQIRVANGNELSVKQEDVTFSGHAIECRINAENPKFNFAPSPGKITNLFLPSGGVGLRVDSAMYSGYSIPPYYDSMIAKVIVHGENRFEALMKMQRALLEFDVEGVITNVDFQLELISDPHVVAGDYDTSFLGNVFLPEYQKED

SEQ ID NO: 4608 - DNA, 2010 bp, Caulobacter crescentus
  CDS (1)..(2010)
atgttctcgaagatcctgatcgccaaccgtggcgagatcgcagtccgggtgatcaagacctgccgtcgtctggggatcaagacggtggtcgtctactccgacgccgatgcgggcagcctcgctgtggagatggccgacgagaccgtacacatcggcgcctcgccggccaatcagtcctacctcgtcgccgacaagatcatcgccgcctgcaagcagacgggcgcgcaggccgtgcatccgggctttggcttcttgtccgagaacgccggcttcgcccagcgctgcgccgacgagggcatcgtcttcatcggccccaaccccggcgccatcagcgccatgggcgacaagatcgagagcaagaagttcgctcaagccgcgggcgtctcctgcgtgccgggccacatcggcgagatcgccgacaccgccgaggccgtgaagatctccgaggagatcggctatccggtgatgatcaaggcgtcggccggcggcggcggcaagggcatccgcgtggcctggacccgcaaggacgtcgaggagggcttcccggctgtccgcgccgaggccaaggccagctttggcgacgaccgcatcttcatcgaaaagttcatcgagagcccgcgccacatcgagatccaggtgctgggcgacaagcacggcaatgtcgtccacctgttcgagcgcgagtgttcgatccagcgccgcaatcagaaggtcatcgaggaagcccccagcccgctgctggacgaggccacccgcaacgccatgggcgcccaggccgtcgccctggccaaggccgtgaactatgactcagccggcacggtcgagttcgtcgccggtcaggacaagagcttcttcttcctggaaatgaacacccgcctgcaggtcgaacacccggtcaccgaactgatcacgggcctcgacttggtcgagcagatgatccgctcggcctacggggagaagatggcctttggccagtcggacctctcgatcaacggctgggccatcgaaagccgcatctacgccgaggacccgtaccgcaagttcctgccctcgatcggccgcctggtgcgctacgacccgccggccgaaggcgacaaggacggccccaatggtggttatgtggtccgcaacgacgctggcgtccgcgaaggcgacgagatctcgatgttctacgatccgatgatctccaagctctgcacctgggcgccgacccgcctggccgccatcgatggcatgggccgggcgctggaagatttccacatcgagggcctgggccagaacatcccgttcctggccgccgtgatggacgaggagcgcttccgctcgggcaagctggcgaccagctacatcaaggacgagttccccgacggcttcaacggcacgaccccgacggctgtgcagctggacattctgaccgccgtgggcgcggcgatgcagcgggtctatgcgacccgggcccgcagctacgagtccggcctgatcggcgaagcgcgcgacgagtgggtggtggcgatcggcgaaacccgtcttcgggtcaaggtcggcggcgaggacggcgcagtggcggtcgaactgctcgacgagggccggaccctgttcctgaccgacatcgactggcgcccgggcaagccggtgttcaaggccgtgctgaacggcctggccttcaccgtccaggccgccccggccgccgagggcttcaccattcgccaccgcgccgccaagacccgcgtgctggtcctgaccccgcgctcggccgagttacacgacaagctgcccgaaaagcaggcggccgacacctccaagctggtgctgtcgccgatgccgggcctggtggtctcgatggacgtcaccaccggccagcaggtccgcgagggcgaggtcgtctgcgtgctcgaagccatgaagatgcagaacatcatccgcgccgagcgcgacggggtggtcaaggcggtcaacgccaagggcggcgatccggtcgcggcggacgaggtgctggtcgagttcgcgtag

SEQ ID NO: 4609 - protein, 669 aa, Caulobacter crescentus
MFSKILIANRGEIAVRVIKTCRRLGIKTVVVYSDADAGSLAVEMADETVHIGASPANQSYLVADKIIAACKQTGAQAVHPGFGFLSENAGFAQRCADEGIVFIGPNPGAISAMGDKIESKKFAQAAGVSCVPGHIGEIADTAEAVKISEEIGYPVMIKASAGGGGKGIRVAWTRKDVEEGFPAVRAEAKASFGDDRIFIEKFIESPRHIEIQVLGDKHGNVVHLFERECSIQRRNQKVIEEAPSPLLDEATRNAMGAQAVALAKAVNYDSAGTVEFVAGQDKSFFFLEMNTRLQVEHPVTELITGLDLVEQMIRSAYGEKMAFGQSDLSINGWAIESRIYAEDPYRKFLPSIGRLVRYDPPAEGDKDGPNGGYVVRNDAGVREGDEISMFYDPMISKLCTWAPTRLAAIDGMGRALEDFHIEGLGQNIPFLAAVMDEERFRSGKLATSYIKDEFPDGFNGTTPTAVQLDILTAVGAAMQRVYATRARSYESGLIGEARDEWVVAIGETRLRVKVGGEDGAVAVELLDEGRTLFLTDIDWRPGKPVFKAVLNGLAFTVQAAPAAEGFTIRHRAAKTRVLVLTPRSAELHDKLPEKQAADTSKLVLSPMPGLVVSMDVTTGQQVREGEVVCVLEAMKMQNIIRAERDGVVKAVNAKGGDPVAADEVLVEFA

SEQ ID NO: 4610 - DNA, 1344 bp, Clostridium acetobutylicum
  CDS (1)..(1344)
atgataagtaaaattttaattgctaataggggagagatagcagttagaataataagagcctgtagagaaatgggaatagagacagtggctatttattctgaggcagataaagaatcaatgcatgtatatcttgcagatgaagcagtatgtgttggaccagcgaaaactcaagatagctatcttaacataggaaatataataagtgctacagttcttacaaaagcacaagcgatacatccaggctttggttttctatctgagaatggtaagttcgcaaaaatgtgcagtgaatgtaatatagcatttataggaccagatgctgaaaccattgaaaacatgggaaataaagcaaaagcaagagaaataatgataaaggcaggagtaccggtagttccaggatgtgaaggaactattgatagtgaagatcaggctttaaaagaggcaactagaataggatatcctgttatgcttaaagcttcagcaggtggaggcggaagaggtataagaattgtaagagaagaaaaagacctcataagttcctttagaaatgctaaaagcgaagctaaagcagcctttggtgatgattcaatgtatatggaaaagtttatagaagaacctagacatgttgagtttcaaatattaggagattcttttggaaatgtagtttatcttggagaaagagactgctcaattcaaagaagaaaccaaaaagttttagaggaagcaccatcaccagttatgacagaagaacttaggcgtgagatgggagaagcggctgtaagagcagctaaagccgtaaattataaaaatgctggaaccatagaatttctattagataagcatggaaattattacttcatggaaatgaatacaagaattcaggttgaacatggtataactgaaatggttacaggcgttgacctagttaaagagcagataaaaatagcatcaggaaataaattatctttcaatcaaagtgatataaaaattaagggtcatgcaatagagtgtagaataaatgctgaaaatcctgaaaagaactttatgccatcacctggagaaattaagtacttccatgttcctggtggacctggagtaagattagatagcgcagcatatactggatacaatatacctccaaattatgattccatgattggaaagcttatagcatatggcaaggatagagctgaagctataaatataatggagagagctcttggagagttcataattgatggtattgatacaaatgtagacttccagtatgaagtaataaacaatgagaagtttattaagggaaaatataatacaagttttatagaaaaagaattaaaacattga

SEQ ID NO: 4611 - protein, 447 aa, Clostridium acetobutylicum
MISKILIANRGEIAVRIIRACREMGIETVAIYSEADKESMHVYLADEAVCVGPAKTQDSYLNIGNIISATVLTKAQAIHPGFGFLSENGKFAKMCSECNIAFIGPDAETIENMGNKAKAREIMIKAGVPVVPGCEGTIDSEDQALKEATRIGYPVMLKASAGGGGRGIRIVREEKDLISSFRNAKSEAKAAFGDDSMYMEKFIEEPRHVEFQILGDSFGNVVYLGERDCSIQRRNQKVLEEAPSPVMTEELRREMGEAAVRAAKAVNYKNAGTIEFLLDKHGNYYFMEMNTRIQVEHGITEMVTGVDLVKEQIKIASGNKLSFNQSDIKIKGHAIECRINAENPEKNFMPSPGEIKYFHVPGGPGVRLDSAAYTGYNIPPNYDSMIGKLIAYGKDRAEAINIMERALGEFIIDGIDTNVDFQYEVINNEKFIKGKYNTSFIEKELKH

SEQ ID NO: 4612 - DNA, 1335 bp, Aquifex aeolicus
  CDS (1)..(1335)
atgttcaaaagggttttaatagccaacaggggagaaatcgcagtaagggctataagggcgtgtagggaactgggattgaaaactgtggcgatttactcggaggctgacaaaaacagcctccatgtagaactcgcagacgaagctatatgcataggtcctcccgacccttcaaagagttatctcgatattccgaggataatgtccgcactggaagtgagtaaagctgatgcggtgtatcccggctacggatttttatccgagaacccaaaattcgcggaaatcgtagaaaagagcggggcgaagtttataggaccacgctccgaggttctggcgaagattggggataaagttctggcaaagaaggttgcaaaggaagtaggactccctttagttcccggaagcgatgagccccttgagttttctgaagctgtgaaactcgcttcaaagataggttatcccgttgttataaaggctgcggccggaggcggaggaaggggaataagaataataagggatgaaaaagaactgagggaaaagtttcccttagcgaagaaagaggcggaaagtgctttcggagatggtaggctttacatagaaaagtacgtgataaatcccaaacacatagagtttcaggtaattgcggacgaacacggaaacgtgtacgttctcggagaaagggaatgctctattcagagaagacaccagaagttaatagaagaagctccgagtgtttccgtgagtgaagagaaaagaaaggaaatctccgaaaaggtagcggaattttgtaaaagactcggttacacttccgcggggacggttgagttcctgatggacgaagaggggaacttttactttatggaaatgaacggaaggatacaggttgaacacccggtaacggagatggtaacgggtgtggacatagtaaagctccagttaatagcagccatgggagaggagataaaacttgaaaaagtggaaactaatggttttgctatagagttcaggataaacgctgaagatccagtaacttttattccctctcccgggcaggtggaaaaattaatccttcccggaggtccgggagtcagagtagacactcacctgtaccaaggctacacagttccgccctattacgactccctgcttgcaaagataattgtatggggaaatacgcgtcaggaagcgatagcgagaggaaaaagggctctcggagaactaaagattgaaggaaagggattaaaggtcaacacggaatttcaccttagggtacttgatcagaaagagtttatagaaggaaagcacgacataacctttgtggaaaggataatggtttaa

SEQ ID NO: 4613 - protein, 444 aa, Aquifex aeolicus
MFKRVLIANRGEIAVRAIRACRELGLKTVAIYSEADKNSLHVELADEAICIGPPDPSKSYLDIPRIMSALEVSKADAVYPGYGFLSENPKFAEIVEKSGAKFIGPRSEVLAKIGDKVLAKKVAKEVGLPLVPGSDEPLEFSEAVKLASKIGYPVVIKAAAGGGGRGIRIIRDEKELREKFPLAKKEAESAFGDGRLYIEKYVINPKHIEFQVIADEHGNVYVLGERECSIQRRHQKLIEEAPSVSVSEEKRKEISEKVAEFCKRLGYTSAGTVEFLMDEEGNFYFMEMNGRIQVEHPVTEMVTGVDIVKLQLIAAMGEEIKLEKVETNGFAIEFRINAEDPVTFIPSPGQVEKLILPGGPGVRVDTHLYQGYTVPPYYDSLLAKIIVWGNTRQEAIARGKRALGELKIEGKGLKVNTEFHLRVLDQKEFIEGKHDITFVERIMV

SEQ ID NO: 4614 - DNA, 2004 bp, Mycobacterium tuberculosis
  CDS (1)..(2004)
atgggaatcactcgagtattggttgctaaccgcggcgagatcgcccggcgggtgttcgccacctgccgccggctggggctcggcaccgtcgccgtctacacagacccggatgccgcggcaccgcatgtcgccgaggccgacgcccgggtccggctgccgcagaccaccgactatctgaacgccgaggcgatcatcgcggccgcgcaggcagccggagccgacgcggtgcatcccggctacggattcctctcggagaacgccgaattcgcggccgccgtgcaggaggccggcctaacctgggtcgggccaccggtggacgcggtgcgcgcgatgggctccaaaatcgagtccaagaagctgatggccgccgccggggtgccggtgctcgaggaactcgaccccgacgccgtcaccaccgcgcagctgccggtgctggtgaaggcgtcggcgggcggtggcggtcgcggcatgcgagtggttcacgaattatcggccctgccggccgaagtcgaagccgcgcgacgtgaagcccaatccgcgttcggcgacccgaccgtattctgcgagcgctacctgcccaccgggcaccacgtcgaagtgcaagtcatggccgacacccatggcaccgtgtgggcggtcggggaacgggaatgctcgattcagcgccgccaccagaagatcatcgaagaggcaccgtcgccgctggtggaacgcgtaccggggatgcgggccaagctgttcgacgcggcccggctggcggccagcgcgatcggctacaccggggcaggcacggtggagttcctcgccgatgactcacctggccgggaaggtgagttctacttcctggagatgaacacccggctacaggtcgagcacccggtcaccgaagagaccaccgggctggatctggtcgaactgcagctcatgattgccgactgcgggcgactcgacaccgaacctccccccgcccagggatattcgatcgaggcccgcctctacgccgaggatcccgcgcatggctggcagccacaggcaggcgtgatgcacacgattgaggttccgggggttcgggcgcagttcgactcgttgggacagcggaccggcatccggctggattccgggatcgtcgacggttccacagtgtcgatccactacgacccaatgctggccaaggtcgtctcctacggtgccacccgccggcaggccgcgcttgtgttggccgatgcgctggtacgcgcccggctgcacggtctgcgcaccaaccgtgagctcttggtcaacgtgctgcgtcatccggcgttcctcgacggcgccaccgacaccgggtttttcgacacgcacggcatggccgagttgtcgacaccgctggccgacaccgcgaccctccggttgtcggcgatcgccgccgcgctggccgacgccgagcacaatcgggcgagcgcgggcgtgttcagctcgattcccagcggctggcgcaacctggcctcgggctatcaggtcaagacctatcgtgacgacgcggacaccgaacaccgcgtcgaataccggttcaccagaacgggtctggcgcttcccggcgatccggtggtacagctggtctcggctgacgtggaccaggtggtgctcgcccaggacggggtcgcacacggcttcacggttgcccgccacggccccgacgtctacgtcgactcggcgcgcggacccgttcacctggtggcactgtcacgcttccccgagccgagctcggccgtcgagcaaggctcgctggtggcccccatgcccggcaacgtcatccggatcggcgccgaggttggcgacacggtcacggccggtcagccgttgatctggctggaggccatgaagatggaacacaccatcgccgcgcctgccgacggcgtgctcacccacgtcagcgtcaacacgggtcaacaggtcgaagtaggcgccattctcgcacgagtagaagcacctcaaaatggcccagcagaaggagattcaccgtga

SEQ ID NO: 4615 - protein, 667 aa, Mycobacterium tuberculosis
MGITRVLVANRGEIARRVFATCRRLGLGTVAVYTDPDAAAPHVAEADARVRLPQTTDYLNAEAIIAAAQAAGADAVHPGYGFLSENAEFAAAVQEAGLTWVGPPVDAVRAMGSKIESKKLMAAAGVPVLEELDPDAVTTAQLPVLVKASAGGGGRGMRVVHELSALPAEVEAARREAQSAFGDPTVFCERYLPTGHHVEVQVMADTHGTVWAVGERECSIQRRHQKIIEEAPSPLVERVPGMRAKLFDAARLAASAIGYTGAGTVEFLADDSPGREGEFYFLEMNTRLQVEHPVTEETTGLDLVELQLMIADCGRLDTEPPPAQGYSIEARLYAEDPAHGWQPQAGVMHTIEVPGVRAQFDSLGQRTGIRLDSGIVDGSTVSIHYDPMLAKVVSYGATRRQAALVLADALVRARLHGLRTNRELLVNVLRHPAFLDGATDTGFFDTHGMAELSTPLADTATLRLSAIAAALADAEHNRASAGVFSSIPSGWRNLASGYQVKTYRDDADTEHRVEYRFTRTGLALPGDPVVQLVSADVDQVVLAQDGVAHGFTVARHGPDVYVDSARGPVHLVALSRFPEPSSAVEQGSLVAPMPGNVIRIGAEVGDTVTAGQPLIWLEAMKMEHTIAAPADGVLTHVSVNTGQQVEVGAILARVEAPQNGPAEGDSP

SEQ ID NO: 4616 - DNA, 1998 bp, Rickettsia prowazekii
  CDS (1)..(1998)
atgacaaaaccattatttgataaaattttaattgctaaccgtagtgaaattgcagttaggataattcgaactctcaagaaaatgggcatagggtcagttgctgtatattctgaagctgatactaattcaatgtatgtacagcatgcagacgaggcttattatataggtgattctcctgctactgcaagctatttatctgttaaaaaccttatctcagcgattcgtgagagtggagcaagtgctgtacaccccggatacggttttttatcggaaaatccaaattttgctaatattcttaaaagagaaggagtagttttaatagggccaagcgctggaactattaagaaaatgggtgataaaatcgaagcaaagaaaattgcaatagaggctggagtgagtactgttccaggttatatgggtactataaaagatgttaaacaagctatagatattgctaaagaaattggttttccagtaatagtaaaagcaactgccggtggtggtggacgtggtatgagagtggtgaataatccagctgaaatggcaaatgcttttgaatcagcaaagcttgaagctgctaatagttttagtgatgatagattatttattgagaagttaattcaaaccccgcgtcatattgagattcagctaattgcggatcaatatggcaatagtgtatgtctcggagaacgtgaatgttcaatacagcgtcaccatcaaaaagtaattgaagaagcaccaagttcttttattactgaaaatatacggcatgaaatgtatcgacaagtaatatccttgtctcaaaaagttggatattattcggctggtaccgttgaatttatagttgacagcaataaaaatttctattttttagaaatgaatactagattgcaagtagaacatcctgttactgagttaattaccggtatagatatcgttgaagaaatgataaaaattgcagcaggtgagaagttatcatttacccaggatgacataaaattaaaaggttgggcatttgaatcaagaatttgtgctgaaaacccaagtcgagggtttttaccttctagtggtagaattatagcttattctgaacctgcaaagagtcctaatatccgtattgatacagggattgggcttggtggtgaagtaagtatgttttatgactcaatgattgcaaaattatgtacttacggtgaaacacgggagcaggcaattgaggtaatgcgttctgctttaagttcttatataattaatggcatcgctcataatattagtttcttagaagcagtaatgctacatccacgctttgttagcggtgatatttctactgcctttattcaagaagaatatcctgatggtttttctggtgctagtcttacttcagaagtaactaccgtatttctagcaactgctatttttatttatatatcggaacaaagacgcgcttcattaatttctggtaatattaataatcaggctaacaaaataggtacaagatgggtagtaactattgatgataaactattcccagtattaattacacctgttgaaaatggctataatattcgtcacgaaagtgatagaatatatattcgtagtaattggaatttaggtaatgaactttttactgctatgattaacggtaagaagacaaatgtaaaaattgaaaatattagaactggttatttattatcgcatgccggtattagtgtaaaagcttttgtacgctctccgcgtatatcagaacttgaagcgttgatggtttcaaaagtagtgttagaagaaaattctgaactacaagctcctttaagtggtcagattgctgcaataaaagtgaaagaagggcaagaggtgactataggacaggaaattatgattttaactgctatgaaaatggaaaatcttattttagctgaaagagacggaaaaatagctaaaatttttgttaatgaaaaagataatgttgtaagagggaaaatattattagaatttgcttga

SEQ ID NO: 4617 - protein, 665 aa, Rickettsia prowazekii
MTKPLFDKILIANRSEIAVRIIRTLKKMGIGSVAVYSEADTNSMYVQHADEAYYIGDSPATASYLSVKNLISAIRESGASAVHPGYGFLSENPNFANILKREGVVLIGPSAGTIKKMGDKIEAKKIAIEAGVSTVPGYMGTIKDVKQAIDIAKEIGFPVIVKATAGGGGRGMRVVNNPAEMANAFESAKLEAANSFSDDRLFIEKLIQTPRHIEIQLIADQYGNSVCLGERECSIQRHHQKVIEEAPSSFITENIRHEMYRQVISLSQKVGYYSAGTVEFIVDSNKNFYFLEMNTRLQVEHPVTELITGIDIVEEMIKIAAGEKLSFTQDDIKLKGWAFESRICAENPSRGFLPSSGRIIAYSEPAKSPNIRIDTGIGLGGEVSMFYDSMIAKLCTYGETREQAIEVMRSALSSYIINGIAHNISFLEAVMLHPRFVSGDISTAFIQEEYPDGFSGASLTSEVTTVFLATAIFIYISEQRRASLISGNINNQANKIGTRWVVTIDDKLFPVLITPVENGYNIRHESDRIYIRSNWNLGNELFTAMINGKKTNVKIENIRTGYLLSHAGISVKAFVRSPRISELEALMVSKVVLEENSELQAPLSGQIAAIKVKEGQEVTIGQEIMILTAMKMENLILAERDGKIAKIFVNEKDNVVRGKILLEFA

SEQ ID NO: 4618 - DNA, 3276 bp, Deinococcus radiodurans
  CDS (1)..(3276)
atgacgccccgcgtgttgattgccaaccggggcgaggtggccgtccgtatcgagcgggcggtgtcggcactgggctggcagagcgtggccgtttatgccccggacgacgccgggtcgctgcacgtgcgccgggcggacgaggcggtggccctcagcggacgcggggcggcggcctacctcgacggagcggcgctgctgcgggtcgcgcaggaacacgcggcgacccacgttcaccccggctacggcttcctgagcgaaaacgccgacttcgcgcgggcctgcgcgcaggcggggctggtgttcgtggggccggaccccgacacgctcgacctgttcggcgacaagagccgggcgcgggggctggcgcagcgtctcggcgtcccggtgattcccggtacggacggcgcgaccacgctggaggaagcggcggcgttcatgcaggcgcagggaggcgcgccggtcatgctcaaggcctgctcgggcggtggcgggcgcgggatgcgggtggtgcggcaggctggcgacctcgccgccgcgttcgagcaggcgtcacgtgaggcgcggctggcggtggggcagggcgacctctacgccgagcggctcattgagcgggcgcggcacatcgaggtgcaggtggcgggcgacggccagagcgtgacccacctctgggagcgcgactgcaccgtgcagcgccggcaccagaagctgctcgaattcgctccggcgccgcacttgccccaggccgtccgcaccgccctcatcggcgcggccctgcaactcgcgcaggaggtgaagtaccgttgcctcggcaccttcgagtttctggtgacgccgggcggcgacttttatttcatcgaggccaacccgcgtttgcaagtcgagcacaccgtgaccgaggagtggtgcggcaccgacctcgtcacggcccagttgcgcctcgcggcgggcgagactctcacggcggtgggactggcaacgcaacccgccgacgccgcgccgccccccggacaggcggtgcaggcccgcgtgaacatggaaacgctgggcgcggacgggcaggttcatgtcggcggcggtcaggtgcagaccttcaccccgcccggcggtcccggcgtgcgggtggacaccttcgtcaccaccggcctgacccccagcccgcagtacgacgccctgctcgccaaggtcgtcgtccacaggcgcgacgcggcgctgccgggcctactgcggcaagcggcgacggccctgagcgagtttcagattgccggggtcagtaccaacctcgcctttttgcaggcgctgctgcaccaccccgacgtgcagcactacgagctctcgacccactggctcgacgagcggctgccggagctggtcacgcaggcggcggagtatgacgacgtttccgcgtccactcaagctccgacgagcagcgggccgtctcccctgcccgacgccacccccggcaccgagcggctgacggcgcccacgacggggatgctggtcgcctacgacgtgcatccgggccaacgggtgcgccggggcgagtgcctggcggtggtcgaggcgatgaaaatcgagtttcaaatcgaggcgccgcgcgacgggcaggtcgtggcgtgccacctcacggcgggcagcagcgtcaccctgggacagccgctgctcgacctcgctgccgatgagggcgcggacgacgcagtggccgccgaggaggagcgtgacctggatgccctgcctgcctcctacgccgactggcagcggcgcctgcgggcgaccaccgacgaggcgcgccccgctgccgtggaaaagcggcacgcggcgggcaaactgacggcccgcgagaatgtcgccgcgctgctcgacgcgggcagtttcaacgaacacggcgccctggccctggccgcgcaacggggacgccgcagcgaggaagagctgctggcgctcagcccggcagacggcctgattaccggggtgggcacggtcaacgcggggcagtttcccgacaccgccgcctgtgcggtcgcggcctacgactacaccgtgctcgccggcacccaggggtacttcaatcaccacaaactcgaccggctgatcgcgctggctgggcagtggaagtggccgctggtgctgtttgccgagggcggcggcgggcgtccgggcgacaccgacatgccggtggcggcggcgctcgtgacgcccacgttcctgaactttgcggcgctcagcgggcaggtgccgctcgtcggcgtggcggcgggcgcctgcttcgccggcaacgcggcgctgctcggctgctgcgacgtggtcatcgccacccgcgacagcagcatcgggctgggcggccccgccatgatcgagggcggcgggctgggcgtggtcgccgccggggacatcggcccggccgaagtgctggcgcaaaagggcgtcgtggacctgctggccgagaacgacgccgaggccaacgagctggcgcggcgttacctcacctactttcagggtgacgtgaccgggtgggaggccgccgatcagcgcgaactgcgctgggtgattccgcaggtgcgcaagcgggcctacgacgtgcgcgcgctgctgcacctgctcgccgacaccggcagcgtgctggaactgcgccgcgccttcgcgcccggcctgctcacggcgctggtgcggattggcggcaaggcgttcggggtcatcgccaacgacccggcggtgctcggcggcgccatcgacgcggcgggagcggacaaggcggcgcgcttcctcaacctgtgcgacacccaccgcctgccggtgctgtcgctggtggacacgccgggcttcatggtcggcccggcgtcggaggccgagggcgccgtgcggcacgtctcgcgcctgttcgtgcgggcggccaaactcacggtgccattttttgcggtggttacgcgccgcgcttacggcctgggcgcgcaggcgatggctgcggggagcctgcacgcccccgccctgaccgtgtcctggcccggcggcgagttcgggccgatgggcctggaaggcgccgtgcggctgggctaccgccgcgaactggccgccgtgagcgacccccaggagcgcgaggccctttatcagaagctggtcgcgcaggcctacgcccagggcgaagcggtcaacgtggccgcgcacctcgaagtggacgccgtgatcgatcccgccgagacccgcaactggcttttgcgggcgctgcgggtgtctccgtactcggcgcagcgccgggaaggcgggctggtggacccctggtaa

SEQ ID NO: 4619 - protein, 1091 aa, Deinococcus radiodurans
MTPRVLIANRGEVAVRIERAVSALGWQSVAVYAPDDAGSLHVRRADEAVALSGRGAAAYLDGAALLRVAQEHAATHVHPGYGFLSENADFARACAQAGLVFVGPDPDTLDLFGDKSRARGLAQRLGVPVIPGTDGATTLEEAAAFMQAQGGAPVMLKACSGGGGRGMRVVRQAGDLAAAFEQASREARLAVGQGDLYAERLIERARHIEVQVAGDGQSVTHLWERDCTVQRRHQKLLEFAPAPHLPQAVRTALIGAALQLAQEVKYRCLGTFEFLVTPGGDFYFIEANPRLQVEHTVTEEWCGTDLVTAQLRLAAGETLTAVGLATQPADAAPPPGQAVQARVNMETLGADGQVHVGGGQVQTFTPPGGPGVRVDTFVTTGLTPSPQYDALLAKVVVHRRDAALPGLLRQAATALSEFQIAGVSTNLAFLQALLHHPDVQHYELSTHWLDERLPELVTQAAEYDDVSASTQAPTSSGPSPLPDATPGTERLTAPTTGMLVAYDVHPGQRVRRGECLAVVEAMKIEFQIEAPRDGQVVACHLTAGSSVTLGQPLLDLAADEGADDAVAAEEERDLDALPASYADWQRRLRATTDEARPAAVEKRHAAGKLTARENVAALLDAGSFNEHGALALAAQRGRRSEEELLALSPADGLITGVGTVNAGQFPDTAACAVAAYDYTVLAGTQGYFNHHKLDRLIALAGQWKWPLVLFAEGGGGRPGDTDMPVAAALVTPTFLNFAALSGQVPLVGVAAGACFAGNAALLGCCDVVIATRDSSIGLGGPAMIEGGGLGVVAAGDIGPAEVLAQKGVVDLLAENDAEANELARRYLTYFQGDVTGWEAADQRELRWVIPQVRKRAYDVRALLHLLADTGSVLELRRAFAPGLLTALVRIGGKAFGVIANDPAVLGGAIDAAGADKAARFLNLCDTHRLPVLSLVDTPGFMVGPASEAEGAVRHVSRLFVRAAKLTVPFFAVVTRRAYGLGAQAMAAGSLHAPALTVSWPGGEFGPMGLEGAVRLGYRRELAAVSDPQEREALYQKLVAQAYAQGEAVNVAAHLEVDAVIDPAETRNWLLRALRVSPYSAQRREGGLVDPW

SEQ ID NO: 4620 - DNA, 1368 bp, Streptococcus pneumoniae
  CDS (1)..(1368)
atgtttcgaaaaattttaattgccaatcgtggtgaaattgcggttcgtattatccgtgcggcacgtgaattggggattgcgacggtagcggtttattcaactgctgataaggaagctcttcatacgcttttggcagatgaagcagtttgtattggtcctggcaaggcaacagagtcttatctcaatattaatgcagttctatcagctgcagtcttgactgaggcagaagctattcaccctggttttggatttctcagtgaaaattccaaatttgcgaccatgtgtgaagaagtaggtatcaagtttatcggtccatctggtcatgttatggatatgatgggggataagatcaatgcgcgtgctcagatgattaaagcaggtgtgcctgttataccaggttcagatggagaagtgcataactctgaagaagctttgattgttgctgaaaaaattggctatcctgttatgctcaaggcttcagcaggtggaggtggtaaagggattcgtaaggttgaaaaaccagatgacctcgtttctgcctttgaaactgcctctagtgaggccaaggccaattatggcaatggtgccatgtacatagaacgggttatctatccagctcggcacattgaggttcaaatcctaggtgatgagcatggacatgtgattcacttgggtgaacgggattgttctcttcaaaggaataaccaaaaggttttggaagaaagtccctcgattgcaatcggaaaaacgctgcgtcatgaaataggtgctgctgctgttcgagcggcagagtttgttggctatgagaatgcaggaaccattgaatttcttcttgatgaagcaagtagcaatttctatttcatggagatgaatactcgtgttcaggtagaacatccagtaacagagtttgtttcaggtgttgatatcgttaaggaacagatttgcattgcggcaggtcagcctttgtctgttaagcaagaagatattgtcctacgcggtcatgccatcgagtgtcgtatcaatgcagaaaacccagcctttaactttgctccaagtccaggtaagattactaatctctatctgccaagtggtggagttggcttgcgcgtggattcagcagtttatccaggttataccattccgccttattatgatagtatgattgccaaaatcatagtacacggcgaaaatcgttttgacgccttgatgaaaatgcaacgtgccctctatgaattagaaattgaaggagtgcagaccaatgcagatttccagcttgacctcatttcagatcgcaatgtcattgctggggattatgatacttccttcttgatggaaaccttcttacctaaatatcaagaaaaagaataa

SEQ ID NO: 4621 - protein, 455 aa, Streptococcus pneumoniae
MFRKILIANRGEIAVRIIRAARELGIATVAVYSTADKEALHTLLADEAVCIGPGKATESYLNINAVLSAAVLTEAEAIHPGFGFLSENSKFATMCEEVGIKFIGPSGHVMDMMGDKINARAQMIKAGVPVIPGSDGEVHNSEEALIVAEKIGYPVMLKASAGGGGKGIRKVEKPDDLVSAFETASSEAKANYGNGAMYIERVIYPARHIEVQILGDEHGHVIHLGERDCSLQRNNQKVLEESPSIAIGKTLRHEIGAAAVRAAEFVGYENAGTIEFLLDEASSNFYFMEMNTRVQVEHPVTEFVSGVDIVKEQICIAAGQPLSVKQEDIVLRGHAIECRINAENPAFNFAPSPGKITNLYLPSGGVGLRVDSAVYPGYTIPPYYDSMIAKIIVHGENRFDALMKMQRALYELEIEGVQTNADFQLDLISDRNVIAGDYDTSFLMETFLPKYQEKE

SEQ ID NO: 4622 - DNA, 1506 bp, Methanococcus jannaschii
  CDS (1)..(1506)
atgtttaacaaagttttaattgcaaatagaggggagatagcgattagaattataagagcatgttgggagttgggaattaagacagttgcagtttattctgaggcagataagaggtctttacatgctactttggctgatgaagcttactgtataggtcctgctccagcggcaaagagttatttaaacattgatgccatattaaatgtagctgagaaagctaaggttgatgccatccatccaggatatggatttttagctgaaaatgctgaatttgcaagggctgttaaaaaagctggttttgaatttatagggcctaatccagatgctatagaagcaatgggaagtaaaattaacgctaaaaaaatcatgaaaaaagcaggagttcctttaattcctggtagtgagggggctattgaagatattgatgaagcaatagaaatagctgaagctatcggtttccctgtagttgttaaagcttcagctggcggtggcggaatgggaatgagtgttgcatatagcaaagaggagttaaaagaagttattgaatctgcaagaaacattgcaaagagtgcatttggtgacccaacagtatttattgagaaatacttagaaaatccaagacacattgaaatccaattattgggagataagcatgggaatattattcatttaggagatagagagtgttcaatacagaggagacatcagaagttgattgaagaggctccctcaccaataatgactgaagagttaagagaaagaatgggagaagcggcaatcaaagcaggaaaggcaataaattatgacagtgcaggaactgttgagtttttgtatgaaaatggcaacttttacttcttagagatgaatacaagaattcaagttgagcatacagttacagagcaagttactggaatagatttggttaaggcgatgattaaaatagctgctggagaagaattaactttaaagcaggaagatgttaaaataagagggcatgcaattgagtgcagaattaacgcagaagacccattaaatgatttcgttccatgtcctggaaagataaaactatataggtctccaggggggcctggagttaggattgacagtggtgtctatggaggggctgaaattcctccttactatgattcaatgatagctaagctaattacttatggaaatagcagagaggaggcaatagcaagaatgaaaagagctttgagggagtatgttataataggcgttaaaacaaatattccattccatagggctgttttagaggaggagaactttttaaaagggaatatctcaactcactatgtagagcagaatatgcataaattaagagagaaaatggttaaatacgcattagaatcaagagatttatacagtgttgtatcagagaaggtatttgaaaagaataaaaagatagccgccgctgttggtggtttaacaatgtatatatcccaaattatgaaagaaaatgaagtgaataacaaagaatggtaa

SEQ ID NO: 4623 - protein, 501 aa, Methanococcus jannaschii
MFNKVLIANRGEIAIRIIRACWELGIKTVAVYSEADKRSLHATLADEAYCIGPAPAAKSYLNIDAILNVAEKAKVDAIHPGYGFLAENAEFARAVKKAGFEFIGPNPDAIEAMGSKINAKKIMKKAGVPLIPGSEGAIEDIDEAIEIAEAIGFPVVVKASAGGGGMGMSVAYSKEELKEVIESARNIAKSAFGDPTVFIEKYLENPRHIEIQLLGDKHGNIIHLGDRECSIQRRHQKLIEEAPSPIMTEELRERMGEAAIKAGKAINYDSAGTVEFLYENGNFYFLEMNTRIQVEHTVTEQVTGIDLVKAMIKIAAGEELTLKQEDVKIRGHAIECRINAEDPLNDFVPCPGKIKLYRSPGGPGVRIDSGVYGGAEIPPYYDSMIAKLITYGNSREEAIARMKRALREYVIIGVKTNIPFHRAVLEEENFLKGNISTHYVEQNMHKLREKMVKYALESRDLYSVVSEKVFEKNKKIAAAVGGLTMYISQIMKENEVNNKEW

SEQ ID NO: 4624 - DNA, 1521 bp, Archaeoglobus fulgidus
  CDS (1)..(1521)
atgttcagcaaaattcttgtggcaaacagaggggaaatagccgtcagggtgatgagggcctgccgggagcttggaattaagaccgtcggggtttacagctctgcggacaaaagggcctttcacagggtttacgctgacgagtgctactacatcggcaaagctgatccaagagacagctatctcaacattgacagaatcattgaagttgccaagaagtctggagcggaggcaattcaccctggctacggctttctcgcggaaaatgccgagtttgcggaaaggtgcgaagaggagggaatcgttttcatcggaccatctcctgaagttatacgcatcgccggctcgaaggtgaggtcgagagagagcatgcagagggctggagttcctgtcattccgggctcaccgaaaattgataccgttgatgaggcgaaggagtgggcggagaagattggataccccgtagcggtcaaagcttctggaggtggaggcggaataggcattgtagttgtcaacagtcaagaagagcttgaggaagctttcagaaagtcgaaaaagctcggtgagagctacttcaaggactccaccgtttacctcgaaaagtatcttgcgagaccgaggcacatagaggttcagattcttgcagaccagcacggaaacgtcatccatctgggcgagagggagtgcagcatccagaggaggcaccagaagctcatagaggaggctccatctccagcgttgaacgaggaaatgagggaggagctcggaaagcttgcggtgaagggagcgagggaaatcggatacacaaacgccggaaccttcgagtttctttacgagaacggaaacttctacttccttgaaataaactcaaggcttcaggtcgagcacacaataactgaagttgttactggcattgacatcgtgaagtatcagattcgcatcgcttacggtgaggaactcaggcacggacaggaggatgtagccattaggggacacgcaattgagtgcagaataaatgccgaggaccctgtaaacttctatccgagaagcggacggattttgcactacagaagcccgggaggaattgggataagggttgacagcggaatccacatgggctacaggattccggaggagtacgacagcatgatttccaagctcatcgcctacggcgagacgagggaggaggccattgcgaggatgaagagggctctctacgagtacatcatagagggtgtggaaacgaacatccccttccatttcgctgtgctcaacgatgaggagtttgttaggggcaacatccacacgaagttcgtggaagagaggaacattgcggagaaggtaaaggagtacttgaggattttcaggccgataaaggcgaggctcgacgagatattcatggagagcgagtttacatgggaggaaatatccgccatcgtaactgcaatcgacgcatacgagcaggaactggagcgcggaattgaagagagaatctggcaggcaattttcagcctgggagcctga

SEQ ID NO: 4625 - protein, 506 aa, Archaeoglobus fulgidus
MFSKILVANRGEIAVRVMRACRELGIKTVGVYSSADKRAFHRVYADECYYIGKADPRDSYLNIDRIIEVAKKSGAEAIHPGYGFLAENAEFAERCEEEGIVFIGPSPEVIRIAGSKVRSRESMQRAGVPVIPGSPKIDTVDEAKEWAEKIGYPVAVKASGGGGGIGIVVVNSQEELEEAFRKSKKLGESYFKDSTVYLEKYLARPRHIEVQILADQHGNVIHLGERECSIQRRHQKLIEEAPSPALNEEMREELGKLAVKGAREIGYTNAGTFEFLYENGNFYFLEINSRLQVEHTITEVVTGIDIVKYQIRIAYGEELRHGQEDVAIRGHAIECRINAEDPVNFYPRSGRILHYRSPGGIGIRVDSGIHMGYRIPEEYDSMISKLIAYGETREEAIARMKRALYEYIIEGVETNIPFHFAVLNDEEFVRGNIHTKFVEERNIAEKVKEYLRIFRPIKARLDEIFMESEFTWEEISAIVTAIDAYEQELERGIEERIWQAIFSLGA

SEQ ID NO: 4626 - DNA, 3384 bp, Mycobacterium tuberculosis
  CDS (1)..(3384)
atgttttccaaggtgctcgtcgccaatcgcggggagatcgcgatccgggcctttcgtgccgcctacgaactgggcgtcggaaccgtggccgtttatccgtacgaggaccgcaattcgcagcaccgtctcaaggcggacgagtcttaccagatcggcgacatcggtcacccggtgcatgcatacctgtcggtcgacgagatcgtcgcgacggcccgtcgggcgggtgccgacgctatctaccctggctacgggtttctatcggagaatccggatctggctgcggcatgcgcggcggcgggcatcagcttcgtcggtcccagcgccgaagtgcttgagctggctgggaataagtctcgcgccatcgcggcggcccgcgaagccggcttgcccgtgctgatgtcctcggcgccgtcggcctcggtcgacgaactgctgtcggttgcggccggcatgccgtttccgttgttcgtcaaggcagttgccggtggcgggggccggggtatgcgtcgtgtcggcgatatcgcggcgcttccggaggcgatcgaagccgccagccgggaagccgagtcggcgttcggggacccgacggtctatctcgagcaggcagtgatcaatccacgccacatcgaggtgcagattctggcggacaacctcggcgacgtgatccatctctatgagcgtgactgcagtgtgcagcgtcgccatcagaaggtcatcgagctggcgcccgcgccgcacctggacgccgagttgcgttacaagatgtgcgtcgatgcggtcgccttcgcccgccatatcgggtacagctgcgcgggcaccgtcgagttcctgctggacgagcgaggggagtatgtcttcatcgagatgaatccgcgggttcaggtggagcacacggtgaccgaggagattaccgacgtcgacctggtcgccagccagctgcgcattgccgccggggagacgctcgaacaattgggcctgcggcaggaggacatcgcaccgcatggcgccgcactacagtgccggatcaccaccgaggatccggccaacggcttccggccggacacgggccggatcagcgcgttgcgcaccgccggcggtgccggtgtccgcctggacggcagcaccaacctgggcgcagaaatcagcccgtacttcgactccatgctggtcaagctgacctgtcggggccgtgacctccctaccgcagtgagccgtgcgcgccgggcgatcgcggagttccggatccgcggggtatcgacgaatattccgttcctgcaagcggtcctggatgacccggacttccgagcgggccgggtcaccacgtccttcattgatgagcggccgcagctgctgaccgcgcgcgcctcggccgaccgcggcaccaagatccttaacttcctggccgatgtcaccgtcaacaacccgtatggctcgcgtccgtcaacgatctacccggacgacaagctgcccgatcttgatctgcgggccgcaccaccggccgggtccaagcagcgactagtcaagttggggccggaaggatttgctcgttggctgcgggagtcggccgcggtcggggtcaccgataccacattccgggatgctcaccagtcgttactggctacccgagtacgcaccagcggactgtcgcgggtggcaccgtatctcgcgcggaccatgccgcagctgttgtccgtggagtgttggggcggtgcgacttacgatgtggcgctgcgctttctcaaggaggatccctgggaacggctggccacactgcgtgcagcaatgcccaatatctgcttgcagatgctattgcggggccgcaataccgtgggctacacgccgtacccggaaatcgtgacgtcggcgtttgtgcaagaagcaacagccaccggtatcgacatctttcgtatcttcgacgcgctcaacaacatcgagtcgatgcgtccggcgatcgacgcagtacgcgaaacaggttctgcgatagcagaagtcgcgatgtgctacacgggcgaccttaccgatccgggtgaacagctgtacacgctggactactacctgaaactggctgagcagatcgtggacgccggcgcccatgtgctggcgatcaaggatatggctggactgttgcgcccgccggccgctcaaaggttggtcagcgccctgcgcagtcgcttcgacctgcccgttcacctgcacacccacgacacaccgggtggccagctcgccagctatgtggccgcttggcacgccggggccgatgccgtcgacggcgccgccgcgccgctggcgggaacgaccagccagcccgcgctgagctcgatcgttgctgccgctgcccacaccgagtacgacaccggcctgtcgctttcggcggtgtgcgccctggagccgtactgggaggcgttacgaaaagtgtatgcgccgttcgagtctgggttgccggggccgacggggcgggtttatcaccacgagattccgggcggccaactgtccaatctgcgccagcaagcaattgctcttggtctgggagatcgattcgaagagatcgaagaggcctacgcgggcgccgaccgagtgttgggcaggctggttaaggtcacgccaacgtccaaggtggtcggcgatctggcgctggcactggtcggcgccggtgtcagtgcagacgaattcgcctccgatccagcgcgatttggcatcccggaatcggtactcggatttctgcggggcgagctgggtgatccgcccggcgggtggcccgaaccgctgcgcactgcggcgctggccggtcgcggggcggccaggcccactgcgcaattggcggcggacgacgagattgccctatcgtcggtcggagccaagcgtcaggccaccctgaacaggctgttatttcccagtccaacaaaggaattcaatgagcaccgggaagcctacggcgacacgtcgcaattgtcggccaaccagttcttctatggtctgcgccaaggtgaagagcatcgggtgaagctggagcgtggggtggagctgttgatcgggctggaggccatttccgaacccgacgaacgcggcatgcgaacggtgatgtgcatcctcaacgggcagctgcggccggtgctagtgcgcgaccgcagcattgccagtgccgttccggccgccgagaaggccgaccgcggcaatcccggacacatcgccgcgccatttgccggagtcgtcacggtcggggtgtgcgtcggcgagcgggtcggcgccggccaaaccatcgccaccatcgaggcgatgaagatggaagccccgatcaccgccccggttgccggcaccgtggagcgggtggcggtgtcggacaccgcccaggtggagggcggagacctgttggtggtggtgagctga

SEQ ID NO: 4627 - protein, 1127 aa, Mycobacterium tuberculosis
MFSKVLVANRGEIAIRAFRAAYELGVGTVAVYPYEDRNSQHRLKADESYQIGDIGHPVHAYLSVDEIVATARRAGADAIYPGYGFLSENPDLAAACAAAGISFVGPSAEVLELAGNKSRAIAAAREAGLPVLMSSAPSASVDELLSVAAGMPFPLFVKAVAGGGGRGMRRVGDIAALPEAIEAASREAESAFGDPTVYLEQAVINPRHIEVQILADNLGDVIHLYERDCSVQRRHQKVIELAPAPHLDAELRYKMCVDAVAFARHIGYSCAGTVEFLLDERGEYVFIEMNPRVQVEHTVTEEITDVDLVASQLRIAAGETLEQLGLRQEDIAPHGAALQCRITTEDPANGFRPDTGRISALRTAGGAGVRLDGSTNLGAEISPYFDSMLVKLTCRGRDLPTAVSRARRAIAEFRIRGVSTNIPFLQAVLDDPDFRAGRVTTSFIDERPQLLTARASADRGTKILNFLADVTVNNPYGSRPSTIYPDDKLPDLDLRAAPPAGSKQRLVKLGPEGFARWLRESAAVGVTDTTFRDAHQSLLATRVRTSGLSRVAPYLARTMPQLLSVECWGGATYDVALRFLKEDPWERLATLRAAMPNICLQMLLRGRNTVGYTPYPEIVTSAFVQEATATGIDIFRIFDALNNIESMRPAIDAVRETGSAIAEVAMCYTGDLTDPGEQLYTLDYYLKLAEQIVDAGAHVLAIKDMAGLLRPPAAQRLVSALRSRFDLPVHLHTHDTPGGQLASYVAAWHAGADAVDGAAAPLAGTTSQPALSSIVAAAAHTEYDTGLSLSAVCALEPYWEALRKVYAPFESGLPGPTGRVYHHEIPGGQLSNLRQQAIALGLGDRFEEIEEAYAGADRVLGRLVKVTPTSKVVGDLALALVGAGVSADEFASDPARFGIPESVLGFLRGELGDPPGGWPEPLRTAALAGRGAARPTAQLAADDEIALSSVGAKRQATLNRLLFPSPTKEFNEHREAYGDTSQLSANQFFYGLRQGEEHRVKLERGVELLIGLEAISEPDERGMRTVMCILNGQLRPVLVRDRSIASAVPAAEKADRGNPGHIAAPFAGVVTVGVCVGERVGAGQTIATIEAMKMEAPITAPVAGTVERVAVSDTAQVEGGDLLVVVS

SEQ ID NO: 4628 - DNA, 1374 bp, Chlamydia muridarum, Chlamydia trachomatis MoPn
  CDS (1)..(1374)
atgaagaaagttttaattgcaaatagaggcgaaatagctgttcggatcattcgggcatgtcatgatttgggattgtctactgttgccatatattctgtagcagaccaagaagctctacatgtgcttctagctgatgaggctgtttgtattggtgaagcacaggctgccaagtcttatctcaagatcgcaaatattttagctgcttgtgagattaccggagcagatgccgtgcatcctggttatggctttttaagcgaaaatgcaaattttgcgtctatttgtgaaagttgtgggttaacatttattggccctagtgcggaatctatagcaactatgggagataaagttgctgctaagcagttggcaaaaaaaattaagtgtccggtcatccctgggtctgatggtgtcgttaaggatgaagtcgaagggataagaattgctgaaaaaatagggttcccaattgttatcaaagccgtcgcaggaggcggagggcgagggatacgcatcgttagagaaaaagatgaattttatagggcttttactgctgctcgagctgaggctgaatctggctttaacaatcccgatgtgtacattgaaaaatttattgaaaacccaaggcatttagaggtccaggtcattggggataaatacggaaactatgtgtatcttggcgaacgagattgtactgtacaaaggcgtcgacaaaaattaatagaagagactccgagccccattttaacccctgaaatgagagctaaggttgggaaggttgctgttgatttagcaagaagcgcggggtatttttctgttggaactgtggaatttttattagacgcagagaaacgattttacttcatggaaatgaatacccgtattcaggtggaacacactattacggaagaaataacgggaatagacttgctaaaagcacaaattagcgttgcaaaaggagaaaaacttccttggaagcagaagaatattgaatttacaggacatgttattcaatgccgaatcaatgccgaagatccatgtaataattttgctccatctccggggcggttagattactaccttcctccagcaggcccctcagttcgagtagacggagcttgttatagtggttacgcgatacctccttactatgattcaatgattgctaaagtgatcacaaaagggaaaactcgagaagaagcaatagccattatgaaaagagctttaaaggagtttcatattggcggcgttcattccacgattccttttcaccaatttatgttggataatcctaaattcatccactctgattacgatatcaattatgtagatcggcttttagcagaaggcagtacttttttgaagttagcagaaggtgactaa

SEQ ID NO: 4629 - protein, 457 aa, Chlamydia muridarum, Chlamydia trachomatis MoPn
MKKVLIANRGEIAVRIIRACHDLGLSTVAIYSVADQEALHVLLADEAVCIGEAQAAKSYLKIANILAACEITGADAVHPGYGFLSENANFASICESCGLTFIGPSAESIATMGDKVAAKQLAKKIKCPVIPGSDGVVKDEVEGIRIAEKIGFPIVIKAVAGGGGRGIRIVREKDEFYRAFTAARAEAESGFNNPDVYIEKFIENPRHLEVQVIGDKYGNYVYLGERDCTVQRRRQKLIEETPSPILTPEMRAKVGKVAVDLARSAGYFSVGTVEFLLDAEKRFYFMEMNTRIQVEHTITEEITGIDLLKAQISVAKGEKLPWKQKNIEFTGHVIQCRINAEDPCNNFAPSPGRLDYYLPPAGPSVRVDGACYSGYAIPPYYDSMIAKVITKGKTREEAIAIMKRALKEFHIGGVHSTIPFHQFMLDNPKFIHSDYDINYVDRLLAEGSTFLKLAEGD

SEQ ID NO: 4630 - DNA, 1359 bp, Bacillus halodurans
  CDS (1)..(1359)
atgtttaaaaaggtgcttattgccaatcgaggtgagattgcggttcgcatcatccggacgtgtcaaaagttaaacattcgcaccgttgctatttattcagaggcggatgtagattctcttcatgtcaaacatgcagatgaagcttttctcattgggaagcctcctgttgccgaaagctacttaaaggtagacacgattttagaagtggcaaagcaagcaggcgtggacgccattcatccaggctacgggttgttatcggaaaacgctcgttttgctagggcatgtgttgaagcaggaatatcgttcattggtccctcacctgaagtcattgaaagaatggggagcaaaattgctgcaagaaccgcgatgcaaactgcgggtgttcccgtcattccgggttccgatgtggcgctagccgatgaagaggaagcagtacatcttgctcgcaagtttggttatccagtcatgcttaaagcctctgcaggcggtggtggtatcggcatgcagctcgtcagaaatgatgaggaaatgagaaaagcattcgctggcaatcaaaaacgggcgacaagctttttcggagatgggacgatgtttttagaaaaggcggttgaaaacccgcggcacattgaagtgcaaatcgccgcagaccatcatggccacgtcgttcatttatgggaacgggattgttcgatccaacgccgccatcaaaaagtagtcgaggaagcaccgtcaccgttcgtagacgaggcactcagggaaaaaatcggtcagctcgctgtcaaggctgcaaaagcgattgattataggaacctcggaacggtggaatgtctcgtagacggggagaagaacatttactttttagagatgaacacccgtctgcaagtagagcatcccgtgacagaggaaattaccggaatcgatctcgtggaatggcaactattgattgcagcaggtgaacaactaccctacgcccaacatgagattccattgcaagggcacgcgattgaagtgcggatctatgcagaagacccagtgaccttttttccgtcaccagggatgattaaacgatttacgctgccggaaggggaagggattcgtcacgagtatgccatttcagaagggtataaagtgacaccgttttacgacccgatggttgcgaaattgattgtatcagcagacacgcggggagaagccattcagcgactaggcagagcactcaagcaatatgagatcgaaggaatcaaaacgaatattccgatgctaaagcaagtgatcaaccatccagtgtttcaagcaggagaagcaacaacggcatttgtaaccaatcatcttaaagtgaaaacagggaggaatccataa

SEQ ID NO: 4631 - protein, 452 aa, Bacillus halodurans
MFKKVLIANRGEIAVRIIRTCQKLNIRTVAIYSEADVDSLHVKHADEAFLIGKPPVAESYLKVDTILEVAKQAGVDAIHPGYGLLSENARFARACVEAGISFIGPSPEVIERMGSKIAARTAMQTAGVPVIPGSDVALADEEEAVHLARKFGYPVMLKASAGGGGIGMQLVRNDEEMRKAFAGNQKRATSFFGDGTMFLEKAVENPRHIEVQIAADHHGHVVHLWERDCSIQRRHQKVVEEAPSPFVDEALREKIGQLAVKAAKAIDYRNLGTVECLVDGEKNIYFLEMNTRLQVEHPVTEEITGIDLVEWQLLIAAGEQLPYAQHEIPLQGHAIEVRIYAEDPVTFFPSPGMIKRFTLPEGEGIRHEYAISEGYKVTPFYDPMVAKLIVSADTRGEAIQRLGRALKQYEIEGIKTNIPMLKQVINHPVFQAGEATTAFVTNHLKVKTGRNP

SEQ ID NO: 4632 - DNA, 6774 bp, Arabidopsis thaliana (mouse-ear cress)
  CDS (1)..(6774)
atggctggctcggttaacgggaatcatagtgctgtaggacctggtataaattatgagacggtgtctcaagtggatgagttctgtaaagcacttagagggaaaaggccgatccatagtattttgatagctaacaatggaatggcggctgtgaagtttatacgtagtgtcagaacatgggcttatgaaacatttggtacggaaaaagccatattgttggtggggatggcaacccctgaagacatgcggatcaatgcggagcatatcagaatcgctgatcagtttgttgaggttcccggaggaaccaacaataacaattatgctaacgttcagctgattgtggagatggctgaagtaacacgcgtggatgcagtttggcctggttggggtcatgcatctgaaaaccccgaattacctgatgccctagatgcaaaaggaatcatatttcttggtcctccagcatcttcaatggcagcactgggagataagattggttcttcgttgattgcacaagctgctgatgtacccactctgccatggagtggttcccatgttaaaatacctcctaatagcaacttggtaaccatcccagaggagatctaccggcaagcatgtgtctacacaactgaagaagcgattgctagctgtcaagttgtcggttacccagcaatgatcaaagcatcgtggggtggtggtggtaaaggaatcaggaaggttcataatgatgatgaggttagggctctattcaagcaagttcagggtgaggtcccaggctcaccaatattcataatgaaggttgcgtcacagagtcggcatctagaggtccagctgctctgtgacaagcatggaaatgtttcagctctgcatagccgtgattgtagcgtccagagaagacatcaaaagatcatagaggagggtccaattactgtggctccgccagaaactgtcaagaaacttgaacaagcagctagaaggttggctaagagtgttaactatgttggagctgctactgttgagtatctctacagtatggacactggggagtactacttcttagagcttaaccctcgcttacaggttgagcatcctgtcactgagtggattgccgagataaatcttcctgctgcccaagttgctgtggggatgggaattcctctctggcaaatccctgagataagacggttctatggaatagaacatggtggaggttatgattcttggcgaaaaacatctgttgtagccttcccttttgattttgataaagctcaatctataaggccaaaaggtcattgtgtggctgtacgtgtgacaagtgaggatcctgatgacgggttcaaaccaaccagcggtagagttcaggagttgagttttaagagcaagccaaatgtgtgggcgtacttctctgtcaagtctggtggaggcatccacgagttctcggattcccagtttggacatgtttttgcatttggggaatccagagccctggcgatagcgaatatggttcttgggctaaaagaaattcagatccgtggagaaattaggactaacgttgactacacgatcgaccttttacatgcttctgattaccgtgataacaaaattcacactggttggttggatagtaggattgctatgcgggtcagagctgagaggcctccatggtatctctctgttgtcggcggagctctctataaagcatcagcgaccagtgctgctgtggtttcagattacgttggttatctggagaaggggcaaatccctccaaagcatatatctcttgtacattctcaagtgtctctgaatattgaaggaagtaaatatacgattgatgtagtccggggtggatcaggaacctacaggctaagaatgaacaagtcagaagtggtagcagaaatacacactctacgtgatggaggtctgttgatgcagttggatggcaaaagccatgtgatatatgcagaggaagaagctgcaggaactcgtcttctcattgatggaagaacttgtttgctacagaatgaccacgatccatcaaagttaatggctgagacaccgtgcaagttgatgaggtatttgatttccgacaacagcaatattgacgctgatacgccttatgccgaagttgaggtcatgaagatgtgcatgccacttctttcacctgcttcaggagttatccattttaaaatgtctgaaggacaagccatgcaggctggtgaacttatagccaatcttgatcttgatgatccttctgctgtaagaaaggccgaacccttccatggaagtttcccaagattagggcttccaactgcaatatccggtagagttcatcagagatgtgccgcaacattaaatgctgcacgcatgattcttgctggctatgagcataaagtagatgaggttgttcaagacttacttaattgccttgatagccctgaactcccatttcttcagtggcaagagtgctttgcagttctggcgacacgactacctaaaaatctcaggaacatgctagaatcaaagtatagggaatttgagagtatttccagaaactctttgaccaccgatttccctgccaaacttttaaaaggcattcttgaggcacatttatcttcttgtgatgagaaagagagaggtgcccttgaaaggctcattgaaccattgatgagccttgcaaaatcttatgaaggtggtagagaaagtcatgcccgtgttattgttcattctctctttgaagaatatctatcagtagaagaattattcaatgataacatgctggctgatgttatagaacgcatgcgtcagctatacaagaaagatctgttgaaaattgtggatatagtgctctcacaccagggcataaaaaacaaaaacaaactcgttctccggctcatggagcagcttgtttaccctaatcctgctgcttacagagataaacttattcgattctcaacacttaaccatactaactactctgaggtgcgtttgttggcgctcaaggcgagtcaattacttgaacagaccaaactaagtgagcttcgttcaaacattgctagaagcctttcagagttagaaatgtttacagaggacggagaaaatatggatactcccaagaggaaaagtgccattaatgaaagaatagaagatcttgtaagcgcatctttagctgttgaagacgctctcgtgggactatttgaccatagcgatcacacacttcaaagacgggttgttgagacttatattcgcagattataccagccctacgtcgttaaagatagcgtgaggatgcagtggcaccgttctggtcttcttgcttcctgggagttcctagaggagcatatggaaagaaaaaacattggcttagacgatcccgacacatctgaaaaaggattggttgagaagcgtagtaagagaaaatggggggctatggttataatcaaatctttgcagtttcttccaagtataataagtgcagcattgagagaaacaaagcacaacgactatgaaactgccggagctcctttatctggcaatatgatgcacattgctattgtgggcatcaacaaccagatgagtctgcttcaggacagtggggatgaagaccaagctcaggaaagagtaaacaagttggccaaaattcttaaagaggaagaagtgagttcaagcctctgttctgccggtgttggtgtaatcagctgtataattcagcgagatgaaggacgaacacccatgagacattctttccattggtcgttggagaaacagtattatgtagaagagccgttgctgcgtcatcttgaacctcctctgtccatttaccttgagttggataagctgaaaggatactcaaatatacaatatacgccttctcgagatcgtcaatggcatctgtatactgttacagacaagccagtgccaatcaagaggatgttcctgagatctcttgttcgacaggctacaatgaacgatggatttatattgcagcaagggcaggataagcagcttagccaaacactgatctccatggcgtttacgtcgaaatgtgttctgaggtctttgatggatgccatggaggaactggaactgaatgcccataatgctgcaatgaaaccagatcacgcacatatgtttctttgcatattgcgtgagcagcagatagatgatcttgtgcctttccccaggagagttgaagtgaatgcggaggatgaagaaactacagttgaaatgatcttagaagaagcagcacgagagatacatagatctgttggagtgagaatgcataggttgggcgtgtgcgagtgggaagtgcggctgtggttggtgtcctctggactggcatgtggtgcttggagggttgtggttgcaaacgtgacaggccgtacatgcactgtccacatataccgagaagttgaaactcctggaagaaacagtttaatctaccactcaataaccaagaagggacctttgcatgaaacaccaatcagtgatcaatataagcccctgggatatctcgacaggcaacgtttagcagcaaggaggagtaacactacttattgctatgacttcccgttggcatttgggacagccttggaactgttgtgggcatcacaacacccaggagttaagaaaccatataaggatactctgatcaatgttaaagagcttgtattctcaaaaccagaaggttcttcgggtacatctctagatctggttgaaagaccacccggtctcaacgactttggaatggttgcctggtgcctagatatgtcgaccccagagtttcctatggggcggaaacttctcgtgattgcgaatgatgtcaccttcaaagctggttcttttggtcctagagaggacgcgtttttccttgctgttactgaactcgcttgtgccaagaagcttcccttgatttacttggcagcaaattctggtgcccgacttggggttgctgaagaagtcaaagcctgcttcaaagttggatggtcggatgaaatttcccctgagaatggttttcagtatatatacctaagccctgaagaccacgaaaggattggatcatctgtcattgcccatgaagtaaagctctctagtggggaaactaggtgggtgattgatacgatcgttggcaaagaagatggtattggtgtagagaacttaacaggaagtggggccatagcgggtgcttactcaaaggcatacaatgaaacttttactttaacctttgttagtggaagaacggttggaattggtgcttatcttgcccgcctaggtatgcggtgcatacagagacttgatcagccgatcatcttgactggcttctctacactcaacaagttacttgggcgtgaggtctatagctctcacatgcaactgggtggcccgaaaatcatgggcacaaatggtgttgttcatcttacagtctcagatgatcttgaaggcgtatcagcaattctcaactggctcagctacattcctgcttacgtgggtggtcctcttcctgttcttgcccctttagatccaccggagagaattgtggagtatgtcccagagaactcttgcgacccacgagcggctatagctggggtcaaagacaataccggtaaatggcttggaggtatctttgataaaaatagtttcattgagactcttgaaggctgggcaaggacggtagtgactggtagagccaagctcgggggaatacccgttggagttgttgcagttgagacacagactgtcatgcagatcatcccagccgatcctggacagcttgactctcatgaaagagtggttccgcaagcagggcaagtctggtttcctgattcagcggccaagactgctcaagcgcttatggatttcaaccgggaagagcttccattgtttatcctagcgaactggagagggttttcaggtgggcagagagatcttttcgaaggaatacttcaggcaggttcaactatagtagaaaatctgagaacctatcgtcagccagtgtttgtgtacatcccaatgatgggagagctgcgcggtggagcgtgggttgttgttgacagccagataaattcggattatgttgaaatgtatgctgatgaaacagctcgtggaaatgtgcttgagccagaagggacaatagagataaaatttagaacaaaagagctattagagtgcatgggaaggttggaccagaagctaatcagtctgaaagcaaaactgcaagatgccaagcaaagcgaggcctatgcaaacatcgagcttctccagcaacagattaaagcccgagagaaacagcttttaccagtttatatccaaatcgccaccaaatttgcagaacttcatgacacttccatgagaatggctgcaaagggagtgatcaaaagtgttgtggaatggagcggctcgcggtccttcttctacaaaaagctcaataggagaatcgctgagagctctcttgtgaaaaacgtaagagaagcatctggagacaacttagcatataaatcttcaatgcgtctgattcaggattggttctgcaactctgatattgcaaaggggaaagaagaagcttggacagacgaccaagtgttctttacatggaaggacaatgttagtaactacgagttgaagctgagcgagttgagagcgcagaaactactgaaccaacttgcagagattgggaattcctcagatttgcaagctctgccacaaggacttgctaatcttctaaacaaggtggagccgtcgaaaagagaagagctggtggctgctattcgaaaggtcttgggttga

SEQ ID NO: 4633 - protein, 2257 aa, Arabidopsis thaliana (mouse-ear cress)
MAGSVNGNHSAVGPGINYETVSQVDEFCKALRGKRPIHSILIANNGMAAVKFIRSVRTWAYETFGTEKAILLVGMATPEDMRINAEHIRIADQFVEVPGGTNNNNYANVQLIVEMAEVTRVDAVWPGWGHASENPELPDALDAKGIIFLGPPASSMAALGDKIGSSLIAQAADVPTLPWSGSHVKIPPNSNLVTIPEEIYRQACVYTTEEAIASCQVVGYPAMIKASWGGGGKGIRKVHNDDEVRALFKQVQGEVPGSPIFIMKVASQSRHLEVQLLCDKHGNVSALHSRDCSVQRRHQKIIEEGPITVAPPETVKKLEQAARRLAKSVNYVGAATVEYLYSMDTGEYYFLELNPRLQVEHPVTEWIAEINLPAAQVAVGMGIPLWQIPEIRRFYGIEHGGGYDSWRKTSVVAFPFDFDKAQSIRPKGHCVAVRVTSEDPDDGFKPTSGRVQELSFKSKPNVWAYFSVKSGGGIHEFSDSQFGHVFAFGESRALAIANMVLGLKEIQIRGEIRTNVDYTIDLLHASDYRDNKIHTGWLDSRIAMRVRAERPPWYLSVVGGALYKASATSAAVVSDYVGYLEKGQIPPKHISLVHSQVSLNIEGSKYTIDVVRGGSGTYRLRMNKSEVVAEIHTLRDGGLLMQLDGKSHVIYAEEEAAGTRLLIDGRTCLLQNDHDPSKLMAETPCKLMRYLISDNSNIDADTPYAEVEVMKMCMPLLSPASGVIHFKMSEGQAMQAGELIANLDLDDPSAVRKAEPFHGSFPRLGLPTAISGRVHQRCAATLNAARMILAGYEHKVDEVVQDLLNCLDSPELPFLQWQECFAVLATRLPKNLRNMLESKYREFESISRNSLTTDFPAKLLKGILEAHLSSCDEKERGALERLIEPLMSLAKSYEGGRESHARVIVHSLFEEYLSVEELFNDNMLADVIERMRQLYKKDLLKIVDIVLSHQGIKNKNKLVLRLMEQLVYPNPAAYRDKLIRFSTLNHTNYSEVRLLALKASQLLEQTKLSELRSNIARSLSELEMFTEDGENMDTPKRKSAINERIEDLVSASLAVEDALVGLFDHSDHTLQRRVVETYIRRLYQPYVVKDSVRMQWHRSGLLASWEFLEEHMERKNIGLDDPDTSEKGLVEKRSKRKWGAMVIIKSLQFLPSIISAALRETKHNDYETAGAPLSGNMMHIAIVGINNQMSLLQDSGDEDQAQERVNKLAKILKEEEVSSSLCSAGVGVISCIIQRDEGRTPMRHSFHWSLEKQYYVEEPLLRHLEPPLSIYLELDKLKGYSNIQYTPSRDRQWHLYTVTDKPVPIKRMFLRSLVRQATMNDGFILQQGQDKQLSQTLISMAFTSKCVLRSLMDAMEELELNAHNAAMKPDHAHMFLCILREQQIDDLVPFPRRVEVNAEDEETTVEMILEEAAREIHRSVGVRMHRLGVCEWEVRLWLVSSGLACGAWRVVVANVTGRTCTVHIYREVETPGRNSLIYHSITKKGPLHETPISDQYKPLGYLDRQRLAARRSNTTYCYDFPLAFGTALELLWASQHPGVKKPYKDTLINVKELVFSKPEGSSGTSLDLVERPPGLNDFGMVAWCLDMSTPEFPMGRKLLVIANDVTFKAGSFGPREDAFFLAVTELACAKKLPLIYLAANSGARLGVAEEVKACFKVGWSDEISPENGFQYIYLSPEDHERIGSSVIAHEVKLSSGETRWVIDTIVGKEDGIGVENLTGSGAIAGAYSKAYNETFTLTFVSGRTVGIGAYLARLGMRCIQRLDQPIILTGFSTLNKLLGREVYSSHMQLGGPKIMGTNGVVHLTVSDDLEGVSAILNWLSYIPAYVGGPLPVLAPLDPPERIVEYVPENSCDPRAAIAGVKDNTGKWLGGIFDKNSFIETLEGWARTVVTGRAKLGGIPVGVVAVETQTVMQIIPADPGQLDSHERVVPQAGQVWFPDSAAKTAQALMDFNREELPLFILANWRGFSGGQRDLFEGILQAGSTIVENLRTYRQPVFVYIPMMGELRGGAWVVVDSQINSDYVEMYADETARGNVLEPEGTIEIKFRTKELLECMGRLDQKLISLKAKLQDAKQSEAYANIELLQQQIKAREKQLLPVYIQIATKFAELHDTSMRMAAKGVIKSVVEWSGSRSFFYKKLNRRIAESSLVKNVREASGDNLAYKSSMRLIQDWFCNSDIAKGKEEAWTDDQVFFTWKDNVSNYELKLSELRAQKLLNQLAEIGNSSDLQALPQGLANLLNKVEPSKREELVAAIRKVLG

SEQ ID NO: 4634 - DNA, 3237 bp, Caulobacter crescentus
  CDS (1)..(3237)
atgtccctctcccgcgttctgatcgccaaccggggcgagatcgccgtccggatcgcccgcacggcggccgaggcggggctcgagagcgtggccatctacgccgccgacgacgcgcaaagcccgcatgtcagcgccgctgatcacgccgtcgccctgccgggcgcgggggcgcgggcctatctcgacatcgccgccgttgtcgccgccgccaaggcgcagggctgcgacgccctgcatcccggctatggctttctgtcggagaacccccatctcgcccgcgcttgcgccgaggccgggattgtcttcatcggcccttcgcccgagcacctgacgacgttcggcgacaaggccgccgcccgcgccctggccgccgagcgcggcctgccgctgatcccgggaaccggcgcgatcacgctggaggccgcccgcgccttccaggccgagcacggcgcgatcatgctgaaggcccgggccggcggcggcggacgcggcatgcggatggtgctcgaccccggcgaactggacgccgccttcgccgcctgcgaacgcgaagccctggccgcgttcggcgacggcggtctctatgcggaaaagctgatcgagcgcgcccgccacatcgaggtgcagatcgtcggcgacggcgatcaggtgctggccctgggcgatcgcgactgctcgctgcagcggcgcaaccagaagctggtcgagatcgcgccggccgccctccccgacaatctacgcgccgccctggccggctggtccgagcgcctgtgcgccggctatcgcggcctggcgaccgtcgagtttctggtcgacgccgatccgcattcgccctcggggggcgaggccttcttcatcgaggtcaacccgcgcctgcaggtcgagcacacggtcaccgaggaggtcacgggcctggatctggtgcgcctgcagttcgatctcgcggcgggcaagcgcctgggcgagctggagctgaccaacaccccgccgccgttcggcgtggccatccaggcgcggatcaacgccgagaccctgacacctgagggtcaggtgcgcccgtcgaccgggaccttgagcgcctggacgccgccgggcggccccggcgtgcgcgtcgatgcgggcgtcgcggcggggctcaccattggcgcggcctatgacagcctgctggccaaggtgatcgtccggggtcggacgcccagcgaagcggccagccggctggaccgcgccttgaccgagctgaaggtcgccggcgtggcgaccaccgcgccgctggtccgcgccatcctggcccatccgaccgccgtgaccggtgaggcgacgaccaccttcatcgcccagcacgccgagaccctggccgccgaggctcagcgcctgacgcccgagaccacggcgagcgtcacgcgcttcgaggtcctggcgggcgccgagcctgtcgttgcgcctctggcggccacggtcggcgccatcacgatccgcgaaggcgacctcgtccgtccgggtcaggccctggcggtgctggaggcgatgaagatggagcacctggtcagcgccagcgccggcggccgggtggtcaagatcgtcgtccagggcggagcgaccgtcgccgagggccagccgctggtcttcctggagccggcggaggtggagagcgcactcgacggggagaccgtcgaacaagacctggacgcccttcgcccggaccttgccgaggtggtcgcccgccatcgccacaccctggacgaggcccgccccgaggcggtcgccaagcggcgcaagaccggccaccgcaccgcgcgcgagaacatcgacgatctggtcgatccgggcagcttcctggaatacggcgccctggctatcgccgcccagaaacgacggcgctcgaccgaggacctgatcgccaatacgcccgccgacgggctgatcaccggcatcggaaccgtcaacggcgcgctgttcccacccgacaaggcgcggacggcggcgctggcctacgacttcacggtgctggccgggacccagggggcgatgaaccatcgcaagtccgaccggctgatggcgctgatcgctgaccagaagctgcccgtggtctggttcgccgagggcggcggcgggcggcccggcgacaccgacaccacggccgtggcgggcctggacgtgccgaccttccgcagcttcgcccagctgtcgggcctggttcccaagatcgccatcgtcgcaggccgctgcttcgccggcaacgccgccatcgcgggcctttcggagatcatcatcgccacccgcgacagcaacctcggcatgggcggcccggcgatgatcgaaggcggcgggctgggcgtcttccgtccggaagagatcgggccgtcggctcatcagtggaagaacggcgtcatcgacatcctggccgacgacgaggcccatgccacgcggctggccaagcaggcgctgtcctacttccaaggaacgctatcgacctggaccgcacccgaccagcggcgcttgcgccacgcgatcccggagaaccgcctgcgcgtctatgacgtgcgcggcctgatcaaccacctcgtcgacgaaggctcgttcctggagctgcgcggcggcttcgcggcggggatggtcaccggcctgatccggatcgagggccgccccatgggtctgatcgccaatgatccgcgccatctgggcggggccatcgactgcgagggcgccgaaaaggccgcccgcttcctgcaactgtgcgacgccttcgccctgccggtcttgagcctctgcgacacgccgggattcatggtcgggccagacagcgaggacgccgccgccgtgcgccgggtcagccgccagttcatcgccggcgccaagctgcgctcgccgctgttcacgatcgtgacgcgcaagggctatggcctgggggctcaggccatggccggcggcagcttccacagccccgcctttatcgccgcctggcccacgggggagttcggcggcatgggcctcgaaggggcggtcaagttgggctaccgcaaggagctggaagccgagaccgatccggtcaaacagaaggcgctctacgaccagctggtcgcgcggctctacgcggcgggcaaggccaccagcatggcggcggcgctggagatcgacgcggtcattgatcctgccgacacgcggcgctgggtgatcggcggcctggacgcggcggcgggcgtgagccggccgtgggaagtgcgggtggacagcttctga

SEQ ID NO: 4635 - protein, 1078 aa, Caulobacter crescentus
MSLSRVLIANRGEIAVRIARTAAEAGLESVAIYAADDAQSPHVSAADHAVALPGAGARAYLDIAAVVAAAKAQGCDALHPGYGFLSENPHLARACAEAGIVFIGPSPEHLTTFGDKAAARALAAERGLPLIPGTGAITLEAARAFQAEHGAIMLKARAGGGGRGMRMVLDPGELDAAFAACEREALAAFGDGGLYAEKLIERARHIEVQIVGDGDQVLALGDRDCSLQRRNQKLVEIAPAALPDNLRAALAGWSERLCAGYRGLATVEFLVDADPHSPSGGEAFFIEVNPRLQVEHTVTEEVTGLDLVRLQFDLAAGKRLGELELTNTPPPFGVAIQARINAETLTPEGQVRPSTGTLSAWTPPGGPGVRVDAGVAAGLTIGAAYDSLLAKVIVRGRTPSEAASRLDRALTELKVAGVATTAPLVRAILAHPTAVTGEATTTFIAQHAETLAAEAQRLTPETTASVTRFEVLAGAEPVVAPLAATVGAITIREGDLVRPGQALAVLEAMKMEHLVSASAGGRVVKIVVQGGATVAEGQPLVFLEPAEVESALDGETVEQDLDALRPDLAEVVARHRHTLDEARPEAVAKRRKTGHRTARENIDDLVDPGSFLEYGALAIAAQKRRRSTEDLIANTPADGLITGIGTVNGALFPPDKARTAALAYDFTVLAGTQGAMNHRKSDRLMALIADQKLPVVWFAEGGGGRPGDTDTTAVAGLDVPTFRSFAQLSGLVPKIAIVAGRCFAGNAAIAGLSEIIIATRDSNLGMGGPAMIEGGGLGVFRPEEIGPSAHQWKNGVIDILADDEAHATRLAKQALSYFQGTLSTWTAPDQRRLRHAIPENRLRVYDVRGLINHLVDEGSFLELRGGFAAGMVTGLIRIEGRPMGLIANDPRHLGGAIDCEGAEKAARFLQLCDAFALPVLSLCDTPGFMVGPDSEDAAAVRRVSRQFIAGAKLRSPLFTIVTRKGYGLGAQAMAGGSFHSPAFIAAWPTGEFGGMGLEGAVKLGYRKELEAETDPVKQKALYDQLVARLYAAGKATSMAAALEIDAVIDPADTRRWVIGGLDAAAGVSRPWEVRVDSF

SEQ ID NO: 4636 - DNA, 3435 bp, Clostridium acetobutylicum
  CDS (1)..(3435)
atggttaaaaagtttaaaagagtattagtggcaaatagaggagaaatagcaataagaatttttagagcttgtcacgaactaggtataagaactgtggctatatactcagaagaagacaaacttgctctgtttagaactaaggcagatgaatcttatcttataggacaaaacaaaggtccagtagatgcatacttaaatattgatgaaataattaatttagcgttaaaaaaaggggtagacgctatacatcctggatatggatttttatcagaaaactcagagttctctagaagatgtactgaggctggaatagaatttataggtccaactggggatatgatggataagcttggtgataaaattaactcaaagctagcagctaaagcagcaggtgtaaagacgatacctggagttgaaaaaccaatagagacagaacagcaggctattgaattcgcaagaacatgcggatatcctgttatggttaaagcagcagcaggcggcggcggaagaggtatgagaatagttgaaaaagaagaagatttaattgctgcttgtagaagtgcaaaaagtgaagccaaaaaggcttttggaatagaagacatatttatagaaaagtatcttgaaggaccaaaacatattgaagttcaggtgcttggagataagtatggtaatattgttcatttatatgaaagagattgctctgttcaaaggagacatcagaaggtaatagaactaactccagcggtttcaatgtctgaagaaaagagacttgaaatttgtgaagatgcacttaaaatcgcacgatcaataggttatagaagtgcgggaacattagagttcttactagataaacatggaaatcattactttatagaaatgaatcctagagtacaggtagaacacacaataactgaaatggttactggaatagatatagtacaaagtcaaattttaatagcagaaggttataaacttaactcacctgaagtcggaataaatagtcaagaagatatacacgtaaatggctatgctatacagtgtagaataacaacagaagatccgtctaatagttttgctccagacactggaaaaatagatgtctatagaactggttccggttttggtataagacttgatggtggaaatggatttactggtgcggtaataagcccttattatgatagtttacttgttaaatctacttcttggtctaggacttttgaggatgcaataagaaaagctatacgtgctataaaagaaacctacatatcaggggttaaaacaaacatagattttcttataaatgtattgaatcatgaaacatttagaaaaggtttatgtgatacaaactttatagctaataatccagaactttttgaaattacgcctagaatagatactgaattaagagttcttaagtttataggagaaaaagttgtaaatgaaactcatggacataaaattgaagttgatgttccatctgttcctaaatacgagataaaggaaccattaagaggaacaaagcagatacttgatgaaaaaggtcccaaaggtcttgttgaatggataaaggatcaagataaacttctacttactgatacaactatgagagatgcccatcaatcattaatggcaactaggcttagaaccgttgatatggtaaaaatagcaaaggcagaatctgtccttgcaaaggatttattttcaatggaaatgtggggaggagcaacatttgataccgcttatagatttttaaaggaatctccatgggaaagattagagagacttagaaaaagagttcctaacgtattgttccagatgcttttaagaggagctaatgcagtaggatataaaaactatcctgataatgttataagagagtttataaaacaatctagcaaatcaggaatagatgtatttagaatatttgattcattgaattgggtaaagggaatggaagttgccatagatgaagtattaaatcaaggtaaagtagcagaagcttgtatgtgttatacaggtgatatacttgatacaaatagagataaatacactttaaattattatgttaatttagctaaggaaatagagaaatcaggagcacacatcttaggaataaaggatatgtcagcgcttcttaagccatatgctgcccttaaacttataagagcacttaaaaacgaaatatctattcctatacatcttcatacgcatgatacaacaggaaatggtgttgctacggtgttaatggcggctcatgcaggtgttgatatagcagatactgctttcaatagtatgtcaggacttacaagtcaaccagctcttaattcagtagtagcagctcttaaaaacactgacagagacactaagatggatataggagatttacagaagatatctgactattggagtacagtaagacctgtatatagtaaatttgagtctggattaaaagcggtttcggctgaaatatataagtacgagataccaggaggacaatattcaaatttaaaacctcaagttgaaagctttggtttaggccatagatttgagcaagtaaaagagatgtatagagaagtaaatataatgttaggcgatatagtaaaggttactccatcttcaaaaatggtgggagatttagctatatttatggttcaaaatgagttgacgtcagagaatattcttgaaaaagctaaagatatgcctttcccagactctgtagtatcatattttaagggtatgatggggcagcctaagggtggatttccaaaagaacttcaaaaaattgttcttaaggatgaagaagctattacctgcagacctggagagcttttaccagatgaagattttgataagataagagttcgtcttaaaaaagaaaataaaattgaaccgacagataaagatgtaataagttatgcattgtaccctgatgtttttgaagaatacttaaaatataaaaatgagtatggtgatttaagtagaatgggtagtgatgtatttttccatggattagctgaaggtgaaatatctgaacttgagatagcagagggaaaaactttagtagtgcagcttttgcacataggtaaattagataaacaaggaaatagaactcttgtatttgaggttaatggtaatagacgagagattaaaatcaaagataaggttagcagtactaagtctgaaatagttgaagagatagttatagcagatagctccaataaaaaggagataggagcaagtataccaggaaatgtagttaaggtatttgttaaacctggagataaagtaaaaaaaggtgacagccttatggtaatagaggcaatgaaaatggagacaaatgtatcagtaagtgaagatggaactgtaggaggtatatttgttaaagagggggaccaagtacaatcaggacaattattagttaaattagattag

SEQ ID NO: 4637 - protein, 1144 aa, Clostridium acetobutylicum
MVKKFKRVLVANRGEIAIRIFRACHELGIRTVAIYSEEDKLALFRTKADESYLIGQNKGPVDAYLNIDEIINLALKKGVDAIHPGYGFLSENSEFSRRCTEAGIEFIGPTGDMMDKLGDKINSKLAAKAAGVKTIPGVEKPIETEQQAIEFARTCGYPVMVKAAAGGGGRGMRIVEKEEDLIAACRSAKSEAKKAFGIEDIFIEKYLEGPKHIEVQVLGDKYGNIVHLYERDCSVQRRHQKVIELTPAVSMSEEKRLEICEDALKIARSIGYRSAGTLEFLLDKHGNHYFIEMNPRVQVEHTITEMVTGIDIVQSQILIAEGYKLNSPEVGINSQEDIHVNGYAIQCRITTEDPSNSFAPDTGKIDVYRTGSGFGIRLDGGNGFTGAVISPYYDSLLVKSTSWSRTFEDAIRKAIRAIKETYISGVKTNIDFLINVLNHETFRKGLCDTNFIANNPELFEITPRIDTELRVLKFIGEKVVNETHGHKIEVDVPSVPKYEIKEPLRGTKQILDEKGPKGLVEWIKDQDKLLLTDTTMRDAHQSLMATRLRTVDMVKIAKAESVLAKDLFSMEMWGGATFDTAYRFLKESPWERLERLRKRVPNVLFQMLLRGANAVGYKNYPDNVIREFIKQSSKSGIDVFRIFDSLNWVKGMEVAIDEVLNQGKVAEACMCYTGDILDTNRDKYTLNYYVNLAKEIEKSGAHILGIKDMSALLKPYAALKLIRALKNEISIPIHLHTHDTTGNGVATVLMAAHAGVDIADTAFNSMSGLTSQPALNSVVAALKNTDRDTKMDIGDLQKISDYWSTVRPVYSKFESGLKAVSAEIYKYEIPGGQYSNLKPQVESFGLGHRFEQVKEMYREVNIMLGDIVKVTPSSKMVGDLAIFMVQNELTSENILEKAKDMPFPDSVVSYFKGMMGQPKGGFPKELQKIVLKDEEAITCRPGELLPDEDFDKIRVRLKKENKIEPTDKDVISYALYPDVFEEYLKYKNEYGDLSRMGSDVFFHGLAEGEISELEIAEGKTLVVQLLHIGKLDKQGNRTLVFEVNGNRREIKIKDKVSSTKSEIVEEIVIADSSNKKEIGASIPGNVVKVFVKPGDKVKKGDSLMVIEAMKMETNVSVSEDGTVGGIFVKEGDQVQSGQLLVKLD

SEQ ID NO: 4638 - DNA, 1335 bp, Bacillus subtilis
  CDS (1)..(1335)
atgtttacaaaagtactgatcgccaaccgcggtgaaattgcaatgagaattatccgaacatgcagccgtctcggcattaaaacggtcgctgtttattcagaagcagacaaggacgcgccccatacaaaagccgctacagaggcatatttgatcggggaatcgagagtcagtgaaagttatttaaatatagagagaatcataaagacggcgaaaaaagcaaaagccgacgcgatccacccgggatatggattgttatcagaaaacagccggttcgctgaacgctgcaagcaagaaaacatcgtgtttatcggaccttcccctgatatcatcgcaaagatgggcagcaaaattgaagcgcgaaaagcaatggaggctgcaggtgtccctgtggtgccgggcgtttctgaatccctcggagatatagaggcagcctgccgcaccgcaagtcaaatcggctatcctgtcatgctgaaagcttcagcgggcggaggcggcatcggaatgcagcgtgttgaaaatgaagaagcattaaaaaaagcgtacgagggaaacaaaaagcgcgcagcagattttttcggtgacgggtctatgtatatagaaaaagttattgaacatgcgcgccacatcgaggttcagcttttggccgatcaacacggccatacagtacatctgtttgaacgtgattgctctgttcagaggcgccaccaaaaagtcattgaagaagcaccgtctccatttgtagacgatgaactaagaatgaagatcggtcaaacagcggtaaaagcagcgaaggcaatcggctatacgaacgcaggcaccatcgaatttatagttgaccagaaacaaaatttttatttcctcgaaatgaatacgagactgcaagttgaacaccccgtgactgaagaaataacaggcctggacttagttgagcagcagctgcggattgctgcgggccatacactcacattctcccaaaaagacatccaacggaacgggcatgcgatagaggttcgaatatacgcggaagatcccaagaccttcttcccgtcaccaggtacgatcactgcgttttcacttcctgaccaaaaaggagtcagacacgaatgtgcggtagcaaaagacagcaccgttacccctttttatgacccgatgatcgctaagatgattgtcaaaggccaaaccagaacagaagcaattgaaaaactagagacagcgcttcgcgactatcgtgtagagggaatcaaaacaaaccttccgctcctcatacaggctgcggcaacaaaggcatttaaagaaggggatgtcacgactgactttttgaaacagcacctataa

SEQ ID NO: 4639 - protein, 444 aa, Bacillus subtilis
MFTKVLIANRGEIAMRIIRTCSRLGIKTVAVYSEADKDAPHTKAATEAYLIGESRVSESYLNIERIIKTAKKAKADAIHPGYGLLSENSRFAERCKQENIVFIGPSPDIIAKMGSKIEARKAMEAAGVPVVPGVSESLGDIEAACRTASQIGYPVMLKASAGGGGIGMQRVENEEALKKAYEGNKKRAADFFGDGSMYIEKVIEHARHIEVQLLADQHGHTVHLFERDCSVQRRHQKVIEEAPSPFVDDELRMKIGQTAVKAAKAIGYTNAGTIEFIVDQKQNFYFLEMNTRLQVEHPVTEEITGLDLVEQQLRIAAGHTLTFSQKDIQRNGHAIEVRIYAEDPKTFFPSPGTITAFSLPDQKGVRHECAVAKDSTVTPFYDPMIAKMIVKGQTRTEAIEKLETALRDYRVEGIKTNLPLLIQAAATKAFKEGDVTTDFLKQHL

SEQ ID NO: 4640 - DNA, 1365 bp, Chlamydophila pneumoniae, Chlamydia pneumoniae
  CDS (1)..(1365)
atgaaaaaagtcttaatcgctaatagaggggaaattgctgttagaattatacgtgcctgtcatgatttaggattgtcgacagtggctgtatattctttagcagatcaagaggctctccacgtacttcttgctgacgaggctatttgtattggagagcctcaagcagcaaagtcttatttaaagatatccaatatcttggctgcctgtgagatcacaggagctgatgctgtgcatcctggatatgggtttttaagtgaaaacgcaaactttgcttcaatatgcgagagctgtggcttaacctttatagggccgagttcagagtctattgctatgatgggggataagattgctgcgaagtccctggcaaagaaaatcaaatgtcctgttattccaggttctgaaggcattattgaagacgagagcgaaggtttaaaaatagctgaaaaaataggtttccctattgttattaaagccgttgctggaggtgggggaagaggaattcgtattgttaaagaaaaggacgaattctatagagcgttttctgccgcacgtgcagaagccgaagccggttttaataaccccaatgtttatattgaaaagtttatagaaaatccaaggcatttagaaatccaagtcattggggatacccatggaaattatgtgcatttaggagaaagagactgcaccattcaacggcgacgtcaaaagttgattgaagagactcctagtcccattctcaatgcggaaatccgagtcaaagtaggaaaagttgctgtagatctagcaagaagcgccggatatttttctgttggaacagtcgaattcttattagataaagacaaaaaattctactttatggaaatgaatacccgaattcaggtagagcataccattactgaagaagtcacaggtatagatcttgtaaaagaacagattcatgtagccatgggaaataagctgccttggaaacaaaagaacattgagttctcgggtcatatcatccaatgtcgcattaacgctgaggatcctaccaataatttctcaccatctccaggtcgtttagattattatcttcctcctgcaggtccttcaattcgtgtagatggagcttgttatagcggctatgcaatccctccttattatgattctatgatagcaaaggtaattgctaagggcaaaaaccgagaagaagctatagctatcatgaaacgagctttgaaagagtttcatatcggtggtgtgcagtctacaatacctttccaccagtttatgttggataatccgaagtttctagaatctaattacgatattaactatatcgataacctacttgctcaaggaaattctttttttaaagaattctaa

SEQ ID NO: 4641 - protein, 454 aa, Chlamydophila pneumoniae, Chlamydia pneumoniae
MKKVLIANRGEIAVRIIRACHDLGLSTVAVYSLADQEALHVLLADEAICIGEPQAAKSYLKISNILAACEITGADAVHPGYGFLSENANFASICESCGLTFIGPSSESIAMMGDKIAAKSLAKKIKCPVIPGSEGIIEDESEGLKIAEKIGFPIVIKAVAGGGGRGIRIVKEKDEFYRAFSAARAEAEAGFNNPNVYIEKFIENPRHLEIQVIGDTHGNYVHLGERDCTIQRRRQKLIEETPSPILNAEIRVKVGKVAVDLARSAGYFSVGTVEFLLDKDKKFYFMEMNTRIQVEHTITEEVTGIDLVKEQIHVAMGNKLPWKQKNIEFSGHIIQCRINAEDPTNNFSPSPGRLDYYLPPAGPSIRVDGACYSGYAIPPYYDSMIAKVIAKGKNREEAIAIMKRALKEFHIGGVQSTIPFHQFMLDNPKFLESNYDINYIDNLLAQGNSFFKEF

SEQ ID NO: 4642 - DNA, 1410 bp, Xylella fastidiosa
  CDS (1)..(1410)
atggccgttgccttaaggacgccgtacttcggaacctttctcatgttagacaaagtcgttattgccaaccgtggtgagatcgcgttgcgtattcttcgcgcatgccacacgttgggtatccgcacggttgcggttcactctaccgttgatcgcaatctgaagcatgtcgcgatggctgatgagtcggtgtgcattggctctgcaccctctgcggagagttatctcaatatcccggcgctgattgccgctgctgaggtcacggatgctcaggccatccaccctggctatggttttttgtcggaaaacgctagttttgctgaacgtgtggaacagtctggtttcattttcattgggccacgggcagagacgattcgtttaatgggcgacaaggtgcaggcgatccatgcgatgaaagcggctggtgtgccgtgtgtccctggttcggatggtccattgggtgatgacattgtcgctaacgtcaaaattgcacgtgagatcggttatccggtcatcattaaggctgccggcggcggcggtggacgtgggatgcgtgtggtacataccgaggtcggtttaaaggcggctatcgagaccacgcagtctgaagctaaagccgcttttggcaatggccaggtgtatatggaaaagtttctggagaatccgcgtcacgtggagattcaggtgctcgccgatggtcaggggaacgcgatccatttgggggagcgggattgttcgatgcaacgccgccatcagaaggtggtggaggaagcccccgcacccggtatcactgaggcgttgcgcaatgaaatcggtcaagtgtgtgtagatgcctgtattcgtatcggttaccgcggtgccgggacgtttgaatttctgttcgagaatggtcgtttttacttcatcgagatgaatacgcgcatccaggtagagcatccggtgacggagcgtatcactggtattgacttggtatgcgagcagttgcgtattgccgctggtcagccattgagtatcaagcagagcgatgtggtgttgcgtggccatgcgatcgaatgccgtatcaatgctgaggatgctgagacgtttttgcccaatccgggtttgattactgcgttccatccaccaggtggtccgggtgtgcgtatggatacgcatatctacagtggttacaaggtgccgccgaactatgattcgatgatcggcaagctcatcgtgcatggtccggaccgtgagacggcgattgcgcgcatgcatttggcgctgagcgaaatggttgtggatgggatcaagaccaatatcccattgcagcagcgcattatgtgcgataagggtttccagttcggtggacagaacatccattatttggagaagtgtttggcggagcgtaagaaccaaacgatcgggcggacctga

SEQ ID NO: 4643 - protein, 469 aa, Xylella fastidiosa
MAVALRTPYFGTFLMLDKVVIANRGEIALRILRACHTLGIRTVAVHSTVDRNLKHVAMADESVCIGSAPSAESYLNIPALIAAAEVTDAQAIHPGYGFLSENASFAERVEQSGFIFIGPRAETIRLMGDKVQAIHAMKAAGVPCVPGSDGPLGDDIVANVKIAREIGYPVIIKAAGGGGGRGMRVVHTEVGLKAAIETTQSEAKAAFGNGQVYMEKFLENPRHVEIQVLADGQGNAIHLGERDCSMQRRHQKVVEEAPAPGITEALRNEIGQVCVDACIRIGYRGAGTFEFLFENGRFYFIEMNTRIQVEHPVTERITGIDLVCEQLRIAAGQPLSIKQSDVVLRGHAIECRINAEDAETFLPNPGLITAFHPPGGPGVRMDTHIYSGYKVPPNYDSMIGKLIVHGPDRETAIARMHLALSEMVVDGIKTNIPLQQRIMCDKGFQFGGQNIHYLEKCLAERKNQTIGRT

SEQ ID NO: 4644 - DNA, 7080 bp, Arabidopsis thaliana (mouse-ear cress)
  CDS (1)..(7080)
atggagatgagagctttgggttcttcgtgttctactggtaatggaggttctgctccgattaccctcacgaatatatctccatggatcacaacagtttttccgtcgacagtgaagctgagaagtagtttgagaaccttcaaaggagtttcgtcaagagtgagaacctttaaaggagtttcttcgacaagagttttgtctcggaccaaacaacagtttcctctgttttgtttcctaaaccctgatccgatctccttcttggaaaatgatgtatctgaagctgaaaggacagtagttttaccggatggatcggttaacggggctggatctgttaacgggtatcatagtgatgtagtacccggtagaaatgtggctgaggtcaatgagttctgtaaagctcttggagggaaaaggccaatccatagtattctggttgctactaatggaatggcagctgtgaagtttatacgtagtgtcagaacatgggcttacgaaacatttggctcggaaaaagcggtaaagttggtggcaatggcaactcctgaagacatgaggatcaatgcggaacatatcagaattgctgatcagtttgttgaggttccgggaggaactaataataacaattatgctaatgttcagcttattgtggagatggctgaggtcacgcgtgtggatgcagtttggcctggttggggtcatgcatctgagaaccctgaattacctgatgctttaaaggagaaaggaattatatttcttggtcctcctgcagattcaatgatagcattaggggataagattggttcgtcgttgattgctcaagctgctgatgtacctactcttccatggagtggttcccatgttaagatacctccggggagaagtttggtaactgtccccgaggagatatacaagaaagcttgtgtttacacaacagaagaagcaattgctagttgtcaagttgttggttatccagcaatgatcaaagcatcgtggggtggtggtggtaaaggcattaggaaggttcataatgatgatgaggttagggctctattcaagcaagttcaaggtgaggtcccgggctcgccgatatttataatgaaggttgcttcacagagtcgacatttagaggcccagttgctttgtgaccaatatggaaacgtagcagctttgcatagccgtgattgtagcgtccagagaagacaccaaaagatcatagaggaaggtccaatcaccgtagctccgcaagaaaccatcaagaaacttgaacaagcagctagaaggttagctaagagtgttaactatgttggagctgctactgttgagtatctctatagtatggacactggggagtactacttcttagagcttaaccctcgcttacaggttgagcatcctgtaaccgagtggatcgccgaggttaatcttcctgctgctcaagttgctgttgggatgggaattcctctctggcaaatccctgagataagacggttttacggtatggaacatggtggaggatatgattcttggaggaaaacatcggttgtagcctctccttttgattttgatgaagctgaatctttaaggccaaaaggtcattgtgtggctgtacgtgtgacaagcgaggatcctgatgacgggtttaaaccaaccagcggtgaaatacaggaattgagttttaagagcaagccaaatatgtggtcgtacttctctgtcaagtctggtggaggcatccacgagttctcagattcacagtttggtaagttaaatgaaaaatttgggatgctaggacaacatgtttttgcatttggggaatccagatccgtggcgatagcaaatatggttcttgcgctgaaagaaattcaaatccgtggagatattaggactaacgttgactacacgatcgaccttctacatgcttctgattaccgggaaaacaaaatacacactggttggttggacagtaggattgctatgcgggtcagagcagagagacctccatggtatctctctgtagtcggtggggctctttataaagcatctacgaccagttctgctgtagtttcggattacgttggctatctagaaaaggggcaaattcccccaaagcatatatctcttgtgcattctcaagtgtcactgaatattgaaggaagtaaatatacgattgatgtagtccggggtggatcaggaacctacaggctaagaatgagcaactcagaagttgtagcagaaatacacactctacgtgatggaggtctattgatgcagttggatggtaaaagccatgtgatatatgcaaaggaagaagcgacaggaacccgtcttctcattgacggaagaacttgcttactacagaatgatcatgatccttcgaagttgatggctgagacaccatgcaagttgctaaggtacctggtttcagacaacagcagtattgatactgatacgccgtatgcagaagttgaagtcatgaagatgtgcatgccacttatttcacctgcgtcaggagttatccatttcaagttgtctgaaggacaagccatgcaggctggtgaactcatagccaagcttgatcttgatgatccttctgctgtaagaaaggccaaacccttccgtggaagtttcccacgattagggcttccaacggcaatctccggtaaagttcatcagagatgtgctgcaactttaaatgctgcacgtatgattcttgctggctatgatcataaagtagatgaggttcttcaagacttgcttaattgccttgatagccctgaactcccatttcttcagtggcaagagtgctttgcagttctggcgacacgactacctaaagatctcaggaacatgctagaattgaaatacaaggaatttgagattatctccaaaacctccctgaccccagatttccctgccaaactcttaaaaggcatccttgaggctcatctatcttcttgtgatgagaaagagagaggttcccttgaaaggctcattgaaccgttgatgagccttgtgaagtcttatgaaggtggtagagaaagtcatgcccgtcttattgttcattccctctttgaagaatacctatcagttgaagaattattcaatgataacatgctggctgatgttatagaacgcatgcgtcagcaatacaagaaggatcgattaaagattgtcgatatcgtgctttcacaccagggcataatacacaaaaacaaactggttcttcgacttatggagcagcttgtttatcctaatcctgctgcatacagagaaaaacttattcgattctcagcacttaatcatactaattactctcagttggcgctcaaggcgagtcaattgctcgaacagaccaaacgaagcgaacttcgttcaaatattgctagaagcctttcagaattagaaatgtttacagaggctggagaaaatatggatactcccaagaggaagagtgccattagtgaaacgatggaaaatcttgtgagctcatctttagctgttgaagacgctctcgtgggattatttgaccatagcgatcacacacttcaaagacgggttgttgagacttatattcacagattataccagccctatgtcgttaaagaaagtgtgaggatgcagtggcaccagtctggtgtcattgcttcttgggagttcctagaacatttcgaaagaaaaaacactggcccagacgatcacgagatatctgaaaaaggaattgttgcgaagagtagtaagagaaaacgggggactatggttataatcaaatcgctgcagtttctgccgagtataataaatgcatcattgagagaaacaaaccatagccactgtgaatatgcccgagctcctttatctggtaatatgatgcacattgctgttgtgggcatcaacaatcagatgagtctgcttcaggacagtggggacgaggaccaaactcaggaaagagtaaacaagctggccaaaattcttaaagaggaagaagtgagtgtcggtgtgatcagttgtataattcagcgagatgaaggacgaacaccaatgagacattcttttcattggttgatggagaaacagtattatgtagaagagccgttgctgcgacatgttgaacctcctctatctgtataccttgagttggataagcttaaagggtactcaaatatacagtattcgccttcacgagaccgtcaatggcatatgtatagtgttacagacaggccagtgccaatcaaaagaatgttccttagatctcttgttcgacaaactacaatgaatgatgggtttctgttgcagcaagggcaggactaccaacttagccaaacagtgctctccatggcgtttacatcgaaatgcattctgaggtctttgatgaatgcaatggaggaactggaactgaatgcacataatgctgccatgaaaccagaccacgcacatatgttcctatgcatactacgtgagcagcagatagatgatcttgtgccttaccccaggagatttgaagtgaatgcggaggatgaagaaactacagttgagacgatcttagaagaagcaacacaggaaatacataggtctgttggagtgagaatgcatgcattgggtgtttgcgaatgggaagtgcgactgtggttggtgtcctcgggactggcaaatggcgcttggagggtcgtggttgcaaacgtgactggccgtacctgcactgtccatatataccgagaagtggaagctactgggagaaacagtttaatctaccactcaataactaagaagggacctttgcatggaactctgatcaatggtcaatataaaccacttaataatctggacaggaaacgtttagccgcaaggaggagtaacactacttattgctatgacttccccttggcatttgagacagcattggagctgaattgggcatcacaacactcgggagttaggaaaccatgcaagaatagactcatcaacgtcaaagagcttgtattctccaatacagaaggttctttgggtacatctcttattccggttgaacgaccagctggtctcaacgacattggaatggtggcctggatcttagagatgtcgactcctgagtttcctatgggacggaaacttctcattgtcgccaatgatgtcacattcaaagctggttcttttggtcctagagaggacgcatttttccttgctgtgactgaactcgcttgtaccaaaaagcttcccttgatttacttggcagcaaattctggtgcccgactcggtgtagctgaagaagtaaaagcatgcttcaaagttggatggtcggatgaagtttcccccggtaatgattttcagtatatatacctaagctctgaagactatgcaaggattggatcatctgtcattgcgcacgaagtgaagctccctagtggcgaaacaaggtgggtgattgatacaattgttggtaaagaagatggtcttggagttgagaatttaacaggaagtggggcaatagcgggtgcttactcaagggcgtacaatgaaacttttactttaacctttgttagtggaagatcggtcggaattggtgcttaccttgcccgactgggcatgaggtgcatacagagactagaccaaccgatcatcttgaccggcttttctacactcaacaagctgcttggacgtgaggtctatagctctcacatgcaacttggtggcccaaaaatcatggggacaaatggtgttgttcatcttacagtctcagatgatctcgaaggtgtatcagcaattctcaactggctgagctacattcctgcgtatgtgggtggtcctcttcctgttcttgctcctttagatccaccggagagaactgtggagtatatcccagagaactcttgtgacccacgagctgctatagctgggattaacgataatactggtaaatggcttggtggtatctttgataaaaatagctttgttgagactcttgaaggctgggcaaggacggtagtgactggtagagctaagcttgggggaatacccattggagttgttgctgtcgagacacagactgtaatgcatgtcatcccagcagatcctggacagcttgactctcatgaaagagtggttccgcaagcagggcaagtctggtttcctgattcagcagccaagacagctcaagcgctcatggatttcaaccgggaacagcttcctttgtttatcatagcaaactggagaggtttttcaggtgggcaaagagatctttttgaaggaatacttcaggcgggttcagctatagtagaaaatctgagaacatatcggcagccagtgtttgtgtacatcccaatgatgggagaactgcgaggtggagcatgggtggttgttgatagccagataaattcggattatattgaaatgtacgctgatgaaaccgctcgtggaaatgtgcttgagcctgaagggatgatagagataaaatttagaaggaaagagctgttagagtgcatgggaaggttggaccagacgctaatcaatctgaaagcaaatatccaagatgccaagcgaaacaaggcatatgcaaacatcgagcttctccagaaacagattaaaacccgagagaagcaacttttaccagtttatacccaaatcgctaccaaatttgctgaactccatgacacttccatgagaatggctgcaaaaggtgtgatcaaaagtgttgtggaatggagcggctcgcggtcattcttctataaaaagctctatcggagaatcgcagagagctctctagtgaggaacataagaaaagcttctggagacatcttatcatataaatctgctatgggtttgattcaggactggttccgcaaatccgagattgcaaaggggaaagaagaagcttggacggacgaccaactgttctttacatggaaagacaatgttagtaactacgagcagaagctgagcgagttgagaacacagaaactgctgaatcaacttgcagagattgggaattcgtcagatctgcaggctctgccacaaggacttgctaatcttctaaacaaggtggatctttcaagaagagaagagctggtggacgcgattcggaaggtgttgggttga

SEQ ID NO: 4645 - protein, 2359 aa, Arabidopsis thaliana (mouse-ear cress)
MEMRALGSSCSTGNGGSAPITLTNISPWITTVFPSTVKLRSSLRTFKGVSSRVRTFKGVSSTRVLSRTKQQFPLFCFLNPDPISFLENDVSEAERTVVLPDGSVNGAGSVNGYHSDVVPGRNVAEVNEFCKALGGKRPIHSILVATNGMAAVKFIRSVRTWAYETFGSEKAVKLVAMATPEDMRINAEHIRIADQFVEVPGGTNNNNYANVQLIVEMAEVTRVDAVWPGWGHASENPELPDALKEKGIIFLGPPADSMIALGDKIGSSLIAQAADVPTLPWSGSHVKIPPGRSLVTVPEEIYKKACVYTTEEAIASCQVVGYPAMIKASWGGGGKGIRKVHNDDEVRALFKQVQGEVPGSPIFIMKVASQSRHLEAQLLCDQYGNVAALHSRDCSVQRRHQKIIEEGPITVAPQETIKKLEQAARRLAKSVNYVGAATVEYLYSMDTGEYYFLELNPRLQVEHPVTEWIAEVNLPAAQVAVGMGIPLWQIPEIRRFYGMEHGGGYDSWRKTSVVASPFDFDEAESLRPKGHCVAVRVTSEDPDDGFKPTSGEIQELSFKSKPNMWSYFSVKSGGGIHEFSDSQFGKLNEKFGMLGQHVFAFGESRSVAIANMVLALKEIQIRGDIRTNVDYTIDLLHASDYRENKIHTGWLDSRIAMRVRAERPPWYLSVVGGALYKASTTSSAVVSDYVGYLEKGQIPPKHISLVHSQVSLNIEGSKYTIDVVRGGSGTYRLRMSNSEVVAEIHTLRDGGLLMQLDGKSHVIYAKEEATGTRLLIDGRTCLLQNDHDPSKLMAETPCKLLRYLVSDNSSIDTDTPYAEVEVMKMCMPLISPASGVIHFKLSEGQAMQAGELIAKLDLDDPSAVRKAKPFRGSFPRLGLPTAISGKVHQRCAATLNAARMILAGYDHKVDEVLQDLLNCLDSPELPFLQWQECFAVLATRLPKDLRNMLELKYKEFEIISKTSLTPDFPAKLLKGILEAHLSSCDEKERGSLERLIEPLMSLVKSYEGGRESHARLIVHSLFEEYLSVEELFNDNMLADVIERMRQQYKKDRLKIVDIVLSHQGIIHKNKLVLRLMEQLVYPNPAAYREKLIRFSALNHTNYSQLALKASQLLEQTKRSELRSNIARSLSELEMFTEAGENMDTPKRKSAISETMENLVSSSLAVEDALVGLFDHSDHTLQRRVVETYIHRLYQPYVVKESVRMQWHQSGVIASWEFLEHFERKNTGPDDHEISEKGIVAKSSKRKRGTMVIIKSLQFLPSIINASLRETNHSHCEYARAPLSGNMMHIAVVGINNQMSLLQDSGDEDQTQERVNKLAKILKEEEVSVGVISCIIQRDEGRTPMRHSFHWLMEKQYYVEEPLLRHVEPPLSVYLELDKLKGYSNIQYSPSRDRQWHMYSVTDRPVPIKRMFLRSLVRQTTMNDGFLLQQGQDYQLSQTVLSMAFTSKCILRSLMNAMEELELNAHNAAMKPDHAHMFLCILREQQIDDLVPYPRRFEVNAEDEETTVETILEEATQEIHRSVGVRMHALGVCEWEVRLWLVSSGLANGAWRVVVANVTGRTCTVHIYREVEATGRNSLIYHSITKKGPLHGTLINGQYKPLNNLDRKRLAARRSNTTYCYDFPLAFETALELNWASQHSGVRKPCKNRLINVKELVFSNTEGSLGTSLIPVERPAGLNDIGMVAWILEMSTPEFPMGRKLLIVANDVTFKAGSFGPREDAFFLAVTELACTKKLPLIYLAANSGARLGVAEEVKACFKVGWSDEVSPGNDFQYIYLSSEDYARIGSSVIAHEVKLPSGETRWVIDTIVGKEDGLGVENLTGSGAIAGAYSRAYNETFTLTFVSGRSVGIGAYLARLGMRCIQRLDQPIILTGFSTLNKLLGREVYSSHMQLGGPKIMGTNGVVHLTVSDDLEGVSAILNWLSYIPAYVGGPLPVLAPLDPPERTVEYIPENSCDPRAAIAGINDNTGKWLGGIFDKNSFVETLEGWARTVVTGRAKLGGIPIGVVAVETQTVMHVIPADPGQLDSHERVVPQAGQVWFPDSAAKTAQALMDFNREQLPLFIIANWRGFSGGQRDLFEGILQAGSAIVENLRTYRQPVFVYIPMMGELRGGAWVVVDSQINSDYIEMYADETARGNVLEPEGMIEIKFRRKELLECMGRLDQTLINLKANIQDAKRNKAYANIELLQKQIKTREKQLLPVYTQIATKFAELHDTSMRMAAKGVIKSVVEWSGSRSFFYKKLYRRIAESSLVRNIRKASGDILSYKSAMGLIQDWFRKSEIAKGKEEAWTDDQLFFTWKDNVSNYEQKLSELRTQKLLNQLAEIGNSSDLQALPQGLANLLNKVDLSRREELVDAIRKVLG

SEQ ID NO: 4646 - DNA, 3414 bp, Lactococcus lactis subsp. lactis
  CDS (1)..(3414)
atgaaaaaactactcgtcgccaatcgtggagaaatcgccgttcgtgtctttcgtgcctgtaatgaactcggactttctactgtagccgtctatgcaagagaagatgaatattctgttcatcgctttaaagcagatgaatcttatctaatcggtcaaggaaaaaaaccaattgatgcctatttggatattgatgatatcattcgtgttgcccttgaatcaggagcagatgctattcacccaggttatggcctcttatctgaaaatctcgaatttgctaccaaagttcgcgcagcaggtttagtttttgtgggtcctgaacttcatcatttggatattttcggtgataaaattaaagctaaagcagctgccgacgaagcaaaagttccaggaattcccggaacaaatggagcagtagatatcgacggcgctttagaatttgctaaaacttacggttatccagttatgattaaggccgctttaggcggtggtggtcgcggaatgcgagttgcgagtaatgatgctgaaatgcatgatggttatgctagagcaaaatcagaagcaattggagcttttggttctggcgaaatctatgttgaaaaatatattgaaaatccaaaacatattgaagtccaaattcttggagatagtcatggaaatattattcacctccatgagcgtgactgttcagtacaacgacgtaatcaaaaagtcattgaaattgcgccagccgtgggactttcactggacttccgtaacgaaatatgtgaagcagcagtcaaactttgtaaaaatgttggctatgttaatgctggtacagttgagtttcttgttaaagatgataaattttatttcattgaagtaaatccacgtgttcaagttgaacatacaattacggaacttatcacaggtgtagatattgtccaagctcaaattttgattgctcaaggtaaagacttacatagagaaattggacttccagcacagtctgaaattccacttttgggttcagcaattcaatgtcgaatcacaacagaagatccacaaaatggattcttgccagacacaggtaaaattgatacttaccgttcaccaggtggttttggtgtacgtttagatgtcggaaatgcctatgctggatatgaagtaactccatattttgattcacttttagtaaaagtttgtacttttgccaatgaatttagtgacaccgtaagaaaaatggaccgcgttctccatgaattccgtattcgtggtgtcaaaacaaatattcctttcttgattaatgttattgctaatgaaaacttcacaagtggtcaagcaacaacaacctttattgataatacaccaagtctgttcaacttcccacacttacgtgaccgtggaacaaagacgctgcattatttatcaatgattacagtcaatggcttcccagggattgaaaatactgaaaaacgtcattttgaagaaccacgtcaaccccttcttaatcttgaaaagaaaaagacagccaaaaatatcttagatgaacaaggggctgatgctgttgttgattatgttaaaaatacaaaagaagtattattaacagatacaactttacgtgatgctcaccaatccttgcttgctactcgcttacgtttacaagatatgaaaggaattgcccaagcgattgaccaagggctaccagaacttttctcagctgagatgtggggtggtgcaacctttgatgtggcttatcgtttcttgaatgaatcaccatggtatcgtctgcgtaaactacgtaaactcatgccaaataccatgttccaaatgctcttccgtggttcaaatgcagttggttaccaaaactatccagataatgtgattgaagaatttatccgagtagcggcgcatgaaggtatcgatgttttccgtatctttgatagtcttaactggttaccccaaatggaaaaatccattcaagccgttcgcgataatggaaaaattgcagaagcaacaatttgttatacgggagatatcctagacccaagccgaccaaaatataatattcaatactataaagacttagcaaaagaattagaagcaacaggtgctcatatcttggcagttaaagatatggcaggtttattgaaacctcaagctgcttatcgtttgatttcagaattaaaagataccgttgatttgccaattcatttgcatacacacgatacttcaggaaatggaattattacatattctggtgcaactcaagcaggtgtagacattattgacgtagcaacagcgagtcttgctggcggaacatctcaaccatcaatgcaatctatttactatgcacttgaacatggtcctcgccatgcttcaattaatgtaaaaaatgctgaacaaattgaccattattgggaagatgttcgtaaatattatgcaccatttgaagcgggtattacaagtcctcagacagaagtttacatgcatgaaatgcctggtggtcaatacactaacctaaaatctcaggcagcagcagttggtcttggacatcgttttgatgaaatcaaacaaatgtatcgtaaagttaacatgatgtttggagatattattaaagtaactccttcttcaaaagtagttggagatatggctctctttatgattcaaaatgatttaacagaagaagatgtttatgcgcgtggtaacgaacttaatttcccagaatctgtagtatcattcttccgtggagatttaggacaaccagtgggtggcttcccagaagaattacaaaaaattatcgtgaaagataaagccgtaattactgaccgtccaggcttacacgcagaaaaagttgattttgaaactgttaaagcagacctagaacaaaaaattggctatgaaccaggagatcacgaagttatctcatatatcatgtatccacaagttttccttgattatcaaaaaatgcaaagagaatttggagcagttacactacttgacactcctactttcttacatggaatgcgtctcaatgaaaaaattgaagtacaaattgaaaaaggtaaaacactcagcattcgtttagatgaaataggagaacctgacctagctggaaatcgtgttctcttctttaacctaaatggtcaacgtcgagaagtcgtaattaatgaccaatctgtacaaactcaagttgtggctaaacgcaaagccgaaacaggaaatccaaaccaaattggagctactatgccaggttctgttcttgaaattttagttaaagctggtgacaaagttcaaaaaggtcaagccttgatggttactgaagccatgaaaatggaaacaactattgaagcaccatttgatggcgagattgttgaccttcatgtggttaaaggtgaggcaattcaaactcaagacttgttaatcgaaattaattaa

SEQ ID NO: 4647 - protein, 1137 aa, Lactococcus lactis subsp. lactis
MKKLLVANRGEIAVRVFRACNELGLSTVAVYAREDEYSVHRFKADESYLIGQGKKPIDAYLDIDDIIRVALESGADAIHPGYGLLSENLEFATKVRAAGLVFVGPELHHLDIFGDKIKAKAAADEAKVPGIPGTNGAVDIDGALEFAKTYGYPVMIKAALGGGGRGMRVASNDAEMHDGYARAKSEAIGAFGSGEIYVEKYIENPKHIEVQILGDSHGNIIHLHERDCSVQRRNQKVIEIAPAVGLSLDFRNEICEAAVKLCKNVGYVNAGTVEFLVKDDKFYFIEVNPRVQVEHTITELITGVDIVQAQILIAQGKDLHREIGLPAQSEIPLLGSAIQCRITTEDPQNGFLPDTGKIDTYRSPGGFGVRLDVGNAYAGYEVTPYFDSLLVKVCTFANEFSDTVRKMDRVLHEFRIRGVKTNIPFLINVIANENFTSGQATTTFIDNTPSLFNFPHLRDRGTKTLHYLSMITVNGFPGIENTEKRHFEEPRQPLLNLEKKKTAKNILDEQGADAVVDYVKNTKEVLLTDTTLRDAHQSLLATRLRLQDMKGIAQAIDQGLPELFSAEMWGGATFDVAYRFLNESPWYRLRKLRKLMPNTMFQMLFRGSNAVGYQNYPDNVIEEFIRVAAHEGIDVFRIFDSLNWLPQMEKSIQAVRDNGKIAEATICYTGDILDPSRPKYNIQYYKDLAKELEATGAHILAVKDMAGLLKPQAAYRLISELKDTVDLPIHLHTHDTSGNGIITYSGATQAGVDIIDVATASLAGGTSQPSMQSIYYALEHGPRHASINVKNAEQIDHYWEDVRKYYAPFEAGITSPQTEVYMHEMPGGQYTNLKSQAAAVGLGHRFDEIKQMYRKVNMMFGDIIKVTPSSKVVGDMALFMIQNDLTEEDVYARGNELNFPESVVSFFRGDLGQPVGGFPEELQKIIVKDKAVITDRPGLHAEKVDFETVKADLEQKIGYEPGDHEVISYIMYPQVFLDYQKMQREFGAVTLLDTPTFLHGMRLNEKIEVQIEKGKTLSIRLDEIGEPDLAGNRVLFFNLNGQRREVVINDQSVQTQVVAKRKAETGNPNQIGATMPGSVLEILVKAGDKVQKGQALMVTEAMKMETTIEAPFDGEIVDLHVVKGEAIQTQDLLIEIN

SEQ ID NO: 4648 - DNA, 1533 bp, Sulfolobus solfataricus
  CDS (1)..(1533)
atgtcaccctttaataaagttctcgtagccaacagaggagaaattgccataagggttatgaaagccgtaaaagaaatgggaatgaaggcagttgctgtatattctgatgctgataaatatgccccccacgttaaatatgcagatgaagcttattggatagggccacctccagctttagaaagttacttgaatattgaaagaattatcgatgcggcagaaaaggctcatgcagatgctgtacatcccggttatgggttcctttccgaaaacgcgtcttttgtagaagctgttgaaaaagctggaatggttttcataggaccttctgcttctgtaatgaatagaatcaaggacaaattggaaggaaagatgatagctagaaaggctggtgtccccacgtcccctggacctttaacaccaattgaaaatgtagatgaggcgttaaagatagctggagaaataggatatcccataatgttgaaggctgcgggaggtggagcaggagtgggtattataaaggttgataatcctagtgaactagctgaggcttttgaaagaagcaaaagattagcgtactctgcctttggcagggcagaaatttacatagaaaaggctgctataaaaccaaaacacattgaaacgcaattgataggagataagtatggaaattacgtagtcgcctttgaaagagaatgcacaattcaaagaaggaaccaaaagttaatcgaagaagccccctctccatccattaaagaagaggaaagaaaggagattattgaggcgtcaataagatttgggaaagaaattaactactttaccttaggtaccatggagttcgtgttctcaccagttactcgtgaattttacttcttagaaattaataaaagagttcaagtagagcacacagtcactgagttcataactggaatagacttagtcaaattacagataagactagctgctggtgaatatttacctttttctcaagaagacttgaaaataagaggacatgcaatacagtttagaattaacgctgaggacccattaaataacttcacgcctcaatccggatacataacctattataaggaaccaactggtcccggtgtgagagtggatagcggtatagaacttggttcatgggttccaccatattatgatccccttgtttccaagttaattgtttatggacaaagtagagactacgcgattcaagtcggactaagggctctaaacgattataaaataggaggagttaaaactacaattccattatataagttgatcttgcaagatccagacttctgggaaggtaatttcactactgcatatatatctgagaaagcagagtactttacgaccaaattaaaagaagaacaagagatacaaattgcaatagccatttcgatttataataggggattgatgaagaagaaaaaaactgaacagaaagtacccatctcaactagtaatggtaaaagtaattggaaaacttatggtatcatattccaatcctctccaagggtgttgtggtaa

SEQ ID NO: 4649 - protein, 510 aa, Sulfolobus solfataricus
MSPFNKVLVANRGEIAIRVMKAVKEMGMKAVAVYSDADKYAPHVKYADEAYWIGPPPALESYLNIERIIDAAEKAHADAVHPGYGFLSENASFVEAVEKAGMVFIGPSASVMNRIKDKLEGKMIARKAGVPTSPGPLTPIENVDEALKIAGEIGYPIMLKAAGGGAGVGIIKVDNPSELAEAFERSKRLAYSAFGRAEIYIEKAAIKPKHIETQLIGDKYGNYVVAFERECTIQRRNQKLIEEAPSPSIKEEERKEIIEASIRFGKEINYFTLGTMEFVFSPVTREFYFLEINKRVQVEHTVTEFITGIDLVKLQIRLAAGEYLPFSQEDLKIRGHAIQFRINAEDPLNNFTPQSGYITYYKEPTGPGVRVDSGIELGSWVPPYYDPLVSKLIVYGQSRDYAIQVGLRALNDYKIGGVKTTIPLYKLILQDPDFWEGNFTTAYISEKAEYFTTKLKEEQEIQIAIAISIYNRGLMKKKKTEQKVPISTSNGKSNWKTYGIIFQSSPRVLW

SEQ ID NO: 4650 - DNA, 1347 bp, Haemophilus influenzae
  CDS (1)..(1347)
atgttagaaaaagttgtgattgctaaccgcggtgaaattgcactacgcattttacgtgcttgtaaagaattaggtattaaaactgtggcggttcactccactgctgatcgtgatttaaaacacgttttactcgctgatgaaaccatttgtatcggtccagcaccttccgcaaaaagttatttaaatattccagctatcattgctgccgccgaagtaacaggtgcggatgcaattcatcctggatacggtttcttatctgaaaacgctgactttgctgaacaagttgaacgttcaggtttcactttcatcggcccaacagcagatgttattcgtttaatgggcgataaagtttcagctattaaagcgatgaaaaaagcaggcgtgccttgtgtaccaggttcggatggccctgtaagtaatgatattgctaaaaataaagaaatcgccaaacgtattggttatccaatcatcatcaaagcatcaggcggcggcggtggccgaggaatgcgtgttgttcgtagcgaagacgcattagaagaatctattgcgatgaccaaagcagaagcgaaagccgcattcaacaatgatatggtttatatggaaaaatacttagaaaatccacgtcacgtggaaattcaagtattagcagatacccatggaaatgcggtttatttggctgaacgtgactgctcaatgcagcgtcgtcaccaaaaagttgtggaagaagcaccagctccaggtattacagaagaagttcgccgcgatattggctctcgctgtgcaaatgcttgtgtagaaatcggctatcgcggagcgggaacctttgaattcttatatgaaaatggcgaattctactttattgaaatgaatacccgtatccaagtagaacacccagtaacagaaatgattacaggtgtagatttagtgaaagagcaattgcgtattgcagcaggcttgccaatttcctttaaacaagaggacattaaagttaaaggccatgcaatggaatgccgtattaacgcagaagatcccaaaacattcttaccgtctccgggcaaagtaaatcacttacattcgcctggcggtttgggcgttcgttgggattctcatgtttatggtggctatactgtgcctccacattacgactccatgatcgcaaaacttatcacttacggcgatacacgtgaagtggcaatccgtcgtatgcaaaatgccttatctgaaacaattattgatggtatcaaaaccaatatcccacttcatgaattaattcttgaagatgaaaatttccaaaaaggcggaacaaacatccattatttggagaaaaaattaggtatgaatgaataa

SEQ ID NO: 4651 - protein, 448 aa, Haemophilus influenzae
MLEKVVIANRGEIALRILRACKELGIKTVAVHSTADRDLKHVLLADETICIGPAPSAKSYLNIPAIIAAAEVTGADAIHPGYGFLSENADFAEQVERSGFTFIGPTADVIRLMGDKVSAIKAMKKAGVPCVPGSDGPVSNDIAKNKEIAKRIGYPIIIKASGGGGGRGMRVVRSEDALEESIAMTKAEAKAAFNNDMVYMEKYLENPRHVEIQVLADTHGNAVYLAERDCSMQRRHQKVVEEAPAPGITEEVRRDIGSRCANACVEIGYRGAGTFEFLYENGEFYFIEMNTRIQVEHPVTEMITGVDLVKEQLRIAAGLPISFKQEDIKVKGHAMECRINAEDPKTFLPSPGKVNHLHSPGGLGVRWDSHVYGGYTVPPHYDSMIAKLITYGDTREVAIRRMQNALSETIIDGIKTNIPLHELILEDENFQKGGTNIHYLEKKLGMNE

SEQ ID NO: 4652 - DNA, 3462 bp, Bacillus subtilis
  CDS (16)..(3462)
aagggggagaaaagtatgtctcagcaatcgatacaaaaagtattagtagcaaacaggggagaaattgcaatccgaatattccgggcgtgtaccgagttgaatattcgtacagttgcggtctattcaaaagaagattccggttcctaccatcggtacaaagcggatgaagcatacttggtcggtgaagggaaaaaaccgattgatgcttacctggatattgaaggtatcattgatattgcgaaaagaaacaaagtcgatgcaattcatccgggatacggtttcttatctgaaaatattcattttgcgagacgatgtgaagaagaaggcatcgtattcatagggccaaaatccgagcatctcgatatgtttggtgacaaggtaaaagcgcgtgagcaggcagaaaaagcgggaatccccgtgattccgggaagcgacggtcctgccgaaacgcttgaagccgtcgaacaatttggacaagctaacggttatccgatcatcattaaagcctcgcttggcggcggcggccgcggtatgcggattgtcagatctgaaagtgaagttaaagaagcatatgagcgtgctaaatcagaggcgaaagcagcctttggcaatgatgaagtttatgtagaaaaattaattgagaatccgaaacatattgaggttcaggtcattggagacaagcagggcaatgtcgtccatctttttgagagggattgctccgttcaaagacgccatcaaaaagtcattgaagtggcgccgagtgtctcgctgtcacctgaattaagggaccaaatttgtgaggctgcagttgcgcttgccaaaaatgtaaactatataaatgcggggacggtcgaattccttgttgcaaacaacgagttctactttattgaagtaaatcctcgcgtacaagttgaacacacgataacagaaatgattactggtgtcgatattgttcaaactcagatccttgttgcccaagggcacagccttcacagcaaaaaagtaaatattcctgagcaaaaggacatttttacaatcggctatgccattcagtcacgggttacgactgaggatccgcaaaatgatttcatgcctgatacaggaaaaatcatggcttaccgctcaggcggcggttttggtgtccgtcttgataccggaaacagcttccagggcgccgtgatcacaccatactatgattcacttctcgttaagctttcaacttgggctttaacgtttgaacaggcagctgccaaaatggtgcgaaaccttcaggagtttagaatcagaggcataaaaacgaacattccgttccttgagaacgttgcaaagcatgagaagttcctgacagggcaatatgatacatctttcattgatacaacgcctgaattatttaatttccctaaacaaaaagaccgcggaacgaaaatgctcacttacatcggcaatgtgacagtgaacggcttccctggaatcgggaaaaaagaaaaaccggcgtttgacaaaccgttaggcgtaaaggtagacgttgatcagcagcctgccagaggaacaaagcaaattctcgatgaaaaaggtgcagaagggcttgcaaattgggttaaggagcagaaatctgtccttttaactgatacgacattcagggatgcccaccaatcgttattggcaactagaatcagatcgcatgatttgaaaaaaatcgcaaatccgacggctgcgttatggcctgaactattcagtatggaaatgtggggaggcgcgaccttcgatgtagcctaccgattcctgaaagaagatccgtggaaacgtttggaagatcttcgcaaagaagtgccgaataccttattccagatgttgcttcgctcatcaaatgcggtcggctatacgaattatccggacaatgtgattaaagaatttgtgaagcaatcagctcaatccggtattgatgtgtttcgtattttcgacagcttaaactgggtaaaagggatgacgttagccattgatgctgttagggataccggcaaagtggcagaagctgcgatttgttatacgggagatatccttgacaagaaccggacgaagtacgaccttgcatattatacatcgatggcgaaggagcttgaggcggccggagcccatattctcgggattaaagatatggcagggctgttaaaaccgcaggctgcatatgagctcgtttctgcgttgaaagaaacgatcgacattccggttcaccttcatacgcatgatacgagcggaaacggtatttatatgtatgcgaaagctgttgaagccggcgttgatatcatagacgtggcggtcagctcaatggcgggattaacgtcacagcctagcgcgagcggattttatcatgcgatggaaggcaacgaccgccgtccggaaatgaatgtccaaggcgttgaattgctgtcccaatattgggagtcggtgcgtaaatattatagtgaatttgaaagcggaatgaagtctccgcatactgaaatttatgaacacgaaatgccagggggccaatacagcaacctgcagcagcaagccaagggagtaggccttggcgaccgctggaacgaagtcaaggaaatgtacagacgcgtgaacgatatgttcggtgacatcgtcaaggtaacgccttcctcaaaagtagtcggagatatggcactctacatggtgcaaaacaatctgactgaaaaagacgtttacgaaaaaggtgaatctttagatttccctgattctgtcgtggagctttttaaaggaaatatcggccagcctcatggcggattcccagaaaaactgcaaaagctgatcttaaaagggcaggagccgattacagtcagaccgggcgaactgcttgagccggtgtcatttgaagcgatcaaacaggaatttaaagagcagcataacttggaaatttcagatcaggatgctgtggcatatgccctttatcctaaagtcttcactgattatgtgaaaacgacagaaagctatggagacatctcggtattagatacaccgacattcttctacggtatgacattaggtgaagagatagaagttgaaattgagcgcggcaaaacgctgatcgttaagctgatttcaatcggtgagcctcagcctgatgccacccgcgtcgtttatttcgaactcaacgggcagccgcgtgaagtagtcattaaagatgaaagcattaagtcttccgttcaggaaaggctgaaagcagaccggacaaatccaagccacatcgcagcttccatgcctggaacagttattaaggtattggctgaagcaggcacaaaagtcaataaaggtgatcatttgatgattaatgaagcgatgaaaatggaaacaacggttcaggcgcctttctcaggaacaatcaagcaggttcatgtgaaaaatggtgagccgatccaaacgggagatctgctccttgaaattgaaaaagcataa

SEQ ID NO: 4653 - protein, 1148 aa, Bacillus subtilis
MSQQSIQKVLVANRGEIAIRIFRACTELNIRTVAVYSKEDSGSYHRYKADEAYLVGEGKKPIDAYLDIEGIIDIAKRNKVDAIHPGYGFLSENIHFARRCEEEGIVFIGPKSEHLDMFGDKVKAREQAEKAGIPVIPGSDGPAETLEAVEQFGQANGYPIIIKASLGGGGRGMRIVRSESEVKEAYERAKSEAKAAFGNDEVYVEKLIENPKHIEVQVIGDKQGNVVHLFERDCSVQRRHQKVIEVAPSVSLSPELRDQICEAAVALAKNVNYINAGTVEFLVANNEFYFIEVNPRVQVEHTITEMITGVDIVQTQILVAQGHSLHSKKVNIPEQKDIFTIGYAIQSRVTTEDPQNDFMPDTGKIMAYRSGGGFGVRLDTGNSFQGAVITPYYDSLLVKLSTWALTFEQAAAKMVRNLQEFRIRGIKTNIPFLENVAKHEKFLTGQYDTSFIDTTPELFNFPKQKDRGTKMLTYIGNVTVNGFPGIGKKEKPAFDKPLGVKVDVDQQPARGTKQILDEKGAEGLANWVKEQKSVLLTDTTFRDAHQSLLATRIRSHDLKKIANPTAALWPELFSMEMWGGATFDVAYRFLKEDPWKRLEDLRKEVPNTLFQMLLRSSNAVGYTNYPDNVIKEFVKQSAQSGIDVFRIFDSLNWVKGMTLAIDAVRDTGKVAEAAICYTGDILDKNRTKYDLAYYTSMAKELEAAGAHILGIKDMAGLLKPQAAYELVSALKETIDIPVHLHTHDTSGNGIYMYAKAVEAGVDIIDVAVSSMAGLTSQPSASGFYHAMEGNDRRPEMNVQGVELLSQYWESVRKYYSEFESGMKSPHTEIYEHEMPGGQYSNLQQQAKGVGLGDRWNEVKEMYRRVNDMFGDIVKVTPSSKVVGDMALYMVQNNLTEKDVYEKGESLDFPDSVVELFKGNIGQPHGGFPEKLQKLILKGQEPITVRPGELLEPVSFEAIKQEFKEQHNLEISDQDAVAYALYPKVFTDYVKTTESYGDISVLDTPTFFYGMTLGEEIEVEIERGKTLIVKLISIGEPQPDATRVVYFELNGQPREVVIKDESIKSSVQERLKADRTNPSHIAASMPGTVIKVLAEAGTKVNKGDHLMINEAMKMETTVQAPFSGTIKQVHVKNGEPIQTGDLLLEIEKA

SEQ ID NO: 4654 - DNA, 1803 bp, Mycobacterium tuberculosis
  CDS (1)..(1803)
atggctagtcacgccggctcgaggatcgctcggatctctaaggttctcgtcgccaatcgcggcgagatcgcagtgcgggtgatccgggcggcccgcgacgccggcctgcccagcgtggcggtgtacgccgaacccgacgccgagtccccgcatgttcggctggccgacgaggcgttcgcgctgggcggccagacctcggcggagtcctatctggacttcgccaagatcctcgacgcggcagccaagtccggggccaacgccatccaccccggctacggcttcctagcggaaaatgccgacttcgcccaggcggtgatcgacgccggcctgatctggatcggccccagcccgcagtcgatccgcgacctgggcgacaaggtcacggcccgtcacatcgcggcccgcgctcaggcgcccctggtgccgggtacccccgatccggtcaaaggcgccgacgaggtggtggcattcgccgaggagtacggcctgccgatcgcgatcaaggccgcccacggcggcggcggcaagggcatgaaggtggcccgcaccatcgacgagattccggagctgtacgagtcggcggtgcgcgaggccacggccgcgttcggccgcggtgagtgctacgtggagcgctatctcgacaagccgcgccacgtcgaagcacaggtgatcgccgaccagcacggcaacgtcgtcgtcgccggcacccgggactgctcgctgcagcgccgctaccagaagctggtcgaggaggcgcccgcaccgttcctgaccgactttcaacgcaaagagatccacgactcggccaaacggatttgcaaagaggcccattaccacggcgccggcaccgtcgaatacctggtcggtcaggacggcttgatctcgttcttggaggtcaacacgcgccttcaggtagaacacccggtcaccgaggaaaccgcgggcatcgacttggtgctgcagcaattccggatcgccaacggcgaaaagctggacatcaccgaggatcccaccccgcgcgggcacgccatcgaattccggatcaacggcgaggacgcggggcgtaacttcctaccggcgcccgggccggtgacaaagttccacccgccgtccggccccggtgtgcgggtggactccggtgtcgagaccggctcggtgatcggcggccagttcgactcgatgctggccaagctgatcgtgcacggtgccgaccgcgccgaggcgctggcgcgggcccggcgcgcgctgaacgagttcggtgtcgaaggcctggcgacggtcatcccgtttcaccgcgccgtggtgtccgacccggcattcatcggcgacgcgaacggcttttcggtacatacccgctggatcgagaccgagtggaataacaccatcgagccctttaccgacggcgaacctctcgacgaggacgcccggccgcgtcagaaggtggtcgtcgaaatcgacggtcgccgcgtcgaagtctcgctgccggctgatctcgcgctgtccaatggcggcggttgcgacccggtcggtgtcatccggcgcaagcccaagccgcgcaagcggggtgcgcacaccggcgcggcggcctccggtgacgcggtgaccgcgcctatgcagggcaccgtagttaagttcgcggtcgaagaagggcaagaggtcgtggccggcgacctagtggtggtcctcgaggcgatgaagatggaaaacccggtcaccgcgcataaggatggcaccatcaccgggctggcggtcgaggcgggcgcggccatcacccagggcacggtgctcgccgagatcaagtaa

SEQ ID NO: 4655 - protein, 600 aa, Mycobacterium tuberculosis
MASHAGSRIARISKVLVANRGEIAVRVIRAARDAGLPSVAVYAEPDAESPHVRLADEAFALGGQTSAESYLDFAKILDAAAKSGANAIHPGYGFLAENADFAQAVIDAGLIWIGPSPQSIRDLGDKVTARHIAARAQAPLVPGTPDPVKGADEVVAFAEEYGLPIAIKAAHGGGGKGMKVARTIDEIPELYESAVREATAAFGRGECYVERYLDKPRHVEAQVIADQHGNVVVAGTRDCSLQRRYQKLVEEAPAPFLTDFQRKEIHDSAKRICKEAHYHGAGTVEYLVGQDGLISFLEVNTRLQVEHPVTEETAGIDLVLQQFRIANGEKLDITEDPTPRGHAIEFRINGEDAGRNFLPAPGPVTKFHPPSGPGVRVDSGVETGSVIGGQFDSMLAKLIVHGADRAEALARARRALNEFGVEGLATVIPFHRAVVSDPAFIGDANGFSVHTRWIETEWNNTIEPFTDGEPLDEDARPRQKVVVEIDGRRVEVSLPADLALSNGGGCDPVGVIRRKPKPRKRGAHTGAAASGDAVTAPMQGTVVKFAVEEGQEVVAGDLVVVLEAMKMENPVTAHKDGTITGLAVEAGAAITQGTVLAEIK

SEQ ID NO: 4656 - DNA, 1344 bp, Vibrio cholerae
  CDS (1)..(1344)
atgttagataaagttgtcatcgcgaaccgaggcgaaattgcgcttcgtattcttcgcgcttgtaaagaattaggcattaaaacggttgccgtgcactccacggctgaccgcgacttaaaacacgtactgctggcggatgagtctatctgtatcggtcctgccaaaagcatcgacagttacctgaacattccacgcattatctctgcggcggaagtcacgggcgcagtagctatccacccgggttacggctttttgtctgaaaacgcagactttgctgagcaagtggagcgcagcggcttcatttttgtcggccctcgcgccgaaaccatccgcttgatgggtgacaaagtctccgccatcaacgcgatgaaaaaagcgggcgtaccttgtgtaccgggttcagacggcccactggataacgacgaagcgaaaaacaaagcgcacgccaaacgcatcggctacccagttattatcaaagcctctggcggcggcggtggtcgcggtatgcgtgtcgtacgtaacgaagccgaattgaccaaatctatccagatgacgcgtgcggaagcgaaagccgccttcaacaacgacatggtgtacatggagaaattcctagaaaacccacgtcacgttgaagtgcaagtgatcgctgacggtcaaggcaatgcaattcacctcgctgagcgtgactgttcaatgcagcgccgtcaccagaaagtggtggaagaagcacccgcaccgggtatcactgaagaaatgcgtaagttcatcggtgaacgttgtacccgtgcgtgtatcgaaatcggctaccgcggcgctggtacctttgaattcctgtacgaaaacggtgagttctacttcattgagatgaacacgcgtattcaggttgagcacccagtaacagaaatgattactggcgttgacctaatcaaagagcagctgcgtatcgccgcgggtcaaccgctgtctttcaaacaagaagacatcaaaattcgcggccatgccgttgagtgtcgtattaacgcggaagatccagagcgcttcctaccttgcccaggcaagattgaacgcttccatgcacctggcggcatgggtgtgcgttgggaatcacacatttactctggctacaccgtacccgcgcattacgactcgatgatcggcaaactcatcacttacggtgagaaccgcgatgtggcgattgctcgtatgcgtaacgcactcaatgagatgattgtggaagggatcaaaaccaatatcccactacaacaagctatcatggcagatgagaacttccagaaaggcggtaccaacatccactatctggagaaaaaactcggcatcaagtaa

SEQ ID NO: 4657 - protein, 447 aa, Vibrio cholerae
MLDKVVIANRGEIALRILRACKELGIKTVAVHSTADRDLKHVLLADESICIGPAKSIDSYLNIPRIISAAEVTGAVAIHPGYGFLSENADFAEQVERSGFIFVGPRAETIRLMGDKVSAINAMKKAGVPCVPGSDGPLDNDEAKNKAHAKRIGYPVIIKASGGGGGRGMRVVRNEAELTKSIQMTRAEAKAAFNNDMVYMEKFLENPRHVEVQVIADGQGNAIHLAERDCSMQRRHQKVVEEAPAPGITEEMRKFIGERCTRACIEIGYRGAGTFEFLYENGEFYFIEMNTRIQVEHPVTEMITGVDLIKEQLRIAAGQPLSFKQEDIKIRGHAVECRINAEDPERFLPCPGKIERFHAPGGMGVRWESHIYSGYTVPAHYDSMIGKLITYGENRDVAIARMRNALNEMIVEGIKTNIPLQQAIMADENFQKGGTNIHYLEKKLGIK

SEQ ID NO: 4658 - DNA, 1356 bp, Staphylococcus aureus
  CDS (1)..(1356)
atgaaaaaggttttaattgcaaaccgcggtgaaatcgcagttaggattattcgcgcttgtcgtgatttaggcatccaaactgttgcaatctattctgaaggggataaagatgcgctacatactcaaattgctgatgaagcatattgcgtaggtcccactttgtctaaagattcatatttaaatattccgaacatcttatctattgcaacttctacaggttgtgatggcgttcatccgggttatggctttttagctgaaaatgctgattttgcagaattatgcgaagcatgccaattgaagttcattggaccaagttatcaatctatccaaaaaatgggtatcaaagatgttgctaaggcagaaatgatcaaagccaatgttccagttgttcctggtagtgacggtttaatgaaagacgtctcagaagctaagaaaatcgccaaaaaaattggctatccggtcatcattaaagctactgctggcggtggcggaaaaggtatccgtgttgctcgtgatgaaaaagaacttgaaactggcttccgaatgacagaacaagaagctcaaactgcatttggtaatggtggactttatatggagaaattcatcgaaaacttccgccatattgaaatccaaattgttggggacagctatggtaatgtaattcatttaggagaacgtgattgtacaattcaaagacgtatgcagaaattagtggaagaagcaccttccccaattttagatgatgaaacacgtcgtgaaatgggaaatgccgcagttcgtgcagcgaaagctgtaaattatgaaaatgcgggaacaattgagtttatatatgatttaaatgataataaattttattttatggaaatgaatacacgtattcaagtagaacatcctgtaactgaaatggtaacaggaattgatttagttaaattacaattacaagttgctatgggtgacgtgttaccgtataaacaagaagatattaaattaacaggacacgcaattgaatttagaattaatgctgaaaatccttacaagaactttatgccatcaccaggtaaaattgagcaatatcttgcaccaggtggatatggtgttcgaatagagtcagcatgttatactaattatacgataccgccatattatgattcgatggtagcgaaattaatcatacatgaaccgacacgagatgaagcgattatggctggcattcgtgcactaagtgaatttgtggttcttggtattgatacaactattccattccatattaaattattgaataacgatatatttagaagcggtaaatttaatacaaactttttagagcaaaatagcattatgaatgatgaaggttaa

SEQ ID NO: 4659 - protein, 451 aa, Staphylococcus aureus
MKKVLIANRGEIAVRIIRACRDLGIQTVAIYSEGDKDALHTQIADEAYCVGPTLSKDSYLNIPNILSIATSTGCDGVHPGYGFLAENADFAELCEACQLKFIGPSYQSIQKMGIKDVAKAEMIKANVPVVPGSDGLMKDVSEAKKIAKKIGYPVIIKATAGGGGKGIRVARDEKELETGFRMTEQEAQTAFGNGGLYMEKFIENFRHIEIQIVGDSYGNVIHLGERDCTIQRRMQKLVEEAPSPILDDETRREMGNAAVRAAKAVNYENAGTIEFIYDLNDNKFYFMEMNTRIQVEHPVTEMVTGIDLVKLQLQVAMGDVLPYKQEDIKLTGHAIEFRINAENPYKNFMPSPGKIEQYLAPGGYGVRIESACYTNYTIPPYYDSMVAKLIIHEPTRDEAIMAGIRALSEFVVLGIDTTIPFHIKLLNNDIFRSGKFNTNFLEQNSIMNDEG

SEQ ID NO: 4660 - DNA, 2004 bp, Agrobacterium tumefaciens
  CDS (1)..(2004)
atgatcaagaaaatcctcatcgccaatcgcggcgagatcgcctgccgggtgatcaagacggcgaagaagatgggcatcgccaccgttgcggtctattcggatgcggatgccaatgcgctgcatgtgaaaatggcggatgaagctgttcatatcggtccagcgccctcgtcgcagtcctatatagtcatcgataaaatccttgaggcgattcagaagaccggggcggatgcggtccatcccggttatggtttcctgtctgaaaatgccgccttcgctcaggcgctagagaaggcaggcgttgtattcatcggcccgcccgttggtgcgatcgaggcgatgggtgacaagatcacctcgaagaaactggccgcaaaagccggcgtttccaccgtgcccggccatatggggctgatcgaggatgcggatgaggcggtgaagatcgcgtcgcagatcggttatcccgtcatgatcaaggcctctgccggcggcggcggtaagggcatgcgcatcgccttcaacgaagccgaggcgcgggaaggcttccagtcctcgaagaacgaggcgaaatcctcctttggcgatgaccgtatcttcatcgaaaaattcgtcacccagccgcgccatattgaaattcaggtgttgggcgacaagcacggcaccattctttatctcggtgagcgcgaatgctcgatccagcgccgcaaccagaaggtcatagaagaagcgccgtcgccctttctggatgaggcgacgcggcacgccatgggcgagcaggccgtggcgctggcgagagcggttggttaccattcggctggcacggtggaattcatcgttgatggcgagcgcaatttctatttcctcgaaatgaacacccgcctgcaggtggaacatccggtgacggagcttgtcaccggcattgatctggtcgagcagatgatccgtgtggcatcgggcgaaaaactctctctcgcgcagggggatgtgaagctgaacggctgggcgatcgaaagccggctttatgccgaagacccctatcgcaacttcctgccctccattggccggctgacgcgttatcgcccaccgggagagggtgcacaggacagtggcaccgtcatccgcaatgataccggcgttttcgaaggcggcgaaatctcgatgtattacgatccgatgatcgccaagctgtgcagctggggcaaggatcgggagaccgccatcgatgccatgggagaggcgctggatcgtttcgaggttgagggtattggccacaatttgccgttcctgtccgccgtcatgcaacatgaacgttttcgctccggccggctgacgacaggctttatcgcggaagaatttccggaaggcttttccgggatcgagccggacgagaccgctgcacgcaagctttccgcaattgccgccatagtcaatcaacgcttgcagagccgcgcggttgaaatttccggcaccatcggcaatcaccgtcgcatcgtcggccatgactgggtggtttcgtttggcgcattccgccacgggatcagcgttgaaaccgttgcggatggcacggcggtccgttttgaagacggaatggccttgaccattgataccggctggcgtcccggccagagccttggcctcttcacggtggcgggcgaggtcatcgccgccaaggtcgatcttgccggcgcagcggttcgcctgcgctggcgcggcatggatattcttgcccgggtgcgcagcccgcgcgtggcggaactggcactgctgatgccggaaaaactgccgccggatacctcgaaactgctgctctgcccgatgccgggcgtcattaccggcatttcggtgggtgagggtgaggaggtggaggccggccaggcgctggcgacggtggaggccatgaagatggaaaacatcctgcgcgcggaaaaacgtggtcgtgttgtaagagtggcggcaaaaccgggcgacagccttgcagtggatgaggtcatcctcgaattcgagtga

SEQ ID NO: 4661 - protein, 667 aa, Agrobacterium tumefaciens
MIKKILIANRGEIACRVIKTAKKMGIATVAVYSDADANALHVKMADEAVHIGPAPSSQSYIVIDKILEAIQKTGADAVHPGYGFLSENAAFAQALEKAGVVFIGPPVGAIEAMGDKITSKKLAAKAGVSTVPGHMGLIEDADEAVKIASQIGYPVMIKASAGGGGKGMRIAFNEAEAREGFQSSKNEAKSSFGDDRIFIEKFVTQPRHIEIQVLGDKHGTILYLGERECSIQRRNQKVIEEAPSPFLDEATRHAMGEQAVALARAVGYHSAGTVEFIVDGERNFYFLEMNTRLQVEHPVTELVTGIDLVEQMIRVASGEKLSLAQGDVKLNGWAIESRLYAEDPYRNFLPSIGRLTRYRPPGEGAQDSGTVIRNDTGVFEGGEISMYYDPMIAKLCSWGKDRETAIDAMGEALDRFEVEGIGHNLPFLSAVMQHERFRSGRLTTGFIAEEFPEGFSGIEPDETAARKLSAIAAIVNQRLQSRAVEISGTIGNHRRIVGHDWVVSFGAFRHGISVETVADGTAVRFEDGMALTIDTGWRPGQSLGLFTVAGEVIAAKVDLAGAAVRLRWRGMDILARVRSPRVAELALLMPEKLPPDTSKLLLCPMPGVITGISVGEGEEVEAGQALATVEAMKMENILRAEKRGRVVRVAAKPGDSLAVDEVILEFE

SEQ ID NO: 4662 - DNA, 1434 bp, Aquifex aeolicus
  CDS (1)..(1434)
atgtttagaaaagttctcgttgccaacaggggtgaagttgcggtaaggataataagggcctgtaaagagctgggaataaaaacagttgcgatatattcggaagcggatgtgcgttccctccacgttaaaaaagcagatgaagcttacctcattacgggagatccgataagggcttaccttgattacgtgagaatagttgaccttgcaaagcaggtgggggcggatgccattcacccgggttatggctttttggcggaaaacgccgactttgcgcgttactgcaggaggagggggataacttttataggccctactcccgaacaaatagagatgttcggagataaagtaaaggctaaaaaggttatgaaggaggtggggctccctacaatacctggaacggaagagccagtaagaactcttgaagatgcaaaacacgccgttaaggagataggtttccccgtgatgctgaaagccgcttacggcggtggcggtagggggatgagagttattagaaacgaggaagaacttgaaaagaacttcgagagcgcgttcagggaagcggaaaccttcttcggaaaaggagacctatttatagaaaagtacgtggaaaacccaaaacacatagaagttcaaatcctcggagataagtacggaaacataatacacctaggagaaagagattgttcaattcagaggagacaccagaagttaatcgagatagccccgtcccctaaactccctcaggatctcaggatgaaaatcctcggaaacgccgtaagggcgatgacaagagtaggatacgaaaacgcaggaacacttgagtttttggtggacctcaaaacgggagagtattacttcattgagatgaatacaagacttcaggtggaacacacaattacggaagcaattacgggagtggacatagttgaagcgatgataaggatagcggcgggagaacctttgccttacctccaaagcgatataactttcaggggatacgcaatagagttcaggataaatgctgaagatcctaagaaaaactttgcacctgcacccggtaaaattacctcttattactcccccggagggcctggtgtaagaatagacgcctccgtttacaaggactacattatcccgccctactacgattccatgattgcaaagatgacagtatgggcactaacatgggaaaaggctgtggcaagggcaaggagagcacttgatgagttcgtagtgaggggagttcccacgaatatacccctctacagggaaatagtaagagaccccgacttcttaaagggagacttcggaacaaggttcttggaagagaaaatagcgaagggagagtacgactttgaaatagaaggcgaaaagcccatggaagacgtagttcttgcaatatcggcggctatagcagcccactacggactttaa

SEQ ID NO: 4663 - protein, 477 aa, Aquifex aeolicus
MFRKVLVANRGEVAVRIIRACKELGIKTVAIYSEADVRSLHVKKADEAYLITGDPIRAYLDYVRIVDLAKQVGADAIHPGYGFLAENADFARYCRRRGITFIGPTPEQIEMFGDKVKAKKVMKEVGLPTIPGTEEPVRTLEDAKHAVKEIGFPVMLKAAYGGGGRGMRVIRNEEELEKNFESAFREAETFFGKGDLFIEKYVENPKHIEVQILGDKYGNIIHLGERDCSIQRRHQKLIEIAPSPKLPQDLRMKILGNAVRAMTRVGYENAGTLEFLVDLKTGEYYFIEMNTRLQVEHTITEAITGVDIVEAMIRIAAGEPLPYLQSDITFRGYAIEFRINAEDPKKNFAPAPGKITSYYSPGGPGVRIDASVYKDYIIPPYYDSMIAKMTVWALTWEKAVARARRALDEFVVRGVPTNIPLYREIVRDPDFLKGDFGTRFLEEKIAKGEYDFEIEGEKPMEDVVLAISAAIAAHYGL

SEQ ID NO: 4664 - DNA, 1368 bp, Helicobacter pylori
  CDS (1)..(1368)
atgaataaagaaaataaaaaggtggaaaaaaaagaactttcgcgcattttgatcgctaataggggcgagatcgctttaagagcgatccaaaccattcaagaaatgggtaaagaatccatagccatttattctatcgctgacaaggacgcccactatctcaatacggctaacgcaaaagtgtgtatagggggggcaaaatccagcgagagttacttgaatatccctgcgatcatcagcgcggcggaattgtttgaagccgatgcgattttccctgggtatgggtttttgagtgaaaatcaaaactttgtagagatttgctcgcaccattctttagagtttattggcccaagcgcaaaagtcatggctttaatgagcgataaagctaaagccaaaatcgtgatgaaagaagccggcatgcctgtgattgagggcagtgatgggttgcttaaaagctatcaagaagctgaagaaatcgctgataaaatcggttatcctgtcatcattaaagcggccgctggtgggggcggaaggggaatgcgcgtcgtaggagataaatccaagcttaaaaacctctatctagccgcagaaacggaagctttgagcgcgtttggcgatgggagcgtgtatttagaaaaatttatcaacaagcccaagcacattgaagtccaaattctagccgacaagcatggcaatgtcattcatgtaggcgaaagggattgttcggtgcaaagacgccagcaaaagctcattgaagaaaccccggcggtggttttagaagaaagcgtgcgtaagcgtttgctagaaacagcgatcaaggccgctaaatacatcggctatgtgggggcggggacttttgaatttttgcttgattctaacatgaaagatttttatttcatggagatgaacactcgtttgcaagtggaacacaccattagcgaaatggtgagcgggttaaacctcattgagtggatgattaaaatcgctcaaggcgaagaattgcccaagcaagaaagcttttctctcaaagggcatgcgatagaatgccgaatcacagcagaagatcctaaaaaattctacccaagcccgggcaaaatcaccgaatggatcgcccctggtggggtgaatgtgcgccttgattcgcatgcgcatgccaattatgtcgtgcctacgaactatgattccatgataggcaagctcattgtgtggggtgaaaacagagaaagagcgatcgctaagatgaaaagggctttaaaggaatttaaagtagaaggcattaaaacgaccattccttttcatattgaaatgcttgaaaatgcggatttcaggcaagcaaaaatccacacgaagtatttagaagaaaatttttaa

SEQ ID NO: 4665 - protein, 455 aa, Helicobacter pylori
MNKENKKVEKKELSRILIANRGEIALRAIQTIQEMGKESIAIYSIADKDAHYLNTANAKVCIGGAKSSESYLNIPAIISAAELFEADAIFPGYGFLSENQNFVEICSHHSLEFIGPSAKVMALMSDKAKAKIVMKEAGMPVIEGSDGLLKSYQEAEEIADKIGYPVIIKAAAGGGGRGMRVVGDKSKLKNLYLAAETEALSAFGDGSVYLEKFINKPKHIEVQILADKHGNVIHVGERDCSVQRRQQKLIEETPAVVLEESVRKRLLETAIKAAKYIGYVGAGTFEFLLDSNMKDFYFMEMNTRLQVEHTISEMVSGLNLIEWMIKIAQGEELPKQESFSLKGHAIECRITAEDPKKFYPSPGKITEWIAPGGVNVRLDSHAHANYVVPTNYDSMIGKLIVWGENRERAIAKMKRALKEFKVEGIKTTIPFHIEMLENADFRQAKIHTKYLEENF

SEQ ID NO: 4666 - DNA, 1332 bp, Campylobacter jejuni
  CDS (1)..(1332)
atggaaattaaaagcatattaattgctaatcgtggagaaatagcactgcgtgctttaagaacgattaaagaaatgggtaaaaaagcaatttgtgtgtattctgaagcagataaagatgctttgtatttaaaatacgctgatgcaagcatttgtataggtaaggcaagaagttctgaaagttatttaaatatcccagctatcatcgcagcggctgaaatagcagaagctgatgcgatttttccaggatacggatttttaagtgaaaatcaaaattttgttgaaatttgtgctaaacataacatcaaatttataggtccttctgtggaagctatgaatttaatgagtgataaatcaaaagcaaaacaagtcatgcaaagagcaggcgtacctgtgatcccaggaagcgatggggctttggcaggagctgaagcagctaaaaaacttgccaaagaaataggttatcctgtgattttaaaagcagctgcaggtggtggtggtcgtggtatgcgtgtggttgaaaatgaaaaagatcttgaaaaagcgtattggtcggctgaaagcgaggctatgacagcatttggcgatggaactatgtatatggaaaaatacatacaaaatccacgccatatagaagtgcaggttataggagatagttttggcaatgtgattcatgtgggcgaaagagattgttctatgcaaagacgccatcaaaaacttatagaagaatcccctgcgattttgcttgatgaaaaaacacgcactaggcttcatgaaactgctattaaggcagctaaagctataggatatgaaggtgcgggaacttttgagtttttagtagataaaaatttagacttttattttatagaaatgaatacgcgtttgcaagttgaacactgtgtaagtgaaatggtaagtgggattgatatcatagaacaaatgattaaagtagcagaaggttatgccttaccatctcaagaaagtattaagcttaatgggcattctatagaatgtagaatcacagctgaagattctaaaaccttcttgccaagtccaggtaagattactaaatacattccacccgcaggacgcaatgtaagaatggaaagtcattgttatcaagactatagcgtgcctgcttattatgattctatgataggcaaacttgtagtttgggcagaagatcgtaataaagctattgcaaagatgaaagtagctttagatgagttgcttataagtgggataaaaacgactaaagattttcatctttccatgatggaaaatcctgattttattaataataattacgatacaaattatcttgcaagacattaa

SEQ ID NO: 4667 - protein, 443 aa, Campylobacter jejuni
MEIKSILIANRGEIALRALRTIKEMGKKAICVYSEADKDALYLKYADASICIGKARSSESYLNIPAIIAAAEIAEADAIFPGYGFLSENQNFVEICAKHNIKFIGPSVEAMNLMSDKSKAKQVMQRAGVPVIPGSDGALAGAEAAKKLAKEIGYPVILKAAAGGGGRGMRVVENEKDLEKAYWSAESEAMTAFGDGTMYMEKYIQNPRHIEVQVIGDSFGNVIHVGERDCSMQRRHQKLIEESPAILLDEKTRTRLHETAIKAAKAIGYEGAGTFEFLVDKNLDFYFIEMNTRLQVEHCVSEMVSGIDIIEQMIKVAEGYALPSQESIKLNGHSIECRITAEDSKTFLPSPGKITKYIPPAGRNVRMESHCYQDYSVPAYYDSMIGKLVVWAEDRNKAIAKMKVALDELLISGIKTTKDFHLSMMENPDFINNNYDTNYLARH

SEQ ID NO: 4668 - DNA, 1833 bp, Halobacterium sp. NRC-1
  CDS (1)..(1833)
atgttcgagaaggtactcgttgccaaccgcggcgagatcgcggtgcgtgtgatgcgggcgtgtgacgacctcggggtcgacacggtcgctgtgtacagcgatgccgacgcgcacgccggacacgtgcggtacgccgacgaggcgtacaacgtcgggccggcgcgcgcggcggactcctatctcgaccacgacgccatcatcgacgcggccacgcgggccggggccgacgccatccaccccggctacggcttcctcgccgagaacgccgagttcgcgggcaaagtcgaggacaccgacggcgtcacgtgggtcggcccgtccgcggactcgatgcgccagctcggcgagaagaccagcgcccggaagacgatgcgggaggccgacgtgcccatcgtccccggtaccaccgaccccgtggagtccgtcgccgacatccacgagttcggcgaggaacacggctaccccatcgctatcaaggccgagggcggtggtggcggccgcggcatgaagatcgtgcgcagcgccgacgaggccgaagaccaactggagtcggcggagcgtgagggtgaggcgtacttcgacaacgcgaacgtctatctggagcgctacttggagaacccccgccacatcgaggtccagatccttgcggaccaccacgggaacgtccggcacctcggcgagcgggactgttcgctgcagcgccgccaccagaaagtcatcgaagaaggcccgagccccgcgctcacggacgagcttcgcgaggagatcgggacggcggcccggcgtggagccgacgccgcgggctactacaacgcaggcaccttcgagttcctcgtcgaggaagacaccgagcgggagcccggtgacctcctcgggccggagacggagttctacttcctcgaagtgaacacccggattcaggtcgagcacaccgtcacggaggcgctcacgggcgtcgacattgtgaagtggcagctcaagatcgcatccgacgacgagctcaccttcgagcaggacgacgtggcactggacggccacgccgtcgagtaccgcatcaacgcggagaacgcggccgacgacttcgcgcccgccacgggcggcgagttggagacctacgacccgccgggcggcatcggcgtgcgcgtcgacgacggcctccggcagggcgacgatctcgtcaccgactacgactcgatggtcgcgaagctcatcgtgcacggcagcgaccgcgaggagtgtctggcgcggtcccggcgcgcgctcgccgagtacgacatcgagggcatcccgacgatcatcccgttccatcggctgatgctgaccgacgacgcgttcgtcgggggcacgcacacgacgaagtatctcgaccgcgacatcgaggagtcgcggatcagtgacgcccaggcggagtgggggacgacgacggcctccgagagcagtgccgatgagaacgtggtggagcgggatttcacggtggaagtcaacggcaagcgcttcgaggtcaacctggaggagcgcggcgcggcgcagttcgctgcccccgaagcggacaccggcggcggcgggccgccggagcccgcgggcggagccgacgacggcgagacggtcgttgagggcgacggcgagacggtcacggcggagatgcaggggacgatcctggacgtggccgtgtccgagggcgatgcggtcgacgcaggagacgtgctggttgtgctggaagcgatgaaaatggagaacgacgtcgtggcgtcccacggtggcacggtcacgcaggtcgccgtcagcgaggacgacagcgtcgacatggacgacgtgctggtggtcatcgactag

SEQ ID NO: 4669 - protein, 610 aa, Halobacterium sp. NRC-1
MFEKVLVANRGEIAVRVMRACDDLGVDTVAVYSDADAHAGHVRYADEAYNVGPARAADSYLDHDAIIDAATRAGADAIHPGYGFLAENAEFAGKVEDTDGVTWVGPSADSMRQLGEKTSARKTMREADVPIVPGTTDPVESVADIHEFGEEHGYPIAIKAEGGGGGRGMKIVRSADEAEDQLESAEREGEAYFDNANVYLERYLENPRHIEVQILADHHGNVRHLGERDCSLQRRHQKVIEEGPSPALTDELREEIGTAARRGADAAGYYNAGTFEFLVEEDTEREPGDLLGPETEFYFLEVNTRIQVEHTVTEALTGVDIVKWQLKIASDDELTFEQDDVALDGHAVEYRINAENAADDFAPATGGELETYDPPGGIGVRVDDGLRQGDDLVTDYDSMVAKLIVHGSDREECLARSRRALAEYDIEGIPTIIPFHRLMLTDDAFVGGTHTTKYLDRDIEESRISDAQAEWGTTTASESSADENVVERDFTVEVNGKRFEVNLEERGAAQFAAPEADTGGGGPPEPAGGADDGETVVEGDGETVTAEMQGTILDVAVSEGDAVDAGDVLVVLEAMKMENDVVASHGGTVTQVAVSEDDSVDMDDVLVVID

SEQ ID NO: 4670 - DNA, 1797 bp, Mycobacterium leprae
  CDS (1)..(1797)
atggccagtcacgccagctcgaggatcgccaaggttctcgtcgccaaccgcggcgaaattgctgtccgggtgatccgcgcggcccgcgatgcgagactgcctagcgtggcagtatacgccgagcctgacgccgaggcgccacatgtgcggctggccgacgaagcgttcgcgctgggaggtcacacttccgcagagtcctacttggacttcggtaagatcctcgacgccgctgcaaaatccggagccaacgcgatccatcccggttacgggttccttgccgagaatgctgacttcgcccaggccgtcatcgacgccggcctgatctggatcgggcccagcccacaatcgatccgcgacctcggcgacaaggtcaccgcccgccatatcgccgcccgcgcacaggctcccctagtgcccggcaccccggatccggtcaaaaacgccgacgaggtggtggccttcgccaaagaacacggggtaccgatcgcgatcaaggccgccttcggtggcggcggcaagggcatgaaagtggcccgcaccctcgaggagatttccgaactatacgaatcggcggtgcgtgaggccaccgttgcgttcggccgcggggaatgttttgttgagcgctacctagataagccccgacacgtcgaagcgcaggtaatcgccgatcagcacggcaacattgtcgtcgccggtactcgggactgctcgctacagcggcgtttccagaagctggtcgaggaggcgccggcgccgttcctaacagacgcccagcgtaaggaaatccacgaatccgcgaagcgaatctgcaaggaggcccactactacggcgctgggacggtagaatatcttgtcggccaggatggcctaatctcgttcctggaagtcaacacccgccttcaagttgagcacccggtcaccgaagagaccacaggcattgatctggtgctgcagcagttcaagatcgccaacggcgaaaagctcgaactgatcaaggatcctatcccgtgcggtcacgccatcgagttccgaatcaatggcgaggacgcaggacgcaactttctgccctcgccggggcctgttagcaagttccacccgcccaccggtcccggcgtgcgattggactccggggtagagaccggttcggtaatcggtggccagttcgactccatgcttgccaagctgatcgtgcacggcgccactcgccaggaagcactggcgcgcgcccgccgcgcactggacgaattcgaggtcgaaggcctggccacggtcatcccgttccaccgcgctgtggtatccgacccggcgctgatcggcgacaacaacagcttctcggtgcacacccgctggatcgaaaccgagtggaataacaccatcgaacccttcatcgacaaccagcccctcgacgaagaggacaccaggccacaacagacggtgatcgtcgaggtcgacggccgccgactcgaggtctcgctgcccgccgatctcgcattagctaacccggccggctgcaatccagccggtgttatccgcaaaaaacccaagccgcgcaagcgcggtggacacaccggcgcagcgacctccggtgacgcggtgaccgcgcccatgcagggcaccgtagtcaaggtcgccgttgcggagggacaaacagtgatgacaggcgacctagtggtggtcctcgaggctatgaagatggagaacccagtcaccgcacataaagatggtatcataacgggcttggcggtcgaagccggcacggccatcactcaaggcacggtgctcgccgagatcaagtaa

SEQ ID NO: 4671 - protein, 598 aa, Mycobacterium leprae
MASHASSRIAKVLVANRGEIAVRVIRAARDARLPSVAVYAEPDAEAPHVRLADEAFALGGHTSAESYLDFGKILDAAAKSGANAIHPGYGFLAENADFAQAVIDAGLIWIGPSPQSIRDLGDKVTARHIAARAQAPLVPGTPDPVKNADEVVAFAKEHGVPIAIKAAFGGGGKGMKVARTLEEISELYESAVREATVAFGRGECFVERYLDKPRHVEAQVIADQHGNIVVAGTRDCSLQRRFQKLVEEAPAPFLTDAQRKEIHESAKRICKEAHYYGAGTVEYLVGQDGLISFLEVNTRLQVEHPVTEETTGIDLVLQQFKIANGEKLELIKDPIPCGHAIEFRINGEDAGRNFLPSPGPVSKFHPPTGPGVRLDSGVETGSVIGGQFDSMLAKLIVHGATRQEALARARRALDEFEVEGLATVIPFHRAVVSDPALIGDNNSFSVHTRWIETEWNNTIEPFIDNQPLDEEDTRPQQTVIVEVDGRRLEVSLPADLALANPAGCNPAGVIRKKPKPRKRGGHTGAATSGDAVTAPMQGTVVKVAVAEGQTVMTGDLVVVLEAMKMENPVTAHKDGIITGLAVEAGTAITQGTVLAEIK

SEQ ID NO: 4672 - DNA, 1347 bp, Caulobacter crescentus
  CDS (1)..(1347)
atgttcgacaagatcctcattgcgaaccggggcgagatcgcgctccgggttcaccgcgcctgtaaggaaatgggcatcgccacggtggcggtccattccgaggccgaccgcaactctatgtgggtgcgcctggccgacgaaagcgtctgcatcgggccggctccggccgccaagagctatctgaacatcccatcgatcatcgcggccgccgagatcaccggcgcccaggcgatccacccgggctatggcttcctgtcggaaaatgcccgcttcgccgagatcgtcggcgcgcacggcttcaccttcatcggtcccaagcccgagcacatccggatgatgggcgacaagatcaccgccaagcaggctgtgaaggacgccggcatcccggtcgttcccggctcggacggcggcgtgtcgaccgaggaagaagccttcgaggccgccgagaagatcggcttccccgtcctgatcaaggccgccgccggcggcggtggtcgtggcatgaaggtcgcccagacccgtgaggacctggccgaagcggtctcgaccgcccgcgccgaggcccgcgccgcctttggcgacgacacggtctatatggagcgctacctccagaagccgcgccatatcgaactgcaggtcatcgccgacagccacggcaacgtcgtgcacctgggcgagcgcgactgctcgctgcagcgtcgtcaccagaaggtgctggaagaagccccctcgcccgccctgtcggccgaaggtcgcgccaagatcggcaaggtcgtggtcgatgcggtcaaggccatcggctatctcggcgtcggcaccatcgagttcctgtgggagaacgacgagttcttcttcatcgagatgaacacccgcctgcaggtcgaacacccggtcaccgaagccatcaccggcatcgacctggtgcgcgagcagatccgcatcgccgccggcctgccgctgtcgttcacccaggacgatgtcgtcttcgagggtcacgccatcgagtgccggatcaacgccgagaacgcgcgaaccttcacgccctcgccgggcgtgatcaccgacttccacgcccccggcggcctgggcgttcgcctggattcggcgatctacaccggctacgcgatcccgccgtactacgacagcctgatcggcaaactgatcgtgcatgggcgtgaccgcgccgaatgcatcgcgcgtctgaagcgctgcctgggcgagatggtggtcggcggtgtcgaaaccacgattccgctgttccaggaccttctggtgcagcccgatatcctggccggtgactacaacatccactggctggaacgctggatcaaagcccaagaagcttaa

SEQ ID NO: 4673 - protein, 448 aa, Caulobacter crescentus
MFDKILIANRGEIALRVHRACKEMGIATVAVHSEADRNSMWVRLADESVCIGPAPAAKSYLNIPSIIAAAEITGAQAIHPGYGFLSENARFAEIVGAHGFTFIGPKPEHIRMMGDKITAKQAVKDAGIPVVPGSDGGVSTEEEAFEAAEKIGFPVLIKAAAGGGGRGMKVAQTREDLAEAVSTARAEARAAFGDDTVYMERYLQKPRHIELQVIADSHGNVVHLGERDCSLQRRHQKVLEEAPSPALSAEGRAKIGKVVVDAVKAIGYLGVGTIEFLWENDEFFFIEMNTRLQVEHPVTEAITGIDLVREQIRIAAGLPLSFTQDDVVFEGHAIECRINAENARTFTPSPGVITDFHAPGGLGVRLDSAIYTGYAIPPYYDSLIGKLIVHGRDRAECIARLKRCLGEMVVGGVETTIPLFQDLLVQPDILAGDYNIHWLERWIKAQEA

SEQ ID NO: 4674 - DNA, 1965 bp, Caulobacter crescentus
  CDS (1)..(1965)
atgctctcctccgtcctgatcgccaatcgcggcgagatcgcccgtcgcatcatccgcaccgctcgcgagctgggcgtgcggacgatcgccgtctattccgaggcggacgccaatgcgccgttcgtcatggaggccgacgcggcgatcctgatcggtccggctccggccaaggagagctatctggacccgcgcaagatcctggcggcggccaggcagatgggcgccgaggcgatccatccgggctatggcttcctgtccgagaacgccgagttcgcgcagagcgtgatcgatgcgggcctcgtctggatcggtccgcccccgtcggcgatccgggccatgggcctgaaggacgccgccaaggcggtgatgatcaaggccggcgtgcccaccacgcccggctatctgggcgaggatcagtcggtcgaacggctcacggtcgaggcggccaagatcggctatccggtgctgatcaaggccgtggccggcggtggcggcaagggcatgcgcaaggtcgagcgtgcggaggacttcgaggcggcgctcggctcgtgccgtcgcgaagcctcggccgcgttcggcgatgatcgcgtgctgctggaaaaatacgtcactcggccgcgccacatcgaggtgcaggtgttcggcgacagccacggcaacgtcgtccacctgttcgagcgcgactgctcgctgcagcgtcgccaccagaaggtcatcgaggaagcgcccgcgcccggcatggacgaggcgacccgtgaggcggtctgcgctgcggcggtcaaggccgcccaggcggtgaactatgtcggcgccggtacggtcgagttcatcgccgacgccagcgaaggcctgcgcgccgaccgcatctggttcatggagatgaacacccgcctgcaggtcgagcacccggtcaccgagatggtcaccggccaggacctcgtcgagtggcagctgcgggtggcctcgggcgagccgctgccgctggagcaggacgagatcaccttggacggctgggccatggaggcgcggctctacgccgagaacccggccaccggcttcctgccgtcgaccggcaaactcaagcactttcgcctgcccgaaggcgatgttcgcgtcgacagcgcggtcgaggagggcggcgaggtcacgccgttctacgacccgatgatcgccaagctgatcgctcacggcgccgaccgcgaggacgccgcccagcgtctggccgaggcctgcgccctggtcgaggtctggccggtcaagaccaacgccgccttcctggccaagtgcgccagtcatccggacttcgtcgacggcgccgtcgataccggcttcatcgaggcccgtttggacgagctgaccgaacgcgccttcagcgacgagccggccatggccgcgatcggctggcggctggacagcttcctcgaagcggaagcccgccgcgatccgtgggagggcgcgccgtccaagctgctcggtttccgcatgaacgcgccgcgcgcgtcgatgcatctgccgatgtcgaccgacggcaaggccacgccgctgcgtgtggcgctgatcggcggcggaactgaggactggtcctgggatatccgccacgccgacggctcgacctttgatgaggtcacccgcctgccgaccacctatggcaagggtccgatccaggtgttcgagggcggcgacgtccaggagttcgacttcgtggccaagatcggcggggcgggcgagggcggggcctcggacggcgccatcctgtcgccgatgccgggcaagatcgtctcggtctcggtctcggccggtcagacggtgagcaagggccaaaccctgctcacgttggaggccatgaagatggagcacgccatggccgcgccgttcgacggcgtggtggctgaactgtcggcggtggccggcggccaggtcagcgagggcgtggtgctggcccgtctggaaccggctgtggcctga

SEQ ID NO: 4675 - protein, 654 aa, Caulobacter crescentus
MLSSVLIANRGEIARRIIRTARELGVRTIAVYSEADANAPFVMEADAAILIGPAPAKESYLDPRKILAAARQMGAEAIHPGYGFLSENAEFAQSVIDAGLVWIGPPPSAIRAMGLKDAAKAVMIKAGVPTTPGYLGEDQSVERLTVEAAKIGYPVLIKAVAGGGGKGMRKVERAEDFEAALGSCRREASAAFGDDRVLLEKYVTRPRHIEVQVFGDSHGNVVHLFERDCSLQRRHQKVIEEAPAPGMDEATREAVCAAAVKAAQAVNYVGAGTVEFIADASEGLRADRIWFMEMNTRLQVEHPVTEMVTGQDLVEWQLRVASGEPLPLEQDEITLDGWAMEARLYAENPATGFLPSTGKLKHFRLPEGDVRVDSAVEEGGEVTPFYDPMIAKLIAHGADREDAAQRLAEACALVEVWPVKTNAAFLAKCASHPDFVDGAVDTGFIEARLDELTERAFSDEPAMAAIGWRLDSFLEAEARRDPWEGAPSKLLGFRMNAPRASMHLPMSTDGKATPLRVALIGGGTEDWSWDIRHADGSTFDEVTRLPTTYGKGPIQVFEGGDVQEFDFVAKIGGAGEGGASDGAILSPMPGKIVSVSVSAGQTVSKGQTLLTLEAMKMEHAMAAPFDGVVAELSAVAGGQVSEGVVLARLEPAVA

SEQ ID NO: 4676 - DNA, 1989 bp, Sinorhizobium meliloti
  CDS (1)..(1989)
atgttttcgaagctcctgattgccaatcgcggtgaaatcgcctgccgcatcatccgcaccgcgcgacggctcggcatccgcaccgtcgccgtctattccgacgctgacggagacgcgctgcacgtggcgctcgccgacgaggcgatccggatcgggggggcgcccgccgccgaaagctatctggcgagcgctcctatcgttcaagcggcaagaagcgtcggcgcacaagccattcatccgggctatggtttcctgtcggagaacgccgatttcgcggaggctgtcgcagaagcaggcatgatattcgtcgggccgccgccggccgcaatccgcgccatgggtctcaaggacgcggccaaggctctcatggaacgatccggcgtaccggtcgtgcccggctaccacggcgaagagcaggatgcatcctttcttgccgacagggcacgggaaatcggctatccggtgctgatcaaggcgcgggcgggtggcggcggcaaaggcatgcgccgggtcgagcggcaggaggatttcggccccgcgctggaggccgcacggcgggaggccgaatccgccttcggcgacggttcggtgcttctcgaacgctatctgacgaagccgcgtcacatcgagatgcaggtcttcggcgaccggcacggcaatatcgtccacctcttcgagcgcgactgctcgctgcaacgccggcatcagaaggtgatagaggaggcgccggcgcccggcatgacggccgaggtccgccgtgcgatgggggatgcggcggtcagggccgcccaggcgatcggctatgtcggtgcaggcaccgtggagttcatcgccgacgtgaccaacggcctctggccggatcacttctatttcatggagatgaacacgcggctgcaggtggagcatcccgtcacggaagcgatcaccggcatcgatctcgtggaatggcagttgcgggtcgctagcggcgagccgctgccgaagaaacaggccgatatttcaatgaacggctgggccttcgaggcgcgcctctatgcggaggatccggcccggggcttcctgccggcgaccggccggctgacggaattgagctttcccgaggggacttcgcgggtcgattccggcgtccggcagggggatacgatcacgccctattacgatccgctgattgccaagttgatcgtacatggccagaaccgttcggctgcgctcggccggttgcaggatgctctcaaggaatgccgcataggcggcacggtcacgaaccgcgactttctcatccgcctgacggaagagcatgatttccgctctggccacccggatacggggctgatcgaccgggagatcgagcgactgaccgctccggtcgcacctggtgacgaggcgctggcgctggcggcgatattttcgaccggcgcgctcgacccgaacaggtcgaccgatccatggtcgtcgctcggctcctggcagatctggggcgacgcgcaccgcatggtggtgatcgaacatgcggacgtgcgcgcaaccgtcaccttggcttcgcgcggccgtgaccagttcgccgtgcgtgccggtgcgagcacgctgcccgtcctcgtgctcgaccgcttcgagggcggtgcccggctcgaggtggccgggcagaagcgcctgatccgtttctcacgggatcgcgaggcgttgacgctcttccatggcgggcgcaacctggtgttccatgtgccggacggattgaccggcgggcagagcagcgagatcgccgacgacgagttggtcgcgccgatgccgggtctcgtgaagctggtgcgggtcggcgccggcgacgcagtgacaaagggacaggcgcttgtcgtgatggaggcgatgaagatggaactgacgctctcggcctcacgcgagggcacgatcgccaatgtgcatgtggcggaaggcgctcaggtcagcgagggcacggtgctcgtgacgctgatggaggaggctgcgcaatga

SEQ ID NO: 4677 - protein, 662 aa, Sinorhizobium meliloti
MFSKLLIANRGEIACRIIRTARRLGIRTVAVYSDADGDALHVALADEAIRIGGAPAAESYLASAPIVQAARSVGAQAIHPGYGFLSENADFAEAVAEAGMIFVGPPPAAIRAMGLKDAAKALMERSGVPVVPGYHGEEQDASFLADRAREIGYPVLIKARAGGGGKGMRRVERQEDFGPALEAARREAESAFGDGSVLLERYLTKPRHIEMQVFGDRHGNIVHLFERDCSLQRRHQKVIEEAPAPGMTAEVRRAMGDAAVRAAQAIGYVGAGTVEFIADVTNGLWPDHFYFMEMNTRLQVEHPVTEAITGIDLVEWQLRVASGEPLPKKQADISMNGWAFEARLYAEDPARGFLPATGRLTELSFPEGTSRVDSGVRQGDTITPYYDPLIAKLIVHGQNRSAALGRLQDALKECRIGGTVTNRDFLIRLTEEHDFRSGHPDTGLIDREIERLTAPVAPGDEALALAAIFSTGALDPNRSTDPWSSLGSWQIWGDAHRMVVIEHADVRATVTLASRGRDQFAVRAGASTLPVLVLDRFEGGARLEVAGQKRLIRFSRDREALTLFHGGRNLVFHVPDGLTGGQSSEIADDELVAPMPGLVKLVRVGAGDAVTKGQALVVMEAMKMELTLSASREGTIANVHVAEGAQVSEGTVLVTLMEEAAQ

SEQ ID NO: 4678 - DNA, 1374 bp, Chlamydia trachomatis
  CDS (1)..(1374)
atgaagaaagtattgattgcaaatagaggcgagatagctattcggattattcgagcatgtcatgatctaggattagctactgttgctgtatattctatggcggatcaagaagctttgcatgtgcttcttgctgacgaagctgtttgtattggagaagctcaggcagcaaaatcctacctaaagatcgccaatattttagctgcttgtgagattactggggtagatgctgtgcatcctggttatggtttcttaagtgaaaatgcaaactttgcttctatttgtgaaagttgtgggctcacatttatcggtcctagtgctgagtcgatagcgactatgggagataaagtcgcagctaagcagttggctaaaaagattaagtgccctgtaatccctggatctgaaggtgtagtgaaggatgaggtggaagggattagaattgcagaaaagatcggattccccatcgtcatcaaagctgttgctggaggcggtggacgaggaatacggattgttagagaaaaagacgaattctacagggcttttactgccgctcgggctgaagcagaagcgggatttaataatcctgacgtgtatattgaaaaatttattgaaaatccaagacatttagaagttcaagtaattggagataagcacggaaattacgtgtatcttggagaacgagattgtacagtacaaaggcgtcggcaaaaattaatagaagagactccaagtcctattttaactccagaaatgcgagctaaagttggaaaagtagcagtggatttagctcggagtgccgggtatttctctgttggaacagtagaatttctgttagataaggagaagcgtttttatttcatggagatgaatacgcgtatccaagtggaacatactattacggaagaagtgacagggatcgatttgttaaaggctcagattagtgtcgctaagggagaaaaactgccttggaagcaaaagaatataaagtttaaagggcacgtgattcaatgccgaatcaatgcagaggatccaattaataactttactccttcccctggtagattagattattatctccctcctgcaggtcctgctgtgcgagtagacggggcttgctacagtggttatgcgatacctccttattatgattccatgattgctaaggtaatcacaaaaggaaagaatcgagaggaagcgatagccattatgaaaagagctttaaaagagttccatattggtggggtgcattctacaattccttttcatcagttcatgttggataatccgaagtttcttctttctgattatgatattaattacgtggaccagcttttagcgtctggtagcacctttttaaatttagctgatggcagctaa

SEQ ID NO: 4679 - protein, 457 aa, Chlamydia trachomatis
MKKVLIANRGEIAIRIIRACHDLGLATVAVYSMADQEALHVLLADEAVCIGEAQAAKSYLKIANILAACEITGVDAVHPGYGFLSENANFASICESCGLTFIGPSAESIATMGDKVAAKQLAKKIKCPVIPGSEGVVKDEVEGIRIAEKIGFPIVIKAVAGGGGRGIRIVREKDEFYRAFTAARAEAEAGFNNPDVYIEKFIENPRHLEVQVIGDKHGNYVYLGERDCTVQRRRQKLIEETPSPILTPEMRAKVGKVAVDLARSAGYFSVGTVEFLLDKEKRFYFMEMNTRIQVEHTITEEVTGIDLLKAQISVAKGEKLPWKQKNIKFKGHVIQCRINAEDPINNFTPSPGRLDYYLPPAGPAVRVDGACYSGYAIPPYYDSMIAKVITKGKNREEAIAIMKRALKEFHIGGVHSTIPFHQFMLDNPKFLLSDYDINYVDQLLASGSTFLNLADGS

SEQ ID NO: 4680 - DNA, 1362 bp, Neisseria meningitidis
  CDS (1)..(1362)
atgctgaaaaaagttttaatcgccaaccgaggcgaaatcgcattacgcgtactccgtgcctgccgcgaaatgggcattgccaccgtcgccgtgcattccgaggccgacaaagacagcctgcacgtcaaactcgccgacgaatccgtgtgcatcggccctgccgcatctgcacaaagctacctcaacgtccccgccattattgccgccgccgaagtaagctgcgcggacgctgtccacccgggctacggtttccttgccgaaaacgccgatttcgccgaacaggtcgagcagtccggctttacctttatcggcccgaaacccgacaccatccgcctgatgggcgacaaagtctccgccaaacacgcgatgatagcggcaggcgtaccctgcgtccccggttctgacggcgcattgcccgacgacggcgaagaaatcctcaaaatcgccgataaaatcggttatcccgtcattatcaaagcctctggcggcggcggcggtcgcggtatgcgcgtggtcgagaaaaaagaagacctcctccaatctgtcgaaatgaccaaggcagaagcaggcgcggcattcggcaacccgatggtttacatggaacgctatctgcaacgtccgcgccacgtcgaaatccaagtgattgccgacgaacacggcaacgccgtatatcttgccgagcgcgactgttcgctgcaacgccgccaccaaaaagtcatcgaggaagcaccggctccgttcatcactgaaaaagaacgcgccaaaatcggcaaagcctgtgccgacgcttgcaaacgcatcggctatcgcggcgcaggtacgtttgaattcctgtacgaagacggcgagttcttctttatcgagatgaacacacgcgttcaggttgagcatccggttaccgagctcatcaccggcgtggacattgtgcaggagcaactccgcatcgccgccggcctgcctttgcaatacaaacaaaaggatattcaagtcgaaggccacgcgtttgagtgccgtatcaacgccgaagacccatacaacttcatccccagcccgggcccgattgaaagctgccacctgcccagcggcttcggtatccgcgtcgacagccacatttaccaaggctaccgcatccctccttactacgacagcctgatcggcaaagtctgcgtcgtcggtaaagaccgcgaccaagccatggctaaaatgcgcgtagcccttgccgaactggcgattaccggcatcaaaaccaatacgccgctgcaccgcgacttgttcaacgacccaggtttccaaaaaggcggcgtcagcatccactatttggaacactggctggaagatcgcaaagccaaacaggacaagtaa

SEQ ID NO: 4681 - protein, 453 aa, Neisseria meningitidis
MLKKVLIANRGEIALRVLRACREMGIATVAVHSEADKDSLHVKLADESVCIGPAASAQSYLNVPAIIAAAEVSCADAVHPGYGFLAENADFAEQVEQSGFTFIGPKPDTIRLMGDKVSAKHAMIAAGVPCVPGSDGALPDDGEEILKIADKIGYPVIIKASGGGGGRGMRVVEKKEDLLQSVEMTKAEAGAAFGNPMVYMERYLQRPRHVEIQVIADEHGNAVYLAERDCSLQRRHQKVIEEAPAPFITEKERAKIGKACADACKRIGYRGAGTFEFLYEDGEFFFIEMNTRVQVEHPVTELITGVDIVQEQLRIAAGLPLQYKQKDIQVEGHAFECRINAEDPYNFIPSPGPIESCHLPSGFGIRVDSHIYQGYRIPPYYDSLIGKVCVVGKDRDQAMAKMRVALAELAITGIKTNTPLHRDLFNDPGFQKGGVSIHYLEHWLEDRKAKQDK

SEQ ID NO: 4682 - DNA, 3624 bp, Caulobacter crescentus
  CDS (1)..(3624)
atgttcgacaaggtcctgatcgccaaccgcggcgccatcgcctgccgcatcatccgcacgctgcgagcgatgggcgtcaagtcggtggcggtgttcagcgacgccgacgccggctcattgcacgtgtcgatggccgacgaggccgtgcgactgggcccggccccggcggccgagagctatctacgcgcggacctggtgctggccgccgcccaggcgaccggcgcccaggccatccatccgggctatggcttcctcagtgagagcgccgccttcgcccaggcctgcgaggacgccggcgtcaccttcatcggcccgagcgccgacaacatccgcgccttcggtctcaagcacaccgcccgcgacctggcccaggcccacggcgtgcccctggcgccaggcaccgacctcctgaccgatcctgccgccgccctggcggccgcccagcgcatcggtttccccgtgatcctgaaagccacagccggcggcggcggcatcggcatgcgggtctgcgagagcgccgaggcggtggaagaagccttcgccgccgtccgtcgtctggcgaccggcaatttcagcgacggcggagtcttcttggaacgctatgtccacaaggcgcgtcacatcgaggtgcaggtgttcggcgacggcgcgggtcgggtggcggcgctgggcgagcgcgactgctccttgcagcgccgcaaccagaaggtggtcgaagagacccccgcccccggcctgcctgcggccacgcggacggcgctgctggacgcggccgtgcgcttggccaaggcggcgaactaccgctcggccggcacggtggagttcctgtacgacgccgaccgcgacgacttcttcttcctcgaggtcaatacccgcctgcaggtcgaacacggcgttaccgagcaggtcacgggcgtggatttggtcgaatggatggtgcgcggcgcagcaggtgacttttcattcctcgacacgccgccgccggccccgcgcggcgcggcgatccaggtgcgcctctatgccgaggacccggcccaggactatcggccgagcgccggcgtactgaccgaggtcgctttccccgagggggtgcgcgccgacggctgggtcgtcgacggaaccgaggtcagcgccttctacgacccgatgctggccaagctgatcgttattgcggagcaccgtcccgccgccgtggcggcgctgcaggcggcgctggacgcgacgcgcctggcggggatcgagacgaatctcgactggctgcggacggtcacacgcagccagccgttcgtcagtggcgaggtctcgacccgggccctggagaccatcgcctgggcgccggacaccatccaggtgctgagcggcggtccggcgaccaccgtccaggactggccgggccgtcgcggctactgggacgttggggtgccgccgtcgggcccgatggacgccctggccttccggctgggcaaccgtctgctggccaatcccgacgatgcggcgggtcttgagatcaccgccctgggtccgaccctgaagttcaaccggccggcgacgctgtgcctgaccggggcgcggttcgacgcccggttggacggcgtcgcggtcgagccctacacgccgttcgacgtgcggccgggtcagaccctgaagatcggccgcgtggtcgaagcgggcctgcgcggctatctgctgctgcgcggcgggctggacgttcccacctatctgggcagccgctcgaccttcaccctgggcggctttggcggccacgccggccgcaacctgaccgccggcgacgtgctgaggctgctgcccgcgcccgaggccccgcccggcgctctggacgagcccctgcgcccggccctgaccaagacctggacgatccgggtgctgcccggtccgcacggcgcgccggacttctttaccccggccgacgtcgccatgatcggcggcacggactggaaggtgcactacaactccaaccgcaccggcgtgcgcctggtgggccccaagccggaatgggcgcggcgcgacggtggcgaggccggcctgcacccgtccaacatccacgacaacgcctacgccatcggtgcgatcgacttcaccggcgacatgccgatcatcctgggtccggacggcccgtccctgggtggcttcgtctgccccttcgtgatcatcgaggccgacctctggaaggccggccaactggcgccgggcgacaccgtgcggttcgcggtcgtggacgatccgaccgccgccgccgctctggagacgcaggaagcgctgatcgcccagctgggcgccgcgccgccgcgcccggccccggccgtaatcgacgtcgaggccagtccgatcctgcgcgagctgccgcaggacggccaccgcccgcgggtgctgtaccgccgccagggcgaccagcacctgctggtcgagtacggcccgatcgtgctggacctggagctgcgcctgcgcatccacgccctgctgctggatctgcaggcccaggcgctggagggcgtcatcgacctgaccccgggcatccgctcgctccaggtccattatgacagccgccgcctcagccaggcccggctgctggacatcctggtcgccgccgaggaccggctgggcggactggacgacttcgagatcccctcgcgcgtcgtccacctgccgctgagctggaaagatccggcgatctaccagaccatcgacaagtacatgcaggccgtccgcgacgacgcgccctggtgcccggacaacatcgagttcatccgccgggtcaacggcctgaacggcatcgacgacgtccagaagatcgtcttcgacgcccgctatctggtgatggggctgggcgacgtctatctgggcgctccggtggcgacacccgtcgatccgcgccaccgcctggtgaccaccaagtacaaccccgcccgcacctggacgccgcccaacgtcgttggcatcggcggggcctatatgtgcatctacggcatggagggccctggcggctatcagctgttcggccgcacgatccaggtgtggaacacctggcgccagaccgacgccttcaccgacggcaagccctggctgctgcgcttcttcgaccagatccgcttcttcccggtcagcgccgaggaactggtagaatggcgccgtgacttcccgctgggccgtcgagcgatccgcatcgaggaagagaccttccgcctgtccgactaccgccggctgctggcggagaacgccgaaagcatcgccgccttccagagccgtcgccaagccgccttcgacgccgagcgcgccgactgggaggccaagggtgagttcgcccgcgtcgaggcgctatcgggtgtcgccgaggccgatgacgccgtcgccgctgtggaggttcccgccggggcggacctagtcgaggcgccgctgggcggcaatgtctggaaggtgctggtcgaacctggtcaggccgttgaggccggcgcggtgatcgcgatcatcgaggctatgaaggctgagtgtgacgtcgcaaccccgacggccggtgtcgtcagcgccgtctatgcccagccgggccagccgatcgccgccggcgcgccggtcatcgctgtcaccccggttgcggaggctgcggcatga

SEQ ID NO: 4683 - protein, 1207 aa, Caulobacter crescentus
MFDKVLIANRGAIACRIIRTLRAMGVKSVAVFSDADAGSLHVSMADEAVRLGPAPAAESYLRADLVLAAAQATGAQAIHPGYGFLSESAAFAQACEDAGVTFIGPSADNIRAFGLKHTARDLAQAHGVPLAPGTDLLTDPAAALAAAQRIGFPVILKATAGGGGIGMRVCESAEAVEEAFAAVRRLATGNFSDGGVFLERYVHKARHIEVQVFGDGAGRVAALGERDCSLQRRNQKVVEETPAPGLPAATRTALLDAAVRLAKAANYRSAGTVEFLYDADRDDFFFLEVNTRLQVEHGVTEQVTGVDLVEWMVRGAAGDFSFLDTPPPAPRGAAIQVRLYAEDPAQDYRPSAGVLTEVAFPEGVRADGWVVDGTEVSAFYDPMLAKLIVIAEHRPAAVAALQAALDATRLAGIETNLDWLRTVTRSQPFVSGEVSTRALETIAWAPDTIQVLSGGPATTVQDWPGRRGYWDVGVPPSGPMDALAFRLGNRLLANPDDAAGLEITALGPTLKFNRPATLCLTGARFDARLDGVAVEPYTPFDVRPGQTLKIGRVVEAGLRGYLLLRGGLDVPTYLGSRSTFTLGGFGGHAGRNLTAGDVLRLLPAPEAPPGALDEPLRPALTKTWTIRVLPGPHGAPDFFTPADVAMIGGTDWKVHYNSNRTGVRLVGPKPEWARRDGGEAGLHPSNIHDNAYAIGAIDFTGDMPIILGPDGPSLGGFVCPFVIIEADLWKAGQLAPGDTVRFAVVDDPTAAAALETQEALIAQLGAAPPRPAPAVIDVEASPILRELPQDGHRPRVLYRRQGDQHLLVEYGPIVLDLELRLRIHALLLDLQAQALEGVIDLTPGIRSLQVHYDSRRLSQARLLDILVAAEDRLGGLDDFEIPSRVVHLPLSWKDPAIYQTIDKYMQAVRDDAPWCPDNIEFIRRVNGLNGIDDVQKIVFDARYLVMGLGDVYLGAPVATPVDPRHRLVTTKYNPARTWTPPNVVGIGGAYMCIYGMEGPGGYQLFGRTIQVWNTWRQTDAFTDGKPWLLRFFDQIRFFPVSAEELVEWRRDFPLGRRAIRIEEETFRLSDYRRLLAENAESIAAFQSRRQAAFDAERADWEAKGEFARVEALSGVAEADDAVAAVEVPAGADLVEAPLGGNVWKVLVEPGQAVEAGAVIAIIEAMKAECDVATPTAGVVSAVYAQPGQPIAAGAPVIAVTPVAEAAA

SEQ ID NO: 4684 - DNA, 2013 bp, Sinorhizobium meliloti
  CDS (1)..(2013)
atgggacacatgttcaaaaagatcctcatcgccaatcgtggtgaaatcgcgtgccgcgtcatccgcaccacgaaggctctcggcattccgaccgtcgccgtctattcggatgccgaccgcgacgccatgcatgtgcgcatggcggacgaggccgtccatatcggcccatccccatccagccaatcctacatcgtcatcgagaatatcctcgcggcgatccgcaggaccggggccgatgccgttcaccccggctacggcttcctctccgaaaacgccgccttcgccgaggctctcgagaaggatggcgtgaccttcatcggcccgccggtccgggcgatcgaggcgatgggggacaagatcacctcgaagaagctcgccgccgaagcgggcgttttcaccgttcccggccatatggggctgatcgaggatgcggacgaggccgcgcgcatcgccgctgagatcggctttccggtgatgatcaaggcttccgccggcggcggcggcaagggcatgcggatcgcctggaacgagcgggaggcacgcgagggtttccagtcgtccaggaacgaggcgaagagctccttcggcgacgatcgcatcttcatcgagaaattcgtgaccgagccccgccacatcgagattcaggtgctcggcgacaagcatggcaatatcctctatctcggcgagcgcgaatgctcgatccagcggcggaaccagaaggtcatcgaggaggcgccctcgccctttctcgacgagaagacgcgccgcgccatgggcgagcaggcggtcgccctggcaaaggccgtcggctatcactcggccggcaccgtcgaattcatcgtggacgccggccgcaacttctactttctcgagatgaacacccggcttcaggtcgagcatcccgtgacggaactcgtcaccggcctcgatctggtcgagcagatgatccgcgtcgcggccggcgcgaaattggctttcgcccagaaagacgtgaagctcgacggctgggcgatcgaaagcaggctctatgcggaagacccctaccgcactttcctcccgtcgatcggccggctgacgcgctatcgcccgcccgaggaaggcacgcaggcggacggcaccgtcatccgcaacgacacaggcgtcttcgaaggcggcgagatctcgatgtattacgatccgatgatcgccaagctctgcacctggggaccggaccggctgacggcggtccgggcgatggcggacgcgctcgacgcattcgaggtcgagggcatcggtcacaacctgcccttcctcgcagccgtgatgcagcaggagcgtttccatgaggggcggctgaccaccgcttatatcgccgaggaatttgccggcggtttccacggggtggcgctggacgatgcatccgcacgcaagctcgccgccgtcgcggcgacggtcaaccagacgctccaggagcgcgccagccgcatttcgggcaccatcggcaaccaccgccgggtcgtcggccatgaatgggtgacgagtctcgatggtcacgaaattcaggtcacatgcgaggtttccgccgacggcacctatgtccgctttgccgacgggacatccgtttccgtcgcaaccgactgggcgcccggccgcacccgcgccgccttcaacatcgacaatcagcccatgagcgtgaaggtcgagctcgccggcccgggcataaggctgcgctggcgcgggatcgacgtcgttgcacgggtcagaagcccgcgcattgccgaactcgcccggctgatgccgaagaagctgccgccggacacctcgaagatgctgctctgcccgatgcccggggtggtgacatcgatcacggtcaaggccggcgaaacggtcgaggccggacaggcgatcgccgtcgtcgaggcgatgaagatggagaatattctgcgggcggaaaagcgtgcgatcgtgaagcgcgtggcgatcgaagccggcgcgagcctcgcggtggacgagttgatcatggagttcgagtga

SEQ ID NO: 4685 - protein, 670 aa, Sinorhizobium meliloti
MGHMFKKILIANRGEIACRVIRTTKALGIPTVAVYSDADRDAMHVRMADEAVHIGPSPSSQSYIVIENILAAIRRTGADAVHPGYGFLSENAAFAEALEKDGVTFIGPPVRAIEAMGDKITSKKLAAEAGVFTVPGHMGLIEDADEAARIAAEIGFPVMIKASAGGGGKGMRIAWNEREAREGFQSSRNEAKSSFGDDRIFIEKFVTEPRHIEIQVLGDKHGNILYLGERECSIQRRNQKVIEEAPSPFLDEKTRRAMGEQAVALAKAVGYHSAGTVEFIVDAGRNFYFLEMNTRLQVEHPVTELVTGLDLVEQMIRVAAGAKLAFAQKDVKLDGWAIESRLYAEDPYRTFLPSIGRLTRYRPPEEGTQADGTVIRNDTGVFEGGEISMYYDPMIAKLCTWGPDRLTAVRAMADALDAFEVEGIGHNLPFLAAVMQQERFHEGRLTTAYIAEEFAGGFHGVALDDASARKLAAVAATVNQTLQERASRISGTIGNHRRVVGHEWVTSLDGHEIQVTCEVSADGTYVRFADGTSVSVATDWAPGRTRAAFNIDNQPMSVKVELAGPGIRLRWRGIDVVARVRSPRIAELARLMPKKLPPDTSKMLLCPMPGVVTSITVKAGETVEAGQAIAVVEAMKMENILRAEKRAIVKRVAIEAGASLAVDELIMEFE

SEQ ID NO: 4686 - DNA, 7041 bp, Homo sapiens (man)
  CDS (1)..(7041)
atggatgaaccatctcccttggcccaacctctggagctgaaccagcactctcgattcataataggttctgtgtcagaagataactcagaggatgagatcagcaacctggtgaagctggacctactggaggagaaggagggctccttgtcacctgcttctgttggctcagatacactctctgatttggggatctctgccctacaggatggcttggccttgcacataaggtccagctggtctggcttgcacctagtaaagcagggcggagacagaaagaaaatagattctcaacgagatttcactgtggcttctccagcagaatttgttactcgctttgggggaaataaagtgattgagaaggttctcatcgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccggtgcctggaggagcaaacaacaacaactatgcaaatgtggaattaattcttgatattgctaaaaggatcccagtgcaagcagtgtgggctggctggggtcatgcttctgagaatcccaaactaccggaacttctcttgaaaaatggcattgccttcatgggtcctccaaaccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctaaaggcagctgagaaggttggatatccagtaatgatcaaggcctcagagggaggaggagggaagggaattagaaaagttaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctagaattgaaccctcggctacaggttgaacaaccttgtacagagatggtggctgatgtcaatctccccgcagcacagctccagattgccatggggattcctctatatagaatcaaggatatccgtatgatgtatggggtatctccttggggtgattctcccattgattttgaaaattctgctcacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctggttctcagtttggtcactgcttttcttggggagaaaacagagaagaagcaatttcaaacatggtggtggcattgaaggagctgtctattcggggtgactttcgaactacagttgaatacctgatcaaattgttagagactgaaagctttcaaatgaacagaattgatactggctggctggacagactgatagcagaaaaagtacgggctgagcgtcctgacaccatgttgggggttgtgtgtggtgccctccacgtcggagatgtgagcctgcgaaatagcgtctctaacttccttcactccttagaaaggggtcaagtccttccggctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttacaccacgtatatgaaggaggaagtagacagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgcagagattgaggtaatgaagatggtaatgactttgacagctgtggagtctggctgtatccattacgtcaagcgtcctggagcagctcttgaccctggctgtgtactcgccaaaatgcaactggacaaccccagcaaggttcagcaggctgaacttcacacaggtagtctgccacggatccagagcaccgctctccgaggcgagaagctccatcgagtgttccactatgtcctggataatctggtcaatgtaatgaatggatactgccttccagatcctttctttagcagcaaggtaaaagactgggtagaacgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgtccagctggtacagaggtaccgaagtggcatccgaggccacatgaaggctgtggtgatggatctgctccggcagtacctgcgagtagagacacaattccagaatggtcactatgacaaatgtgtattcgcccttcgagaagagaataagagtgacatgaacactgtactgaactacatcttctctcacgctcaagtcaccaagaagaatcttctggtcacaatgcttattgatcagttgtgtggccgggaccctactctaactgatgagctgctgagtattctcacagagctaactcaactcagtaagaccaccaatgccaaagtagcacttcgagcacgccaggttcttattgcctcccatttgccatcatatgacgttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtacgttcgaagggcttatattgcctatgaacttaacagcgtacaacaccgccagcttaaggacaacacctgcgtggtggaattccagttcatgctgcccacatctcatccaaacagagggaacatccctacgctaaacagaatgtccttctcctccaacctcaaccactatggcatgacccatgtagctagtgtcagcgatgttctgttggacaacgccttcacaccaccttgtcaacgcatgggcggaatggtctcttttcggacttttgaagattttgtcaggatctttgatgaagtaatgggctgcttctgtgactccccaccccagagtcccacattccctgaggcaggtcacacgtctctttatgatgaggataaggttcccagggatgaaccaattcacattctcaatgtggctatcaagactgacggtgatattgaggatgacaggctggcagctatgttcagagaattcacccagcaaaataaagctaccctggctgaccatgggatccggcgcctgactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaagtgaaggggagcggctactcctggaagccatggatgagttggaagttgcttttaacaatacaaatgtccgcactgactgtaaccacatcctcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgccttttcctgacaaacgagtctggctattacttggatatcagcctatacaaggaagtgactgactccaggacagcacagatcatgtttcaggcatatggagacaagcagggaccactgcatggaatgttaatcaatactccatatgtgaccaaagacctgctgcaatcaaagaggttccaggcacaatccttagggacaacgtacatatatgatatcccagagatgtttcggcagtccctgatcaaactctgggagtctatgtcaactcaagcatttcttccatctccccctctgccttctgacatgctgacttacactgaactggtactggatgatcaaggtcagctggtccacatgaacaggcttccaggaggaaatgagattggcatggtagcttggaaaatgagccttaaaagtcctgaatatccagaaggccgagatgttattgttattggcaatgacattacataccgaattgggtcctttgggcctcaagaagatttgttatttctcagagcttccgaacttgctagggccgaaggcattccacgcatctatgtatcagccaacagtggagcaagaatcggactggcagaagaaattcgccatatgtttcatgtggcctgggtagattctgaggatccttacaagggatacaggtatttatatctgactcctcaagattataagagagtcggtgctctcaactctgtccattgtgaacacgtggaagatgaaggagaatccaggtacaagataacagatattattgggaaagaagagggaattggacccgagaaccttcgaggttctggaatgatcgctggagaatcctcattggcctataatgagatcattaccatcagcctggtgacgtcccgggccattgggattggggcttaccttgtccggctgggacagagaaccatccaggttgagaattctcacttgattctaacaggagctggagccctcaacaaagtcctcgggcgggaagtgtacacctccaataaccagctggggggcatccagattacgcacaacaatggggtgacccactgcactgtgtgtgacggctttgaaggggttttcactgtcctgcactggctgtcttacatgcccaagagcgtacacagttcagttcctcttctgaactcaaaggatcctatagacagaatcatcgagtttgttcccacaaagaccccatatgatcctcgatggatgctagcaggccgccctcacccaacccaaaaaggtcagtggttgagtggcttttttgactatggatctttctcagagattatgcagccctgggcacagacggtggtggttggtagagccaggttagggggaatacctgtgggagttgttgctgtagaaacccggacagtagaactaagtgtaccagctgatccagcaaacctggattctgaagccaagataatccagcacgccggccaagtttggtttccggattctgcgtttaagacgtatcaggccatcaaggacttcaaccgggaagggctacctctaatggtctttgccaactggagaggcttctctggtggaatgaaagatatgtatcaccaagtgctgaagtttggtgcttacattgtggatggcttgcgggaatgttcccagcctgtgctggtctacattcctccccaggctgagctgcggggtggctcctgggtggtgatcgacccaaccatcaatcctcggcacatggagatgtatgctgaccgagaaagcaggggatctgttctggagccagaagggacggtagaaatcaaattccgcagaaaggatctggtgaaaaccatgcgtcgggtggacccagtctacatccacttggctgagcgattggggaccccagagctgagcccaactgagcggaaggagttggagagcaagttgaaggagcgggaggaattcctaattccaatttaccatcaggtagccgtgcagtttgctgacttgcacgacactccaggccggatgcaggagaagggtgttattagcgatatcctggattggaaaacatcccgtaccttcttctactggcgactgaggcgtcttctgctggaggacctggtcaagaagaaaatccacagtgccaaccctgagctgactgatggccagattcaagccatgttaagacgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgggcagaagtcataaggatcctttccactatggactccccttctacgtag

SEQ ID NO: 4687 - protein, 2346 aa, Homo sapiens (man)
MDEPSPLAQPLELNQHSRFIIGSVSEDNSEDEISNLVKLDLLEEKEGSLSPASVGSDTLSDLGISALQDGLALHIRSSWSGLHLVKQGGDRKKIDSQRDFTVASPAEFVTRFGGNKVIEKVLIANNGIAAVKCMRSIRRWSYEMFRNERAIRFVVMVTPEDLKANAEYIKMADHYVPVPGGANNNNYANVELILDIAKRIPVQAVWAGWGHASENPKLPELLLKNGIAFMGPPNQAMWALGDKIASSIVAQTAGIPTLPWSGSGLRVDWQENDFSKRILNVPQELYEKGYVKDVDDGLKAAEKVGYPVMIKASEGGGGKGIRKVNNADDFPNLFRQVQAEVPGSPIFVMRLAKQSRHLEVQILADQYGNAISLFGRDCSVQRRHQKIIEEAPATIATPAVFEHMEQCAVKLAKMVGYVSAGTVEYLYSQDGSFYFLELNPRLQVEQPCTEMVADVNLPAAQLQIAMGIPLYRIKDIRMMYGVSPWGDSPIDFENSAHVPCPRGHVIAARITSENPDEGFKPSSGTVQELNFRSNKNVWGYFSVAAAGGLHEFAGSQFGHCFSWGENREEAISNMVVALKELSIRGDFRTTVEYLIKLLETESFQMNRIDTGWLDRLIAEKVRAERPDTMLGVVCGALHVGDVSLRNSVSNFLHSLERGQVLPAHTLLNTVDVELIYEGVKYVLKVTRQSPNSYVVIMNGSCVEVDVHRLSDGGLLLSYDGSSYTTYMKEEVDRYRITIGNKTCVFEKENDPSVMRSPSAGKLIQYIVEDGGHVFAGQCYAEIEVMKMVMTLTAVESGCIHYVKRPGAALDPGCVLAKMQLDNPSKVQQAELHTGSLPRIQSTALRGEKLHRVFHYVLDNLVNVMNGYCLPDPFFSSKVKDWVERLMKTLRDPSLPLLELQDIMTSVSGRIPPNVEKSIKKEMAQYASNITSVLCQFPSQQIANILDSHAATLNRKSEREVFFMNTQSIVQLVQRYRSGIRGHMKAVVMDLLRQYLRVETQFQNGHYDKCVFALREENKSDMNTVLNYIFSHAQVTKKNLLVTMLIDQLCGRDPTLTDELLSILTELTQLSKTTNAKVALRARQVLIASHLPSYDVRHNQVESIFLSAIDMYGHQFCIENLQKLILSETSIFDVLPNFFYHSNQVVRMAALEVYVRRAYIAYELNSVQHRQLKDNTCVVEFQFMLPTSHPNRGNIPTLNRMSFSSNLNHYGMTHVASVSDVLLDNAFTPPCQRMGGMVSFRTFEDFVRIFDEVMGCFCDSPPQSPTFPEAGHTSLYDEDKVPRDEPIHILNVAIKTDGDIEDDRLAAMFREFTQQNKATLADHGIRRLTFLVAQKDFRKQVNYEVDRRFHREFPKFFTFRARDKFEEDRIYRHLEPALAFQLELNRMRNFDLTAIPCANHKMHLYLGAAKVEVGTEVTDYRFFVRAIIRHSDLVTKEASFEYLQSEGERLLLEAMDELEVAFNNTNVRTDCNHILLNFVPTVIMDPSKIEESVRSMVMRYGSRLWKLRVLQAELKINIRLTPTGKAIPIRLFLTNESGYYLDISLYKEVTDSRTAQIMFQAYGDKQGPLHGMLINTPYVTKDLLQSKRFQAQSLGTTYIYDIPEMFRQSLIKLWESMSTQAFLPSPPLPSDMLTYTELVLDDQGQLVHMNRLPGGNEIGMVAWKMSLKSPEYPEGRDVIVIGNDITYRIGSFGPQEDLLFLRASELARAEGIPRIYVSANSGARIGLAEEIRHMFHVAWVDSEDPYKGYRYLYLTPQDYKRVGALNSVHCEHVEDEGESRYKITDIIGKEEGIGPENLRGSGMIAGESSLAYNEIITISLVTSRAIGIGAYLVRLGQRTIQVENSHLILTGAGALNKVLGREVYTSNNQLGGIQITHNNGVTHCTVCDGFEGVFTVLHWLSYMPKSVHSSVPLLNSKDPIDRIIEFVPTKTPYDPRWMLAGRPHPTQKGQWLSGFFDYGSFSEIMQPWAQTVVVGRARLGGIPVGVVAVETRTVELSVPADPANLDSEAKIIQHAGQVWFPDSAFKTYQAIKDFNREGLPLMVFANWRGFSGGMKDMYHQVLKFGAYIVDGLRECSQPVLVYIPPQAELRGGSWVVIDPTINPRHMEMYADRESRGSVLEPEGTVEIKFRRKDLVKTMRRVDPVYIHLAERLGTPELSPTERKELESKLKEREEFLIPIYHQVAVQFADLHDTPGRMQEKGVISDILDWKTSRTFFYWRLRRLLLEDLVKKKIHSANPELTDGQIQAMLRRWFVEVEGTVKAYVWDNNKDLAEWLEKQLTEEDGVHSVIEENIKCISRDYVLKQIRSLVQANPEVAMDSIIHMTQHISPTQRAEVIRILSTMDSPST

SEQ ID NO: 4688 - DNA, 4201 bp, Saccharomyces cerevisiae
  CDS (430)..(3966)
ccgcccaatgtcgcgggttgacccgcgacattgggcgggcaatactctcatcttattggctattcaacttagacaacggccagttgcgcgcacaaatttggtcatgaccgctccaccggcatgcgtgtcgtcatcccgcatcattcgggacattttggccttttccgcagtgcgtagttgacgtggggagaaagctagtgggctgtcgcatatggttggttttaggtggcgaaagtttcgccgcgatagcaatcatgtcctcgaccttaatctcaatggaatgggtcatgctcggtaagtgagtctcgctgtatataagtatatatgtaatcgcctagttcgatagatacaaggaggtcttgagtatgtagataaacgaaaagaagataacaaaaggaaaatctcagcctctccccttcctcttagacaatgtcgcaaagaaaattcgccggcttgagagataacttcaatctcttgggtgaaaagaacaaaatattggtggctaatagaggagaaattccaatcagaatttttcgtaccgctcatgaactgtctatgcagacggtagctatatattctcatgaagatcgtctttcaacgcacaaacaaaaggctgacgaagcatacgtcataggtgaagtaggccaatatacccccgtcggcgcttatttggccattgacgaaatcatttccattgcccaaaaacaccaggtagatttcatccatccaggttatgggttcttgtctgaaaattcggaatttgccgacaaagtagtgaaggccggtatcacttggattggccctccagctgaagttattgactccgtgggtgataaggtctcagctagaaacctggcagcaaaagctaatgtgcccaccgttcctggtacaccaggtcctatagaaactgtagaggaagcacttgacttcgtcaatgaatacggctacccggtgatcattaaggccgcctttggtggtggtggtagaggtatgagagtcgttagagaaggtgacgacgtggcagatgcctttcaacgtgctacctccgaagcccgtactgccttcggtaatggtacctgctttgtggaaagattcttggacaagccaaagcatattgaagttcaattgttggccgataaccacggaaacgtggttcatcttttcgaaagagactgttccgtgcagagaagacaccaaaaggttgtcgaagtggccccagcaaagactttaccccgtgaagtccgtgacgccattttgacagatgcagttaaattggccaaagagtgtggctacagaaatgcgggtactgctgaattcttggttgataaccaaaatagacactatttcattgaaattaatccaagaatccaagtggaacataccatcacagaagaaattaccggtatagatattgtggcggctcagatccaaattgcggcaggtgcctctctaccccagctgggcctattccaggacaaaattacgactcgtggctttgccattcagtgccgtattaccacggaagaccctgctaagaacttccaaccagataccggtagaatagaagtgtaccgttctgcaggtggtaatggtgttagactggatggtggtaacgcctatgcaggaacaataatctcacctcattacgactcaatgctggtcaaatgctcatgctccggttccacctacgaaatcgttcgtagaaaaatgattcgtgcattaatcgagttcagaattagaggtgtcaagaccaacattcccttcctattgactcttttgaccaatccagtatttattgagggtacatactggacgacttttattgacgacaccccacaactgttccaaatggtttcatcacaaaacagagcccaaaaacttttacattacctcgccgacgtggcagtcaatggttcatctatcaagggtcaaattggcttgccaaaattaaaatcaaatccaagtgtcccccatttgcacgatgctcagggcaatgtcatcaacgttacaaagtctgcaccaccatccggatggaggcaagtgctactagaaaaggggccagctgaatttgccagacaagttagacagttcaatggtactttattgatggacaccacctggagagacgctcatcaatctctacttgcaacaagagtcagaacccacgatttggctacaatcgctccaacaaccgcacatgcccttgcaggtcgtttcgccttagaatgttggggtggtgccacattcgatgttgcaatgagatttttgcatgaggatccatgggaacgtttgagaaaattaagatctctggtgcctaatattccattccaaatgttattgcgtggtgccaatggtgtggcttattcttcattgcctgacaatgctattgaccatttcgtcaagcaagccaaggataatggtgttgatatatttagagtctttgatgccttaaatgacttggaacaattgaaggtcggtgtagatgctgtgaagaaggcaggtggtgttgtagaagccactgtttgtttctctggggatatgcttcagccaggcaagaaatacaatttggattactacttggaaattgctgaaaaaattgtccaaatgggcactcatatcctgggtatcaaagatatggcaggtaccatgaagccagcagctgccaaactactgattggatctttgagggctaagtaccctgatctcccaatacatgttcacactcacgattctgcaggtactgctgttgcatcaatgactgcgtgtgctctggcgggcgccgatgtcgttgatgttgccatcaactcaatgtctggtttaacttcacaaccatcaatcaatgctctgttggcttcattagaaggtaatattgacactggtattaacgttgagcatgtccgtgaactagatgcatattgggcagagatgagattgttatactcttgtttcgaggctgacttgaagggcccagatccagaagtttatcaacatgaaatcccaggtggtcaattgacaaacttgttgtttcaagcccaacaattgggtcttggagaacaatgggccgaaacaaaaagagcttacagagaagccaattatttattgggtgatattgtcaaagttaccccaacttcgaaggtcgttggtgatctggcacaatttatggtctccaataaattaacttccgatgatgtgagacgcctggctaattctttggatttccctgactctgttatggatttcttcgaaggcttaatcggccaaccatatggtgggttcccagaaccatttagatcagacgttttaaggaacaagagaagaaagttgacttgtcgtccaggcctggaactagagccatttgatctcgaaaaaattagagaagacttgcagaatagatttggtgatgttgatgagtgcgacgttgcttcttataacatgtacccaagagtttatgaagacttccaaaagatgagagaaacgtatggtgatttatctgtattgccaacaagaagctttttgtctccactagagactgacgaagaaattgaagttgtaatcgaacaaggtaaaacgctaattatcaagctacaggctgtgggtgatttgaacaaaaagaccggtgaaagagaagtttactttgatttgaatggtgaaatgagaaaaattcgtgttgctgacagatcacaaaaagtggaaactgttactaaatccaaagcagacatgcatgatccattacacattggtgcaccaatggcaggtgtcattgttgaagttaaagttcataaaggatcactaataaagaagggccaacctgtagccgtattaagcgccatgaaaatggaaatgattatatcttctccatccgatggacaagttaaagaagtgtttgtctctgatggtgaaaatgtggactcttctgatttattagttctattagaagaccaagttcctgttgaaactaaggcatgaaccggttagttctcatttataatgtataatatacccgaatcttatttatttacctttcctattttttgacgaccagtaaatactaatacataattaggaacaaaagttaaataaaaaaaaaaataataatttaacgcatccaattaacgtgtccttttttcatcattaatttatctactatttcgatttaaattccatatacaataaatcctagatacattcccgaaagcatctt

SEQ ID NO: 4689 - protein, 1178 aa, Saccharomyces cerevisiae
MSQRKFAGLRDNFNLLGEKNKILVANRGEIPIRIFRTAHELSMQTVAIYSHEDRLSTHKQKADEAYVIGEVGQYTPVGAYLAIDEIISIAQKHQVDFIHPGYGFLSENSEFADKVVKAGITWIGPPAEVIDSVGDKVSARNLAAKANVPTVPGTPGPIETVEEALDFVNEYGYPVIIKAAFGGGGRGMRVVREGDDVADAFQRATSEARTAFGNGTCFVERFLDKPKHIEVQLLADNHGNVVHLFERDCSVQRRHQKVVEVAPAKTLPREVRDAILTDAVKLAKECGYRNAGTAEFLVDNQNRHYFIEINPRIQVEHTITEEITGIDIVAAQIQIAAGASLPQLGLFQDKITTRGFAIQCRITTEDPAKNFQPDTGRIEVYRSAGGNGVRLDGGNAYAGTIISPHYDSMLVKCSCSGSTYEIVRRKMIRALIEFRIRGVKTNIPFLLTLLTNPVFIEGTYWTTFIDDTPQLFQMVSSQNRAQKLLHYLADVAVNGSSIKGQIGLPKLKSNPSVPHLHDAQGNVINVTKSAPPSGWRQVLLEKGPAEFARQVRQFNGTLLMDTTWRDAHQSLLATRVRTHDLATIAPTTAHALAGRFALECWGGATFDVAMRFLHEDPWERLRKLRSLVPNIPFQMLLRGANGVAYSSLPDNAIDHFVKQAKDNGVDIFRVFDALNDLEQLKVGVDAVKKAGGVVEATVCFSGDMLQPGKKYNLDYYLEIAEKIVQMGTHILGIKDMAGTMKPAAAKLLIGSLRAKYPDLPIHVHTHDSAGTAVASMTACALAGADVVDVAINSMSGLTSQPSINALLASLEGNIDTGINVEHVRELDAYWAEMRLLYSCFEADLKGPDPEVYQHEIPGGQLTNLLFQAQQLGLGEQWAETKRAYREANYLLGDIVKVTPTSKVVGDLAQFMVSNKLTSDDVRRLANSLDFPDSVMDFFEGLIGQPYGGFPEPFRSDVLRNKRRKLTCRPGLELEPFDLEKIREDLQNRFGDVDECDVASYNMYPRVYEDFQKMRETYGDLSVLPTRSFLSPLETDEEIEVVIEQGKTLIIKLQAVGDLNKKTGEREVYFDLNGEMRKIRVADRSQKVETVTKSKADMHDPLHIGAPMAGVIVEVKVHKGSLIKKGQPVAVLSAMKMEMIISSPSDGQVKEVFVSDGENVDSSDLLVLLEDQVPVETKA

SEQ ID NO: 4690 - DNA, 7020 bp, Homo sapiens (man)
  CDS (1)..(7020)
atggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctacaggcagctgaggaagttggatatccagtaatgatcaaggcctcagagggaggaggagggaagggaattagaaaagtcaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatcggagcttctactttctggaattgaatcctcggctgcaggtagagcacccttgtacagagatggtggctgatgtcaatctccctgcagcacagctccagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaagcagagaagaggcaatttcaaacatggtggtggctttgaaggagctgtctattcggggtgactttcgaactacagttgaatacctgatcaaattgttagagactgaaagctttcaaatgaacagaattgatactggctggctggacagactgatagcagaaaaagtacaggctgagcgacctgacaccatgttgggggttgtgtgtggtgccctccacgtggcagatgtgagcctgcgaaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttccgctgggaagttaatccagtacattgtagaagatggaggtcatgtgcttgccggccagtgctatgctgagattgaggtaatgaagatggtaatgaccttaacagctgtggagtctggctgtatccattacgtcaagcgacctggagcagctcttgaccctggctgtgtactagccaaaatgcaactggacaaccccagcaaggttcagcaggctgaacttcacacaggtagtctgccacggatccagagcacggcactcagaggcgagaaactccatcgagtgttccattatgtcctggataatctggtcaatgtaatgaatggatactgccttccagatcctttctctagcagcaaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgttcagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctcactgatgagctgctgaatattctcacagagctaactcaactcagtaagaccaccaatgccaaagtagcacttcgagcacgccaggttcttattgcctcccatttgccatcatatgagcttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcgcagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaaatgaaggggagcggctactcctggaagccatggatgagttggaagttgcttttaacaatacaaatgtccgcactgactgcaaccacatcttcctcaacttcgtgcccactgtcatcatggacccctcaaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaacaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagaggcgattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccactgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttggggggattcccgtgggagtgattgctgtggagacacggactgtggaggtggcagtccctgcagaccctgccaacctggattctgaggccaagataattcagcaggcaggacaggtgtggttcccagactcagcctacaaaaccgcccaggccatcaaggacttcaaccgggagaagttgcccctgatgatctttgccaactggagggggttctccggtggcatgaaagacatgtatgaccaggtgctgaagtttggagcctacatcgtggacggccttagacaatacaaacagcccatcctgatctatatccgccctatgcgggagctccggggaggctcctgggtggtcatagatgccaccatcaacccgctgtgcatagaaatgtatgcagacaaagagagcaggggtggtgttctggaaccagaggggacagtggagattaagttccgaaaggaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctga

SEQ ID NO: 4691 - protein, 2339 aa, Homo sapiens (man) [sequence omitted]

SEQ ID NO: 4692 - DNA, 6042 bp, Saccharomyces cerevisiae
  CDS (373)..(5880)
tcccctatttcatagggcactctgttcgcagttagcgcaagccattgagataagacacgcagatgttttgctttttcctgcttcttaatttgaatcgagctttgttagacgttgttggaaattgaatgtttgtatttaaacactagagcagatgaggtgtgagatttgtatactcgctcacttctgaatatcaggctctcttagctaagctttttttttctaggatcatataggctcaagtttttataagcttatattaatatatcagtggagcagctgatatacaccaaatttcaatttacattaatataaaagataaaaaatagaaatatcttttttatagtcacaataaatttcagttttgattaaaaaatgacagttagttccgatacaactgctgaaatatcgttaggttggtcaatccaagactggattgatttccacaagtcatcaagctcccaggcttcactaaggcttcttgaatcactactagactctcaaaatgttgcgccagtcgataatgcgtggatatcgctaatttcaaaggaaaatttactgcaccaattccaaattttaaagagcagagaaaataaagaaactctacctctctacggtgtccctattgctgttaaggacaacatcgacgttagaggtctacccaccaccgctgcatgtccatcctttgcatatgagccttccaaagactctaaagtagtagaactactaagaaatgcaggtgcgataatcgtgggtaagacaaacttggaccaatttgccacaggattagtcggcacacggtctccatatgggaaaacaccttgcgcttttagcaaagagcatgtatctggtggttcctccgctgggtcagcatcggtggtcgccagaggtatcgtaccaattgcattgggtactgatacagcaggttctggtagagtcccagccgccttgaacaacctgattggcctaaagccaacaaagggcgtcttttcctgtcaaggtgtagttcccgcttgtaaatctttagactgcgtctccatctttgcattaaacctaagtgatgctgaacgctgcttccgcatcatgtgccagccagatcctgataatgatgaatattctagaccctatgtttccaaccctttgaaaaaattttcaagcaatgtaacgattgctattcctaaaaatatcccatggtatggtgaaaccaagaatcctgtactgttttccaatgctgtcgaaaatctatcaagaacgggcgctaacgtcatagaaattgattttgagcctcttttagagttagctcgctgtttatacgaaggtacttgggtggccgagcgttatcaagctattcaatcgtttttggacagtaaaccaccaaaggaatctttggaccctactgttatttcaattatagaaggggccaagaaatacagtgcagtagactgcttcagttttgaatacaaaagacaaggcatcttgcaaaaagtgagacgacttctcgaatcagtcgatgtattgtgtgtgcccacatgtcctttaaatcctactatgcaacaagttgcggatgaaccagtcctagtcaattcaagacaaggcacatggactaattttgtcaacttggcagatttggcagcccttgctgttcccgcagggttccgagacgatggtttgccaaatggtattactttaatcggtaaaaaattcacagattacgcactattagagttggctaaccgctatttccaaaatatattccccaacggttccagaacatacggtacttttacctcttcttcagtaaagccagcaaacgatcaattagtgggaccagactatgacccatctacgtccataaaattggctgttgtcggtgcacatcttaagggtctgcctctacattggcaattggaaaaggtcaatgcaacatatttatgtacaacaaaaacatcaaaagcttaccagctttttgctttgcccaaaaatggaccagttttaaaacctggtttgagaagagttcaagatagcaatggctctcaaatcgaattagaagtgtacagtgttccaaaagaactgttcggtgcttttatttccatggttcctgaaccattaggaataggttcagtggagttagaatctggtgaatggatcaaatcctttatttgtgaagaatctggttacaaagccaaaggtacagttgatatcacaaagtatggtggatttagagcatattttgaaatgttgaagaaaaaagagtcccaaaagaagaagttatttgataccgtgttaattgccaatagaggtgaaattgccgttcgtattatcaagacattaaaaaaattgggtattagatcagttgcagtttattccgaccctgataaatattctcaacacgttactgatgcagatgtttctgtaccccttcatggcacaaccgcagcccaaacttatttagacatgaataagatcatagatgccgctaagcaaactaatgcacaggccattattcctggttatggtttcttgtcggaaaatgcggatttttctgatgcgtgcaccagtgctggcattacctttgttggtccttcgggagatattatcagaggtttagggttaaaacattctgctagacagattgcacagaaggctggcgttcctctagtgccaggctctttgcttatcacatcagttgaagaggctaagaaagtcgcagcggaattggaatacccagttatggtgaagtcaactgctggtggcggtggtattggtttgcagaaagtcgattctgaagaggacatcgagcatatttttgagactgtgaaacatcaaggtgaaacatttttcggtgacgctggtgtatttctggaacggtttatcgaaaatgccaggcatgttgaagtccaacttatgggagatggttttggtaaggccattgctttgggcgaacgtgattgttctttacagcgtcgtaaccaaaaagttatcgaagaaactcctgcaccaaatttgccagaaaagacgaggttggcgttaagaaaggcagctgaaagtttgggatctttattgaattacaagtgtgctggtacggttgaatttatttacgatgagaaaaaggacgagttttactttttagaagttaatacaagattacaagttgaacatccaataacagaaatggttacagggttagacttggtcgagtggatgatcaggattgccgctaatgatgcacctgattttgattctacaaaggtagaagtcaatggggtttcaatggaggcacgtttatatgctgaaaatccattgaaaaatttcagaccttctccaggtttacttgtcgatgtgaaatttcctgattgggcaagagtggatacttgggttaagaaaggtactaatatttctcccgaatatgatccaacattggccaaaattatcgttcatgggaaagaccgtgatgatgcaatttccaagttaaatcaagcgttagaagaaacaaaagtttacggatgtattactaacattgactacctgaagtctatcattaccagtgatttctttgctaaagcaaaagtttctacaaacattttgaactcttatcaatatgagcctaccgccatcgaaattactttgcccggtgcacacactagtattcaggattaccccggtagagttgggtactggagaattggtgttccgccctctggtccaatggacgcatattcgtttagattggcgaacagaattgttggtaatgactacaggactcctgccattgaagtaacgttgactggtccatccatcgttttccattgtgaaactgtcattgccattactggtggtaccgctctatgtacattagacggccaagaaattccccaacacaaaccggtcgaagttaagaggggatctactttatccattggcaagttgacaagcggctgtagagcatacttaggtatcaggggtggcattgatgtgcctaaatacttgggctcttattctactttcactctaggaaatgtcggtggatacaatggaagggtgctaaaacttggagacgtactattcttaccaagcaatgaagaaaataaatcagttgagtgccttccacagaatattcctcaatcattaattcctcaaatttccgaaactaaggaatggagaattggtgtaacatgtggtccccatgggtctccagatttttttaaacctgagtccatcgaagaatttttcagtgagaagtggaaggttcattacaactccaatagatttggtgtccgtttgattggacctaaacctaagtgggcaagaagtaatggtggtgaaggtggtatgcatccttcaaacactcacgattacgtttattctctgggtgcaattaatttcacgggtgatgagccagttattattacttgcgatggtccttccttaggtggttttgtgtgtcaagctgttgtcccagaagcagaactgtggaaggttggacaggttaaacccggtgattccattcagtttgtgccactttcttacgaaagctcgagatccttaaaggaatctcaggatgttgcaattaaatcattggatggtactaagttaaggcgcttagactctgtttcaattttaccatcattcgaaacgcctattcttgcacaaatggaaaaagtgaatgagctttcaccaaaggttgtatacagacaagcaggtgatcgttatgttttggtggaatacggtgataatgaaatgaattttaatatttcctatagaattgaatgcctgatctcccttgtgaaaaagaataagactattggtattgttgaaatgtcccaaggtgttagatctgtattgatagaatttgatggttacaaagtcactcaaaaagaattgcttaaagtattggtggcatatgaaacagaaatccagtttgatgaaaattggaagataacttctaatataataagattaccgatggctttcgaagactcgaagactttggcatgtgttcaaaggtatcaagaaacaattcgttcgtctgctccatggttgccaaataacgttgatttcattgccaatgtaaatggaatttcaaggaatgaagtttatgatatgttgtattctgccagatttatggttttaggtttaggtgatgtcttcctagggtcgccttgtgctgttccattagatcctcgtcacagatttttgggaagcaagtacaacccaagtagaacatatacagaaagaggtgcagtcggtattggcggtatgtatatgtgcatatatgctgctaacagtcctggtgggtaccaattagtgggtagaacaataccaatttgggacaaactatgtctggccgcatcttctgaggttccgtggttgatgaacccatttgaccaagtcgaattttacccagtttctgaagaagatttggataaaatgactgaagattgtgataatggtgtttataaagtcaatatcgaaaagagtgtttttgatcatcaagaatacttgagatggatcaacgcaaacaaagattccatcacagcattccaggagggccagcttggtgaaagagcagaggaatttgccaaattgattcaaaatgcaaactctgaactaaaagaaagtgtcacagtcaaacctgacgaggaagaagacttcccagaaggtgcagaaattgtatattctgagtattctgggcgtttttggaaatccatagcatctgttggagatgttattgaagcaggtcaagggctactaattattgaagccatgaaagcggaaatgattatatccgctcctaaatcgggtaagattatcaagatttgccatggcaatggtgatatggttgattctggtgacatagtggccgtcatagagacattggcatgaattaccttttgttggcatctaaaatcaaaggagcactcatttagtctttatagcatgcctttttctagctatttttaatgacgaatatatatgtacatagtatttactgtaaaatgtatgaaaagaagcttaaaattattacgtgtgtttgttatgttctca
